United States Patent 11,549,145 (METHODS AND COMPOSITIONS FOR INHIBITING AND TREATING NEUROLOGICAL CONDITIONS) - sequence listing, part 45

SEQ ID NO: 975 - DNA, 1474687 bp, Homo sapiens
acaaatagtcgccgacctactgccaatccgcctctcctctctctctctctctgtctcaacatgactgactgggaagcggtggctcgggcagagcagctccgctggcgcaggcaggaggagcaggaggattattaaataacgcagctggactctgtgcaactgggagtggagaggagcccaacagccgagaaggggagggagggcagaggagggggaccaggaaggacacccccgtgccccgaagacataaatccctgagtgcccgggaggagccttaacaagcgcacggagccctcaaggtagtaacgcccctggtgcctcagcgctcagcgggtcgcgcgtcgcgtcgccgctttgcggggccggccgcaggcggacgcggggatgaccgctcggcaggtgaccgcgccgtgtcggggccgcctgcgagcagcgcgcgcccaggcccggcgtgctcggcgcagagacctggccttgcgggcggggtgggaaggaggcgggcgggctcgctcaccaccggcccgcgactcccagtgcgccgcgtggccatttcctccacgctgctgcgtggtttgctgcctgcggccgcggcggccgctccagggcgatgcggagcgctggccaaggcggcgagagttggcgcaggcttcgggtcgctccccttcctcgccactcgcgtcccgcaggtagaggcgaccggtcagcgctggcgccccgggctgcgggtgctgaggcggggacggcggcgaagagggggaaggggaggagggggcggggagccaggggctcccggaggaaccgcagtgcggggccgggaccacctcttgcctccgcctgcttgtcctctggcgccagtttcctggattggaagcaagaccctgcccagaggcagcagtaacggcagcgacttagattgaaccacttgctttgtggtggagcgtcaagggccccaggttgtgtgcgtgtgtgtgtgtgtgtgtgtgtgcgcgcgcgcgcgcgctctggactaaccagtgggttggttcacctgagcagaaagtcagccgtaagctgaaaccgcatgtggccccctggccccttcgacttttggcttgtgtcccagggactcgtacacacggtgccagcaaggggtaagggtgacggagggatttgtgaatggtgcttctgcgtgcgtggaggctgagccttgctgatgtaaaggaggaggtatccagagtgagaagaaaggctatttatggcaaagagttgtgaaatttcttggggtttccttttagtgtatcctgaactgctctctttctctctctctctctctcctctccctgcctcagaattagaagcaattatgcttccccttcctctcgtgggacatggaatatgaaatgaagtaaaaaaaaaactcatatttttacaggtagaaaaaaatacttcttagaagttacagattctttgccctttaatgtttttatgtcctcttctccacccctcttaccttttcaggcagtcagtaggacttacaagtcagaaaatacctacttggtttcaacagctttcatttctgaaatctttacagttgaataccttcctattgaaatgtaacacacatcctcccttctctgcccctcaaggactattaaaaataatgtgtacacgtttaaagtaaagctggttttattaacagccttagggaaaacggataagaggacacctaggtgggggtcagttatcactggttccttcaaaactggttattaagggaagacctaaaatactggtaatctaggctataatataatttgtcttggtttctctttctgtttgctttataacaggtacatgttccagatacgtaacttgaaacttaaagatgccttgggacagtgcctgtcacggtgcttataaaatgaatgttttctcttaaaagtagcaacctgtacttttatagaactgtgactgggtttagtagtaggacagtatccttaatattgcaaactgaaatgtctctaaaagcctgccaagacaatgtttttcaaatattgaaattccatgttgtaaccacactttcaatagtttcacagagaaaaaagagaagttggtcaacctattgtcagagtgatttgtcttcatttaaattaattagttattttgatcaaaacaaaccaactgttgtttgtattgttttattgctttcctaaacagtcctgttctttgaaaaacaaagcagagttaaggatttgatattttgattttgttagatttatattactttgaaatacattttcaacacggaagcatgtgcagctttaaatattaggttagaactcagatggagaaccccattcggagggttattacctcaactatcccaaactatttgaacatagatataatagggaattaaaaaatgtaattgatgaactgtattattgcaatcattaaaagtcctatttatgagtattttgttttttgacagttaagagaatcagcaactgtttattattttaaagatacattatttataccatagaatgttaatttagataaaacaaagtagaaaatgaaaaatttgttatatttttacagtaatagttattcaaccctttattgcattttattactcatcataatgctcataataaagggcctaacgtttgcaaagtactactgtctaggcattggggaggaacgggagattccttgttccctgtctttcaggaacttacttgccatgtgggaggaatctgatgctcatgcttgagcgtagagttaacaacccgtaacaataagagattacatgtctaatgagtactacaggagttcagaacatgacaataacatttcatactggattttgtttgagaatgcttcgggggtgggtaagacttgcttgatcttgatgttaaaggataagcaggattagtacattgtggataagaaaaatataaggtataagatgcaagtctcctggaataatagaaaagaacatataagggaagataagtttgttttgatataaattaagatattgctggatattttgcagagtgcaggttgagtctgttttggatgtacatccttctacacattctattctttttttttgtttgtttctgagatggatttttgctctgtcacccaggctggatttcagtggcgctacctcggctcactgcaacctcagcctctcgggttcaagtgattctcctgcctcagcctccggagtagttgggactacaggcgcatgccaccccgcccagctaaattttgaatttctagtagagatggggttttgctatgttggctaggctggtctcaaactcctgacctcatgatcaacccgcctcggcctcctgtgctgggattacaggcgtgacccactgcgccctgcccacattctattcttgaatttaattgttaatatttacacatttaagaagacaaatctttagctttatgttgtctttttgtttgttagtttgttttttgagatggagtttcgttcttgtcgcccaggctggagtgcagtggcgcaatctcggctcactgcaacctccgcctcctgggttcaagtgattctcctccctcagctccctgagtagctgggattacaggcacgcgccaccacacccagctaatttttgtatttactttagtagagatggggtttcaccatgttggccaggctggtctcgaactccggacctcagttgatccactctcctcggcctcccgaagtgctggggtaacaggcgtgagctaccacgcctggcttatattgccttttaatagacaatatgtacttgtattactacagtagtgcaatagagttcttgtagagaatatgtactttaaatatttaaatgtatccacatctcactaatgtgttgagtaaaagtggcacacctctttatagtgaggtgttttcggtatttccctaagcaaatctttttaggtttgctctaaagaagtgtgatgatgtgtaaaagaataacagtattaatagtgagcatctattgaatactcaacattttattcttcatataaaatgtgttgtctattaatatatttcatataatagtttattttaaacttcttagatttattgaatctattagattagattttatttaaagttattgtatgcagccacataatagttaatctatccatatattatttgccataaatatagagctatgatacggagcctatagtgaaaattttagaattttagcaacaattttatggctattttaactatcttctgataaataaattgtattaacaataacaccatgacctgtctctaaacttagttgtttttttctttgtgtatataggttgattttagacaaactgcttaaaatgcatttcttcatttcaagaataaaagggaaacatctgagttgactttgagcctgtacattcaatatgacaccccagaagtatgttttggtgacagtaaagaaattgcacaaatattagacatgactttcaataaataaccaaatggaattactttcagattagttgaattaaaatattttcatatatatattttgttgacagtgaatagataagagttattacaaaagtgaaagcctatttaatcaccaattttatattcatgcaagaatggaatgattccccatgtagttagggtacaaactagcctatctgttaattggtaccttttgaatttggttttggactatatgtcacaggtgtatcatttcgataatgtaatctcgtccactgtatgactgacagcttctgcatgatttccctattggacagtgacaaaatctgtttgctttatagtgagtacatacacttctatcagcaatattatcttccctgtgcaagagtgtcagttaacaataaaacatgaagtctggggtgggagaagcagtgaaaaaagatggggagattgaggagaaaacactgtaacaaaagaaacatgttttactatgaagcttaaactgaatattaaaatataaagctgactattctaaactgcagtacattaccaagatattgttatcagtctactttaaacaaccatattgtattttaagttgtttccatgcagcctaaatttttttaaaaggtgtttgttggaaatatttactgaggtgtttgatatattacaaattgttaaaagatttctgctcagatcattaactaatgaagttatttgccaaattcctggccctatacctggaataacttaaagcacggcttttggttttgcatcatttacactgcactaactcttttcaaatattaattaaagttaaacttgattaaaagttttgaatttttaaactgtgctttgatactaaatacagtccaaaggacttttataaagaaacagtttattatctagtgacaattcttaacctagagtagtggttttcaaaatgtggtgtcctaagcagcaatagcagcaagtataaacttgttaaaatgccatatctggagccccaccacagactgattgattcagaagctctggggtggggttctctgtgtgattcttatgcactctagaatttgaaagccactgacctagagtattttagagtaaaaactgaaggctatgtctttcttctgttttataaataaatacttccctcagctggtagtaaactaaggttcagatattcagttttggaaaatattccattgtccatcaaaagtttttcatcttaactatgttttctgaccaaatttttaatgagttcccattgcttgtgcaagaatttgctgttgattggggagggaatacatgaaaatttaactggatagtaatgactgtaggctggaccttattggtaggtagttataatgcaaagggtatgcacaatacaaaagttgaccaatttctgtttagttttgttgactctcctgtgatatttttggttttggcatatagtaagcacctttctttggataagattatagctgttttagctgtacaataataatatcacacatgaaatattctaagtcccactgctgaaataaattttggaccatagctctacgtctttcaagcttaaatataatgtgttcacatcctgtatcacctttataccactgtttctctccctttccaccgaacccttgcttctctatttcaatcatcacttccctagggatacctttcttggccttgttttctacatcggttgccctgttatatatagttttgcattatgttcctcttccttgtggtacttttggcagtttaaattttacctgttttgtatgattggttcagtattgcttcatcagtgttagcaatgtccagcacatagtagacgcctgataaatagtgcctaaaagaatatatgaataaataactgagcttctttgccttcattctgagaatgttttattttttccaaagaaagaaaccttaagaaatattaaaaataaggggagtcttagaatttttgcaaacataggtatttcctgttttgcaaattatgaaatattattttattaacaacaatagcaatgactgtaatgtgctggacacttcttacatgatatacactttataatgttatgtcatgtcattctaacattgtaaagttagtttgatgcatatattagagatgaggaaaccgagtctctgttctatggtctgctaaactatatagaccaaactttgatttttaaagtgataatgatgcaaaaattatgaaactcataaacagagaaactctgaaggagtatatctcctctttcttcctaatttaaccaagggcccagcagcaatatctgtgtattacctgtccttttgccaccatcttgaatgatgctgccattgcttcttgggtcactgaggacttggagatggaggacctgcaaggctggtactcccatcttcttattgctattttcagtggggatattgtgcactctcagtgccattcaaccacacttctcttactctatttagtcagaatcactgaactctttaatgaaaatttaagatgtaaccaagtataattttgtgaatgtgtgcgttcatgcagagaaagttcagacattagatattccacttcatatttgaagttatgcagcttatcttctggaaaggttcatgcagagctttgagcatgttgcttaagaaaagttgagcttatgcacaagttatgaatctagctttccttccatgaaaaggaaatatgttcactgctgctatcagatttaatttagtttcttttaacttttattcttcagttcatctatttaactgtggatttaatcagtgttcacatatttgtagcaaaggatatatttaaaggctgatttcatagaagtaaatggacagaaagttaaatttggttattttgaaactctcttcaagactatacaaagttatatatattttataatgtgtttaaatcagtcaaaaccatgaataaaactagattaataatatcaaggattaaaaaatgtttttttaactaatttttcacttatggcttattttgtagcttttgtcaaaatctatttctgttactggaagaatgaactctaacttgagccttaaccatgctcctgattcggaagcattctttctatataatgaaaaattaactgatttctagcctaacattttgtggcttaacattaagcagcctttgataactcaactctaacattacaacgtatttctagtaattaggcttacttctataactgaaactgatttctcgcttaatattttgccctgtatcttgataaattacccaatctcactattcctcctagcatttgagcaagaccccccctttgaaaaaaaacaacaactgggatcctgcctctgaaacaacctcattttttaaaaaaaagactgggatcctgcctctgaaacaacctcatttcctgagccattttatctgccagcagacaccagaaaacacaacactttcctggatctccaaacattgctagctcttagaagtatgcttcatttcaatactcactcttggatttccatgatgccaactacttatggcatattgccttgctcctgcatagttagactggttagactttttctaagtatttacagctgtgcctctggagtgctttctaaacgacagtgcagttgtagtaccagtttaggaccatcgccagactgcctcattttgctgaatgtaacctttccttacctggctgtgccccactagaaagatagtcatgcatcatcattgacaataaatattttataaatgtttattatagagttgaagtccgtcagtttcaaaaataatcatgcacctcttattggtattatcttaaagtataaattaccaataacttatggtgtttactgaacagcttaatccacaataaatgaaatacttggaattctgtatcttatttggtgtccaaatgtgatatgtgtgtacaaatatatgcacaatgtgcatatgaattctttagggtttgcctgtttctctttttctagtcacctaagttcatgatgatatgactcttctgcagtctccttcataaccttatttgtatcttatgtatttagaatgtagaaaaattgacgaaatttattccacacagtaagttttcttctctaatttctccagttcattagtgaaatttagtactgctcctgtactcaaggagtgtttattagctgggtgtggtggagcactcttgtaggtcctagctacttgggaggctgaggtgggaggattgcatgagcctaggagttcgaggctgcagtgagctatgatcacaccatgcattccagcttgggcaacagcaagaccctgtctctaaaaaagaaaaggtaaaaaaagaagtgtttgcttagctaagtgtactactctaattcagcctttatggggatatcagtgatataccattcttattaaacaaattcagactaagttgttgtatttatgtacctattcactgaaattagctctttcttggaagcaaatattatgaatctgttaatgaatgtttgttgtgtgtgtgttttgcaatagcagtaaataatgtattacaaacctacatcatgtttacaaataaaagccaaccaaacatgaattagaggcatggcaaaaataaatggctaaatttctaggcaagtatccctttagagaactgtttttgtttgtctgtttagttttgtttattttatagatatagaaaggaccaaaacgttaagtctgaatatataaaatggattgtgagtgcttcttgataatagacaatattcttcaagacatttaggaaaagctcgaagtgagaaaaccatgcatatatcccagaaaccatcaggtgagaagttaggaaaaggaggaaaatactagctctaaacaagacccaaattcattgttataaatataaattaagaataacttatttcaggtaaagtttcaatatattttagaggtaacaaaaccccactgagtttgtacaataagattcttaaattttcaaaggaatgttacctagtgcacagatagctcaagaataattattgactttttcagctagtaatattgtattcatgtataaatgacctaggaatattaaaagtactcattaataaatgagctccacagaagtcagaatgtgactcccataatgtaaatcttaaaaattaaagtacagattactaaactgggccattaaatgaaacattacaaatttgtacacaggtatataaacttttagaaacattatgactaaaattgtttttgagaggtattccttacagggtacttcaaagtataaatataggggaattggagagatagcttcattatcaacaacaattcagtttctgataggaggaagggacctgaaatgggaagttttacgttgattatcgggacaatatagtatgaattctagcctggcttggaacacagaggggataaagaccccagagtggtaactatccagtgaggagaaggaaggtattgcctcccaggatatttctgaggagagtcaggttcattggacggtgatatagaaagtacccagcctcagaggcctggttcaggaaataaatggatgagatattttaaaagctaaggaattataatttgaatacaaaacagattagtaaatttgaagttctggagattctctaatctcaattccaatctgctagccatcagtctgcacagtcacctttgacgcagaggagctatccagggtactagatcttgctgacctctcttgcaaaaatgcaaaacatgccgtttttgtttacgttaatcatagagtctgctgttgcagatgctacgttacttaactgcagttactaaccttccatcatttggcttattctagtaggcccttcaaagttctttttaaaagtaaactcatggaagcccatctcaattccacataagaagcatattctgagttccagtaatattctgtgtatgttagtatcaaatctccattgaaagtatcataattcactgcttgtttgtacttaatgctcagtagatggtgagctctatgagggcagggtttttattttattttattctctttccccaccagctggtctaaaccagaggtgtaaagatactcagtatggaagtgagaaatggatgaataaatgcactactacttaagagtgacgtggatttcttttttaaatttttttttgaggcaaagtcttgctctgtcacgtaggccagagtgcagtggcacagtcatatctcaatacagcctcaaactcctgggatcaagtgatcctctcacttatgcctcccgagtagctgggattacaggtgcgccccactacgcccaactaagaatgacatgaattttgtcggcattatgtgaactacttccagtgctaaccactgttctgaatcctaccctaggctcactttgaacactgccctccctggctatttcatagactgaaaatttgttcttaatttggagctgaatagccaacactggctaaaattcttaaagtaaatgaaaggactggaggaatggtggcagctaaactacatgcattaggggttagtgaggtctagggaagcaagaagcagtggcacaggccaatttggagaatggagatcaaaggagagttggttttgtcacttcctcaaaccaaaatcctgaacacctactccatgttcacttttttttttttaattattttactttaagttctagggtacatatgcacaaggtgcaggtttgttacatatgtatacatgtgccatgttggtgtgctgcacccattaactccatgttcactttttaagacctttggaatatggcattttcttccactttatacagcccagattcacattttgaaatgttgacaaatctgaggtcatgtgaggctgtcagaattctttcattcagtaaacaaatgttactaggccctatgcatgtatcagttaatgaaacccagtatgtttcctgtccccatataattgatggtccttgttgagaacagaagttggtagactttttttttgtttgtctgtttcttctagtagccatgttagtgacatcctagcttgctacacagagtgagtgtgcttgtttccagatctccaacctgcctcctcacatcattgccctaagtttccaatgtggcaaaaagggactaagtcatcatagagaaactcttatttacataaaagatatcctgtcactagtgtggtattgatctgctggtcagttttgcatgatgttggtaaattatgtgcctgtatatattttcccttatagggatattttctgaacagtttaggttccatggtttctattttggtcagaaattccctgtattccaagtgcataagccatagaaaatagctgtgtgacctttagatggagtgtattttcactttatagttctagctttcatgtttttgaagtatatatactatctatccttcaggtcatatgttcctgtttcctgttttattttattttattctatttttttcacgtattgccaacagtaatgttccaattatgaagtagaaaaagaaaagctgtatttcttggtaatttttttccttgagaacacaattgtgtcactcagagaaataatgtggattcagaataacaggtgtaaaagtatgaaaatgaagctcggtgcagtggctcatgcctgtaatcctagcactttggaaggcggatgcgggcagatcacctgaggtcaggagttcgagaccagcctggacaacatgatgaactctgtctctactaaacaaacaaacaaacaaaaattagccaggtgtggtggcaggtatctgtaatctcagctacttgggaggctgaggcaggagaattgcttgaattcagaggaggaggttacagtgagctgagatcatgccacttgcactccaacctgggcgacagagtgagactccatctcaaaagtaaagaagtaaataaaagtatgaaaatgaaaaatgaataaagcaaaagatctcggtaatcatcttgaataaactgattatttaaaaacctaaaatttctttgctaaatatttacaattatgtcaaataatatggtcatcattaattgcattgattaaaagccacttgtgctattttctaagtattactagagctgaaatatacataataaaaactatgtttaatctatctaaaataaaagttgccttaaaaccctttcaagagttagcatgtgtgcgcaaaatttaggtgttttgtagtgaaacttaaagggatgaattttcgcaatcatctgaatcatttgtgttgtgtaaatatagccctaggaatcctcagtactcactcaagtttaggactccttagggaccagaagtgatgattgtctttgattttagagtgtgtttatagaaagatggggtcctgctgagattacattcttctttgacaaaggaaagtagttcagttcacactcacatcaaaaacaaattttattgaattaaaaattttttactggaatattttttgacatgaagacaaacttgtatcaatctttgttatatgtgtgtacgtacacatgtacacaggtatgtagtaattaatttcttatgaaaactgtcttgtataacttacttccaatcaggtatttttggtctacttttttttttttttttttttttttttgagacggagtcttgctctgttgccaggctagagtgctgtggtgcgatcttggctcactgtaacctccaactccctggttcaagggattctcctgcctctgcctcctgagtagctgggattacaggcatgcgccaccaagcccggctaatttttttgtatttttagtagagatggggtttcactatattggccaggatggtctcgatctcctgacctcgtgatctgcccgcctcagcctcccaaagtgctgggattaccggagtgagccaccgcgcccggccttggtctacttttttagaatgaagggtttagtgttctccagagaaacccagcaagatatctatctatctatctatctatctatctatctatctatctattgtctgtctacctattgaaagactaattttaagtaattggcttacatgactgaaatctgtagaaccgactggaaggctggaaactcaggcaggatttttatattacagttttgaggcagaattctttcttttccagcaaacatcagtttttattcttgatgccttcaactcattagatgagacccaccccacattatcaagggtaatctgctttacttaaatgattgtacatattaatcacatctacaagatacctttacactaacatccggagcaatgttttatcaaacaactgggcattatagcccagccaagttgatacataaaattaactaaaacaagggatgaaaggtaatatgttaagctctttctgttttacataatatgttagtgtatacattttctttggtcagagatattttagcattggttagttattggtatacaaagacacaggtcatcatttgttctttatcatttatttaacatgcaatatgtgcaagagacaatgctatgcaattgaataatttttaaaaaatgaatgaggagactgtgtcttttaagtttgttaacaactctagtggaagagccacaagtgtgttagatgactgactggtaaataaagttgcagaatgaaaatgcacatttccaactttgccgatgaaatgtcattttacccatgagcaatgcccctccaaaaaccccttatgtcaaggctaatatgccaagttattacacttgttagtttaaggatatgttgtgtgtaaaataggatcctgaaaggtatgcttgcccactgcaggtcaacttaatttggacaatgttgactatgcatacatttattttagcacattaatgggtttgtacctgtactcgacctttgcaaaggtgattcaatatatgcccagagagccatgacaagtggactgtcacgttttattgatagtcttgctcttcatgtagcatagagtaataaacatttgctttactggctctaaataggtatttttaatgccttcctattccaaaactacattgtgtttctgtgtttttattcaatgaatatggatttgtctgcctggctttggaggccctttgtgagctcaccacactttgttaatccaaacacagatcttctactttgttaaggtcatgtaacttagagcaccctcacacacaaagcatatgcatttaatcctttttgtttatgcaaatctcagctgtcattacaggcctaagtccatgaaaccttccatgacgactttaaccctcctggggagtttcttttgcagcactctgagttgtgagcaatacctgcttggcaccagacaattaagtacagtctgttctgcaacaatgcatttttctgtagtgggaattagctccaacatgatgggtaaataggggaattgtgttagtaaaatgtggaagttctttcatgtgtgtttttccccaagcataatcatatttagctttgccaaataactacagctgaatgcaaaatatactaatacaggcaaatgcacaatacagcagagggatatcgttttatttatttaccactttttttttttttggtatgagtaagccacaattttagctttgaaagtgcttattgtgcggtttttcttgatccctgcagcctctggctaccttcacttttttttaaagagaaaatttatgtattctctgtattatttcttttctttactgagaattttacatgtccttttaggcatataggatttttataaaaattgttatggttttggttagaactttgtgttataaattgcatagattttaaatgtttctgctacagttctatttttttattatccctgttatatttattgcccagtttttcagaataaaataacacatatattgcaatagcaggagttcggcaaatttacatgaaatcacttaatttttatttaatatccactatttgtcacttcctagtgctaatgttggatgtatgaaaagtgaggaagccttacttttttgtacattgggctttctaagcaaatatctggtatgatggtggttgtaattcttggctcatttgaaggggaggaagacagacaatgagaagtaactgtgttactgcaaacatcagttccagcaaacatgtttttgttcttccctctgcctggaatggtctcccattcctgccgtattaagccaatttcttctcaagcttcatctctcaagtcaagcatcatgtcttcatgctattttaaactctcactaccatgtaccatatacctttctttcatagtctttaaggtagctgcaattttataatcatttgtcagattatttaaataatatcttttttcttagaccataaacttcctgagaacacagttcatgtttggttttttccaccattgtatttctgtttcctagcaagtacacacatacacacacacacacacacacacacacacacacacaccaggtattaatataccattatagaatacatcaagtattcagtaaatttttgttgaatgaatggattattgaataaattaacttttcttttttcttttttaacaactaagtcttgaatatgcttcctagaatcaattattttacttctccattcctacttttttttttttttttctgagatagagtcttgttctgtcacccaagctggagtgcagtggtgtgatcatagctcactgcagccttgaactcccgggctcaagcaatcctcccacctcagcctcccaagtagctgggaccacaggcatgtgtcaccatacccaagtcatgttttgttgttgttatttatagagacagggtctccttatgttacttaggtttgtcttgaactcctgggctcaagcagtcctcccacctcagcctcccaaagtgttgggattacaggcatgagccaccaatccttgtccacatctcctttgttatcatcacatttcctggtctgtattcccattacttgtaaagccacttcagcatccaaactgtaagatatctttttaaaagggaaagatataaatcacttgttacttgtcaggttgttccatctactgcttttttctctcaaaatttggatttgtttcttgaaatttcattttattataattcacagctttcctgaatgtgctcccataccttgcctgttcaaattatagctaggtaatgtttatattcttgccagggaaacttgattgtggaaggaaaagtgtgctgctattcattggattaattgtggatgacatctttgctgtttcctattaaatatgacatataggtagctagattatttaaagtaaaatatcattaagtcaagtacctgtggatgatcaacatatagctcttgtaacattcatcccactatgcattatgaataactgtttcactgcgactgccttggatataaattattgaggtgtttatgaatgtggactcaaatttactcaatgcacacagtaaacagctgagtaaactcctgtttaagcagtgagggaaaaatgtgaaaaagtagtggaatatagttaaaacatatctagtcatcatttcagtcattaataacaactggattctagattacctggactatttaaagtgtttcaagaatacagtataataatcaaataggaatttttgctttcacaattacatgcagcgaatttcagatattcagactatgtagtattttatgcattatgggaaaatttttatgtaaattattttattctaatgcttaggttcctctttgtgagttcaaatgccccatttattcattttgataattgtttactttttgtattatccactattaatctgttattatgtaatattctgaaaaccaaccaaagagatcagctcatctaaattaattactgctgagtattatttctacaaaattttacgaccattattttcgtttcaataagcaatctattttctggctacctatagtttaattttgattataaaagcatgatggcccgtaaacttccaggtatcaagtattatgataaaaagtcaaagaatctatttctctttgctttatagatgacatttgaaatgctaattctatttttatgttactttctacctttaaaatattctaatctcataggccccaattagattttaaataaaaatctcagagaaatagggtaccttttcaatttaacaaacaaaatacatcattttttatgcataaggtaactccatgtaagtgattgtggaatgccacataatcaaaataactcataaataattaaagagtcacattataaaattaggaagtgtaaaagaaacaataagtgtactcctgcctgctttttgtgtcatatgttgctgcctttaaaatacaatttcattgctgtatcagtgtgcttttcagtttcatgctctgcatccatagttggatttacattgtctgtaggcttgggctgactcaccgtatttaacatttcaatatctattgtgtcaagcgtgattttgttttttatgttcacatctgtgtttataggaactggctatagatgcctaaactgtgagggaatatgatctttatgcagtcattgtcttaagataggttacagagttttcattgttgttttgactgtattaacattttctatctgtgaagtgttttgtaatcaaaattctactttttcttttatcatgtcttcattctttggagtttttaaaatctggagctaaaattaagcatccttgcctaatatgtgcaataaaaacaaaacaattgaacagattataaaaaattttaaaaggccagaattttcatataatgctgatctatgcactcataggcattgtcttagggtacctttttttccctgtgacattgacaaataaacagctgaagatttgttgaaataatctctgaagcactattatatggcttgataattggcatttgcaggaagctaactgttattatctatgaattaatactcttaccttcccaagacttaaaaagaaaataaactttaagtgggaaaaatgtttcaaagtgaaatattcagctaaagtagtgaaaaagaacaagtgagataagtactgctcttttgatgtgtgattctgtaaccttctcatttttaatattcttgtatttctagtcttttgagaagtgagctccaatttatatagcacagatgtagaattttaatctacatctactgtgcaagaacaggagatcagaggaatattttaatatgtaaagtctctttaaatttttatggagcataaaataatactttacccacattatgcttgttctcatgtttaaatttaacaaatgtaaagggcatgatctttagatcatctttttcctcttaaaaatcatctcttttacggtgcatattaatgtctgaattagcctagaaaaacagctaccgtcattctaattactggcagctttggtccagcagcttgtactcggttcaaagagcagatcacaataaagatacacattaaataataaaatacggctgtgaacttggaaaatttagtttagtattaataattttattaactcaactgttatcgaaattggcttagtgtaattttatgttagctaattttgatacaattggattatgttcataaaataccttaataatttatacagaggattatatatcttttagaacagcacttttgaaaatttttcactagaagatgatcaattttccttaacttgaagatgtggcattactttgaccgggctgttatgtgtttgaatttggtcaaatcagtatcaatgctgctaatagtttctgtaaccacatgaattatttccctttgaagacactatgatattcttttaaaagtaattaacacataagattaaatattcatttttatgatctcaagaatttatgaagtcaaaccacaatgtttcttctaattgtcttcaggctacgacttgtattttgattattttatttatttatttacttagttgtttaattcatttgttcagtgatttatttatttactattgtatttatttatttttaatactttgtttaataacttaacagtcatttaatgctttccatgtgtaagacactttactgtgtctttctgtgtgtaagacactttactgtgtctttctgtgtgtaagacactttaaatttctcaaatttaatgatctaattttattctcacaacaaccctatgagataggtttttaatccccattgttgtttataaaaatagagacacagaaaactcattaacttgtcaatgattacacagtttgttgtggtgaaatagttgttatttgggtttaatttatataactgcttattaggtcaaaagtattccattataaatgagactttacaaaccatgaattgtttctggtttattaaaatatgcatctagtaattatagatataaaagtagtattggccatgttcaagtaccttacaggctattctagattaatttgaaaagataattttgtgaaatgcacaagtgctaattatgcatcaaagtgagtagcatttgaacaattcaggtgtactaaaagcaagaggcttataatcctgataatcttcatgacaaaattatttcaggtttgaaaatgatatgaatacatccgtaaatacaaacatttgaaaacattttcacatttttattctaaaacagaaatgccattatattggctgtactaatgtgcccttaaaaaaaaagtaagattgtgaacatatgctatgtaggttagaatgtgattgtgatcaacataattcatttgaagagtataattataacaatttaaataattttataaaaggccgggcatggtggctgactcctgtaatcctagcactttgggaggccgagatggatagatcacttgaggtcgggagtttcagaccagcctggccaacatggcaaaaccctgtttctactaaaaatacaaaaattagctgggcatggtaacgcttgcttgtaatcccagctacttgggatgctgaggcataagaattgcttgatcctgggaggtggaggttgcagtgagccaagattgagccactgcactccagcctgggctatacagcaataccctgtctcaaaatgataataataataattgtatgtaattataatttaaattttatagttataggcaacctttaggagttaaagaaattaatggtttatatttttcactcaaataaacacatgtgcataagaaaaataatagtacttgtaatttctgatagtttgtggatccactagagtatccatgaatttatttagaaaagcccagtattagtctcttgaaaatattcaatcaagaaaaaaattgtacagtttttttgcattgttagtatacttggattgacaacattataaaacaaacaaaaggcacaaagaaatgcatattgtctaggatatggtagtacaaggttgatatagatgtgatcctggtcgtagagtaaagggcttcttggttagagagaaggatcagagagataggaatttacctacctgccataacaaccaggaacaaagcattcctcagaagttttatagtctgtcatcttttttcccaaactctatctcatttgaacctcactgtacaattattttgatttcagttttgcaatggacaaacctgaggattggaaatcaaatgttttacctatgatgtcactgtgtaattagtacttctggctttagctgacttattttttttctctatcttattctgtggagctatcaagctgaacctgtaactcaagcatacctatacgtctactttcctcctagaaggcataggcattggaatactgtcttttaacctcttgagtcaatcttatgcttatttttacaagtaggtcacaccctaactaaaagacatgaataatgacatgcattttagaatatgaaaggcactttggctttgttagaattttatcagtgtttcttatgacatctatttccgaaatcccatgatgtttgtaattgcaggcaacaccaaatactgataacagctgtcagtatttaccagctactgttctaagaattttacatatagtaatgcatttaatcatcacaataaccttatgaagtaggtgatatttttcttattttgaagatgaggatatggaaggatagatatgctgagtaaatagcccaagttcaaagagttagaaagtagtagagcagaaggggccaatccatgcagtagggctctcaaccacctcaccctatatacatggaggctaaccaaagttttgttcatgaacatttgctattttattgttgctgttttcaggcaaagccatttcattgccctttgaagaacaatgggagtctaatattgatgaaattgtccatttctatgcttgacttttatattggaggtagtgccattaatccagcatcaactgggaaattactcaaatcaggtggactagtctgagatttctctaagacaatctcaacattcagttatacttaaaaaatgtgttaatctttgagaaagggaaagcaagtaattgaaattaaaaataaacttacgaatatctttggcctctatatgacaattttggaaaaactgtatataataatctaaaccatgatacttctttaggtagtgtttgaaaatcagaaacagacttgttcttagctgaaaattttattattataaacttagtgctcttgaactttgcttaagatatttaatgatgcaggaaaaatagaaacattcagtaaagaaaaaaagagcaatatatttttcatattcaagttaagtctgcattgtatgtaaaagcaatcatttaatgttttttggagtaaaataataagaaacttttattgacaggtcaatgccataaggaagttggaaatcaccagtgtttatgttgacttcatgagctataaagttgacccttgaacaaaatgggctaactgcatgggtccatttaaatgtggatttttgcaataagtagggttggccctccatataggggataaccacatcctcaaccaaacatggattgaatatattcgtgcaatgaaaaacccacataatagcaagggctgatttttcctatctgctaattctacaggaccaactgaagtaacttgaatatgtgcagattctggtatctgcggggagtcctggaaccaaaccctgtgggtaccaagtgtattcagttttccaaatgagtaaaatatcattattagttagcctgagtttcctatttatttttctgttctttttttaatagcgactcccatagtaacatcagtcactgttgcaaatgtgggcaaaaaaagtggggtttcacacatttggtgaattcctacgtagttattagtggggaaaggatgtcaataatactgcatcttgctgctttaagtataagagatgcatgacttgtgaccactgtgtatgtgtagaaaacgcaccttttgttttttaaaaaagattattaccagctcatgaagcattttgaacatataaacatttacttgtaattgtacctcattcatcttcatcactcttatcaatgtcctaaatgtaataagcaatttgttgttaaaaccagtactgaccacagtgatcattttatgtataggacaatgtaattattaagaagaaaaaccaatgctttactaagtaagccagctctattctatgtaaatatccatatagaaaacacatttgaagctgtgcactgggtttaatatttatatatagatgtctttaataatcagtttgtgtatttaaggattcaagtagttattattaggtcagtgaataaatgtatccaatgtatctcatcattctgaattattttattgctttgcagttggagtttatttaaaatattactaaaatctttttgaatagattgttatttttttttcctcctcacaaaagcgaagcatttgatttaataaaaggttccacaaccctgctctggcctgacaaagacttgcttggttgattagcatgaatgagaatatgaaagatttaaagaaaagctgtcaaagcaattagaactaaagtcctcctatcactgaataatgaaaatccaggcctggaacactttcaaatgtacctaagaaaatcgtacttatacaaaatgaaatgatagtgaataaaagaaatggaataataaaagccaccagaggtaaaattgtacaggtagcattttaatatattcttgctactatattttagatttattaatgaacataatgatatatggtttcttcataaagatatatgtatcaattttaatttaggtatttatttagattattaggcttaatattcaattgttttaaaatgtttagctttaagatgatttctataaagtctaccatttgggtgtctttctttgtaatttaacttttagatcaatcatttaaaatcaaatgtggatattcaagctacaaaagagattaacaggcatttaatatttaatatacaccctttttcttaatgcttttaaatcttaaaaatctagaataaattgatagactgtcagaatactttgtgtgattaagaaaactaatgatacaaagagtacacctggagagcaaactcataatcattttatatttttattaaaacataattcagtctaggagatcattacatcaatagattcttttccatttgttcagttatttaagcactcagttatttagtattaaacaattattttttcaatctttacaatgtaaatttgtatttacatttacacagtgaaagataacaagatgagttagacatggatctggcattaaagggcttgcagtctaaggaagtagctatgataaatgtactatagatgctaatgcattaaataggtagaatataaacactataaagtgaatataaaaaaagaagagattatctccagctctattaagtaaaggaatcaccactgaataagttatattagaatttggtccttaagtctgtgtatgcatatcattttaaaatgtttttgactgcaagtaacccaaatcaaagtatcttaaacaacacaggggatttcttagcttgtgtcactaaaagggtgagcacagacacagttcattagagcctctgctttatctctctctgctctatcacctgagatcttttccctgactagtaggagggtggcaggagtgagttctgaaactcacaactgtgcaccacaatctccagaagagacactgacccagtatttcaagaaagtgttctgagagctaccttgattggtgtgtgtaggttaaaaatttgcccttaacctgaggccaggatgaaggaatgggcatactggcctaagtgagccaaggttcatccctggagctgaaaatggggcttgattttccctgagtattcagctgcatgatggagaattttgggatattacagtgagcttatgtgtactgttggggatgggaaagggagaatggatcctgagtaggcagcctacaatgtccagtggagtgtgatttagacattcacatttgaggaaggttattcaagcacagtggattatgtgaacatgtgaaggaaggaaaatgtaacgtgtgtgtagagagcactgattattgcagtttggctgagatagagagtgcccaaagggaagttattggaaataacatcaaaagagtaaattggatcagatggtagaataccttgaaagctaggcagtgaaatttgggatattctgtagatgatgggaggtgcttaagcttttgagcagtagaccagcatgctcagagttgcttttaagatttgtatttgtcagtgctaggtttttttttttttaattttattttttattattatactttgagttttagggtacatgtgcacaatgtgcaggttagttacatatgtatacatgtgccatgctgctgtgctgcacccattaactcgtcatttagcattaggtatatctcctaatgctatccctcccccctccccccaccccaccacagtccccagagtgtgatgttccccttcctgcgtccatgtgttctcattgttcaattcccacctatgagtgagaatatgcggtgtttggtattttgttcttgagatagtttactgagaatgatgatttccaatttcatccatgtccctacaaaggacatgaactcatcatttttttgtggctgcatagtattccatggagtatattgccacattttcttaatccagtctatcattgttggacatttgggttggttccaagtctttgctattgtgaatagtgccgcaataaacatacatgtgcatgtgtctttatagcagcatgatttacagtcctttgggtatatacccagtaatgggatggctgggtcaaatggtatttctagttctagatccctgaggaatcgccacactgacttccacaatggttgaactagcttacagtcccaccaacagtgtcaaagtgttcctatttctccacatcctctccagcacctgttgtttcctgactttttaatgattgccattctaactggtgtgagatggtatctcattgtggttttgatttgcatttctctgatggccagtgatggtgagcattttttcatgcggtttttggctgcataaatgtcttcttttgagaagtgtctgttcatatccttcacccactttttgatgggtttatttttttcttgtaaatttgtttgagttcattgtagattctggatattagccgtttgtcagatgagtaggttgcgaaaattttctcccattttgtaggttgcctattcactctgatggtagtttcttttgctgtgcagaagctctttaattagatcccatttgtcaattttggcttttgttgccattgcttttggtgttttagacatgaagtccttgcccatgcctctgtcctgaatggtactgcctaggttttcttctagggtttttaaggttttaggtctaacgtttaagtctttaatccaccttgacttaatttttgtataaggtgtaaggaagggatccagtttcagctttctacatatggctagccagttttcctagcaccatttattaaatagggaatcctttccccattgcttgtttttctcaggtttgtcaaagatcagatagttttagatatgcggcgtagatttctgagggctctgttctgttccattgatctatatctctgttttggtaccagtaccatgctgttttggttactgtagccttgtagtatagtttgaagtcaggtagcgtgacgcctccagctttgttcttttggcttaggattgacgtggcgatgcgggctcttttttggttccatatgaacttttaagtagtttttttgaattctgtgaagaaagtcattggtagcttgatggggatggcattgaatctataaattaccttgggcagtatggccatgttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaactgaataccctttatttccttctcctgcctaattgccctggccagaacttccaacactatgttgaataggagtggtgagagagggcatccttgtcttgtgccagttttcaaagggaatgctttcagtttttgcccattcagtatgatattggctgtgggtttgtcatagatagctcttattattttgagatacatcccatcaatacctaatttattgacagtttttagcatgaagggttgttgaattttgtcaaaggccttttccgcatctattgagataatcatgtggtttttgtctttggttctgtttatacgctggattacatttattgatttgcgtatattgaaccatccttgcatcccagggatgaacccacttgatcatggtggataagctttttgatgtgctgttggattcagtttgccagtattttattgaggatttttgcatcaatgttcatcaaggatattggtctaaaattgtcttttttggttgtgtctctgcccggctttgctatcaggatgatgctggcctcataaaatgagttagggaggattccctctttttctgttgattggaatagtttcagaaggaatggtaccagttcctccttgtacctctggtagaattcagctgtgaatccatctggtcctggactctttttggttggtaaggtattgattattgccacaatttcagatcctgttattggtctattcagagattcaacttcttcctggtttagtcttgggagggtgtatgtgtcaaggaatttatccatttcttctagattttctagtttatttgcatagaggtgttcatagtattctctgatggtagtttgtatttctgtgggatcgtatcccctttatcattttttattgcgtttatttgattcttctcttttttcttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgcttcctcttgtgggcatttagtgctataaatttccctctacacactgctttgaatgtgtcccagagattctggtgtgttgtgtctttgttctcattggtttcaaagaacatctttatttctgccttcatttcgttatgtacccagtagtcattcaggagcaggttgttcagtttccatgtaattgagcagttttgggtgagtttcttaatcctgagttctagtttgattgcactgtggtctgagagacagtttgttataatttctgttcttttacatttgctgaggagagttttacttccaagtatgtggtcaattttggaataggtatggtgtggtgctgaaaaaaatgtgtattctgttgatttggggtggagaggtctgtagatttctattaggtccacttcgtgcagagctgagttcaattcctgtgtatcgttgttaactttctgtctcgttgatctgtctaatgttgacagtggggcgttaaagtctcccattattaatgtttgggagtctaagtctctttgtaggtcactgaggacttgctttatgaatctgggtgctcctgtattgggtgcatatatatttaggatagttagctcttcttgttgaattgatccctttaccattatgtaatggccttctttatctcttttgatctttgttggtttaaagtctgttttatccgagactgggattgcaacccctgcctttttttgttttccatttgcttggtagatcttcctctatccttttattttgagcctatgtgtgtctctgcacatgagatgggtttcctgaatacagcacactgatgggtcttgactctttatccaatttgccagtctgtgtcttttaattggaacatttagtccagttacatttaaagttaatattgttatgtgtgaattcgatcctgtcattatgatgttagctggttattttgctcgttagttcatgcagtttcttcctagcctcgatggtttttacaatttggcatgattttgcagtggctggtacctgttgttcctttccatgtttagtgcttccttcaggagctcttttagggcagtcctggtggtgacaaaatctctcagcatttgcttgtctgtaaagtattttatttctccctcacttatgaaacttagtttggctggatatgaaattctgggttgaaaattcttttctttaagaatgttgaatattggcccccactctcttctggcttgtagagtttctgctgagagatccgctgtcagtctgatgggcttccctttgtgagtaacccgacctttctctctggctgcccttaacattttttccttcatttcaactttggtgaatctgacaattatgtgtcttggagttgctcttctcgagtagtagctttgtggcattctctgtattttctgattctgaatgttggcctgccttgctagattggggaagttctcctggataatatcctgaagagtgttttctaacttggttccattctccccgtcactttcagatacaccaatcagacgtagatttggtgttttcacatagtcccatatttcttggaggctttgttcgtttctttttattcttttttctctaaatttcccttctcgcttcatttcattcatttcatcttccatcactgataccctttcttccagttgattgcatcggctcctgaggcttctgcattcttcacgtagttcttgagccttggctttcagctccatcagctcctttaagcacttctctgtattggttattctagttatacattcatctaaatttttttcgaagtttttaacttctttgcctttggtttgaatttcctcctgtagctcggagtagtttgattgtctgaacccttcttctctcaactcgtcaaagtcattctccgtccagctttgttccgttgctggtgaggaactatgttcctttggaggaggagaggcgctctgctttttagagtttccagtttttctgctcggtttttcccccatctttgtggttttatctacttttggtctttgatgatggtgatgtacagatgggtttttggtgtggatgtcctttctgtttgttagtttcccttctaacagacaggaccctcagctgcagatctgttggagtttgctagaggtccactccagaccctgtttgcctgggtaccagccgtggtggctgcataaacagcggattttcgtgaaccgcaaatgctgctgtctgatcgttcctctggaagttttgtctcagaggagtacctggtcgtgtgaggtgtcagtctacccctactggggggtgcctcccagttaggctgctcgggggtcaggggtcagggacccacttgaggaggccgtctgcccgttctcagatctccagctgcgtgctgggagaaccactgctctcctcaaagctgtcagacagggacatttaagtctgcagaggttactgctgtctttttgtttttgtgtgccctgcccccagaggtggagcctacagaggcaggcaggcctccttgagctgtggtgggctccacccagttggagcttcctggctgctttgtttacctaagcaagcctgggcaatggcgggctcccctccccagcctggctgccgccttgcagtttgatctcagactgctgtgctagcaatcagtgagactccgtgggcgtaggaccctctgagccaggtgcgggatataatctactgctgcgccgttttttaagcctgtcagaaaagcgcagaattagggtgggactgacccgattttccaggtgctgtctgtcacccctttctttgactaggaaagggaactccctgaccccttgtgcttcctgagtgaggcaatgcctcaccctgcttcggctcgcgcagggtgtgctgcacccactgtcctgcgcccactatctggcactccgcagtgagatgaacccagtacctcagatggaaatgcagaaatcacccgtcttctgcttcactcacactgggagctgtagaccggcgctgttcctattcggccatcttggctccgacctccctgtcagtcctaggttttaagagatgtggtctcactgagtcactgaggttggagtgtagtggtacaatcatagctccctgcagcctcaaactcctgagctcaagtggtcctcctacctcagcctctttagtaactaggactgtaggcctatgccaccgtgactggttaattttattattattattattattacttgagaaatggagcctcactgtgttacccaggctgctctcaaactcccagcctcaagcaatcttccctcctcagcctcctaaagcactgggattaaaggcatgaaccaccatgcctggcccattgccaggttttataaaaaaatatattgcagttgaatcatgatttttggcttcagtacctcgatgaatggtgaggtcatattctgacatggggaagaggaatagaagcagtctgtgaatgtctaactttggtgtctaggaagacagttgtttccttactagagagagaacacacaatatggaaaaattaggggtaaagagagatgagtcaatatttggatataccaaattagttctccatggatctattgagtataagccctttggaattcgatttttcaaagctttttatcttgcaggtaaatgatttaatattcacagaatgtagtgacctactctatttacattgttttacatttcagacctagttttcgtgtctagttcttttgactcaggtggtcagtattctgttcattttaatatagttacctccctacttgacatacagattgacatattttgccataatagtaaatagtgcctaacatttattgaggattgttttatttcaggcattatgccaagccatttttactcttattaataatatttcattgataagtataattaaaatcatagtacctaatgttatcaaatacttacaacatgacttttcactgtcaagcaatttgcatatattatatactgtgcttttaataatcatcctattaggtagtggtgttattctcattttacagattggaaaatttacacttgaagaggttatgtaacttgcagagattacacagcttgttgggggcagagcaggatttaactccatagtagttgttgcactcaaccagtgcacattgctctcttcaaaacagtccttaagagggtgtgttggcttggtggaggagagggagtagactggagacagttgtgcttggaaactggaaatgtgacactgacagtctgtctggaggtcagggctaaactggctgatgatttagatgtcacacttatgtacattaagttgggaattgaaatcacgtgtttgggctctgtttatgagagagattagagatgaagagaagatgactacagtcagaatctgggtgccaaataataagattgagcaaccatgaaagtaggaggactatcaggagatttcagtgacaaagaatgcagtagagatgagagttttcaaaacaaagaagatggctaaattctctggtgttacaagaaaagcccattaggcttggtaactagcaggtcattggaggcctcttaggagcctagtttttaatcaaatggcagttgtagaaggcacaggaaatagggctcatgaatagatgctatttatatttggagagagattccactggagagggtaatcttgaagaatcatgaggtagataaactatgcaatgaagcctgatattggaagctatgggaaacaatagaatgtagacctctagaggaagagttaactgcacataggaagcactaaagaaaaagtgaaattaatgaagattagcaaaaaaacaggaataaagtgaaattgggaaaatctcatggataatctcagtactctcagccaagtgtatgtctaagtcatcagcatgattttgtgtgatatttttgccaaataccacacatatcctaagaatcaatttcctagaagataagattattaaaatttaaatccagctgccaaaaagataagctacctaaaagagaaacaaggccaaataaaactacccacctatatagatgcctgatagaaatgtaacctgtaatgttgtatcctaagtgagtgtaaggagacaggtggacttactgtatgtaaacttgtgaagtctaaattttctcttatatgtttgctcatcctatgtgcttatttttcttgctgatgatctttggttggattcttccaagtacacagtattcaccttcatgcaaaataagaacagattgtgtagtcagtttaaaaaaacagttaacacttatttagcactaattctgtttcaggtactgttctaatgtcttacacataatcacttattattctcacctgccatatgatttggatattatttttatgcacatgttgcagatgacgaaaatgaaatatagaatttacatattgttgatgtattagctgttggcattttgttataattaatttaaacaaaattatgataatcactttaaaactattaaccattaacttgacctttgtaaaggtaatctatctcagatctctttttttaatgagaatgtttaaatgagaataattatagaaaataactcttgtcattgtgaattgaattagatagtatatataaaaatctaaaaaagttttaagcacaagcaaatattgaatcagtgtgaattaataataataggtaaaacgtgggtttaaaacttgaagtctttatttctctgtgcactaatagaatgaactaacaaattccttgatcaaaagtaaaaatgtaaaaattctcatatttttttcagtttagaaagtgcaattatagcagatagatgcacaaagtaaaccaaattcaagacctagagagctaaaaggtgttctttttctctacaagctatctacttcactgtgaaaataaagtgctaccttttgtaaaacacagtttttcaagcaagtagacaaatgttgcattggaaagtaaggctctatctgtgtccatatcaagtctattcttctggctcagaaagtaaaaacaaacaaaaagctatggtattttggaaggtggagtgtggtaaggtggcaaagggataagttggtgaaaggtttaggtgtacaaagtatgaaccagtttctctcaggcttatgttctttttgcctcaggaagctcattttgacatatcccctcacagactattacccatttccttctgagtgtgaagcagaaagccttccctttattaacttgcttccctgtaggctgttcctaactgaaatattgacatttatgtgttttacatgctctgatcacaataaatgctaatgttttatcaatatttaataattatgatagcagaactcatataatgtactcagatgccttcctcctgtatcatttctgtatctgataatgacataatgacattttcaccaaataagtatataaaaattagtcttaatgcttgtacttatcccactgtatgtaaaagttaacgtaacataatggattaagtgtttttcaattagaaaataatttttaaaacttatccttttttaaatgagcgtagcagtatcctaaacagtattatagaagtctaaaaaaaaagttaagacatcaaaaccctaacagtggtggaaagtcacttgaacagtgacaagaagagtccaatgagtcataaataagctaaattaattcagaagctgcagggtgctgcagagatgtggttggtaccttttgacctgtgaccaaaaaaaattcatttttttcttctatggtttatggagatagccttgtgggattcttatcaattgaagttacaatattcagtacttgaatataaacatggtggattagagtctgttagaaacagtgacttagataagcgtgttaatattttaggtcactagacaaccacctaattgaatagtataaaacaatttgtgtctttgtccagggagtaagaaaccatggaaattattcacatatgtcacaactccaagattatttttattcctgtgtttgtttcagtttatcatgtttttacacattttgaaagaagagatgcatataattattttcaacttttttgtcacttattttagcattattttatttacattcaaataaaataatctttaaatttatgctttcttatacatatatgtttatgtttttctgacattgttagtttatgatgctaaatttaagcattgcattgttaaaggcaggtaaatatgacagagtgcttttaatgtaataagtggggataataaatgtttcgtaatacctatattggcagtggagcagatagcttatgtagaaatagaacgccattcttaaataggtcagaattagctctttaggccttgaatttggtttactttgtgcatctatgtgctataaattcacattacaaactgaagaaagtatgggaatttttacatttttacttttgatcacgaaatttgttagtttattctgttagtgtagagagaaaaaagactactttgagttataaacccacattttttacctattattattaattcacactgattcactatttgatttgtgcttaaaacatttttagatttttttacatgtagtatctaatttaattcacaacaatgacaagaggtattttctattgttattctcatttaaaaataagagatctgagataggagattaactttacaaaggtcactaagatgtcaaggaaatgaggtgtagattattataaatgctctaactttttccagatttgctccccaaagaaggttggaagtactacattaatgacattgtaccagctgactttctagatttgtagtaataaagtgggaatgaagtggggttgggaggagtgtattcactaaaaataccttctttgttggctttggcatactgaaaagagaaacatttcttttgagataaattttctagccatttctgctagatacctccttttggcaagtgttgaatttggatgcactctgtttcagtttttatagctgggtgtttgctgctgtcttgggtcatgtttgtcaggggttgacaagcactttaggatgttgtgcagcttcaggcaacagcaggctccctggaaatcatgactgcttcttttaacctcatagttctcaaaattccgtggcttatgagaacctacatgaaagcctgccatgtcacacatttaataagggttttttttcaaatcattaaggaaaataatagctacaatttcctacattcttaaggtttttttttttttcttcaaattttggcttctactgttacttgtctatcgcagaattgattttagatgttacatttatattttagaacaaaatttatttttagttatttaagatatgaagataatcgcaaacattttaaagtttaaggaatagtaattttttctttaactgctgttggacaaaaaagaatctgtacttgtgttgctgggcttttgagatcttttttgatagtcaggataatatataggtatgctgaagtagcacagatagtagattgagttacataagaaaggacacacagctaactgaatatttttaaaggtggattaaaaagaatagatccataaaaagaatctaaagtagcagatccagaaataaagcgaagaggaaaattagagttgtctagacttcctacagaaagggagagaaaagagaaattgtgaagcagctactgtgttgaatgagactttgtctaaagagtgtgttttggatattttggtcattgttatatagaaatctgtatatagtgagcacccacccatacccatagactactctccccaaatacactttgctaccttttgacaaaacttgaatgtttttgaattttttttgaatcttttagacttggattggtgttctgtggatatgatagcatacagaaatgggccagaaggcaggataatgaggaacaaaggagtattgatggtggtttttaccaaatcaaaaagacatatagatatttcatgatttgaacttgttgaaaatcactgatgacatttctatctttttctggattctaatcctaaactcttaaggctgaacctgtgatctacttggcattgtttttgaagacctagaattttaaccttagtgtaatgcttatgcttcattagttgatagaagcttctctgataccagttgtgccaaatattaagtttcactatacacaatagctggtgttatgcctgtcattggaagtaaatgaaggactgtgtgctttaaatattactaaaactgttctaaatcctctaaagaataggaaaacaattgattcatgttcttcaaaaggattttaatgtaactgctgatttggtgatgagcatacccaaaatgtttagtttggggaatgtggtgtcaattggaattcttgaaactacactagtattatcctattactgagtcattcctttgagggtggcttagaattaaaccatcttggaaaggagaagacattatatcctctttcatttatttgttcaacaaacattaaattgttactcttattgggcagtgtgttagttttcatagatacaacaataaataagaactctctttgacttcatggattatattatctattggaaaagacagatgtgtaaatagattataattacatgtttctgtgataatggtatacacatgtcatacatactaagaaggaagcataggacaataatctgagagttgttttaacctaaaaagactaattgtcacagggaggaaatctgcatggtgagaattgatggggttgaaaattttgcagtgaagtatgaggcaagctgtgtttaaaaagcagaaatgtaatatggaaggtgagatgataaaccaggaatgagtgaaaccagaggatcattacttcagtaataaaatctctagggaaaactaggttaaagctggggatgttgtcttctggaatttaagaatagaagttaatgtatgagttcacatgtataactcatattccaactatagacggtccctaacttaagatggtttcacttaacaatatttcgactttatgatggtgcgaaagtgatacgaactgagtagaaaccatactttgaacacccacacaaccattgttttccactttcagtacagtatttaataaattgcatgagctattcaaacgttactataaaagaggctttgtgttaggtaattttgtctaactgtaggctaatgagcatgtttaggtgtgcttggctaagctctatggatgttaggttaaaggttgtatatatcaaatgcatttccaacttagatattttcaacttaatggtgagtttatcagggcacaacccaatcataaggagcatactttagtgttgtgtaatagcaacactaaaatagtgacatagagtaaaaaagtaggtacatggtcttagataagacagtataccatatacttgacataattttttttggaaatagcaccctcaaggaggtattttgtttatattattaaaagcttatagcatttaaaaattaattaaggggagaataattatcagatttttactctttagctaatgtcattcgtataataaaatgcctatataagtttaaggagtataattcaattaagccttctttctgtggttttgaaaataatttttacaatgataatcagctgcagcaaaaacagatctaaggcaaaaataccaaattgtattagaatagtcaaatttcagatatttttattgcaaatgttaaaagagtttcaaatatcagctttaaaaacttatgtaaaagctcattgtatactaatgtgatttaaataatatataattaacctacataggttgtgtaattaatttaccagtatttaaataatttaggatgataatattctagaactgaggctgtgtctttttttagtttcttttaaaatatcatatttttaattcttgagataattgcttgttggaagtatcaatttagtgaaattctttaatcaagcgtaagtttatgttatatcatcttcttatgtgtattgtttattataattgattgtaacataagtgacttcaccttgcattagccagataaaataaaattcagcaatgtaattttggatttccacatttctatgttaaagtacttaaaaactcaaactcaagaagttacaaaggtgttaaatattaaagtatcaagaaattagcaatttaaaaatatctgtgtctcattttaagcatatagttacatcctaaatatatttttcatttacaactgttagaaatgagttaattttaaggatactactaccagggtaaaaatatagattgaatttaagaaatttataagaatattgtcaataaagttgtacattttcattctatccatggctaaagaaagattatccacacactcatacgtagtcattaatacagaaagatgggaaagatggtttgggacaattttatttgttttattattattttttattatactttaagttttagggtacatgtgcacaatgtgcaggtttgttacatatgtatacatgtgccatgttggtgcgccgcacccagtaactcgtcatttaacattaggtatatctcctaatgctatccctcccccgtccccccaccccacaacaggccccggtgtgtgatgttccccttcctgtgtccatgtgttctcattgttcagttcccacctatgagtgagaacatgcagtgtttggttttttgtccttgtgatagtttgctgagaatgatggtttccagcttcatccatgtccctacaaaggacatgaactcatccttttttatggctgcatagtattccatggtgtatatgtgccacattttcttaatccagtctatcattgttggacatttgggttggttccaagtctttgctattgtgaatggtgccacgataaacatacgtgtgcatgtgtctttatagcagcatgatttataatcctttgggtatctacccagtaatgggatggctgggtcaaatggtatttctagttctagatccctgaggaatcaccacactgacttccacaatggttgaactagtttacagttccaccaaaagtgtaaaagtgttcctatttctccatatcctttccagcacctgttgtttcctgactttttaatgatcgccattctaactggtgtgagatgatatctcattgtggttttgatttgcatttctctgatggccagtgatgatgagcattatttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtagattgaaaaaattttctcccattctgtaggttgcctgttcactctgatggtagtttcttttgcagtgcagaagctctttagtttaattagatcccatttgtccattttagcttttgttaccattgcttttggtgttttagacatgaagtccttgcccatgcctatgtcctgaatggtactgcctaggttttcttctagggtttttatggttttaggtctaacattgaagtctttaatccaccttgacttaatttttgtataaggtgtaaggaaggcatccagtttcagctttctacatatggctagccagttttcccagcaccatttattaaatagggaatcctttccccatttcttgtttttgtcaggtttgtcaaagatcagatggttgtaggtatgtggcattatttctgagggctccattctgttgcattgatctatatctctgttttggtaccagtaccatgctattttggttactgtagccttgtagtatagtttgaagtcaggtagcgtgatgcctccagctttattcttttggcttaggattgacgtggtgatgcgggctcttttttggttccatatgaactttaaagtagtttttttgaattctgtgaagaaagtcattggtagcttgatggggatggcactgaatctgtaaattaccttgggcagtatggccatgttcacgatattgattcttcctacccatgagcatggaatgttcttccatttgtttgtgtcctcttttatttcattgagcagtggtttgtagttctccttgaagaggtccttcacatcccttgtaagttggactcctaggtattttattctctttgaagcaattgtgaatgggagttcactcatgatttggctctctgtttgtctgttattggtgtataggaatgcttatgatttttgcacattgattttatatcctgagactttgctgaagttgcctatcagcttaaggagattttgggctgagacgatggggttttctaggtatacaatcatgtcatctgcaaacagggacaatttgacttcctcttttcctaactgaataccctttatttccttctcctgcctaattgccctggccagaacttccaacactatgttgaataggagtggtgagagagggcatccctgtcttggaccatttgaaatgagatatgagaaaaccaatttactctcagaaagaaatagaatatcatttgaaaacttgtgaaactgctataaaccatcatgttactgaaatgcattcattttaaaggtctctctgtaccacaaaaacggttttattgtggagcatatgaacagcttcttccattctcactacatgcttaatgtttcttgttcctcattagttagcctttgtctacattctttaattgtggatttctatgggtgttaatcactgggttacacatgtacttatctagtgtccctctcacgttttattcttagttctaggcataaaccttttcatgccattttccaggcttaggcttctatgataatacacgtatcctggacctccttccctttcttcttttccccatcctcccttttctatctgtccttaggtgttcttatgtcacctagatagataattcctctagcctccactctggttcagatcttctgatttccttattcatttattggtttctctaaaagtttccaaatgttcttaaagtcccagcatcttgactcctatgcaatcatctacccattatatacacactactgaaatatatctattaccaggcaaaggtggccagaacgtctcttgaaggcagatagtatatctacaaataatttgcctcatgctattgtttctatcttagaaattagatttctatagaaatggtacttgggcatccaaacagattcaacaccttcttttatatcacagataatatgtatattgtttttactgtttttgttaaaggaaccttgaaatatcttttaattctcgaacactttacctacctaacagctaacctttttttttttttactgtattttaccctttgcctagcaataaactcaacaatttaaaaatatttctgatttattctaattatatttttcaccagttaaccatcgccccctagccactctccactacccttcccagtctctggtaaccattctgctactctctatcttcatgagttcatttttttttagcacccacaaatagatgagaacatatgcaatttatctttctgtgcctggcttatttcatttaacataatgacctctagttccgtccatgtttttgcaaatgacaggatctcattcttttttatggctgaatagtattccattgtatatatgtactatattttctttattcatcttttgatggacatttagtttgcttacaaatcttgtctattgtgaatagtactgcaataaacatgggagtgcagatatctctttgacatactgatttcctttcttctgagtatgtagctagcagtgggattgctggatcatatggtagctcaatttctagtatttgatagcacaacagtgtgattatagtcaataataatttattatacatttaaaaacaactgaaagaatataattagattgtaactcaaagacaggataaatgcttgaggtgatggataccgaattgcctctattgtgacttttatgcatttatgcctgtttcaaaagatctcatgtaccccataaatatatacacttaatatgtatccccaaaaattaaaaattaaaaaaaagtcttgtgggcagaaatgtaaaaaaaaaataaaatacaggaatatattttaaaaatttatttgcatcaatttaaaggacacaagtgtaaaaaatttatactaagagaattttcagtgtcctttgagggtttgtcaaactaaaatcttaaaaatgttattaagacgttcctacttaaatctaacctaaatatttattgtgccaaactgcccacatgaaaacagaataaatatttgtgatgtaaagtaaccatttactactattaaatcttgtctcagctttgtttttgcctattatatatcatttacttaaaaaccttttaatcacaccctgattaatttggattggtttttgtaatctgacagtgtaacttccaaataataaagatgttttaagttaaaaacactttagaagtttttcttcacttagaaacacattccactgtgtaagtcccttgaagtcagttataattattacagtctgtggggattagtatattgtaaggagattactgggcttctttacttagcagcacaatgagcaacggtgtaccctgagcacacagagcggtaaacattggaattgtacagttaaaagagttctgcataaacatgctatgttccagcacccacttaaaaagaaatcagcctgaaaccaataaatttctgttgagtactactctgtatatattatttgctataagggctagaaagtaaagaaatataagacatgatttccaggctcaagaatactgcagttgtttacgaggaagggctgtgttcctgttgtaaacatttcatacaataatcttattcatatcactatttttataacacagggaaagaaattgagaatcagagaagtcagataattgcccaggttctgtaggtgggaagtgtaagagttggaattcaaatttttctctctgggtgaaaaggccatgctctttgctcatgtcaaatccgctggatggaaaagatgatcacacatgcagtaacactgaacacttacgtgatgatgacttccattgtgagtattgtctatagttactctagaaaaactcagagattgttaaagtaacctataaatgcttcatagaggagttaagaattgagttgtattttgaatcagaataggataaagatatacccagagaaagttgaaataaaagagcaggagttagtgcaaaggcatgcaaatagaaatagtatgtatatttcaaatgtggaagaaaataaattttgtcagtttaccgtagaaagattcttttagtaatagcttggaaataagactagataaggcataattgtatgagctacactgattgatcatgtactagttattgatattggtaagtaatttaaatatactaattcatttaatctgaataacaaccatatcagaagtatagtataattaatttcattttattatgcagaaatggattgtgcagagagagtaaacagcttttcccaagattttacaactagtaagtggaaaattgaattcaaattcaggtattctagctctagatcctgtactcttaaccactatactatccattcctctgggaaaatgagacaatattgcatgcaaccttgaaagtcatgcgtactagctacgtttgaaatagtaaaatgaaatagtgacctaggattgaaacaatatgtgtgcctggtggtatggctggagttaggtagtggttggtgtgcagtaggactggagagtaggattgtaaaatctgcaataatttgtgattgattttaaatattaaggtgaggtaaatgttaaaaattttatggagttttagattctggtgattgggatagtgctagtatcaattacagatagataagaccctatttggcagggaaagtggcgatttcagttttttcatgctgaacttgagccaactgtgatacatcaagatgttgatacccagaagatgtatcttagaatacaggacagacaatctgctgaggatcacagaaattaagatatcaatttaaaagtaatacagtgtagtaaatttaataattatttgagtgtaaaatattgctgaagaagtgctaccaaaagtgagtttcatgggccattgtggtccacgaattgtttctggttagaattaagagtaattcatgtttgttatatgaaagtattgatctgcaattgtgttttttttcaaaaaaaaaatgattcttcaggataaatatttcaagaagcattgttctaaatggttacattcctttgctgtaatgaccagacagtatcaaggtctcccaaacaaattgaggcattttccagcatttcaggattaagctcaattgaattgactttattcacttttgtctccttcagcaccacctcccagataagtaggagcctgggtcagtgatcttgtcctagagtctcagacaagtactaggacagagcattactttcctgtaatatgtgattaaggtgagcaatccaagaggcggaatcctgtaatgaaatcaaagtcagttcagacaaaccatctatctcactatcatcaatccagaaatgctaggcacaagtttaagggttaaaagtgaagaataagaaaacaatcattttctcctggcttgagaaaacatttaaggtcatcttcataggtcacttaagagtggctggctgtgatcagttatggattatttaggagcattgattggacttgtataattatagcctggcagacatcacatctgattaactcagccttaccatggagatgacttagtttatattttttaaattgtacctgtaccatttcagtacttcctgagaattctcagcctattttgtaggatttattttcttcttatccaagtcagaaacaatctacctacatgattaaactatgtcccttggtcagtgaaactgataggtttgttaaatacataaaatcactttaattttgagtaagaaggcaagaagaggtgggtacagagaatgtcttctaataaggaattattattagaaggattatgatctgagatgcctaaaaagtcaaaaactctgaagtataaggaatataaatataacaagaaaaatctgtatataccaggagtttacaactagtttaaagtgtaaagcatacaaaaagtttataattaaaaatataagcaaatgccatttatttgatggagtaacagggatcagatctgaccttccactgtaaacagcaaaacatgaacaaaatatataaagctctaatttttaaggcactggaacactggaatcagccaacaaagaacaatggatcgtaaaaattggagaataaatgaagtaagccttatgattttctcaggttagtgccttgagagtttctatgtctcaatgcacagatggaaactcaggtgaaccctggtggattctctgtaatgaggagacagagctgagagtttggcaagactacagcagcaagaaattgcaatacagagtaccgaggaaggaagagctgcactcgaagaatgctgacatgtgcagaggatcccctttaggtattctgctgaatactaagtagcacatgtatgtgaggaaactacctgaggcctgaaaaagaaatttctaaaatgagtagaggtgacaagtgactcacacagggctagaaatagtacctattcccacaagtggcaaacctattagagaagttacaattaaaaagattgattgtatcaagtgtcgagaatgtggagcaactggaatcctcatacactgctggtgggaatgtaaaatggtgcaagcactttggaatgcaacttttcaggttcttaaaaagccagacatgtaccttctacctatgacctagctattccaaacacaggtatttacccaagataagtgaaagcatgtatttatccaaagactcagacatttgtattcatagcagttttatttgtaagagccagaaactggtaacaaaccgagtgcccatcaacaggtggatgggtaaataaactgtggtatgtccacaatggaataatactaaatgatataaggaaatgagccactgatacaggctacaacatgggtgaatgtcaaactagttatgctgagtgaaaggggctagatgaaattacttcataatgtattcaatttttatacaattctagaaaatgcaactaatttatgatgatagaaagccaatcagtggttccatgaagaaggggtaagatgtatgctggccggaaaagatgggaaggagaaattaaataaagaattgagaaacctttagagttgataggtatgttcattttcttgattgtggtgatggtttcacaggtgcctatacagattggctatccctaatccaataatccagaataagaaatactccaaaatccaaaactttttgagcgccgatctgacacacaataaaagtttattggcacattttgaattttggatttttggattataccaggaagtagaatgcaaatattaaaaaatctgaaatattccaaaatccaaaataccttttatcccaaatattttggataatgcattctcaacctgtatatgtaaaatcttatcagttaccatttacaatttttaaaagtacagcttattgtaggtcagttatctgtcaagaatttaaaaatgaatatgagtgaatgatacttgcgaagtgaaggatagatatagtaagtgcagtagctactcaaaagagtgtgagagagaaatagagaattaggaatcatgttcagttaagaaaatgtatataaacaaaatgggagatatattagagcttaacagtaaacatttagacaggttgatgtaagatgaatggaggtgggtatggtatcaatagagtcatcaaggggaaaaattgtaggattttcataaaatgaaaaagctgtgatcttaaatagagtgatctcaagttttggaaaggggtggacaagagggcatgatagttgggaacttttaaatgacaggttaagacgtcttggcagtatctgtggagtaaggatgcttaatggtcagaatagatgagtgacaagctctgtgtgaaggagcttgatgccagaagagcagagagcaccaaacagtcttcagaagcactcaggtcaagtgaattcaggaaaaagagttataaacgttgaaaacaattagtcatcatagtatcagacaggctaatttgtagaagagctttagacacaggatacagtttttgcaacttccgcagagaaggcctggagaagaggaggaatgaaaggacagaccatggcttgtcaatgagatgttgttttctgaaataaacatagtgaataggtctctactggaaacagtattgaacatacccacttattaagaggccttctaacaaagtgcacagagaaaagaatcccctgttgaggttgctgatttcctatgagggatatttttggagagcaaatttggtctgatactgatactttttttttcccataagagttgtcttacttttggaccacctgtcgatatccagaaactctgaagattcccagaaccattccaagtattattgatagtgtgataggtccaaaattttgacattttaaaacttcagaacgaggagcattttggagaccttaaattcaggagggaccttctaggaggcctgcatttttccttttgtgttttagaggaaaccaggaaattctgaagagtataataaatcaatatgtagtttagacatctgtgttattctctgggtacagattagttaggctgttgcaagtcatattcccctatttcacattagaacaacctgctgttggtacatgagttagcattacactatgagcaaaacatgagcagaggaattgcaaagttgtattggtccttgaagcaatgaatcagagctaaagtgacagactttaccagcagcatattaaaaaatgccctcttgtaaaatttaccatgattattttcagacaaactgtgcatccaggacacatggatgatgacaagatcatgaacattatctctgaatatgaaaggcatgatgtgcgcaactatcaaagtgcagttcattttagaataagtggtattttcatgtagttgcagggcaagacaggaaaaaatagtttataaagggaatgaagttgtggatctctgacagctgatcttttcaatctatgtgaaaataccagttgtagcagcaatggcaacaaaaactactgatttctctttttatttgaaagattccttagacactttaagcggttttaccataggataaatggactatgctttctgcttcatcttcaggtctccaattaggggtgggttgcccctgtttgaggagtcagtatgtggggaatactattgatggcgtacacttagagactgaccttctgaataccttgtaggtcttatcaaagtagtcactgaaattcatccattttataatttttcttatgtttctttttgcatgaacctcctcaagtcatcacccactgccccagaaaaaatcactctgatgttggaggctaaattcatcattgcatttgtaagcctagaatcaagggagttattactgcttttcttcacaagactagctctttcatatgcgttttccgtgtatacaaaatgcctaaaccatttaagcagtatctcatagcaagtgacaaaatatgttctgtttgaagcacgatgcacagctctggttgttttgggcctgctttatttacatgttcagagtaagcctggcaaatacaggttgaatgtccctaatctgaaatccaaagtgctccaaaatccaaaattttgagtgcccacatgatactcagagaagtatttcagattttggattttcagatgctcaaccagaaagtatattggaaatattcaaaaatccgaaatccaaaacatttctggtctcaagcattttggataagggatacacaacctaggcattgcattgattgcctaaatggaaatctggagctattaaaatttttggaatgcattagtttactttgaaagtaaaaattgttgtagtgtgctcaagcctaaactgcagcaaattaatataatcaaatgaatttagagcataaacaaagtattcctaggatttttcagagttggaatttcatggttgcttttggctttaaaatgaagcttattgaaattatagtaaaaatacagtaacagggaaaaatttaacagttttggtaaatggaaacaatttgtctctgatataatttttttttctatttctgttactctctcccatttttagggcagtattttaaccacatacttttatattggcttttttttgaaagatcaaatatttgatgttaatttttgtttgaagttgtgaaggctttgctggaaaactcgaagttccaaatgtgacatttattatattattatgtgcccttactagggaaaattgaatataaataagtgttaatgagcgtgctggttgtcttataaggaataattcattagaattcggtatatgagaaaagcaggtggggagatgataaaccataccacatgaatatgctggacttttgaaatgacaacaatagtaagggaacaatagtacattcttgaaagataattgtaattctttcaaggctcatgaactgatcattttgctcctaaggcgagaagtttgtggtgattaaattatggacatataaagcatgttcatatttttcaataaaattctatatgatatgctccgcaaatgtggaattgttttggtggatgaataaatattaatctttggaagtggctaaataaacattgaatgtccaaggtgatttttttcaccatttatcctaaaggagaaacttacgcatacatatatgcacaaaaacacacaccatacatcctcagggagattgttttttggtttctggagatcatcagacttctggtgatgctggtgtaggaagtgattctagttagttttatatagctgttgctttatattgtaaataaaatagtactctgggacactggaggaacaattagatcaagtaaaatcagttttctttggtcgaagaaaataattgagtgaaagctcttgatattgtgtgtttaagaaggaaaatgtaaagttaaagaagaagaaaatggatatagcccagagataacctaaggataggatatggaatacataggtaatatggcaggaatggagagttatctaactgcatgtcctcatgtctccaacatgtgcaagatattttccgaagtataatttttttttaatttattttttagagacagggtctcactctctgtagcctaggctggagtgcagtggtataatcctagctcacctcaaactcctgggatcctcctgcctcagtctctagagtagctataggattatagttgtgcaccaccatgcccagctaatttgaaaataaattttgtacagagagggtcttgctgttttgcccaggctggtctcaaacttctggcctcaagagatcctctcaatttggcctcccaaagccttgggattacaggcgtgagccatcactaaaaatattttaacagtttcctcgagtggttctagttgtggatgtccagtaacttaacttgtttttacacaatctgatgcttttattagaaagtatttcctgaatgcttaacataatttccctttactcaattaaactgtaccatttctagctggtgtaattacaaacatacttaagaacctttcatggttttgtttctatgcggatttggaactttcatggttttgtgcctatggcctctttaaaaaatataggacatatctaaaatgaataagcaataagtaaggaaagttgaagcactcctaatgtatgataggacagaaaagacaaagattaaaaaatagactaaattttcttatggctataaacctttttcctataaacgtatttgattttgtaaaacagggaagttgttggagtttgatgtatgtattgcttatgtagttatatatatatatatatatataaattatattttgcttttgttatgtttagtggagaaacgataactaaagataatttttaggcattttttaagacttctaactgcagacagttttttagagttggaacaaactttctgaagtatcataaagcaactcttgaaattaagagtaaagagataattgatggccagatgcggtgcctcacgcccataatcccagcactttgggatgccaaggtgcgtggagtgctagaggtcaggagttcgagaccagactggccaacatggtgaaaccgcgtctctactaaaaatacaaaaattagccaggcctggtggcaggcacccatggtcccagctactcgggaggctgaggcaggagaatcgcttgaacctgggaagcagaggttgtagtgagctaagattttaccactgcactccagcctgggtgacagagcaagactctgtctcaaaaaaaaaaaatttgtttatctcctgtctaaaactcttccctctgtgacttcattattatggatgagccaccttcttaaaaatcctattttgaatcacagaattagcatattctctcagtcatctaccctctcaccatcttatgaataagtatcactcctgttaaggcttgaaaaactgagacagggaatacctgtatatagatattcagtaaatatttcatggcttcgacaacaaataacacttcaaaatgaacatcataatgtaaaaggcatgttgttgctaagactataggttgagtactagactatacgagtttgaataattgctctactgtttactagctagatatgcttatgcaagttatttagactctttctgtctcaatttctttatatatatatataatgagcataacagtaatctttacttcatgtgttgttgtgaaggtcaaatgagctgatacattcaaaacatttagaaaacttcctggtgcaatagaaaaactacctgtttgggtactgtgcccattacttgggttacaaaatgatctgtacaccaaaccagtggcacacacaatttacccatggagcaaacctgtgcatgtaccccctgcaactaaaatagaaattggaagaaaaaaaaggaatttccttgtacaaagtaagcatttgataataatcagctagtggtcatagtaattttaattcatataaaatgtcagttttgttgtcaagggaaaaattttcacaatatgatatacaaaagttaatgcaaaagtaatgaacttttggtacatgctacaacatggatggacttgacatgcgaatggaagtaagccagacaaaaaggcatcagtatttctcatctccctttttgcttttacttcccatttgcaacccatctcaagagaggacaatggaaggaaaggggtaaaaataatatttaagaaagaaacaggagaaaaagtaaaagaaaaagcaaaatagtgagacagaggaacagttgcaggggtcgttaatatgcattttccatggttccaagaggctcctcaattttattttccctgattgaaacttcaaagaacaactttttgattaaaaaattaaatttcccagtaattgccagcctgaacaagatgtgaattggcagacccagtggtagcttctagatttactgacaaaagaaatattctgggctggtagagcagacactcagctggtgagtcagctgactgaggtgcctttatctgtctttctctactttgcccagtcctctgagagtgtgagacagccacagcccataaaagaagtcatttggtaaacatctaagggttggatttagaaaaaatggaggatggtttgggtcataggatttgggatacagtaagaggtcataaaggcaataactggttagttgtacgtagaggctgtgggcacagttaatttgtgtggaggaaaagaagaatgatttgatgctcagatgtttttgagaaaaaggtttttatattaatgttggaaaaaaccctaaagataactttaattatgtactacaaataaattgtttttaactttatattttttcttaaatttagggtgaaattgaattgcttttgtctaattattatgaaatatgacttcttatactttggaaaataagagttatggttttgaaacactagaatacagttgtttttgatttgactcattttatttgacctaaaaaatagaaattaggttatgtatgattatgatgaatggaattttctaggaagcaaaattggttcaatcagagcaattattgtttttcattgttgttagcccagaagcagtaggaccagtctttgtgttattctttaccgatgtctctctagatattatagtcaatttgctttattcagtggtgaaggaagcattacaggatatgttgttatattatcagagagttacatgtggataatggtaacagccacagtgtctgaggctaatttttcaggaaaagaattgactaattattaaagcttttcttatttaggcaattgcagataattttgtatcattgaataatttttagtaaaagtagttcccctctattttggaaaggaaaatttaaggaaacaatagaagctcagaggaaagattgacttttgaaaaagtaaatattacacctaacactttgatgaaatgtacacctaactaatacctttatccagaaggaaaattgcatttgtctctgacacttgaatggaagaacagtttaaaaaatggtttaataaagggtattacctttatttttttactgatatttgctttaataaaattatatttaattaaattatattagattttaaattgtttttgaaatgaaggacatccatttgtaattacacacaaaaatattttttattttctcttttatctcagttttatctcctcaattttctcaattggtataatggtataaggagaaacataaattatgatttttctgtaattattctgaaatagaaaacttctgaaaaattggtagaccttgaggaaatatttaaatgatgccatctaaagatgatgctgagtaaaatattcattattctttataaacaaaattacagagtagatgaaatttgtcttaattcccttgttagctttcctcccattcatataattcctatcaccctatgacctccaaacacacacacacacaaccctgtatccggttttaaccatcttgcaggggtaataactaattccttactaccagtgaaacctgataaaggtttaggtacaaagtctataatggtttatttgcattttataaaaggagaagggtggggaggttggcagatgagattggaatcataacaacttagtgaagttacctctgggtggagtccttttgatattgcttactttccctacgaagggctatcagtgctgctctcccacagtgcacacacacatgcatgcacacacacactcgtgcaagaatgcatgtgatagtggaacaaataatgaacaatgaactatgttataataactctgaaaaggtactcactcagctatagtctgacttgagctttttctctgactagattttttacctcaaaggcagttgtacagacaacactagtaatcattgtaaattaaattctttctattgtcacaatctggcagtgttaaggacaatttcagttcactgcagaaaatatatttgaaggatattttcccaaatatttgagtgaacttcctttttagagtaattatttgttaatttgagaagtttcatttagattttatctatacaataagttgtcagctaaaggtggacaaataaataaataataccataaaattttagatgtatgttgcttgtgcccccctctacaaagagaaaacagtattatgagaaatatcataaagcatatcaaaatggaaatatctccccagtgactgctgtgtgcttgaagtatctagcactagtctagaaatagcacctaggggaggagattctgttaaattgtgaatatatgtcttgaaacctgtaagacattttgccatggctcgaaagtgacaagtttgtgcctagtttattattacattagttgattgtcatgttacagagtagacaacacaatactgaggtaaaaagaaatagacaagaaggctctcatttgaagcaaaacacagtactggccaatcccatagcatcttgatctgtcagcagcccctgttgggagttggcagaaagatttgcaccaaagagtaagtttctaagtgacaccaaaatgttcggtggggatggctgaagatctgactgacttcttaaaatttttctttagagagttgtacctaggtgtccattaaaaaatattgctggagcatggagggtagggaagctgatagtagaacctcagacaaatgatattttgaagagacagtgcaacagactgaacatgtagcagtattttattgaaaggttttattaatcgaataaaaatgagagcatgctacattttaaacatacaactcaaattaactgctagaaaagtgaaaacttggtgcaattgttctgaacttaaccaggtaaagtgtttgctcagcctgcagatggtgtgaaacacttggcatagtttctggactcctggggtgagaagtgtgaactctgaaacaaggaatggcaatgtggtgatgatcttagtggagacaatgtgagggcagagaggggagaacaggaaatgcaactttccatacctaaaggaatagtgtgctttacctgccagcctgaaatgacagtgactgctgcagttctagattttctacatagttggatacaaaagaaaggaacaattcctgcctctgtgccaaaacttccatattccttagggttttgacaagaatttggattaccttgacctagggaataggagtgaggataatcaccatccgtctctagcccatgtgaggacagtattcccatcagtgtcactcgctgttgtatctgagagtcagcagtattgagtgaaggaacgacctgaagagagcatgagaaggtacattcacaccttcacaatatgtgcggattagggatctacaatctttggtgaggagaaactgctttttatttccctggacctttatttcaacctgcattcattcaacagatgccttctgaggacctcctacatattattgactgatttgtttctctggcagcctactattatagagataaaagttgtcatcactcatgggaggtaaaagaatgaacatggcctcctccctagttgagtacttgaaaggcagacatgagaaacatgattaaatgaataatttttaaatgttgattttcaatattgatctttgaaaaagaagtcaaatgtacaatatggatacgtgatgaacagaggagtaagtctgccttgtgattagggaaagcatctcatttgagacctaaagaaggtaccagtgctgataataaagtaataaggaggaagtgctgacataaaacatatgccactgttatctgtatgcccttccattctgaaagacaagagggatggagatgaataatgtccccagtcctcaagcaaaatattagtcttgtttaatggattatacttgaatacagtatataaatctctctactgaaaatgtctacaatgaaatgattttgacaattgaatatgtaattaaatttaaaatatttatctgtgctttctacaacaatttcaaggaagtgaggcattattatcaatggaagatattttgttttcacaaaggattactacatccctcattagagaccaatctaacacagataacatggtacttttttgatggcaggtgttcagtgcgttcactgaattgaattgcaattcatattgtgccacattaggttcctcacaattaagcattttcatgttgagttacaaaattgcctactttcagggaataatgtattcaacagctctcaactatcttgcattgtctaggagtggaacagaacaataaatcttggatcttgatcaccaagaaataatctggttaggatgctgtctttgggcagttctactttagatatgaggcagccaaagagttaagagacttgctctaggtcccaggcacattacatatttttatgtgtcccttctctcataaaataaaagtgcttactgccaccctcaagagatatgtgtcaggttcttatactcctgtgggataaggttaaatcatttcaataggtcttgcaggaaatcagtggcacagctgtttataaaacctaagatgtttaaccctgggtgactttttgaaccctgctcttagtatcaaaagcaaatactgtgattcattttcatctacatcagtgtctgtctgaagccttaaagagagaaaaggtgtcactgatcataacatatgaattagaaaccataaatgagtaaactgcttctcagtacagagaacaaagtacttatcatttaccaatatgatgatattgtataacgaaatgtatacttacaactatcattaggaaatccccattttaaatattccttgaggccttaatagaaatgtgatttcttaacaggtacctcctttagcctatgaatctctaatttgtctttaggttagaatataggtaaaaactgtaaagtgtacctttttccttttctatttttttgtttgttttttgctcctctctttctctgtgctttgtgtccataaactgtcactttgctgcctgtgatttcctggtttttcccccccatggtgtagtgtaaccaaggcctcttttgtgttgcaccctaataaagtgtacaagttgagcatctaccctttcttggtatctttttctgcatcgtttttccctttcatctttgctgtgataatctgataaattaatattctttacagttttaatgactgctaatagattaatgcatcttaatgactgttaatggcttaatgtgctgcacctcctgggtaaaatgtttgcattttaaaagggctttttagaatcctaaccttatttaaagacatgactctgtgagtatccaaaacctgttgacaaatcacttaggagaaataccatgttagatttttttttcacattttaacatctctgagaacaagaatgcattcttaaaattggtgtgattaaaaaacactgcatcatagattggaggcattttttatttcattcttagtgatgcataaaataatcatatgtcttaaaatcaatgacattgtagatttgataaaatacagtagctattttttttttttttttttggccaccgttgaaatcataccttgtggtagatggtaattacctcccttatcggatttcactcacacacacacacaaactcaattctgtatccactaaacactcataaacatatcctggcaccatcgaaccatgacattctctaattggctgctgtggaagctacaattaaaattttagggtttttttgagccacagcgaagaatgctttctaaacttggcttaagacatttgtaagaaatctgcactggaaatgacattctatttataacatctatttgctattttaaaaaatgtcatttataatactttggttcctcttattctgtctcactttgctttgagggagagaatgataaatatgagtaaacaccacagatgaatatagtgtcttgaaggactggtgatatttttaaagatgaaaaggctttgtatctgtaattactgatcatgtgatacacaatttcaaataaaagagttaatttcgtcctttctttttggaagacattagaaacagttgcagaagaaaaagcaagctcatcaacaacaaaaaaacagtcagaaaattggctaaaattcagctctttgtgctcttgagactgaaaaccatggctgaaagaaagcttttcaatttcctaccacgtatattcattgcctccttttagattggtttacttttttgaagcagttaagtagtagtatttcttggcaaaagaaacgtgtttaaacaattctttaaattctgttacttattcttcccactttccactcttctccattgctcatcccataccaccaacttcacattcctgcttgggttatgaggtatgggcactaatgtatattcctctagggtatcttttaattttatttttatttaagttcaacattgagatagtggagttaaaggattttttaaaaaaatatatagtagcagtcatatcttcactgttttattatcagtatatatttttcagtattctttgtgaataagactttaatgtagcttctatcattgtagtcttatattaagaagtcttccaagagtttaaaagtagggttgaattttgcagagccactacttagaagattaccaaataaatgctgaaatgtgaaaatatcaaaaccaattattttctggacttcttagtatgtataccaattacatactaagtcttacatactaagttttacatactaaatttacatactaagttttagtacaactagaaactatagttttgtgaaatgttaatattactccattagctccttcttaatatcttatcctgagaaatgccatgtgacttagcaggcgcatctagaataatgaattaaaccatccagctctgagtcagatgctaattagagaaaggactcctcccaaaaaataaatatgaacattttcaaccatatttgcatatttatcctggattagtatatttcatattaacactcttcaaagagaagtgacctgagtgaataagaattaggataggagactattactatgggaatagaaaaaaatctgatgaacctgattaagcattggtaactaatggcaagagaagtttgctacacacaataaagaggacttgaggggtgtagatatgaaaaaatgtagtttctttatatttttgcctagggctagcccaggggctttagaaatggatggctatactgtggctgacagcagggttgcaaaaattaaggtcatttttatgtacaggtctgtattttttaaactctttgactgcgttttcatgtaaaacttaagtcctttagctgccatgttgtcacgagaaggaaggaagtatgtatttagaaggtactcatagaagcccgtcagaccaaggatctgtgaaatatggttttgtcaagaaaggcacctctgagtctattacaagtacaatacaatgtggtctgtaatgaatccccaaccctagagagttctaaatatagaatagatagtcaggtctttggatggtttaagcattaaactgcctaaaggaaaggatctcctcagatgacctctcagtgccccttgcagctctgtaattccaagtctgagacagttggcttatgacgtgcactgagcatatggatgtgcgcaagtatgtttagtgtatatatgtatatatagatgtgtgtatgtatgtatatatatagatgtgtgtatatatgtatgtatatatacatatatataccatagagacgttgtgtttaatattcgtaatgttccttttttcttatcctgttatatcctgcagaatttgtgttttttctacctttctctgtgtatttgccttatatacaaaaacatatacctatttacttttgcagttgaatagccaacacatggagctcttaaacgtttagtttcttcattaagcattcttacaattttatccctgatattttcttaacagaaaagctatgtgtgtctgtttaactttaaatattgtggtaagaggtgaaaggcatattttcaatatagtatgagttttgttgtttactaggagaaagaagtgtaaagcatatagtttagtttggagacccaggatatttacagataccagtagagaaggaagatgtgggatagaattaatatctacttgcattttgttattgtttgtggaacaataaaaggttttctggcatagtcattctgatagcggcatgagactgcagaggattaaacatttatgcattgtgatttggctctgaggcgtgataactacagttggtcgagaaactgaagtacagaaatgccatgtgacttagcaggcgcatctagaataatgaattcaaccatccagctctgggtcagatgctaactagagaaaggagtcctcccaaaaaataaatatgaacattttcaggcatatttgcattcaagatgaaaagtataatctgctctgtcatgagtcctgggacaggcattgtacagaaagctcaaagaattgtacattgttgttttaagaaccaacacagtagttgtttcttgctggtaaaattatccacaaaaaactggtcaaggtcagaatagagatttcatcaggatgcatgtaattgcttacaaatctttgctacttttttacttacactaaaggacaaagcattttcattttcagctctcaaatattcctcctcacattttaacaccaccggggctttcatggatttgtgaatatttgtatgtatgtgagcttgataacaaacataaatttacaaactttaaaagacaggctattcttggccacttgttcccagacaatagtgataggattccacttgccctaaggccagttctggcctgcatttgttgcctttgccaaattgccatctggttactttgtcatccctagtcagctcttttatgtgattaggaaggaacacttctttgggcaagatgctaggtgcagctgttaattggcaccaaggttttcttcctagtacttggaacaaaatggttattatcatcagcagcaacttgaaaatagaaaatttgaaactctgctcatatgacataaaaatattaccagaaatataaactttatatgtaatagctaacacaaattggaaaagagcttcaaagtttatgctatgttctttaaaaagtcaaaacaatctaatgacaatttactatcatatctaaaaatatttaaggaactttaccttgccttataacttcttgtttctctttggactagcttgattgagtgattatttctgttcataatgcattaggttcttgtagggtttataaaaaagtggaagaaagggctgggcaaaccttcccaacacaggactccccagagaagagattgacagatgctgcttttagcagaagaattgatgagtcttctttctccctgtgtttcgggccatttcataactgcattgtaacaatctgagtatgggggcggggggtataaaacctggtgtgaagcacatgtactagtttatacggagaatgagatagatggtcagaaagaggttttttgccccccagttcctagtgccaagctggcctggccctttgttggtcaagatcatgtaatttatgcataagacagaagtcaagtccaaattaccaagaagtggaaaggctagggagagagacagcactataccagtagtgtgggtgagatgcagtaaagaggacaagtgggtgtaccatgcatggaaactaacctttaactcacttatgcaggggtccctgcagcatcttgagttctggatactcagatatattaggagaaggagctgtgaggagatagtgagaggggctgatagttatgttttccaacagtctcctctcctaaggagaagaaatggtttcctatggaaagtagaagcataagacaagaacagttcttcacaataatccttgcctttaagaaatctacgttttccttgatgtgtgcagacaaataaaagtaaagcagtaattaaaaaatacccaacagtatggtataatgtgttaatctgtgacttttagaatgtggaagttttctactatatactagagacattgcattgagttagcttatgtaaaattgctgtcactttaccctgtacttattaaaaacaacatataaaagacttcatactaattacaaaggcataaaaattacagaatggagagattgtgtgtattagtccgttttcacgctgctgataaagacatacctgaggctgggcaattttcaaaggaaagaggtttaattggacttatggttccacgtggctggggaagcctcagaatcatggtggaagtcaaggaggagcaagtcacatgttacgtggatggcagcaggcaaagagagcttgtgcaggaaaactcccccttacagtagccatcagatcttgtgaaactcactcactatcatgagaacagcatgggaaagacctgccccatgattcaatcacctcccacctggtccctcccacaacacgtgggaattcaagatgagatttgggtggggacacagccaaaccatgtcattgtgacacaagaatgaaaggcacatctctgcaatgtattcagtagacatttagttcatttttattatgagaagcaatatttcactagtggttgagaatttcagctttggagccacaaagtcctggatttgcgaccattgccgtgcagtagttgtatgaccttgtaaaagacatttaccctcattgagactattttcttatatgacaaatagggataatagtaattatcatgaagaaaaatatgtaaagcacctagtgcatcgttcctggcccataaccgttaataatgaagattatttatattgccagtagtgtattggctgaaatacaatagataaaagtaaaattcctcttttgaatgggaggtgattagctaggactgaagttagtaaaaaaatttgtgtgttgtgtttagaggatcaggtgtgaatataaggcagtaggaacaatttaataaagtatgccaccagtattttcccttgtgtcacaaaagtatgtagacatgctacatctctaaactaaaaacaggaacaaaaaacaatttttctttcctttccagagaacagcttgtgccccacatataactgaatcttaaaataaattttattaggattcctattaccacctcagcatgcctgtgacaccccattgagaatctcaggagcaagtcctacatatccgtggtagcaacatgttattttctaatgttcatgattagtttgtttttgaaagagtaaaatctgatattctaaaattgcatgtgtagtaaccatgaataaataattttgaaccattagactgattctaagagtcatgtataagagacccagcttcttttagccaccctggaggcaggaaccactttgtcttgttcacacacagacctcaagtgcataacaggtgcctggcacatagtgttcaataaatatatagagttgctaagagaatgaaaaatctatggtcgtacttcacatattatagtacccagaagatcattccctagtagagtggcaaggatattgaatttggaattgaatagctaagtatgaatacaaaagagttagggtatcttggagacagttttctgtacattgggttgttttatagattaagataataatagaaacaacttgggaaactgtacaattatgatacatattcttaaaagttattacttcacttgagcaccatattacctagtttttttttttttacttcgtttgtagttttactcctttggatgcaaactgagaaagccacttaacattatttttacatgataacactaatattccacctaagctagcggtccttaaaaagcttagaacacttttaactgcaggaagacaactgtgtattcttaacatgtacctcatttgataaaaaagaaaaaacatgttaaaacatagatgaagaaaatatctattgatgcttttaataaatcctgctagtctagtgcctagaacaaggaagctaaaggtaaaaatatgcactagaaattttgaaatcggggactttgatttcattctctatttaacatatttggtgggcaagatggtcatttaaatatgctgtatcaattgtagatttagtaaacatttctttgttcattcagctaaaattcattgagttcttttgaaatatgttgatgtattaatttggcttgtctttgtaggtccagttgataggcagtcacaatagagtgccttagaaagacaagagctgcctgattactagtctagggcagtgatattatggttagaaggttatagtttggcacaaatagcctagatcagatttgcagcccagttacttgttagtaacttaattgtgtgcaacttatttaacataagccttgattttttatctgtaaagtaggcatactattgtctatgccatacagctgttatgaagattaaatgaaattatgattgaagggcatttgttatagtatctatcatacaaagcatgctcagtaactggcagctcttgttatttatgaactctgaactttactaatggtaattatctatgaaaatatatcagataggtacactctgtcttatatgccatacttcagtgatgataggtttagacttcatggtgttttttattttcgcctgctttaaaacatatgattctttaattatattagaacatttaaagtctgaatattggaaaataactttgtactgtgtgtatacaaatttggccatgtaaatataaaacttactgaattatcaaatatctgatctcatttttgtggtattaattgatccaagtaatttaccacctgtcaatccctgtggatagctggaaggcccaagttgatagattgtttaaagaaagcacactttgtttcccaaaaattgaaaaaaacatgctagctttatgagctgactagctaaaccaagaagaaattaaaaagaaaaacacttaaatagcataagaggaagtaatgagtatactcttactgtagtccttgtaactcctctgaagaaaatacaaaaatattttctttgaagtgtattaagttctgtgagtttcagaaatatagaaaatgttctcatgtaagatataaaaaaggttgaaaatgaaggaattagtttgcattgcctgtgtaatcaccttaaagtaataaattaatgaattatctcaaatcaagaatttatggacattcctgtcatatttcaataaaagggaagcttaaaaattaatgtatccaaaggaactgaaagcttgtattcacacagaaacctgtacatggatagttatagcagcctttttcataattgccaaaacttggaaggaaccaagatgttccttagtaggtgaatggttaaattaagtgtgacccatccagacaatggaatgattcagtgttaaaaaacgaataatcaagccatgtaaagacgtggtgggtggagtaaacttaaatgcatattactaagtgaaaaaagctaatctggaaaggctacatactgtatgatttcaactatatgacagtccagaaaaagggaaaactatggagacagtaaaatgatcagtggtttccagggatatccagggaggaagggctgaatgggtgagtacagagtatttttagggcagtgaaactactctgtatgatactataatggtggatacatgtcattataaatttgtccaaacccataggatacgcaagaccaagcatgaactctaatgaaatttcagactctgggtgataatgatgtgtaaatgtaggctgtgcatgtgtaggagcagggggtatatgggaaatctctataacttctgttcaattttttagtgaacctaaaactgctctaaaaaataaaatctgttaaaaattaattatcatgtcaacaaagagataattctctcttcccagaaactacgtttggcattttagtctaaggcaatgaggatgtgggctggcagcaatatttatttcaacacagtggataggagcaaactgttggaaacaatcaaaatgtccagcaatatgggcagtgtttcagtaagttatatccatgtgaaagtattcgaagtaattttctagagttctgttttgtggcagattccatcagttgaattcccaatatcttttcctttgttctcgtatgctaacaaaacccagatattgttcagggtagcagtgtccactgctccaggcacaaaatggtaacaatcctatttccactttcctagctttttttttttttttttgcaactaggtgtggtggtgtgttccagttctggtcaatgaaatgtaagggaagtctaatggatgcttttgagaaagcttttttctctcctaataaagggggcaaatgtgaatgccagcaatcctccactgcagaccttatgttaagtgagaaaaaattagctatttgttaagcaagagttggttgggttttctgttacttagagtctgtaacgtactgtccagatccttttcgagacttccagatagtgggatactgattgacagcctttatccttcacttatctccaggagttgcactcagttgaagtcagctgccttgcccagtgtcatacccgcttcccaggggccagcccacatcaaaatacacaagagtataagggcccagccttgtttctttaatttgggcaaactctcccaggctctctcagctccagagctggagtctttctggatactgcacctttctgcctaatccttctttattccctttccccatagatactgatttcaagagcatttcctaataattttcctgctcagatacacacacacacacacacacacacacacacacaatcttagctcattgtcttatacattctattgctcaagcaatagtatatgaagcattagagtttttgaaataactgtaacattttacagaaatgacagtgaaatatgagctaatataactattagggataggaaaagcaagtgtttttgctactctcccgaacagatggaaaccagatgcatctgtgggttttttccatacatcaagccatcagttttcctttggacaccagctgggtgtcctaaaatgcaactgtgacactatgtaccttgagatagtgtcagatcctacaggttaaggtctcagttccactagactacccctatatcagatgccacttgccagccccaggttgagatctgtgcttctgaccagttgattataaattagggttcccacgaccccctccttgggcttcattaatttgccagatcagctcacataactcagaacactatgcttacttttacccatttattataaaggatattataaaggatacagatgactagccagattaaagagatggataggttaaggtatggtagaaggggtgccacagtccaggcagctccacaatttgagcaacctggaaactctcagaaatccatcttttttggaaccctcatatactgttggtgggaatataagttagtacaaccactatggagaacagtttggaggttcctcaaaaaattaaagactggacctaccatatgattcagcaatctcattactgggtatataccccaaagaaaggatagcagtatatccaagagataactgcactctcatgtttgttgcagcactcttaacaacagacaagatttggaaacaacctaactgtccatcaacagatgaatggataaaggaaatgtggtacatatacactgtggagtactattctgccataaaaagaatgagatcctgtcatttgcaacaacatggatggaaccggaggtcattatgttaggtgaaataagccagacacagaaagacaaacatcacatgttctcacttatttgtgggaactaaaaatcaaaacaattgaatacagggagatagagagtagaaggatgggtaccagaggctgggaagggtagtgggaggtgggtggaggtggggacagttaatggttacaaaaaaaaaaatagaatgactaagccatactattgactataggcacaacagggtgctcacagtcagtaattatacatttgaaaataactgtttaagagtaaattagattgttagtatcacaaagaataaatgcttgaagggatggataccccattcttcatgttgtacttatttcacattgcatacctgtatcaaaacatctcatgtaccccataaacatatacacctattatgtaccaacaaaaatttaaaagttaaaaattaaaatatagaaatctgcccttttaggtttatttggagtcttcattacctaggcatgattgattaaatcattggccattggtgatcaactcaacctttgttccttcttccttcccctgaagttgtgtgggtgggtgggaaatgaaagttcctttctttttctaatcatatggctggttcccctggcaaatactcccccatcctgaggctatccaggctatgctgattagtcatctaatcagcatgaaaaagataccactgcttgtagatcccaagggttttagaaactatttgccaggaaccagaggcagacaccaaatatacatttcttatatcacaatatcacagtatttggtgctgtgctaggtttggtgctatgtaagaacaggaatagaaacagattttttttaaactttctgtatcatggtgaaatactttttgacccttgatgttgcaaatcaagacttgaacatgaaattttaggtgaacttcatcttggtgaatttcaactctggaaggattcagcttttgcagaaaacttcaattcacttttgtctatagtcagcaataaaatggatgcttcctgacctttaaatttcaaaagaactatttcaaatcaattttgtaagagacctttcgatgataatgtgcaaacccatccgtccaaaaagagcaccttctttgaaaaaagtgatgaagaatcaataaaaattgttttcagaaatctctataaagctttgcatgaataggatagttatgctaatataaatgttttgaaactttttagattattcaaatctttacatttattgtgactgtctttgagctaagtatcagttttggctacaactttaaaacaattttttttcaacagactcatctttcacttatgaaaaaacaaattgtcaatcttttcactaatctccttacctgtctgctatacattttcaagcgtctgatacacagagactcgaagattatcccaatcttttgtaacaagaaaccaacccattgctgtacccagctggtcagcagtctttaggtttgcaaatagtgattttgaaacagatttgtaatttggaatcttcttctgagatttctatactttaaatacttttaaaaagggtattgtaacagaatactcaattaaaatattataggccaagcccataaatattttaacattttattaatattagaatagcagaattgatctacaggctataatgggcctctacttgttatttactttttctctaaatgaagaacatgtacaaattctggtaatatttgctgaaaatcctatttaatcatttcattaccccttttgtttttccatcaaatactatctaacatctaatcaaagtcaatataattgctattatggtaatgatttgttaacatgaaacaatttttccaactctgtaataaaacaaattattgtataattaaaaatgtacataaacccaactgtacataacttactcttccagttctctcctttgcctctcaaggaaagtaaaattgactgaagaaaaaaaatatgtatggagagagactttagctaatcagtgcttaattaatctggtataatccttcttcagaaccatgggatcatcaagtcctggcacttataaaattagtgggtttgggttacaatagattttgtgtttttttcacactcatgtatggtaattttaatagttactatgttttgaagcatgtcgatgtgcccatctccttacatataatattgctaatgctcacaaacttgatatttgcttctcacagaaaagcaatcctagattcgctaaagaagtttgcccaatattgcatagcaattaagtggaagagttaaggttccaatttatggtgtttactccaatgcaatatttttcccattacattattaacatttcctcgatcccctaccctggaggcaccctccactccctgacatgcgtgcacgcagacacacacacacacacacacacacacacacacttttttttctgactgctgttagcctaattaggctgttagcctaattagtagcacccagttccctaaaacctgaagtcatgatggcatattgtgttatctccttcccagagtacatgtctctggaccatcccacacctgaaatattttctcaaagtaagcagaatcttcctgcctcatatttaattctttctgagactgccctctaaattctactgaggattatgtaattaataatggcttactacattatttttcctagagagcaaaattaatattttaacccagaataataaatgggcacacaaatatcttgatacctgcaagagatatttttccttatttagaggattttttcagctaaaaaaaaatttctaaaaaactttttagaaaatcatacaaaaaaacccagcaaagccctctttgcttatgaacaatggccattctagagctttcagcacttaactgctatgaagttatggtaattccttaggaaacagataagattacggctgttaggattttcagtagcctaaaaaatagatgagtgtattaataaacataatttgacttggcaagggtttttgtttaacatattaccaagagaccttataaagattacctactagtttactatatacataataatatacataatgtatatattatgtgcataatagattgcctactaatctaccttagcatccttaaaaacagtcaacttttgttttttatagattgtcagtacttatatagctcctatgtactatgtataatgatgctttttataaatgtagagatgaataggaaatacttcctgtcttcaagactttcagtatgtgggtgaaatcagcagcattttttatttaacatttatggtatcatatatgcagatatcccaaagagacactccagaaagctttcaaaatagagtccataatgtcttccaaaccttgtccaggaatatgagaagaagagtagacaaaaatccctcaataagccaattcttagagtgcatgcttcacatgcaaatagaattgcagaaacagctttggctgttccttaccattcctagggcaaatatacacattaaactctcatttcagaaccagcttacaattaaaataaataattcagtttttacttggtgcaataaatcagcgtatttattttgcatgaatattacgtaaacttttttgggttctatatatcttgtagacacttgctcttaaagaacatgctgtagtgataggaaaagaaggtagcaaagatattataaaattagcacaagatgttatataattgagtaaaatgcataatgtaggccaagaccattctgtaaaaatatgtgagtcacatgtgtgattttgttatctcatagccatagttttaaaaagttgaacaggtgaaattaattttattaataaatgtattaaatttaatatatctaaaatattataatttaacataatataaaattattgagacatttataatttttatactaaatctttgaaatcctgtgtgtatttacacttacggaacatcttaatttggacaagatgcatttaaaagcaccaatagccatgtgtggctataggctactgtattgaacagttcaggataaggttagaattacagatgttcagagaaagagaagaggtgtatagtatatgcaacacttgttctgggtcatgaaagttgtgtagaatttgtgtagatggagggcaggagtttataatagtaaggaggaatgccagatttgaaacactgtttactgaagattatcatagtagttccagctgttgaacaggttaccagtttatcatatacttcaggttactattaaggaaagttgatacataatttaaggagtgtatagtacccaattagttattcttaatattttttcccaaggacattggacaaaaccataaggttacacagtatttccaaagaggtattaattaagtataatagtaatctttcaagatattatgaaagtctaattctttggtttaaatgtttcaaaaactaactctttttggtgattcataatgaaccctgacatactacattttcttggattcttggatgtactgtaagtaaaactttttttttttttttgagactgagtgtcgctctgtcacccaagctgctggagtgcagtggtgctatcttggctcactgcaacctctgcctcccaggttcaagcgattcttgtgcctcagcctcctgaatagctgggattacaggcacccgtcaccatgcctggctaactttggtatttttagtagagatagggttttgccgtgttgtccaggctagtctcgaactcctgacctcaggtgattcacctgccttggcctcccagagtgctggaattataggcatgagccactgtgacccgccgtaaataaactgtttaaattctgtttattacaatcttcccaaactggctggactaagggtctcattttcacagcactgctgttaatgttgatggatctggtatcctatagaatataggcttgagagcactgctctaatgcattttgtattttcagaagtctgtgtaagatatatttgaagagtgttttatcactgcttccacaatttaggaatgctttctaattctgtctttctgattacatggcaagtccgtcacatttaggtgatgagatttattcatttattcactgaaattactacctttcttctcatttatagaaatgcatttttcgtgaaccacagctgcttatgtgatttctaatggctcatataaattgataaatagtagacacagtactttgtttgtaactcattaaatattattttgttaaaatgtccaggaatatttgcaatctgtatttgattatccatgtatttttaactgattttcaaaaaatgatagtaaactgtaaaattttcagcagttttaaaaaagtataattacttaacactcacaaggtacatgcctacaccttgtctcaagaaacaactatgatttctgtacatattcacaatgtagacacagatactatcatgatttgtcacatgagtctacttttaaatatttaatcgtttatgataaagtagttgatgattttttctttttttattagactttaagttctgggatacatgtgcagaacgtgcaggtttgttacataagtatacatgtgccatggtggtttgctgcacccatcaacctgtcatctatattaggtatttctcctaatgctatccctctcctagctccccaccaccaacagaccccggtgtgtgatgttcccctccctgtgtccatgtgttctcattgttcaattcccacttatgagtgagaacatgcaatgtttagttttctgttcctgtgttagtttgctgagaatgacggtttccagcttcatccatgtccctgcaaaggacatgacttcatcctttttatggctgcatagtattccatggtgtatatgtgccacattttctttatccagtttatcattgatgggcatttgagttggttccaagtctttgctattgtgaatagtgctgcaataaacatacgtgtgcatgtgtatgtatagtagaatgatttataatcctttatataccaagtaatgggattgctgggtcaaatggtatttctggatctagagccatgaggaatcgccaccctgtcttccacaatggttgaactaacttacactcccaccaacagtgtaaaagcgttcctattgctccacatcatctccagcatctgttgtttcctgattttttaatgatcaccattctaactggcacgagatggtatctcattgtggttttgatttgcatttctctaattaccagggattatgagctttttttcctatgtttgttggctgtataaatgtctatttttgagaagtgtctgttcacatccttcacccacttttggatggggttgtttgttttctcttgtaaatttgtttaagttccttataaattctggatattggccctttgtcagatggatagattgcaaaaattttctcccattctgtaggttgccttttcactctgacgatagtttcttttgctgtgcagaagccctttagtttaattagatcccatttgtcaattttggcttttgttgccattgcttttggtgtttcagtcatgaagtctttgcccatgcctgtgtcctgaatggtattgcctaggttatcttctagagtttttatgatttttaggtcttacatttaagtctttaatccatcttgagttaatttttgtataaggggtaaggaaggggtccagtttcaattttctgcatatggctagccagttttcccaacaccatttattaaatatggaatcctttcccttttgattgtttttgtgaggtttgtcaaagatcagatggctctagatgtgtggcattatttctgagacctctgttgtgttccattggtctatatatctgttttggtaccagtaccatgctgtgttggttactgtagccttgtagtatagtttgaagtcaggtagtgtgatgtttccagctttgttctttttgcttaggattgtcttggctatgtgggctcttttttggttccatgtgaaatttaaagtagttttttctaattctgtgaagaaagtcaatggtagcttgatggggatagcattgaatctataaattactttgagcagtatggccattttcatgatattgattcttcctatccatgagcatgggatgtttttccatttgtttgtgtcctctcttatttctttgagcagaagtttgtagttcttctttaagaggtcctttacatcccttgtaagttgtattcctaggtatttaattctctttgtagcaattggtgaatggaagttcactcaagatttggctctctgtttgtctgttattggtgtataggaatgcttgtgattttcacacgttgattttgtatcctgagactgctgaagttgcttatcagcttaaggaaattttgggctgagatgatggagttttctaaatatccaatcatgtcatctgcaaacagagataatttgatgttctgtcttcgtttttgaataccctttatttctttctcttgcctgattgccctggccagaacttccaatactatgttgaataggagtggtgagagagggcatccttgtcttgtgccagttttcaaaggcaatgcctccagcttttgcccattcagtatgatattggctgtgggtttgtcataaagagctcttattattttgagataggttccctcaatacctagtttattgagagtttttagcatgaaggggtgttgaagcagaaaggtatgaaggccttttctgcatctattgagataatcatgtggtttttgtcttcggttctgtttatgtaatggatgactttattgatttgcatatgttgaaccaatcttgcatcccagggatgaagcctacttgattgtggtggataagctttttgatgtcctgctggattcagtttgccaatattttattgaggatttttgcatcgatgttcatcagggatattggcctgaaattttctttttttgttgtatctctgcctcgttttggtatcaggatgatactggcttcataaaacaagttagggaggagtccctctttttctattgtttggaatagtttcaaaagtaatggtaccagctcctctttgtacttctggtagaattcggctatgaatccatctggtcctgggctttttttggttggtaggctattaattactgcctcaatttcagaactttttattggtctattcagggatttgacttcttcctggtttagtattgagagggtgtatgtgttcaggaatttatccattttttctagattttctagtttatttgcgtaggggtgtttatagtattctctgatagaagtttgtatttttgtgggatcagtggggatatctcctttatcattttttattgtgtctatttgattcttctctcttttcttctttattagtctggctagcattctatctattttgtaatcttttcaaaaaaccagcttctggattcattgattttttgaagggtttttttgtgtctccatctccttcagttctgctctgatcttagttatttcttatcttctgctagcttttgaatttgtttgctcttgcttctctagttcttttaatagtgatgttagggtgtcaattttagatctttcccgctgtctcctgtgggcatttactgctataaatttccctctaaacactgctttagctgtgtcctagagattctggtacgttgtgtcttggttctcattggtttcaaagaacttatttatttctaccttaatttcattatttacccagcagtctttcaggagcaggttgttcagtttccatgtagttgtgtggctttgagtgattttcttaatgctgagttctaatttgattgcactgtggtctgacagactgttatgatttccattcttttgcatttgctgaggagtgttttatttccaattatttggtcaattttagaataagtgtgatgtggtgctgagaagaatgtatattctgttgatttgaggtggagagttctgtagatgtctattaggtctgcttggtccagagctgagttcaagtcctgaatatccttgttaattttctgtctcattgatctgtctaatattaaagtctcccactattactttgtgggagtctgagtctctttgtaggtctctaagaacttgctttttgaatctgggtgctcctgttttgggtgcatatatatttaggatagttagcttttcttgttgcattgatccctttaccgttatttaatgcccttctttgtctcttttgatctttgttggttcaaagtgttttatcagagacgaggattgcaacccctgttttttttctttttcttttttccatttgcttgataattattcctccatccctttattttgagcctgttgtgtgtctttgcatgtgagatgggtctcctgaataccgcacacccatgaatcttgactctttatccaatttgccggtctgtgtcttttaattggggcatttagcctgtttacatttaaggttaatattgttatgtgtgatctgatcctgtcattatgatgcattaagttgatcttcaatctctgatatcctttcttctgctggattgatttgtctgttgatacttgtgaatgcctcatgaaattctcatgctgtgtttttcagctccatcaggtcatttatgttcttctctaaactggttattctagttagcaattcctctaaccttttttcaaggttcttagcttccttgcattgggttagaacatgctcctttagctcggaggagtttgttattacccaccttctgaagcctacttctgtcaattcgtcaagctcattcaccacccagttttgttcccttgctgccgaggggctgtgattctttcgaggagacaaggcgttctggtttttggaattttcagcgtttttgtgctggtttttccttatctttgtggatgtatctacctttggtctttgatgttggtgaccttctgctggggtttttgtggggacgtcctttttgttgatgttgatcctatttctttctgtttgttagttttccttctaacagtcaggcccctctgctgcaggtctgctggagtttgcttgaggtccactccagaacctgtttgcctgcgtatcaacagtagaggctgcagaacagcaaagattgctgcctattccttcttctggaagcttcgtcctagaggggcacccgccagatgccagccagagtgctcctgtgtgaggtgtgtgtcgacccctgctgggaggtgtctcccagtcagggggaatgggggttggggactcactttaggaagcaatctgtcccttagcagagcttgagcactgtgccgggagatctgctgctctcttcagaggctgcaggcaggaacgtttaagtctgctgaagctgcgcccgcagccaccccttcccccaggtgctctgtcccagggaaataggagttttatctataagtccctgactggggctgctgcctttctttcagagatgccctacacagaggggaggaatctagagaggcaggcagtctggctacagtggttttgtggcgctgcagttggcttcacccagttcggacttcccagcagctttgtttatgctgtaaagggaaaatcgcctactcaagcctcagtaatggcagatgcccctcccccaaccaagctcaagtgtcccatgtcgacttcagactgctgtactggcagcaagaatttcaagccattggatcttagcttgctgggctctgtagacatgggatccactgagctagaccacttggctccctggcttcagcccctctttccaggggcgtgaacggttttgtctcggtggcattccaggcaccactggggtatgaaaaaaaactcctgcagctagctcaatgtctgcccaaacggccacccagttttatgcttgaaacccaggtccctggtgatgtaggcacctgaaagaatctcctggtctgtgggttgcaaagactctgggaaaagcatagtatctgggccagaatgcactgttcctcacagtacagtccctcctggcttcccttggctaggggagggagttccccaaccccttttgcttcccaggtgaggtgatgccctatcttgcttcagctcgccctccgtgggctgcacccagtttctaaccagtcccactgagatgagccaggtacttcaggtggaaatgcaaaaatcacctgccttctgcctttatctccctgggagctgcagaccggagccgttcgtatttggccatcttgccagccaccgagtgccaaacatctacctattttttcttatgtattgtttttgttaggctttgtactgacaataattaaaatatttgcctgagataattttcaggtctcctatttttacccttccagaagatgctcagaggcttacttgtttataagaaattgggccagtgaccatttggacagtcttctattccttattgcctcccttcactgtataaagaagctgtaaagggtgacccgctgaaatagatggcggtatgggtgtggaaatcagtagacactaagtgttctggtcatgagagcccaagtgaggggcacccctagtcaagccttgcacagaggagtggatttgcccttggagcattctgtgtactactatcattggtagggatctgggcaatgagtagtggaacagatggtggaggggcagaatctgagggcaatcagttctaaggtaaaggtgaaggagtagcagcctgactaccctaggccagtggtgtggtcccagtcttgcttggagtagaagtctggccatgccccttttgatctgcgtatgtctgcactaccagaggggcccatgacctttgcctaaaaaataatactagatttctcatgatctaatcagtgagaccttaagacagttctaattttatttgagaacaatggaatgtataataacatgttttctgtgtgtggcattgcattttgaatttcagttttcctttactttgggccaattaaatctttaggacttcctttccaaactaaatttctctgagtgaccaagctcattgtgtctgtttgtctagtgtttttttttttttttaatttttcggtatagtactgttttaaaatgtaaatcagattaagaattaatctttatcaatcattgttaaaggactgtcctgtttaatttttctcctctgggattaagtgacagcatccccttatatgttttgttttggtttggtttggtttgtgcagtactttaatcaggcagttttgtctgttattaaaatttctgaagcctttctctctcggtatcttgctgtttttctatgccctaatgttagcaaagtaaacacttggacttcctgcataatactaactggaggaatctctttttcccttccatgctctgtttgcactctttcaatggcccaagaaacagctatgtaggtaaaaggtcttttgttaaaaagaaggaaattgagcagtcatttcccttttccttctttgacctgtatcagcaggcaagtggttgttgctatgatcttttcagtttacactgtttaaaagaatcaatgattgtttcccagaactttgaaaaatctacacaaaaataatttaaaatgaactatacatatatatgttttgtcttaaagttgaattatgaagtttaagcagttgtcttcatttgaattgatgatagctatttgttgtatgagtttcaggtattctgctatcatttcttttcttttcttttcttttcttttttttttttggacaggatttcactctgttgcccaggctgaagtgaagtggtgaaatcacaactgagtacagcctcaacctctggggctcaagcgatcctcctgcctcagcctcttgagtagctgagactacaggcatgtgccaccatacctggttaattttttaaattatttgtagagacagagtctccctatacttcccaggctgctctagaactcctgagctcaagcaatcctctggcctcagcctcccaaagtgctgggattatgggcatgaactaccgtgcctggcctggcgtctgctatcatttctaataaaataaaagacacagatggcaaaactctaaatgattgtatgactttgttaggcagtggttttgaaaagcagaatacttaaaatcctatgtaaaacattttgtttttttttaattaaaataattccattttcacaattatgctttatgatttaattagctttatgagaattctgttgtcttatgggagagatgtgatttttgtttatttcagttgtcttgagtgtattctcagactttcaacagtttatatttcccttagtctactagctgttaaaaacagtccagtttcataggcatttttgttttacatagtaatatcagacaatgatagggaacttagtaacttttctttcaattttggggaaaaagataaagtccttgaaaaattctttttaaactgttccttggaagaataaaagcatttgaaatccccatgtgcaacaagatcagcagatcttcaattctcaactttaagaactgcaagcccagaaatttgtgggtttcttaaacccctatttttagctatttgtaaaagtcatatctctaccttcattgtctcttgcttcagagaagacatggttagtcctgtaatagtccagcattagtgctttcaagggaaggagaatgattgcataactggttacatttaaaatgagtaagaatgaagattcttgagtgttgctcacaggtatataggaaaaggagctactgttatgactgtggaatctccattgcattttattagatacaagaaaagcacgaatgccagaccagactcaagaagagaacaatttgactctgctttcaaatggagtggcaaaatcacattgaaggaaagctggtgggatgtagtattcttatacccatggttggcaaatacagtcagccacaacagtttaccctaagaatcttggatttcattccatatgtgattaacagttagtgaataatattagttgtaataatgtaatcagaaacatgttttaggaagtttactgatgaattcttgagaggaagaagataatcaaggaagtcattgtgttttgttttttgcttttttttcctctcaaagattcttgagcacatctgtaggcagaatagacagaagtagaaaagaagaaaataacaaataatcttaaagttggacggaaacacagaatacttctttaacaggacaaacgatcttagcagaatgtcaagttcaagtgcagacaacaaccgctgtcagccctttagttatttgaatacagctctcatcatatacctgctttcattaggtagaaaaatttcaagatgtatcataaaattggatactttcttcgggagattctttgtcttgtctatatcactttcatcaaagcatcttatagtccagagatttttaaattgccacaataagattcccaaatattcccacatattcactgtaaagagctcaagttttgaggagttcggaaaagcagctgtatttgtttgggttgtcatgtatgtatatatatctccacccaatatacaaattggttttgtttctttaaatgtatgatggaaactaatgcatttgagtatctaataatcacaatattttcatcttgaaatatatattactctgaatattaaaaagttgaaaattccatcttaagggactttactttctctgtttttattcacatcaagtttgctttctttatgttgtatcacttaaaatggtgacccatctcttatagttaaatacatttgaaggattgactttcttcagtttttaaggaatacaagaacaaagtagagaataaatttaaccctgaataaactatattacatatttaatcaagttagaaagttgtttactagaactagtttatatctgacgtactggaaataagtggtatttggagagtttgaaactccaaaagagtatagatatattgtatgtctgataatgctaaggagaaaattaaagtaagatgaggagaaataggagtgcaatggtagttgcattttatgtaagatgttcacaaaaggtctttctgcaaagatagcatttgagcagagatctttgggtggctaatttgtgggaagaatattttaggcaaagagaacatcaagtgtaaagacctcttagcaggagaggactgggcctgttgatgaatgagccaggagaacagtgttgtagcagagtggttaagagggagagtaatggcagatgaggcctaacatgtgtatgggggaagttagatcatgaaggcatttgtaaggattttgggttttatctgtgtgacatagtaaaggttatgcgtgctttataaggaagagcaacatgatctgacttctgatttgacaggtgcactctggcatcagtgttgaaaataccctgatagcagggtaatcaggagaaagcaatggtagctgacagggtggtagcagtggagagagagtcataaggaattgctagaggattaatatgaagtgtgtgagaaagggacataggatgcctggtttttagattggactgtaaatatggaattgccattttctgagatggggaaggagattgtgagatgagcaagtatttggaggaaaaccaggtatttcctttgggatgtggtaaggttgagatgtctattggacatctaagtgaaaatgttgagtaggccatagaatatgtgattctggatttcacaggctagatctgggctggggatagagatttggaagtccacggtatatagctgggcatttaccacgtggaactaggtgagatcacctggcagaggggtgtacataataaagaggagaggtccacgaactgaactctgaggagtgtgcacttgtggagattgtggaaactatgaagaagaaccagcaaatgcttggtgagggacaagccaagaagtgaggaggaaaaccaggagagtttgttgtactcgacgccaagtaaggaaagtacatcaagaagggattagtcaacactgacagatgctagttcttaaataaggtgaggactgaatttagcagtggtcttagcaatatgaagatcattcattacttggacaaaagctgcttcattgaaattgtggtgacaaaaacttgactggaatatctttaaatgaaaattggagaaaacagaagtagagacagaaaggatgagagatgcttttgaatgatttagccataaaagagagaatagaataagtcaatagctggagggaggagagggattaaggaatttttgtttgtttttaaggttaatacattatgtttataaggaataatctgaataaatttgtaggcaataatctaaagaagataaaattaaccatgtaatggagaaggaatgcaatttctggaatgaggcgattaatttgctgagaggggatggaacgcagtgcaaatatgggagagctggccttggatagacacaggaggtgtttatctttagcagtggtaagaaagggagattacatggacagagttgcaagtggattgggaatgtggaactaggagtctatagaagttcttttcaaaatgcttctatgttttcagtaatagaccaatgtgagagtgaggataataggagaaggtgttggaggtttgagaggagagtaaagaatatgaatatatcacctaggcgagttagggatgcactaataggattgctggagagcacccagggaaacgctggagattaaagcttatgattctaaaatgtgatcactcagcataatcagtaaatattgttcacaaaaatgaattaactgtgaatttctcagttattttgacatcatgtagccatgcagttgctaggtcattacaaggcaataaaaagtagatgtatttcctaaagaaatactgtaagatctggccaagtcagtggatttgctacataacaaaggcacaatcagagtttctgctaattcagtcctagatgagagtaaattgtgaaattagaacaatcatataggcttttgagataacagactttaaaaaaacatttttctacttttataaatgaagaagctgaggtccagagaggttaaaggattcccttgttgtgaatcacattaccttttacaaagaattttgaatattctagtaaatatgctcttccaggaatgttacattttattctaattttattccttttaatatagcattcctgttaggtttttcaatttgtgtttgattgtacagttatgtaaattctttttgacagatttgttattaagggaagaaagatgagtatgaattctaacagctcattaattttaaagaaatgtgtcatgaattaatgctttgagtgctatatttttctctttacattatgtttttctggttgaatagaattctatcaaaataaataggttatttaaaaatgattaggtaggagctatataaagattctcctaagcatgttcaccgttcctgagaaataggttgaatgtaatacccaactagtgaagcattatcatcagcaatacatgattacattgtagcctttctttacaaagctagttataaaaaatattttctttgtaaaaggttttcaaagtgtctttcacttgagtgagcatttagtgaattaaagtcctttcaccaaagtatatatttcttaagcatattgactacaaaaaggatgtccttgacctacttgtttacaggaagtgaaatcagttactttcgacctttagtatagtagcaagtttaatgaggggtgagtaagctttcactgtatagatttcaacatcacctgactttcttgaagttcaggaaaaacaccatttatctcagtttaaaaatatgcacacctggttaaaaaaaataaaagcaagttcacactcctctgtgctctatttgacagataaaatatacacagggcactagtgatcaaatgtgggtcaaagtatctgctttaataatgggcaagatagttcccaataatttcaaaatatagaactttctggcaaaggtgcaatggaaaatgtatcttagacctgaggctaaattgaaaacctgcctcagatctaatctttggaaccccagatctaatctttggaacccactcactgtccaacaggctttactacctgagaacatgaagcaggagagaagggcaggggcgaggtgggggcctgcacagggtcaggatgtaggaggtgcagaagacagagtttgtagtgtgtgtgaatatgtgtgtgtgttctgtatgtacgtggataatatctaatgaattccgctcaccaactgtgaaaaattctgatggataaaatttgtcactctttatccctgaagagatttgaataagttggtagaaaggagcagaaactttttatataacacagacccttgctactcaaatgtgtggtggttcttgaatcagcaccgtctgcatcacctggaagcttgttagaaatgcagaatttaaggcttaatcccggacctactgaatcagaatgcgctttttaacaatacttctctctactcctgggtgattgattcatgcattgaatttgaaaagcgcttcactagttgccagatgttttgctctaaattccttcttctgtgtactaaggcataatataggaaagactcaaaggatttctccctacagctggagttcataagcttccattattgaagtgaggtgtatagtgtttttgagatagtccagtggatgggaatgtttttaagatctttcaactacaaaactgtgacagtcagagcaacttatattaaagatgtgcacattacagttctgtattagatatcatttataaaagagatttccattgactttgttgaagatcagatggctgtaggtgtgtgactttgtttctgggttctctagtctgtttcattgatctatgcatctttttttgtaccagtaccatcctgttttggctactgtagcattatagtatagtttgaagtccatagtacagtgtgatgcttccagctttgttctttttgtttaggatttctttggatatttaggctggttttcggttccatatgaattttagaatcatttttcttctaattctgtgataaatgatgttggtcacttggcaaccaacaggaatagcattgaatctggaggtttcctttggcagtatgacaattttaacaatgattgattcttccgacccttgaacatgggatgttttccatttgtttttgtcatctgtgatttcttttagcagtgttttgtagttctccttgtagtgatcttttacgtccttggttagatttattcctaggtatttaatttttttgtgtgttgctgttgtaaatgagattacattcttgatttgacttggatgttattggtgtatagcagtgctactaattttcgtacattgattttgtatcctgaaactttcctgaagtcatttatcagctccaggagccttttggtggagtctttagacgtttttttgttttttatttttgagatggagtcttgctccatttcccaggctggagtgcagtggtgcgatctcggctcactgcagcctccacctccggggttcaagtgattctcttgcctcagcctcctgagtagctggaattacaggtgcctgccaccatgcctggctaatttttgtatttttttagtagaaacagggtttcatcatgttggccaggctggtctcaaaactcctgaccttgtattccgcccgcctcggcctcccaaagtactgggattataggcatgagccaccatgcccagccctctttagggctttctaggtatagaattatattgtcccaaaagagagataggctgacttcttcttctcctatttggatgccttttatttccttctcttgcctgatagctctggctggcacttccagtactatgttgaataggagtggtgagagtaggcattttttgtcttgttctggttctcaaggggaatgtgtccagtttttgcctgttcactatgatattggctgtgtgtttgttataaatggctcttaatattttgaattatattcctacaatgcctaatttctttttctttattattattattgtttttttgagacaggatctcactctgttacccaggctggagtgcagtggtatgatcatggctcagtgcagccttgacctcccaggctcaagagatcctgccacctcagccttatgagtagctgagactacagacacacaccaccacatctggcaaattttaaaatttttattgtatgtaggtgggggtcttactatgttgcccaagctggtctcaaactcctaggcttaagtgaccctgctgcctcagcctcccaaagttctgggattacaggcatgggtccccatacccatcccttaatgtctagtttcttaagggtttttatcatgaaaggaggttagattttattgaaagctttatccatgtctactgagatgatcatgcggtttttgtttttaattcattcatatgctgaatcacatttatttatttgagtatgttgaaccaaccttacatctcaggaatgaagcagacttgatcctggtgaattaactttttggtgtgctgttggattcagtttgctagtattttgtatagtatttaactattgagtactatgttcagcatatgggtgctgggatcatttgtaccccaaaacccagcatcacacggtgtttacttttgtaacaaacttgcacgtgtacccctgaatttaaaataaaaattgaaaaaagagagatttgtgctgctaatttaaaaaagttgtaaaactcaaataagaaataaaacattaaacttgcagtgaggcagtctggctttaattattgagttatatacagctagctacataataagggcaagtgataacttttcagggtcttaatttccttaggagtagtttactcttcatgggctggaagtggggttggaactatataaaaatgtaaacatgatacgaaaacctgaaactttaaaataacttgaaaaagattaggccaggtgtggtgactcatgcctgtaattccagagctttggaaggccaaagtgggagaatagttaggaccaggagttcaagaccagcctggacaacatagcaaaaccctgtctttacaaaataaataaataaatattaatatgtctatggagtaggatgcctgtatatgtgtttggtgttagcaatgaagggggttatactattgagatttgatattgatgatcaaggctttttacgccctgtgaaagggtttggaatttgacctaaggttaaggagaaattattaaaggatttatgcaaaggagtgaagttggcattttagaaggctaattctggcttcagggcaaagaacaggagttgaaagatcacagagagagatgggttagaaatcatttgaataatctacatgagaataatggtaacatgaattagaagtatggaaatagggatgaggaaaatgaactttttgtgagaatgtatctacaggatgcactgacgtatttgttggggattgatggggagaacaatgtcattggtaattcctatgttttgggacttcattgtgataggaaatataggaggagaagtaagtttggaaagaaatgattaattctcttatcaggttattttttagaatggacatccaattgtagatgtctggtaaacaggtatgcctgaaatatttatcttgaacggtgtcagggcttatttttcacactacataatttatatattactcattctcatcatcccaattattatatatatgttgtcgccttcaaatctacattatcattctgtgtcacttacctaaaccctagtcccaagtatatttatctgtctcacttgtgagtttaatcttattttcaataaaaatcatgccttgctcttcattgtaaatgaagtggggatttttcagatcccactacttgtattgggcatatggactattgttcagttttagatactgacaagcatacttattttgtgagaaagattatgattgtactggttttgatatcactcttgtacctgaaataataccttgtaagtatcccatgcttaaataaagttattgagttaaatgctagaactctgagtctttagattgcttctataaattaggaataaggaaatagatctacgggaaatagcgtaataatgataagtaaaatattattaagaacttttatgttgctaatatttctctgtcttaaaattactaagaccatgtacagtagtttccccttatctgcagtttcgatttctatgatttcagttaacctgtggtcaatcctagtctgaaaataggtatgtatagtacaataagatgccttgagagaaaatgagaacacacatcacctttattacagtatgttgttataaaatattttgtttttagttatttttgttaatctttcactgtgcctaatttagaaattaaactttatcataggtgtgtatgtataaggaaaaacacagtatagataggacttggtactatctgtggcttcaggcatctgctgggggtcttggaaggtatcctctgtagataaggggcaaatacggtaattcaaaacatttaatttcatcacattagcacttatctcaaaacaacaaactatgcttctctggggcttattcttctatgattttttttttaactttgtcgcctatgtgattttttcccctgcacatgaatatatatttctttttgatttgcttttttttttgctttctgtgacttaagctatcactcttagattttaatgaacaggatttctgacaacataacaaaacagaaatcaggtttgatgggcttcagcatacatgaagtgcatatcctctctgaaaaaaattcaagcatgcaacacatctggcacgtttctgtactttgtatccgtctctcctggccaatcttgtgcatttgcgacagcaatgacattgatgaatcgctttaatttaccaggcagtggacaccttgccaaggctatctgtaagaaccagctagagctggtcctgatcatttcagatatgtgtattgtttcagaaaactgtaactgatcagatgcaatttagatgtatcattgcaccacaatcacacagaaatacatattttaataacctctggattttaatttttcttattcccttctccatttttgaaataaagataaataactatataaatatatgctaatttagttatgtggtaaaattaatcatgaaataatttggcaattttttgcattttgaagatgatttagaaattgaatttatataaatgggaattgatttttacaaaacaatattatctttatgtcatttaataagcaaggaatcattattttgacaataaaaaagttgtatcaatttttcacttaaatacttctaacctgaggtgggaaacaggcaatagaatacgtaaaatcctaaactattataagtttccgtggaaatatgcttaatggtagtctaagaaaaaataatcttgggaacattgtggagagagtagataattacatgtaatatgaagaggttatgttctcttgatgcttagagtatatgacagttatatatttttgaaaatcattcagagctaatattatatttaggtagactagatagcttgctataattatgtggtacaattacagcattaaaaaattcagcatatttacagagcacctaccatatgctaagacctgtaccaggcattttcacacataggcagtgcattagacagcatattgtattataacacacaagcaggatctggtgtcctcgaaacaaacgtcttcgcttgtcattttttgatattgatacctggaattctgatcaaacctcaaaacataaaactttcatcactattaaaatacaaattgtatctctatttcttaaaaatatatatttattctttcagggaattattacttgagtctttaataacatctaccctttggcatgaatgattactgtataatgtctgctgtaagcgagctttgacagcggaagtaggaatgagtttagatgccttgactatttgaactgatctggtacaggacaaaaactaagagccatatgataaagattgtttatttgttttgcctacattacatatcaagtgggactgatcctggctgcttttattaccactaattgaataaaacataactcatatattagataaatgaaatatttatacctaaatatctaagttattctttgttttttctttgtaatattctcagaatgactcgcatgttttcactctgtaacagtagtacaagcacatcaaattatcaaagagtaaattttgcaggctcaggtaacaaagcaagctggtgcatggaaatgatttctggggtggggatattcatgagacataatcttggggcaactctggtttaaagacacagggtcccgtatttggagaggagcgtatttagaaggggtcttcctggggccttctttccttaagaagatgtcttatttctcattagcattttaaaaaagagacctggataaaataattataatttaaaatatacttctatccattcctatcttttgtgttcttataattaattttccttccttctctttcacttcactattcatgccaccacattgaaacatttcctattgttgttagtaggagttatgtgcatagttcacaagatgaaatgttttaatagcattgcttctcttttaaaggcaagtttgggcttggctagatttaggagttgctttgaaaatgtggcttagtgtattgtttctaaatgacaatatgggaattagaacaagggaaggaacagatcacacaatttacgcacgtttattttatagtggaatttttctgttatctaaatttcaaagtgcctttttaatcccttggtactctctaccaacattggttttttaaattttgtttttccttgttttcaatgtatatctttcatattcacatttgcatgaataccttccataattatttcaaatgggaccttaatgaatacaaactctttctgatttcttttaattgaaaatttattgagtaaattatagattcatatgcagttttacatgcagagtttctgtgaaccctttgccaatttcccccagtgctaatatcttgcaaaattatagtacagtattataccctaggtatttactcaatccaccaaacagttagatttcattagttttccatgtatttatttgtatgtatatatgtgtgtgtgtgtttagttctatacagtttttcacatatataggttcacgcatccatcaccacagtcaagatgctgaacagttccagcaccacaagggttcctcctattccctttgtgtaactacactcatctcccttctgttcccccattcctaaccccatgcaatcactgatatattcctcatttctaaaattttgtagtttcaaaatgttgtataaatggaatgatacagtatgtaacctttttgattgactttgcctatgtgttttaaacaattgatatgtatttttttcactatggatttttgtcaaaagactgtaagtatgtgataaaagataatattgattttactgttatagattcagggtaaatttgtacttctttacattttagcatttatggaaattactaacccttcattatttatattgatggagggaccagagacccaattgcatggtacaaaatactacaggctatgaacaagaagtatgtgactgtgggtcagagaaatattgattgcattgatttttaacatggatgattcatgtggacattgatcattggagtgtaatatggaccaggttatctcaagggtgtcccaagtgagagacagaggtagatttggcatcagaatgtctagtagtttaccttatcttgagcctactttatgaccttaatggactgtaactgaagggaatgtgttaaatgtatacactgttaatccagtgatttcagtgaaataattttggatctagaagaaacaatataacgtaaaaaaagtctgtattgcattgaatatgacatgggtcaaagaaacttgctcattgtaggcccaaattacagaatttattttattgccttctcagtttatttgtcctatgggagaggaaataaacaaaaattaattaatattcttcacaattagacctttatgacttcaagaaggtagataatgtctttttcatctttgtatctcagtgcctagctagatagaacatgctcagtaaatatgtgtcgaataactgtagcttatgagattgggaagttgctaatgtaagtgcatattgccctagtactcttttcagtcaatattttcttcatgtgttagtaagagataggttggaatttttagcagcagtatcatacaaatctttagagattttatatttatctgtgtacagaacccagctaatcaatttgagttcattgttagagccccaattcatcagaagacggagaaaaggcagactcctgaggttgacatatgacaagggaatttctatagtttgcattttattcactttttcccaatgcccctttctattatcattgctttgtggggtgtcagtatcacctaacaaacatttgaagtgattttgaagatattgttataaaacagcagttgtaatggattactcggggtgctgcattgtacaatgaaaataggcttaagtagaaaactgctggctatctagaagtgtcttttgtggcaggaaatattttagatagtttgttcatcacctgtgtttatcgtttgctatcccagtctattataacatattttttctttcaattctctaattattataaagaaatgattacactgtggaacacacataatgattaacacatgaaacacacacgtatgttttacttcacactgatttaagatacattcgatggaagaagagatttctggcttttccacagttaatgtgtaatgtttggcatgtaatagacactcaaaacagatttttttgaataaatgagtggtagtatttgtaatttaaaactgatgcagagggatgtgccagtttcagtactgtaagggctccataaaggcaggatcataattagcctaattcttattagtatatttcttaatgactctgaattttccaagaacatcagagacttctagttcctggcttgtgtactctagcagctctcagtggtttagtgtgcaggcccttatccctctcatgtatacaacttcccaatcataagacaggcctgtaagatcctgcaaaatttggttctactctttctgcttctacccttcctgagtttaaaatgacttccttttttttttcttttttatttttgagacagttttcactccattgcccaggctggagtgcagtggcaccatcatggctaactgcagcctcagcctccatgggttcaagttatcctcccaacttggactcctgagtatttgggaccaccggtgcacaccagcatacccggctaatttttttttttttttttttttttttgtagagacaaggtttttccatgtttcccaggctggtctcagactcctgggttcaagccttctgcccaccatggcctcctaaagtgctgggattacaggcatgagccaccatgcccagcctaaagtgactttctgttacctattctaaagttaagaagaaaacaaaaatggaaaaacaagcaacctaaactataacctccactcttgagtgggacagatttctatagatctattatctcatttgagtctcatgacaacctgagaggtgggcattatattatctatttggcaattgagaaaatagaggcttatagaggctatgaaactaggctaatgtcataagtgctggaactagtctttggtcttatagcaataagattctaaagctatacagttaggttattgctggatttgtctctcctgcttttggtatagatcctacttgctctgtctgggccatctctactttttgatctattgctgttttcctcatttttgtctcttttcattccctggagattgatgctttagatatgctactggtttgataacagctttgcttcagtagtggattaaaattggccacagatgctttgctgcttctctcatcaagaagtgggatctatttttcctcctcttgaacccaggagataaacttgtgacttgctttgactaatagaatgtggtataagtaatactatatcagttatgggctttaagaggcctggcagccatcactttcactctcttggacccctaggccatcatgcaatgtggttggctaccctattagagatgctgcaaggagaatgagagagatgcctggttagctagcagttcttccacctagctcagctgaatcaccaggtgtgtgagtggggtaattttggatttcagccccaaatgagtgtgcagaaaactgcttctgcatgaatggcctatgtgagatcagcagaaaagccagccagctgagccttgctcagattgtaaaatcataagcagatacacagtcatgttaagccattaaatttgggagtgttttgttttgtagaaatagatatctgaaatacccagtgacttacacatttacttcatctccatatactgaagaccgagtgttagtttctatcatacctatgcccgtcccaagatactgggccctcaggcaaggtgaggttctagttcctctaggaaaggcaaagaaatttaagggatatggggtgttaaaattagacaagtgaagatgcagttggtataagaaaattcatatcaactatcagaaggctgcttttgcaagaggaatatagttggttttgagaattcaaggaatgggaagataaaacatgttgagaatccacatatgaataaatatatttaacttcagtgtgatgaagctttctttacaggtgcttcacaaaggggctttggctttccaccttgttgagatacgtgactgttgtggaggtgtgcttcttggtcttccttcaagaaagagcttgttcttcagctatgaggaatacagatagatgacaggtcttggctcccaaacctttagaatcctctgcaggattcaagctaaggtcatacttttccagatcatctcccagccaatgactgagcatgatggggtactagggacctgaccatttcttccaatgtaggattcacttgaccagttgtctttttggcagagtgccacatgggttagtcaagacagtgtggaatttttattgcattccctgcattgttctccatgtccaattcttcttaccctcttttttccccccacaaatgtcagatctgccttgtggtctgaaggctttctctgcataaccctttttcattcccctttacctttcctggtgttactcccagcaatctcgtacttctaactctggctcagcatctgcttctgagcaaggtacagttgagagaactaaaatggcaaatctatcagattaatatgatctgtagtttgtttgcttttaggtagagttggataatcattttacaacaattctaagaaaacttagtgtgttttactgcatgagatgccttttgaagtagagaagacatctgtctaaatcaccaactttatactttgggaaatctgtgttttttgccgaattgcaaaattgcattcgtcttatagtccttaaaatttattttacttcctaatatttgtaactacacagagtcatttgaatctgctaaacatagcacaaaaggtggatatacatcagtatttagtaaaagacatctatttaaattaagcaccttgcaacatgtattcagctatgaggaattttccgagcaagtagcattaacattgaaaattattatagagcttatggggggaggagccaagatggccgaataggaacagctctggtctacagctcccagcgtgagcgacgcagaagatgggtgatttctgcattttcgtctgaggtactgggttcatctcactagggagtgccagacagtgggcgcaagtcaatgggtgcgcgcaccatgcacgagccgaagcagggcgaggcattgcctcactcgggaagcgcaaagagtcagggagttccctttcctagtcaaagaaaggggtgacagatggcacctggaaaatcgggtcacttccacccgaatacagcgcttttccgacgggcttaaaaaacgccgcaccaggagattatatcccgcacctggctcggagggtcctacgcccatggagtctcactgattgctagcacagcagtctgagatcaaactgcaaggtggcagcgaggcttggggaggggcgcccgccattgcccaggcttgcttaggtaaacagagcagccgggaagctccaactgggtggagcccaccacagctcaaggaggcctgcctgcctctggaggctccacctctgggggcagggcacacacaaacaaaaagaccgcagtaacctctgcagacttaaatgtccctgtctgacagctttgaagagagcagtgtttctcccagcacgcagctggagatctgagaacgggcagactgcctcctcaagtgggtccctgacccctgacccccgagcagcctaactgggaggcaccccccagcaggggcagactgacacctcacagggctgggtactccaacagacctgcagctgagggtcctgtcagatagaaggaaaactaaaacagaaaggacatccacaccaaaaacccatctgtatatcaccatcatcaaagaccaaaagtagataaaaccaccaagatggggaaaaaacagagcagaaaaactggaaactctaaaacgcagagcgcctctcctcctccaaaggaacataattcatcaccagcaacggaacaaagctggacggagaatgactttgacgagctgagagaagaaggcttcagatgatcaaattactccgagctacaggaggaaattcaaaccaaaggcaaagaagttgaaaactttgagaaaagtttagaagaatgtataactagaataaccaatacagagaagtgcttaaaggagctgatggagctgaagaccaaggctcgagaactacgtgaagaatgcagaagcctcaggagccgatgcgatcaactggaagaaagggtatcagcgatggaagatgaagtgaatgaaatgaagcaagaagggaactttagagaaaaaagaataaaaagaaacgagcaaagcctccaagaaatatgggactacgtgtaaagacgaaatctacgtctgattggtgtaactgaaagtgatggggagaatggaaccaagttggaaaacactctgcaggatgtcatccaggagaacttccccaatctagcaaggcaggccaacattcagattcagaaatacagagaacgccacaaagctactcctcgagaagagcaactccaagacacataattgtcagattcattgaagttgaaatgaaggaaaatatgttaagggcagccagagagaaaggtcgggttacccacaaagggaagcccatcagactgacagcagatctctcagcagaaattctacaagccagaagagagtgggggccaatattcaacattcttaaagaaaagaattttcaacccagaatttcatatccagccaaactaagctttataagtgagggagaaataaaatactttacagacaagcaaatgctgagagattttgtcaccacgaggcctgccctaaaagtgctcctgaaggaagtgccaaacatggaaaggaacaactgataccagccgctgcaaaatcatgccaaaatgtaaagaccatcgagactaggaagaaactgcatgaactaatgagcaaaataaccagctaacatcataatgacaggatcaaattcacacataacaatattacctttaaatgtaactggactaaatgctccaattaaaagacacagactggcaaattggataaagagtcatgacccatcagtgtgctgtattcaggaaacccatctcacatgcagagacacacgtaggctcaaaataaaaggatagaggaagatctacgaagcaaatggaaaacaaaaaaaggcaggggttgcaatcctagtctctgataaaacagactttaaaccaacaaagatcaaaagagacaaagaaggccattacataatgggaaagggatcaattcaacaagaagagctaactatcctaaatatatatgcacccaaaataggagcacccagattcataaggcaagtcctgagcgacctacaaagagacttagactcccacacaataataatgggagactttaacaccccactgtcaacattagacagatcaacgagacagaaagttagcaaggatatccaggagttggactcagctctgcaccaagcggacctaatagacatctacagaactctccaccccatatcaacagaatatacatttttttcagcaccacaccacacctattccaaaattgaccacatacttggaagtaaagctctcctcagcaaatgtaaaagaacagaaattataacaaactgtctctcagaccacagtgcaatcaaactagaactcaggatgaagaaactcactcaaaaccgctcaactacatggaaactgaacaacctgctcctgaatgactactgggtatataacgaaatgaaggcagaaataaagatgttctttgaaaccaacgagaacaaagacacaacataccagaatctctgggatgcattcaaagcagtgtgtagagggaaatttatagcactaaatgcccacaagaggaagcaggaaagatccaaaattgacaccctaacatcacaattaaaagaaccagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccaatcccacagaaatacaaactaccatcagagaatactacaaacacctctacgcaaataaaccagaaaatctagaagaaatggataaattccttgacacatacactctcccaagactaaaccaggaagaagttgaatctctgaatagaccaataacaggatctgaaattgtggcaataaacaataccttaccaaccaaaaagagtccaggaacagatggattcacagctgaattctaccagaggtacaaggaggaactgataccattccttctgaaactattccaatcaacagaaaaagagggaatcctccctaactcattttatgaggccagcatcatcctgatagcaaagccgggcagagacacaaccaaaaaagacaattttagaccaatatccttgatgaacattgatgcaaaaatcctcaataaaatactggcaaactgaatccaacagcacatcaaaaagcttatccaccatgatcaagtgggttcatccctgggatgcaaggatggttcaatatacgcaaatcaataaatgtaatccagcatataaacagaaccaaagacaaaaaccacatgattatctcaatagatgcggaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcacgactcctattcaacatagtgttggaagttctggccagggcaatcaggcaggagaaggaaataaagggtattcaattaggaaaagaggaagtcaaattgtccctgtttgcagatgacatgattgtatgtctagaaaactccattgtcttagcccaaaatctccttaagctgctaagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcttgaaaatggccattctgcccaaggtaatttatagattcaatgccatccccatcaagctaccactgactttcttcacagaattggaaaaaactactttaaagttcctatgaaaccaaaaaagagcccacatcgccaagtcaatcctaatccaaaagaacaaagctggaggcatcacactacctgacttcaaactatactacaaggctacagtaaccaaaacagcatggtaccggtaccaaaacagagatgtagatcaatggaacagaacagagccctcagaaataatgccgcatatctacaactatctgatctttgacaaacctgacaaaaacaagcaatggggaaaggattccctatttaataaatggtgctaggaaaactggctagccatatgtagaaagctgaaactggatcccttccttacaccttatacagaaatcaattcaagatggattaaagacttaaatgttagacctaaaaccataaaaaccctagaagaaaacctaggcagtaccattcaggacataggcatgggcaaggacttcatgtctaaaacaccaaaagcaatggcaagaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaccacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacactttgacactgttggtgggactgtaagctagttcaaccattgtggaagtcagtgtggcgattcctcagggatctagaactagaaataccatttgacccagccatcccattactgggtatatacccaaaggactataaatcatgctgctataaagagacatgacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacacggatgaaattggaaatcatcattctcagtaaactatcacaagaacaaaaaacccaacaccgcatattctcactcataggtgggaattgaacaatgagaacacatggacacaggaaggggaacatcacactctggggactgttgtggggtggggaaagtggggagggatagcatggggagatatacctaacgctagatgatgagttagtgggtgcagcacaccagcatggcacatgtatacatatgtaactaacctgcacattgtgcacatgtaccctaaaacttaaagtataataataataaattaaaaaaaaaaaacaaaacaaactggccttatgaaccttagaccaatcttgagggtataaaagccttcgcagtgaagtggccataaaaaaaaaaaaaagagaaaattattatagaaaaagcagtagaaatcatggtgctgtttattatcatttgaaaagtatttttttattttgttctattaatatgtttcaatatgaatgatgcactgagatcttggataattagcacataacaacataaataataaaaatcatttattggacacaattaaattatgcctttcttacatacgttgtttctattaaaatgtgctgaaatttacttcttaatcttgagatgtaataaagtgttttaaggttacttttaaaaataaacatttaaaaaatgttgtgcttatatgatatcaatggaaaacaaatacttttgaggtttgaaattttaaatccgaaaataataatattaggcagcctttgtatttccagacctcttgtatttatacagggggatctagggcaaaaataattgctgaaatttaacatttatctgggtgggcctctgcgtacctcagcctctcttattcttttttttttttttcttttgagatggtgtctcgctcttgtcacccaggctggagtgtgatggcatgatctcagctcactgcaaagttttgctccctagctcaagcaattctcctacctcagcctcccaaatagctgggattacaggtgcccgccaccacgcccagctaatttttgtatttttagtagagatgaggtttcactacgttggccaggctggtcttggcctcctgacctcagatgatccgcccgccttggcctcccaaagtgctaggattacaggcttgagcgactgcgcctggcccaacctttcttattcttttgaaaatgcttctggagtccattgatacattctgtgagacctggtgggaagaaataggcctcaaggcacactgagtttttgagttgccctctacatttttcaagctgatcattattgagtccctattatctgacagatactctgctaagttatttatttaaattatctcattaaacattatcacaatcatattagatggggactgttattatttccatcttatacacaataaatttgaggcatagagaggttaaatttgagcagtgtcactgtaactcacttttaaaaactgtgtgataattaaatggcagtccttagttttaacccagttatggctggctgtaagttccatcccgtcatgaccattatgtttcctcaacttttctattttcctacttcctttgctctgctctcagtcactgggagacgaaagtgctgctggttagcacagaagaaactgctgctgctgcggcttctactgttgtctgccatctctgttaccatcgagaccggggctgtgtatgctcgaggtgcagggagctaatgtataaggagttaaatgaactcttgctgctgccaaatatgttgttatcactaactgcaccgctgctgtcattagtgctgctgccaacactgcaagccctgctgctgccagtgccaattctgctgatgccttgggctctccatgtcccagggtgattccatagacaagcagctgcttttagatttcacttgctcattacctgtagatcctttgccttaggactcaagcttaagcccatgaagcctgggatagaagacaattggaggtatgttttatcttctctagcatctgggacaactggccttgaaccaaacatgtgcacctcgtttttcttttcccttcttcctctgagatttcttttcccataggctcttatttcatgcaatgatccactagccctggaaacaggaacataaacactcgaaccctagaatgaacataatttagtcttaactacattagatattttagtttgaaagaaatcactcacatttcataatcctgaaacatataaatttatacttagttatctgtgcaaaaattgaatcatgataattattaaagaattactatgcaagtgtaaatagctttggtattaaccaagagtggtttcagtgtgcttttgtaaaaaaaaaaatactagagttcaaaaattcaggtctatatttgaagctctgtcaataattcatatacctcatatcaaaaagcttaccaagggacaagatgattttgttagtgggagtggtttactttttacttttgcttccaaccctaactcagaagaagggcaatagtctatcaaacctggaaaataagaaaacagcattcaaatttacaaagctctatttactaaaaacatgcaaaataagtaatttttttttgagagagtgtctcattgtgtctcccaggctggaatgcagtggcatgatcatggcttactgcagccttgacctcccaggctcaagacatcctcccaccttagtgcccccaagtagctgggacttcagatgcatgccacgatgcttggctaatttttaattttttgtagagatgttgctcacgctgctcttgaactcttgagctcaagcagtcctcccgctgtggcctcgcaaaatgttgggatgacagccgtaagccactgcgcctggctaaaataaagaatttttaactggaggaaaagaatcttatgttgttgaattctttattgtcttaactgaaagcaaaagcctgtttgaacttttttcttaatcgagaaaagcatatgaggagaaaagagctctaagttctatgccagatgcttacaaaacaaattgtttaccagtagtttagtgggacagggggtgggggtaaaagaaaaagttgtattaaaatcttgatgaagatattctgcatcaaggactattttatttttcttaagggcgaaacaatctgttttcttatttgaggccagtgaaagtttatatttctattccacctgggataataacaattgagagttttgtgttttattttccctaattgagaatatggggattggtaaataatatggtaagtaatttgcatttagaataaggtgaggttcttggttttccaaattattgatttgtggagtgaatttgcatctaggactctaattttttttttcagtaaatttcatgagaaatgttattgtttttaggaatgtaattttattaaaaaatttgcgggaattttgggatgtatttatatttaaagttatcataacatgttagatgttgtcatactgtgtgtgtatatgtgtatcctatatgtgtgtatgtgtgtatatttagcacgcatttttctttttatttgattaggttttcttaattttaaagttggaatgaaagaaaaatgtgttagtatatgattcataaaaaacaaaccagtgatggtactgtgtttaaacatctcaatatggatatgggttttgttatattttgcgagctacatgccagagtatattgtaaagaagtctatttataggtaaaataaagatgagaaagcagtgcagagagaaatcaaatataattgtcttacatttctgattctccttcatttttagtttttaatgggaatttctgtcttttatctgcatgaagatgctaatgttctcttaatgtacttaaaattgtagagtaagaatttcgaaatttgtaggaagacaaatggcatttataaatattagagtttatgagtacttaatatcccctctgtcatctgcatttaatgttttcgtttccttttaacagtatgtgtaagaactttctgtgctgtgcttagagtttttttcctagataaatgtttttcttatgctgtaaacctgtttaaggagatgagatttgaaagtagttgaattcagagctcttacttgagcagagtgtttctcaatagcttttccaagaaaattttaaaagattaaaatcaattttaatctttgtcgtataggccacagaaacttccattcatacatccttagaaaattaaaacaaggcaaaataacaatttgggaaataatcaattaaaaccataactatatgggaagtctttggaaatggaaggcccacaacctacctatatatgaagccagtgttgtctgaactgaattctaccgtagggtggactttttcttaacgtctgaatttatgaacctgtgaaagaggaacgttaaattgaaaataacgacaacatcttaattatggtgattttactgaaagactactaccataataagatgtattctaggtttccagagtagtggcagctgtcaaacaccaacatttctccctgagaataggtttagtgtagtgtgtttttcaaggacaagttgctcagtgagccctgctagttaatattcaacagttttcttaatcaaaattgtggtcttgctccctagagtgtttgtgaaaatgattgtatgtttatccgagccttcaacagcagaaagagaattcttgggctaggtgctggtaatgagaacctatattaatcccagggtgctgataagaaaaggaaaatcctgtcagaatacattgtttgtaaaaaaatgattactgtagctcaaaaagtcaaaccttttttttgaagcccttgtaccttatataacttcagttgtttatctgggataatggggaggtaggggtatggtgatgtccagcaatccactccaggaatggtattttagtgatcgagtagtctggggttctgttaatcattgcttctgttgcataccttattaagggtcctcacatgattcctttagattacaagaaggtcttaatgaagtaaagcttgtgaggtattagagagctcagtctggcattgtacaaatggtattgaagactcacataggaaaaacaagcttgccaaataaaataatgcaacagctaacattttctatgaaatattttgcttaggatgcaggttttgttagtgcttttgtttttaaccctaaactgttttctactgtcaggtgatactgcccttgaaacagagctgtcctggttgaatgtgacttttttctgccgtgggtacctatcacttccttctcacaccccctcaactcgtgcgcacatacacacacatacatctgaaagaatcaagatgaacagtttgaacaatatgatctctgtaatactataaagaacatttacttttggattttgttttgttttgtctgtaatggagctctataggaattaaatcttctgaaaacagtctttttaaaatattagcttggtggatttcttctagcattaatttttttttttttgagacagagtctcactttgttgcccaggctgcagtgcaatggcatgatctcggctcattgcaatctccatctcccaggttcaagcgattctccttcctcagccttctgagtagctgggattacaggcatctgccaccacacccagctaatttttgtatttttagtagagacggggttttaccatgttggccaggctggttccgaactcctgaccgcaggtgatccgcctgcctgggcctcccaaagtgttgggacaggtgtgagccaccgtgcccagccagaaagttttagtcaataacaaaaacacattttttgagtagttgtttaacatgattaaaagcacacttggactttaattaggaaacaataaacatacatcccataggagttaatctttgtaaacaacaccaattttgaaggctacagtcagttatattgatcacttcagtgatactgagacatatactgcactttatgcattgatctttgacatagaaagatcagcacgttaatgtaaaaaattgccactatgtatttgaaatttaagccctactattagctaatattcaaaataactcatttacttgatactgtaatgtgtagtcaactgatttttccttttaaatagattgatctgttatatatatattagaggcagagtctcactctgtcacttaggctggagagcagtggtacaattatggttcactgcagcttccaactcctgggcacaaacagtcctcctgccttagccaccactatgctcagctaattatttttaatttttttttgtaaatgtgggctcttgcattgttgctcagtctaatctcgaacgcctggtctcaagtgactcctgcttcagcctcccaaagtactgggattataggcacgatcctgcacctgccccaattctgtatttttatttgttcttagttgtagcttgtaattatttccaaatgtgaatcataatcagattgattcaataccaagttttagaagaattgtgtatcaactagtccactttgaagaggaaaaccacatagtaggttaaactagtgagtttaatttaaaaatattattaaagtatgacaaaagagtaacttctctctaagatatagagaaacctaagtggtaccctgaagctaaaggagtgtaaccaaagaatgacaaacttggaagaggatcagatcttaaagagaaggtgtaattcatctcactggagagcagagaagttttcgagtttggctgagcatccagagatggcccatagtcatggggcaagctggcggccagtagaatagtcggcatggataaccaaaccagtggctatgtttcagaggacatgagcaccctccagggaagagtatggggcctgtagtggactcagtaggactcaggaggactgccagaggggagggggcttcaggtagatggcccatagccctacagagggaattctgactctgatgggcatttctttctggagaaggccttgggaagattgtctctagcttgagactgcaagattggcaagcaaccacacgttcttataccctgcatggcttggcagggctacactgaatgtcctcacacctctacccaaatcactgactcctgtgtcaccagaagtcatggaagagccccttcctcctgcagtgtccctccagcttcctctactgggaacactcagcatcacacccattgtaaagaagaaatacttaaaagaattctatctatgatcataggacatatatttgtggaaaagtgcatttggagctgggaggcaattaattcataactagcacacattgccttacatttaggtgctggttatagctaatattgtggcaaaaatgacaactctaaatgccgtaagaatgtcatgttgctttcaggtgcccaattttagccccttggacttgtccatctggattagtcacattatcctagttttcagtagctgatcttaggcctgtgcttatttttcaccatatccttcaaagacaccacctatagctctctgcagtgggaatgaaagcctgtctacatataccactgtaaatatgctcaaattctttgagtgtttgagcagctttagtcaaaggaattcatggtgtatcaatagactctattctaattaaaaccatttaaatcacttttataagcaagtgaggaaactgtttagccccagagtgtgcactagtaatagcacatagttcatttcacaaagctaaagagcaatattgatgatagggcactaaggagcatgcgagtgcatagatcaatttgttactagtcagtcattgtttttctctgttattagtacaaccactattgtggtttaggtgagaaaatgttattagtgactgctttctggtgctttataggtgctatcatttactttcatgttcatatactgttgtaatcatgtatgaatgagttgccaactattatatattatgtatacgtaagagacaggtaaagaggtgcatgccggtatcaaatatgatatttacaaagatacatattaataattcctagataatggtggtttattatgaacgacagtaacagctagatggtaaatcattcacaatatttatgtctattgttgctttaacataggaattaccaatggcaatcacattttattttcctagcagccagaacacttttgttatacatcatttattctttcttaaaagaaaaaaaatcctttctagaaacactgttattcctttgacaatttgctttggatttgtaatctttccttagggtgttatttttttttctttagggaaaagaaggaaagggatacacgtggttaaaaaaatgccaacatgaataaatccaacagataaattgttagcaattacatttttaagagtgttgcaggagcattaacattgagaaactaatacttaagtacaaatggtttaattgtaatatggaaaataggtgatgctataaaaactattatgattcatatctataaaattagtaatggaatgattataggacaagaaatatgctttggtatgaaattgtattctaagaatcttctatcatcaaatctagttagttaaatctactaaccctgaatttaagatctgtgaatgaatttacctttatctaccatgaaaataacaaagcataggctgggcgcagtggctcccacctataatcccagcacttttggaagccgaggtgggcagatcacttgaggtcaggagttcaagaccagcctggccaacatggtgaaatccggtcttactaaaaataaaaaaaattagctgggcatggtggtgcatgcctgtaatcccagttacttgggaggttgaggcaggagaatcatctgagcatgggagacggagcttgcagtgagccgagattgtgccagtgcactctagcctgggctacagagcaagactccgtctcaaaaagaaaagaaaagaaaagaacaaagcataaatgtagtggacctaggagtactcttaggcactattcccaatgttaaggaacttaaaatctgtagcttttaaactgttgatattttttatactatagtacgaagaaatgtacaaaataattgagtcaaaagtatacaatttatttagaacaaaaaagcatatgaaaaggatgatgataataaatgagtgtattgaagagataataaaatgatggacaagaacatgaacctagtgaacaatgtagtaagctatcagttagcagataaccacaaaatgcatcatttccatggctctgtgaaaactaagcttacaaaaatgatttttcccctttggttataaggataacaattaattatagagcacgtttattgagtgtccactaggtatgtgactgatatgcacacaattagttgtttttactgatcgtttcactaagatacaaattattcaggacctgttgtaagttttaaatacaagttcaaacaccacaagggacttgcacaaggtcatacagccaaaagtaatgaacagagatacaaatcttagattgcacatcctcaaagcccaggccctttctactacatagtgtggcttctaaaaattaaaaatagtgaaactgcttggttcttgatgtgctggggacttgataatttcataaattccatgtggaatttaaagactgaatattcagctagttgatctctctctcttttctctctctctctttttttttttttttttttaaaataggatcttggtctcttgtccaggctgaagtgtagtggtgtggtcatagctcactgcagcttcaaactcctgggctgaagtaatccttctgcctcagcctcccaagcagctaggactacaagtgcacatcactatgccagtcctgtttttatttacttatttatttatttactatttttttgagatggagtctcgctctgttgcccaggctggaatgcagtgggacaatctagactcactgcaacctccgtctcccgggttcaagcaattctcctgcttcagcctcctgagtagctgggattacaggagcgtgccaccatgctcagctaatttttgtatttttagtagagatggggtttcaccatgttggtcaggctggtcttgaactcctgacctcatgattcacctgcctcagcctcccagagtgttgggattacaggtgtgagccactgctcccggccatgtttttattttttattttggggaggtggggggtcttgctttgttgcccaggctagtcttgaactcctggcctcaaacaatcctacagtctcaacctcccaaagcgctggggttacagacatgtgccaccatatcagccctcagctggtaatttccattacatatatagtcacttgactttcattatgtttttccctaaagtgcatacacaggtgaaaacgaaaatgtgacataaataagcagggtgaatatattataattttttaaaaaattattacttctcttacaagtgggaacctttttttttttcgctgttgtagcattcactggtattttcctgttaacctcttggtacacataacaaaaattaagtgtgtttatttcaacgttatgacttatttatagattcttattaaactttgcttcttaactagaatagaaatgaaaataattatcacaatagtgaataatcccttttgttttctgttatctcattataccaatgaatattttgagtattttgaggattatttatcatacttttccaattagaaaacgagtttcttaaagattgtattattttctcttaatgagagaggctgcacacagaggttatttaacagatattgtaggttaaacatctgactattgtgagtggagagaaaattatgagatagagttttgctaaatgtaacaagtaagatgcttaatggactcatggagtttctaaacttggcaagatgagtctgttttaataggcaaatttaccagtttagaataagaaatattacattctcatcagtaagtgccctgacaaatggtccagcattagaaacatttatcaattgttttaataaggaactgttgtgatattatcaggcagaggttaaatgctttgctagaaagacctatgtattagtctgttctcacaatgccataaaaaaatacctgagactgggtaatttataaaggaaagaggtttaattgactcacagctccacatggctggggaggcctcaggaaacttataattatggcagaaggggaaggggaagcaaggaccttcttcacgtggtggcaggagagagaagtgaggatgcaggaaaagctgccatttataaaaccatcagatctcatgagagttcactcactattatgagaacagcatggggaaaccgcccccataatccagtcacttcctaccaggtctctccttcaacacctggggattacaattcagaatgagatttgcgtggggacacaaagcctaaccatatcagtctaaaaatgtatatgtcataaaaattgcttagaaatatgtttagaggtatcatagacaggtgaatagaaaatgagctttagagtcacacgaccttggtttgaattccagctctgtcattagctctgtgaatttagccacagagtaatctcattaagatgtttcttcacttacaaaataaaaataatactatctcttcatgtaaggtttttatgaggattaactgtagtaatgaataaaaaagtaactggcatcaaaacgatgcacaacaaatgtagcttcttttaatttgaaatattaaagtgatatatttgatgctgattattgtatgtactggagattatatttttctgaatttttagaaagaaaaatcaagggaattttaaacatcatgaaaggcctacttgttcacacagtttttaaattgtgaatgacatttaaaaaataattttcattatgtttttaggctaaatatgtccaatgctttatagctcttgaaaaaatttagcctgatttttgttgctgttcttttgtggtgtaattagtgtcctcagctgaaacaaggtgctggtagctgaccccttctctaaggtcatggtaggatctttaggcttccttcttataagtcacagaggtcaggaaaaagacattattgttgggttggacttatcgcatgctcttataacagcccattgttagtgtagaattaactacagagtttttatttcttatgtcttgtaaaaatcagagcacttttgtaaaaatgacgattgaacatcaaggtaacctttatgttatatttccaaatgggtacatggatctatatatgaagaatttttagttgaaacagtttatagtgtttctgtttttggctctataactgacttccttcagaccaacttcatatactctctccttcaccttctggtgtttgtgaaacaaagggtgaaaaggacaagtgcagtgatgatttttagctcaaaatgttgggcttttctatctaatttagttgtccaagaacacattataaaatatttgcaaccacaaggaatctaatagcctaagaaaagtgaaaaaaaagcagccttttgtgtgtttgttttctccttagggaataactataaatggaaattagagataagatagttaatattgttctgtaaatattcagtcatcctgaaatagtcacgcctgtcataggagggagaattattatttactaggattacaagccagttgatcaactgacatcctgtggctaattgtggattggtatttcaaagataatgtagtctttattaagcatctgcaattttatagttacatttcacacattaccattttgatttttagcaacattttgtccttaaaaataatgtgtatgtgtgtgtgtgtattcctcattttacacatgaggtaattaaggttcagacaagtcaaacttttttcaaggtcgtacagttaaaaagtggcaaaatcaaatttcaaccctgtttggtttgattggtttgttaacatgtgcctttgtttctgtacttatcatttttagtgccttgctgactaaaatacaaagtttactcatttttatacaattcctcttatttttaggagatacaaataaaaacactgtagttaattctcaactaacaatggactactataagagcatgtagtaaacccagtccaacaagaatggcttttgtcggaactctttttctcctgttctcagtaaaaatttattgcttgaaatgtttattgagtctctgctggtgcttggtattctatttcactgctgggtacagcaatgaaaacagatggatgcaatccctgctttcataaagcatactttctaattcccaacatatgtacctatgataaagtttaatatataaattaggcccagtaagagattaacaataactaataataaaatagaacaattataacatctatgtaagaagttatgtgaatgtggtctatttctttctttcaaaatatcttattgtactgttgatcttagctaacctcactatagggtttttttttctttctttattaggttgagaactttcaccttttcacttaaaggaaacactttgcggcttctctttgacatatccaaatggccagcatcacgggggccattattaagtaaaaaaaaggttctttgaacacaagcacagttgatatgataacctactcagctacaaaatgactaaagggcaggtagcgcctacagcatgaatctgttggacaaagggatgattcacatgaggaacaaagcaggatactgtgagatttcatcatgctcctcagaatggcatataatttaaaactaatgaattgtttatttatggaatattcaagttaatatttttagattgccattggcagcgagtgactgaaactgtggaaagcaaaactgcagctccatcccatagcaaacattaggcataaaatctttatcaaattcttatctcgtacagagttgaggacaggtaaaagggaacttgtcgtagttgttgatacatcctggttgctatgtgaataataattcacaacaatatcggaataatatagatagaaaatataacaagaaaatatattgaagaaaacttgttgtgagaaatgcagtgaatattaaagtgactgacttttcacaccatcagattttattttaaagcataattttccatagaattaaactaatcagttaatgtaaacatgggatttttagtttgaaaactgagaaagtattacagatcatttaaaattagtactgctactttgaatttggaaaacatgtttctataccaagagagaatggaagcgaccatcttagtataatgtaaatccagactaaacgtataattaggaatatataataaattacgtatttatagggagatatctgggctattaaatgaattctacagttattttaatatatagtcagttttatatatattatatatgaattcctcctttgcacttcttttatttttagactagctggttcttatttatggttttttttgaaaaaagcatttttgatctgatctttagaatgaagcaatttcccaacctgtagtgaaagatattatttaccataaattttccagtattgccaatatatcttttttgggtcaaaaaatacgacagagacaaaatttaaaaattatttcagctgtctacattcattaaataaaatactggcaggagttgtatattatattagtttgaataagttgggcaaatatatttagctatttctttgattagatttataggtttcaaagttctatatatgcatgtgttgaaaataaaacacatggtaaattggtaaaggactttagaaacaagtacatataacactggcagaaggaccttgtctctcttgcataccattgttttcctagggcgtgtcacacaacaggtccttaataaatatgtattgaatgaatgtattaaattataaaagtaatgatgaaaagctggacataaaaaatttctgatgataacttcacatgcattagcaggttcttaatgtcacttgactgtattccttgcttctggcttcctaagtgggttttgctttgctggtcctgtactacagaccctgcctctgaatcatgacacattttgtcagtaatgtacacatcagtatgtagagagcttcaaaagcttgggcacttaacactaaccttctgctcaggtccttaggtaaatgttgggtatgcgccaccattaaataccctgtaactctccgatgctacttctctgctacatcttgtattctaccaaggtctagaggagggtggatttaaatgatcaattttcttagcattgactgatttatgtgtagaattttagatttttttttttttttgagacggtttctcactctgttgcccaggctggagtgcagtggtgtgatcaccgttcactgaagcctcgaccttctaggcttaagcgatcctcccacttcaccctttcaagtagctgggaccacaggtgcacgccatcacagtcagctaatttttgtgttttttttgtagagacagggtttcaccatgttgcccaggctgatctcaaactcctaatctcagacgatccgccttggcttcctagaagtgctgggattacatgcatgagccacaatgcctggccagaatttttaaaatcttaattatttttgttgagtcatagactgcagtagcaaatgtctagattataattacaggaaaataaaatcatttgtggcaaagacatggcatacttctttttaattcctcaaatagtactgtattccacagccctactcgtatataacccaccagacaagaaagctgatctgtgtaacaacttgaacttcttacttgccatgtttaaaaagggaagaccatcgactagagacaggggtggctacctttagagattactaattttgtcaatgcaaagcttgctaggataacagttgataatatcaaattgcttattaatagttttatcaggatgtaatttacatgttaaacaagtcaaccatttaaagtatacagttcaatgattttttagtatattcacagaattgtgcaactcagagtaaattttaaaccattttcattacccccaaaagaaatgcaattcttattagcaatcacccacaatattctccactctctcccagccctgagcaactactaatatattttctgtctctatagatttacttattctgaacacttcatataaatagaacatacaatatgtggtcttttgtgactggctcctttcacttagcataatgttttcaaggtgcatccatgttgtagcatgtatcagtactttattccttttattgctgaataatattccattgtatggatctaccacatgtatttttttattgatccattgatgaacatttgagttattttcactttttggttattatgaataatgctgctatgaacattcatgcgcaactgccaacatgtttttcaacacacttgcaccattttatatttccatcagcaatgcaggacgattccagtttctctaccatctggagaacacttattaatatcaatctccattattataaccatcctagtgggcataaagtggtgcctcattgtgggtttgatttgcatttccttaatggctaattatgttgagcatcttttcatgtccttggggtcatttatatatcttctttgcataaatatcgatttagattctttgccttttttaaaaaaattgggttgtatttttgagttgagaggtccttaaaatattatagataatttgttattagatctatggtttgcgaatattttcttccattctctgggcttttaccttcctgatggtatcttttgcagaacaaagttggtaattttgatgaagtctaatttatttatatgcttacttttgcttatacatttggcattgtatctaagaaggttttgtttaactcaaagttgttaagatttactcccattttcttctaagacttttatagctttagcacttacatttgggcttaagatctattttgattcactttttgtgtagagtgcaggaaaagaagttaaacttcattgttttgtccctgggtctgggaccatctgatgaaaagacaattctttcctccattgattttccctctcacccttgttaaaaatcacctgaccaaaaatataagggctatctgtactcttggttctgttccactgctttatatatctgtccttatgccagtatcacagtgtcatgattactgtagtttggtagtaagttttgaaattggaaactgtgtgttcactaactttgttccctttttcaaaattgttttggctattgtggcttcattttcatatgaaatttagcagcagcttatcaatttctgcaattttaaaaaggcagttgggattttgacaaggattgtgttgaatctgtatcagtttggggtgatttgtcatctttgtaataacacgtgttctaatcaatgaccatcaaatgtcttcaatttctttcaataatgttctgtcattttcagagtacaagtattgcactttttattaaacttattcctagagattttttcttgtgaatgctactgtaaatggaggactattttcttaactcatttttagattattttctactgtatagagatacaattgattttggtgtattcatcttgtatctgtcaaccttatcaaacttgtttattagttgcaatagtttatttttgtttgtgtatgtgtatgtgtgttccttaggaattattaaaaatataagatcataagatcattccctttgcaaatagaggtacatttatttctttttttctaatctggattcctttattttatttaagtgttataaatttttactttttgcctacttgtgctggctagaatgttcggtataataatgaataaatatgatgatattgaacagtcttatttttttctaattttagatgtgaaagcatttggatttttaccagtaggtataatgatagccagggatttttctacacatccttatcaggttgaggagatgttcttactagtttgctgagagtttttatcatgaaagttgtgttggaatttgtcccatgctgtttctgcatctataacagaaacatgtgctttttgttctttagtcgattgatatggtatattatattgattaatttttggacattaaaccagcattagatttctggaaaaattccacttcctcatggtgtatgacctttttattatgttgctggatgtttgctagtattttgttgaggattttatatataaaataataaaagacattgttcttttctttattataggtgtatttagagttttctatttactctgagtcaattttggtagtttacatctttttaggaatttctccatttcttctaagttatgatctgttggaatgcagttgttcatagtattccttttaattcttttatttctgtgaggtttgtagtgatcttttattatttcaaaaataatttgagtcttttctcatttttcttgcttgttctttttaaaggtttgattttgttgatttactgtattgtttttctatgttttatttcagccgtttgtgctgtaatctttattattttcttaattctgctggcttttaagtttcatttggtcttctttggtcagtgtcttaaggtgaaagataatgttattgatgtgagatgcttctttttaaatacaggttgagtatcccgtatctgaaatgcatggaattagaagtgctttggatttcagattttttttagaatttggaattcttgaattatacaggttgagcaacccaaatccaaaaatttgaaatccaaaagtgctccgatgagcatttcttttgagcatcatgtttttgcataaaaactttcagattctggagcatattgtattttcagatttgagatgctcaacctatatatgtttatggatagttatagctctaagcattgcttaagttgcatctcacaagttttattttcttcttcattaatctcaaagtatttccaatttctcttttgatttatttttcttttttaacacattggtaatataagaacgtgttttttactatttatatatttgtaaattttccaattttttattttaagatttttaatttttgtgggtacatatatttaagggatacatgaggtattttgacacaggcatgtaattcataataatcacatcatggaaaatggtacatctatcctctcaagcatttatcctttgtgttacaaaaatccacttatattattttagttatttttaaatgttcaattaaattattattgattatagtgcccctgttgtgttatcaaatactaggccaattttccaaattaaaaaaattaatttttaatgttattcctttgtggctggagaacatatttttgtattatttcattttttcaattgttcaatgtgtctatttctactaacttttaaattttcataatatattttgtctgatattaatatagccatttttgcattcctgtcatttttatttttatggtatagttttactttcttcgtttttgcatcttggaatctaaaatgtggctcctgtagaaggcatactttgaattttgttgtttttatttagtctgacaatctctttttgattggattatttaatacattcatgtttcatataattggtgatatggttggatttgtcatttaactttttgtttggtgtcattttttctccactacagcttttttcccagccaattcctttgtgctattataaatatgttacatttctatatgtcataggcccaacaatataattatgtacatattattgtaaaaaatagcttttaaaatcagttaagaaaaggaatggaaagaaatgtgcaattgtatgtcatactttctaatatgattacctttactgaaattttaatttttagtgggtttcaaattattgttgggtgtcacttgctttcagcttgaagaatttttttagtatttcttgagaagtagatgtgctagcaatgaattctgtttttgttaattaaagaatgtttttattcaacaacatttttgaaagattgtttcaatatgaaatacttgattgagatttttttcctttcaactttgaatatgtgatcccactgccttatattctacattatttttggtgaaaactcagctgttattgttattggggttccttaatatgtgacaaaccatttttctcttgatgctttcaagattttccttagtcttattgttgttgttcacttgtttatctgtttagtgactttgctcaacaactttggtgaagtccatttccccaatgggattcaatctctgatattgttcctaagaggcacaaccgtgggcatgcacacactctggtctttgttctccatcaacttctcaagagatgacagtggattttagttagtctctttttgattgtctctttctttcttctccctattaaatttctagctagtctgcatctactggtatcatatccatctgttagccttcactaattgctagctgattgctccattgtttttgacaatacctagtgcatagattgctctacagtctgatccaattaaatttaggcacctttgcagaggtattttttgaaatgagactttgagacttattcctaccctgggaatgctctttagttgtgtcttttcctggttttatctgttaaactctagcttgcttactgttatatttcttgctttcatgaagctatctgtctcctcttaaatttctcaccatcaaaatctttgttctttacaacagtgtcccaagacttgaacttcccatgccctgtcccaaataaagccagatcttttaggaagacctatagagcattagttccttctggcttgcctcgttctctgggcagtacccctgcaccagtgttccagagctggtggtcaggaagtcgctcacttctctaggaatgacagccttctctaatgagtagaatgcttggcaggggcagtagcctctgttcttgtcaacttgatattatcttgatgttgaacctccaccgtaaacttgctgaaacaaggacattcagggctcagtattatcagccagctatgcctgggggtagatcttccattctatgagtaaggctgagtagaggaaaggaacagggatcatttgactgttcttgcctgcagtggagcttcagcagcaatgggctgggcaggatgagaaaggctggtgatcagctcctcctgggaagaaactgtagccctaaacttgggtctaggaggagacagagccctgtgttcttgtctgtacatgccgatagtagagcttccataaagttgagctgggtaggagggaatgggccatggctcacatgccatagactgtcacttattgagatttatttgattttgctgaataaatgtttctccattttttgcatgtcattagggaaacttcctgataatttaagtggttactttatataatttttacctgttatggttgttcctcctgtagtgttcttagcatttactttcatttactaaaatatctgtatgttttttaaaagtatatgttgatatacatatcaacatatatatcaacacacacacacacacacacacacacacacacgcacactttatgaacatattgattctaccagcatttattctgcttctaccagtaatggtcttctttttaattaaaatggtagtgttttttaaagcataagtcaagcaaaatttagcgcttttcgtcagcaagtaacaattcttttattaaacactattttcaagtcctttttcaaataccatcagaatttccatttattaatttacaaagaaaattataaaaattacatagaactatttgaataagcataaccatatattttttttttctcagagtgatctacatgggaaccacattcacaagtagaaggttgcttggtgaccagggaatctgcgcaatcattaatctttgatgattggaatgattaatgatatcaagccattttgttttgcctgtccttttgcatcttcaccatctctgctctgcatttaataaatatgaatcattttatagaaatacagattgttataaattatggttattttaatcataaggatagtaattctcaaagcttagtttacagtttgacaatggtaaatgaaaaatttatatgttcacaaaaatattttgcaaacataggatttgtactttctaacaattttcagatatctgtttttaaaataagttttacaaaaactactgattacagaatagatatctagcctttaaatgcaacatattacatagaaattatagttgttgcaatcatccaaagaggtgtaaaaaaaacacagttaaagcaagagaagtctttatagaacagattgccagtagttagtgtacaagtatggtaacacttaatgtttattttcagtgtttgggacattattcactttacatgtataatgtcacccaattgtcacaataggtaggaacttgtcattcactttatagatgaggatactgaagctctagatgtttatgtaacttatctaagctagctagtgatggaactgtggcatttctagttaatgatagaactgtggcatttaccttgcagcctaactctagagttctcactcttactctgccacattgtatccagaagtatgccaaaatttttcttcatcttatataatttgttttcatatttttcacatatttgtaaagagcatgtttattgaccctgttccatgtccatctgaagttctctcttggttatttgagtaatggaggagccaattcctatagtctccattcatgctcaaaatcttcctgcagtctttgtgacctgactcattctttctattacaaaaatatgtaatataaacatgattaagatgaagaggatataatagccaaaatgtattgtgccaggcattgttctagtgtcttgtgtatgttatctcatttaatctatggtaaaattctctggggtgggcattattgacttagtgattaagaaacttcaaatcggagaaactaactgtgcttttggctacacagtttttaagtgttgattctgaattatgcctggtgattctgaagacattgccctttccctgtcatattctaaaatgtttactgagtgctgggtcttacatgccctgtgagtaggctgtcagcagaatacttctctagaggtagttatattaaaaatacattaaggttgagaaactcagaatcagaaagattcattataagatataagtttgcatagttcaccttgagattgctatggcaggttcataaatggattgacaaatgaaaagtgggtcactgatcattttatttactgtagttccccattatctgtggttttgctttccacgacttaagttatctgcagtcaaccatggtataaaaatagttgaatacagtaaaataagacattttgagagagagaaagagggagctcacatttatataacttttattacagtatattgctttgttttataattattattaatctcattgtttttcatttataaattaaattttaccatatatatgtatgtataagaaaatacatagtatttatgacattccgtactatctgtagtttcaggcatccactgcgggggggtcttcgaagatatgcctgatgggtaagagagggattgctatattcactgttatggaaaatagtggtggtcttaacagcagatataaaaattatttgcaaattaacagtatgttaacaaacaaaggaaaggagatggcataaaatatcagtgtcttatgttataaaatgaaatgttatatatatatatataggtatatgtctatataagcaatgcatcattgctattcattatcaaatactattcatcaaaaatgagtgcttatgattctaggacagggaccttgtatggttcttttgtttttatttataaaacatgacacataaagggcacttgataaatgtttaagggagcaaaaaatattttttggtgtatttaaaagtcaaatgagcaaagcagggatttatgctggtggaaaagagattaattatggtctaaatagcatagcatgctccttgtgttagtccagagagagagagtgccaataggatacagatagatagatagatagatagatagatagatacatagatacatagatacatagatacttagatagataaagaaggagagagatttaacataaacatgtaaatacttaagtaaatgtttatttattataaggaattggctcacacgattatggaggttggaaaattccaagatttgctgttggctgtctgatgacccaggagagtcaattacatagttccagtctgaatctgagtctgaagacaggagaattttgatattgtagctcccagacagtcaagtagaggagtgaattccccctgactcagccttttattctattcaggccatcaagggattggataagccccactcatattggagaaggcaatccgattgattcaggctactgatttcatatgctaatctcatccagaaacatcttcatagactcacagacataccctcaataatgtttaaccaaatacctgggcagtctgtggtccagtcaagttgacacataaaattaaccgccacactgttcagttttcctagctgttaactccaatcatttgaaaggaagcgatctcaaacttaaggttccagactctatagccagataataatttctggtttttataggctgatgactcccattctgtatttaagggctactggtatgacatcacagaaaaataattatttactcatttaaaaaaatatcggatgggcacggtggctcatgcctgtaatcccagcactttgggaggccgcggcaggtggatcatgaggtcaagagattgagatcatcttggccaacatggtaacaccccgtttctactaaacatacaaaattagctgggcgtggtggtgcacgcctgtaatcccagctactcgggagactgaggcaggagaatcacttgaacctgggaggcagaggttgcagtgagctgagatcacgccactgcattccagcctggcgaaaggtgagactccatctcaaaaacaaacaaacaaaaatatcaaagtgaaatatgtgtaagaaactcaaagaatattttaagagagtataataatgttaaaatacacaaagttccttatttatagtttcactttcaaagataaacagtcataatgatttgattttctagccatttttcaatacactatacaattaatagtacatatgtgttagttttattttttatttcaatagtttttggggtacaggtgttttttggctacatggatgagttctttagtggtgaattatgagattttaatgcactcctcacctaagcagtgtacactgtatcaaatatgtagtcttacacccctcactttctttgcaaccatgctgttttggtaactacagccttgtagtataatttgaagtctggcaatgtgatacctccagatttgttctttttgcttagtattgctttggttatgtgggctcttttttggttccatatgaattttaggattgttttttctagttctgtgaggaatgatggtggtattttgatgggaatagcattgaatctgcaggttgcttcaggcagtatggtcattttcacaatattgattcttcctatctatgagcatgggatgtgttttcatttgtgtcatctgtgatttctttcagtagtgttttgtagttttcctttatagttttcacctttttagttaagtatattcctaggtattttattgtttttgcagctattgcaaaagggattgcgttcttgatgtgattctcagcttgatcattgttggtgaatagcagtgctttgtatacattgattttgtaatgtgagactttactgaatttgtttatcagatctaggtgccttttggatgagtatttatggttttctaggtatatgatcatatcatcagtgaacagtgacagtttgacttctttttttttcccaatttgtatgtcctttatttctttctcttgcctaattgctctggctaagacttcctgtactatgttgaatagaaatggtgaaagtgggcatccttgtcttgctccagttctcaggggaaatgcttttagctaagatgttagctgtgggtttgtcatatatggcttttattactttgaggtaagtcccttctatgcctattttgttaagagtttttattatgaagggatgctggattttaccaagtgcttttcccttatctattgagatgatcatatggtttttgttttcaattctagctatgtgatatatcacatttattgacttgtgtatgttaaaccatccctgcatctctgtgactaaactcattttgtcatgatgtattatcattttgatcatccaccagctgttggatttggtgagctagtattttgttgatgatttttgcatctatgtttatcagtgatattggtctgtagttttctcttttttgttatgtcctttcctggttttgctattagggtggtactggcttcatcgaatgacttagggaagattctctctttatcttttggaataatttcagtaggattagtaccaattcttctttgaatgtctggtagaattcaattgtacatccatctggtcctgtacttcttttcactggcaattttttaaaattattgattcagtctcaccacttggtattggtctgttcagtgttcctgtttcttcctgatttaatctaagagggttgtatatttctaagaatttatccatttcctctgggttttctagtttgtgcatgtaaaggtgttcatagtagacttcagtgaacttttgtatttttgtggtattggttataaaatcgttgactttctgccttgatgatctgtctagtgttctgtggagtattgaagtcttccactattattgtgctgctatctcatttctttggtccagcagtaattgttttataaatctgggagctccagtgttagttgcatataggtttaggattgtaatgtcttcttgttggactgctacttttatgatgatataatattgttctttgtcttttttttactagtgttgccttaaagtctgttttgtctgacataagaatagctactcctacttcttctggttttcatttacatggaatatctttttctatccctttgaccttgagtttatgtgaatgcttatgtgtaagatgagtctgttgaagacagtagatattgtttggtggttttctaattttttatttgatttatttcttgatttattaagacagagtttcactcttgttgcccaggctggagtgcaatggcactattttggctcactgcaacctccgcctcctgggttcaagcaattttcctgcctcagcctcccgagtagctaggattacaggcgtgtgccagcacacctggctaatttttctatttttagtagaaacggaatttcaccatgttggccaggctggtcttgaactcctgacctcaagtgatctgcttgccttggcctcccaaagtactaggattagaggtgtgaggcaccacacctggctaggtgttggttttgttaaacccattcggccattctttaccttttaagtggagcatttaggccatttacattcaatgttattattgagatacgaagtactgttatattcatcatattcatcatattagttgttacctagatacactgttttttttttcactgtgttattgttttataggccctgtgagcttaatgctttcaggaggttctattttggtgcacattgagcttttggttcaagatttagaacttttagcatttttcgtagtgctggtttggtagtggcaaataccctcagcatttgtttgtctggaaaacactttatctcttcatcatttatgaagctaagtttcactggaaacaaaaatcttggctgacaattgttctgtttaaggaggctaaagataggaactcagttccttctagtttgtgaggtttctgctgagaagtcttctgttagtctgatagcttttcctctgtgggttacctgatgcttttgtctcacagctcttagaattctttccttcatgttgactttagatagcctgatgactatgtaccttggtgatgatctttttgcaatgaatttcccaggagttctttgtgcttcttgtatttggatatctaaatctctagcaaggtcaggaaagtttttctcaattattccctgaaatatcttttcaaacttttagtcttctcttcttcctcaggaacaccaattattcttaggtttggccatattacataatcccatatttcttggagactttgtgtatttcttttgattctttttgcttcatctttgtctgattggttaatttgaaagctgtgtcttcaagctttgaaatgttttcttatacttattttattgttgaaactttctgttacattttgtatttccctaaatgtgtctttcatttctagaagttctgattggtttttctttaagatatctatctgtctggaaactttttcacttatatattgaattttttttaaatttatttttgttgattttcacctttctctggtatttccttgagtagcttaataataaaccttctgaatttttatttgctatttcaaatatttcatcttggtttggatccattgctagggagcttctgtgattttttggggatattaaagaaccctgttttgtcatattacaaatccctgtcttaggtagagtattgctttaaattgtttttaaatttatatttgatttcttttaaatttctttttatcctcttgaggatgtggctttaatgtttatagtttattatagcctcatttgattcttggtgcttttagggctgaagactgtatgagttcgtttgttacagagtctttgtgtgctggctttcttagctgctcattgtattagttatgtacttgatgtgtgggcaagttcactgtctcctatggggttggaaaagcaaggatctcttgaagcttatttcattgccccatcgtatgcatttttaaaattttaattagttttttcctgttattttatttactgagttaatggttcaagttttaggccaatagaggatgtatctccgggtaggaatcagttgttgctaaagccagtgggtagatgcaatacccaatggtgggcagggatcccagccttgatgaaggtggctgggagagctctccattagatgcactgaagttttagcagggggaagggtgggagctaccttaactcccctgccaggccagtaggaaatctgtctacctcccagcctcactcctgcccctgtgttctggctgttcagatcagacaggtacctctttttgtctgtaagaacattgatattccaagtagagaggaattatgactctgccactcatgcaatcctgaacctggggagtgctcctcctgtggggacataatcaccctgaaatgttccaggaaggctgtctatagatgtgtcctcgctgagttcctgtgggaggagtctcagttgtgtctgcagttgtggacaaggcagaaacaagggccccttctccaagacccttcatgtgctgcctgactgttggggtagaggtgcagactttctccactgagcccagtgctgcaatagcatctctgctatgagaaacttcccaccagcggaaagatctgggactcaagtcctgccatccggattcttttgtcccatggcatgttccctagaagtggcattctccctcttcccctagtagtaggagttcctgagagccagactacagtgattggtattgcctttctggggctagccacccagtggggctgccacactctggactcgtactggggatgtctgcaaagaatccggctatgtgaactgactttaagtctcccagcattgggaagcagcaccagctctgatggaggtggcaggggagtgatgtagaccctgtgagattccttggttgtagataggcttagtgtgctggctttttcaaatgctggttataatcatagtgaacttgtcatgtggacagactcaggacctctggttaaccagagtactgcaggcaaagttgatagccgaagtcacacagccattttctttttcctgggcacagagttattctacctagagatgctgtaatggcccgagttgattgacctccaacagaggtggcgcttgaaaaggggcatcagctggcacagaggcagtgggatttgagcttgccctaagtagtctggggtaagtattctggtttctcaggtgatgggtggagctataaagctcccaaaagtttatgtcctttgtgttaagctagtagggccagtggaggggcatggccaactgctactccataacccctttgtgaattcttctgtgcagcagactattatactcccctctggaacattaccccagtggcctgagagccaccgccaaccctcacaggggccatgacttgtccccatcaaggaaagtcagagcacagacccccctaactttgcccccacttggggaagcattttttaggcataaagctacaaaagaaagatatagcagttttcaagtcacacttgacttttagagcaccatagtaaagaggacctcttgttaaaatacaccgtgggcttgatgaatttccttatgagcataatctgtgatattccaaatgtgctctttattgctattcttgtcaatattctcttcttccacaattaactggtgttacagtcccaatttgtaaatggctttgagtgttttgagcagttttctaccctcactttcataaattgagtggaatcttgcactttttacatgttctgctttggaatttattgtattgtgtatacattgcatttttggttgtttatactgcaaacctgactcccaaagacattaacatgatatctatcgagtcagtctagtactaactggggtgaaaaatttcattggctattaactttataaaaagttagtttattacagaatattttcatattaggatcatttatgtcactgccccacctacaacacaaactaacaagagaagaactgacaagaacatccttcatattgtgttactttcctgtttactggaatgctttttgtaggttgtttttgtatatttctaaactttatttttctccttttggtgtcaatcagtaaatctgctctactattcagtgtctacatagctgtctaatacacttttttttttatcctggatggttgagtttgctggaatattttgagacaattaacatttataacattttaatccagctatctgagcatttaatattcctgtctggattattaaggttatcttgatgattatgaagtgattttatttttccagtcctctaagttgatatattaattctgaatttattcgtttataaaaagaagtcttaataagctccagattacattgtcccactaaacataacccattttccttttctgatattctttgactattttattttaaattgagggtataattttcttctgtcttcataaactatgtgaatatcttaaaaatgacatctagtaaagaatattcttgtatctcagatagcttatgtattatatataatctttaattttgcgagatacagacctttatagagtgtgttgaagggaagagtgtatgaactacttgcaatctcttccttgactattttttagttcttaaaataattatacctacctatattcctgaggcaatattttttattttactttttcttttgaatggaattcagtatgtatttttatggcaaaaatgtgctttcatagaaagtaactttcatatttagaataaaatatatttgtatgtatattatgtatttatataaatgtatatcaaaggtaaatgacagtaatgattcatcaggtattaaaaaagtaaagtaaaatttaaatgatcaaatttcactagtgtaatattaggactggttaatattttttcttgaacataatgatttagaaatgaaaatttgtgattattacttgattacattaaaatagtcttaaagatatttctgtccacattgccatgtttttaaaaatgccaatgaaataagctatcaaaaattataataaaatattctatactattaagttatatcaatttcccaattattacaaaataaaacgtattgttctgaatgtaacgaagaggagatatttcatacttaaattctgaatccagctgttttacactatgaaatattaattgcatgatcttaaggataagaacctcttttatagtacttctgtaagagaaataaattggtcataattgtatttcattttcttgattgaatagatacatagaataaaatgcactgcagtcttctgacaatcacatcctgagactctgcttaaatagctctattataatcttacagcatttttagtcatttaaatacaagtttagttctgttgtagccttcagatattttgcaccaagatatttaactttgtagccttcagatattttgcagcaagatgtttaactgggaaaacccttagttattcatattcagatttaaattatttcacttacaaccatagctaaatatttaaaactgcaatgtcccactaaaacatagctgttataaatattataattatcatcataatagaactgacaggaaccactatcatttatcttacatttcaatacttcaggttatatgattcagtatgaaagtattgagatagatttttaaattctaaaaccaactaacctacctttcctttcttctttggttccttctacccttcctaattttctctagagaactaaaatgaatgtcatgtggctaagaaaactcatgaaatgttttctctgtattgtatgtaaatcattgttactctccagtatgtatagtattttaatctatatagtccagagcatattaaaattgggaattttttttttttgtggagcaagatgaccaaatggaaacctccactgacttgtctacacaaaaaagcacctacatacgaactgaaaatcaggttaaccatcctagtacgtggttttaactttatattgctaaaagaggcactgaagatggtaggaaagaaagtcttgaattgctgatgccacccctcccccattctctgacagtagctgcacagcacaggagagagaatctgtgcttctgggggagggagagtgagcaatcaggattttgcactggaagaactcagctggtacccatggagggagcatttagactagccctagccagagagaaattgcccattcctggggttggaacttgagtttcgacaagcctcatcaccattggctaaactgtctggggtcctaaataaacttgaaaggctcactaggccacagggactacaaatcctaggcaagtcttagtactatgctgtgcttggagcaagtggacttgggggctataaggagaggcctcttctgcttgagaaaagcagagatataagaataaaggggactttgttttgcatcttaagtagcagctctgccactgtggggtagagcaccaagccaactcttggggtccccaattttaggctttggcttttggacagcatttctaggcctaccctgggccagaggggagcccagtgttagaaagggtagtcttaggcctggcagcatttgccacaagctgactgaagagtacttgggccttacttcagtgaacatcagtggtaccctggcagtacattccatgggcccttggtggtagtggacacagggagaatctcctgcttggggaaagaggaatgaagagggggaaagactttgtcatgtggcttgtattccagctcagccacagtagaacagagaactaggtagattcctaaggtttctgactataagcactggctcctggacagcatctctggacccacctggggcctggggaccttgcaacccttcagaaaagaacacaaatctggctgggttcgctacctgctgattgtagagccctggaccttgagcaaacatagagataggtagtggctatagcaggccttggaaaagacccagtgctattctggcttcgggtctgacccagcatagtcccagtgggggtgaccacaggggtgcttgtgtcaccccttccccagctgcaggcagctgagcacagagagaaggacttcatttgtttgggagaaagtaagaacaagagtctctccctggtcatccagataattcttccagatcttatcccaaactgtcaaggtggtacctctctaagtatgcaagaactacaacataactgggcttgggtaccccctaatgcagatatggcttcagtgaacaaaactttagaccatatgcccaattctcttctaacacctggaaaaccttcccaagaagggtaagtacaaacaagcacagattgcaagggaatagaaacaaataacctacaatggagttctagtacatctgtcagtagacgcttccaaggaaaccttacaggccaggagataggaatatggcatatttaaagtgatgaaggaaaaaaaccttttaccctagaatagtatattcagttaaaatattcctcaagcaaaaaggagaaataaagactttctcagacaaatagaagctgagagatttcattaataccagatctgttgtacaagaaatgctaaagggagttcttcagtctgaaagaaaataatgttaatgagcaataaggaatcatctgaaggttctcactggtagtaataaatatgcagaaaaacacagaatattataatgttgtaattgtggtgtgtaaagtactcatatcttaagtagaaagatgaaaagatgaaacaatcaaaaataataactacaacaatttcagacatggatagtataataaaatagaaacaatgataagttaaaaagtgggaatacgaagttaaagtgcagagtttatattagttttctttttgcttattagtttgtctatgcaatcactgttgtcatcagtttaaaataatgggttatactatattatttgcaagcctcatggtaatctcaaataaaaaaataaaacagatacacaaaaaataaaaaacaagaactcaaaacataccagcagagaaaatcaacttcactaaaagggagacagaaaggaagaaaagaaggaagtgggaccacacaaaacatcagaaaaataaataacaaaatggcaggagtaagtccttacttatcaatgagaacattgaatgtaaatggattacatgcaccaatcaaaaaacagagttggtcaatgaatgaaaaaacaagaccaaacgatctgttgcctacaagaaatgtacttcacctataaagacacacctagacagaaaataaaggaatgtaaaaagatactccatggaaatggaaacaaaaaaaaataagagtagctacacttacatcagacaaaatagatttctaaacaaagactacaaaaagaggcaaagagggacattatttaatgataaatgggtcaattcagcaagaggatataacaattataaatatacgtgcattcaacaccagagtacccagatatgtaaggcagatgttagagctaaagagagaggtagatcaatacaatagctggagacttcaacacccaactttcagcattggacagattatccagttggaaaactagcaaagaaacatttaatctgtatttagattgaatagacttaatagacttttacagaacatttcatgcaacagctgcagagtacatagtcttctccttagcacagggatcattctcaaggatagaccatatgttaggtcaaaaaacaagtcttaaaacatttaatataattgaaatcatatggattatcttctttgatcatgattgaataaaactagaaataaataacacaagaaattttgaaagatgtacaacacatggaacttaaatagtttgtttctgagtgactagtgggtcaatgaagagattaacaaggaaactgaaaaatttcttgaaacaattgataatgaaaacagcataccaaaatctataggctacagcaaaggtagtacaaaaaggaattttatagctataagtatctacatcaaaatagaagaaaaacttcaaataaacaacacaacagtgcatcttaaagaactggaaaagcaaaagaagtctgaacccaaaattagtagaagaaaagaaataatgaatattagagcagaaataaatgaaattgaagaaaacaatacaaaagatcaatgaaacaaaaagttggttttgtaaaaagattaaaaaaaaacctgacaaacctttagcctgactaagaaaacagaagaggaaatccaaataaaaccagagatgaaaaaggggacattacaattgataccgcaaaaattcaaaggatcattagaggttactttgaggaactatatgcttataaattggaaaactgagaagaaattgagaaatccctagacacatataacctaccaagattgacctgtgaagaaatctaaaatctgagcagaccagaaacaagtaatgagattgaagctctaatgaaagggatccagaaaagaaaagcccaagacccaatggattcactgctgaatttttccaaacctttaaagagctaataccagtcccactgcaactactccaaatattataggaagtgggaatacttccaaactcattctgtaaggccagcattacctcaataccaaaaccagataagcatcagaaaaggaaaactacaggtcaatatcattgataaacgttgattcggaaatactcaacaaatactagcaaactgaattcagcaacacattaaaaagatcattcataatgaccaactgggatttattccagggatgcaaggatgattcaacatatgcaaattagtcaatgtaataaattgacaagatgaaggacaaacaccatatgatcatttcaattgacactgaaaaatcatttgataaaataataaaactgtaaaaaatactggatatagaaggaacacacctcaacataataaaatccatatgtgatagacccagagctagtatcatacagactagggaaaaactgaaagactttcctctaagatctggaacatgacatggatgttcactttcaccactattattcaaaatagtactggaagttctagatagaggaatcagactactgtctgattgaaagaaataaagagcatttaaattggatcatactatccctgtttgcagatgatatgatcttatatttggaaaaacctaaagacttcaaaaatctatttgaactgataaacaacttctgtaaagttgtaggatacaaaatcaatatatacaattcagtagcatttctatgtgccaacagtgaacaatctgaaaaagaaatcaagaaagtaattgcatttataatagctacaaataaaattaaatacttaggaattaatgtagccaaagacatgaaagatctcttcaatggaaactataaaatattgatgaaagaattggataaggacacaagaaaatggaaagatattccatgttcatggattggaaaaataaattttgttaaaatgtccatggtacccacatcaatctacagatttaatacaattcctctcgaaatacctagacatttctctcagaaatagaaaaaaaatgctaaaatttatatggagccacaaaaggctctgaataggcaaagctctactgaacaaaaagaagaagactggaggaatcacattacctgacttcaaattattatacaaagctatggtaaacaaaactgcatggcactggtgcaaaaatcagacatatagatcaatggagcataattgagaaaccagaaataaatccatacatctatggtgagctcatttttgataaagctgtgaagaacatacactggggaaaggatagtcttttcaataaatggttctgggaagactggatgtccatatgcagaagaatgaaactagactgctatctcttaccatatacaaaaatcaaataaaagtgggttaaagacttaaatctgagatctcaaactgtgaaactactaaaataaaactttggggaaactcttcaggaaattgaactgggcaaagattttttgagtaatactccaccaagcacaggcaactaaagcaaaagtggacgaatgagatcacaacaagttaaaaagcatctgcacagcaaaggaaacaatcaacaatgtaaagagacaacccacagaatgggagaaaatatttgcaaactgtccatctgacaaggaattaataaccagattatatatgtattagtccattttcacactgctataaagatactacctgagactggacaatttatatatatatatatatatatatatatatatatatattttttttttttttttttttttttttttaaaaggaggtttaattgactcacagttctagatgactccggaggcttcaggaagcttacaatcatggcagaacggaagcaggcaccttttttacaaggcaggagagagtgtgagtgtgtgaggaaggaactgtcaaacacttataaaaccatcagatctcatgagaactcactgtcacgacaacagcgtgggggaaaccacccctgtgattcaatcacctcccaccaggtctctccctggacacatgaggattacaattcaagatgagatttggatggggacacagccaaaccgtatcaatataagtagcacaaacagttctgtaggaacaatctattaatctgatttttaaatggtcaaacggtctgaatagacatttgtcaagacatgcaaatggcaaacaggtatatgaaaggtgttcagtatcattaatcatcagagaaatacaaattaaaactgcaaagatatatcatctcatgccagttaaaatggcttttatccaaaaggcagacaataacaaatgcagacaaggatgtggagaaaaggaaactctcatgcgctgttggtgggaatgtaaattaatacaaccactattgagaacaatttggatgttcctcaaaaaactaaaaatagagctaccatatgacctaggtatcccactgctaggtatattattgaaataaaagaaatcaatatgttaaagagatatggacactcctatgtttattgcagcactcttcatgatagccaagatatggaagaaaccttcacatttatcaactgatgaatagataaagaaagtgtggtacatatacagcatggagtactattcagccataaaatggctcacgcctgtaatcccagcactttgggaggccaaggagggtggatcacctgaggtcaggagtttgagaccagcctggacaacatggtgaaacctcgtctctactaaaaatacaaaaattcgctgagcatggtggcatgcgcctgtaatcccagctactcgggaggctgaggcaggagaatcgcttgaacccaggaggcggagtttgcagtgagctgagattgtgccaatgcactccagcctgggtgacagagtgagactctatctcaaaaaaacaaacaaacaaacaaaaaaaaacagaactatgatatcctgtcgtgtgtagcaacatggatggaactggatgtcattctgttaagtgaaattagccaggcacagaaagacaaactttgcatgttctcacttatttgtgggagctaaagattaaaacgtttgtactcatggagatacagagtaaaatgatggttaccagaggctggggagggtagtagtgggggtggatgggaagatgggatagttaatgggtacagaaaagtagaatgaatgaatgagatctagtatttgacaggctaacagggtcattatattcaataacaatttaatcgcatgtttaaagataattgaaagaatataattgtttgtaacacaaaggatcagggcttgaggtgatagatacctcatttgccctgatgtaattattatacattgtatgcctgtatcagaatacctcatataacccatatatacctactatgtacccacaaaaataattttaaaaaactgaagttttaaatcagaaacattttcttttagagactttattttgtggatgttaatgaagttttgtggtgaactcactaaaaccaagttgtatagttaatataacatgcaaaatcacttactgtatggcagtatgtctcgaacatataaaactttgcctctttattgaaaaacacattctgaggtcaatctcaaaacctgtgaagaattctccctgcttcacaagccaaactagtagggatagtgatttcctcttctgcaccacaccagaacaacatgagtaagagttccaggcacttgaaaaacatagaagaaaggaagggaaagaagcacctgtgcattcttccattctttcaagtggttacgtcttgtcaactatgttgtgataagagcagagaagataattattcaagatatttgcaattattcaagataattttgcatatttgagtaatgcaaatttaaaaactttttaaaaatttaaaaacactaatgcaaatttaaaaacaaattttgcatatttgagtaatgcaaatttaaaaacatctgtaggtgcatactactcatgtatgtttgtgagacatgaattcagtgattccaagtcttcaacatcatttcatgtccaaactccctgtctgtcccatcctctgagatttgggtaaaaaagaatttgtcttggggtagagctttacccaaactttaagaaaggacattggttaagggcacaagaggcatctctttagtggtagattcatgtcatcaggtgtggaagtcatggtggaaaaaaaatagaaaactaccagggagttgtggaatactggactttggaaaaaatagctcattaaagacatactgaataacattttacatgctgtgtgtgtcttttcttatcactttgtcattttgtttgcttaaatacgtgttatctatcagctttgctgttaagaaaactatgtcatggaaaggtagttgaatatttagtttgttactattgttcagtggtcaagtgagaactccagtaaagtttttagaatttaaaactagaattgggtatgaataagaggagcaaaatatatacatataatgtttcttttaatattttagatatgtctacgagatccaaagtatattttttataccttactttattacaattacaaagtctgtatttttcttttgcaaaatttgcacttgaccatcttggtcccagaatatcatactttcagaattttctaatgttcttaatattatgctttatattatatcacacaattactgaataaattaggtgaattcaaattttaaatggatacattaaacatatcaaaaggaaaagatcaaattagaaatagttttagaatgaaagattgggcttacactgtcttgctgtaagataaatatttctgcatagcacatgtgaagtaattaagacacagcagaaatatcctaagcagtgtaaaagcactaaaaatgggaaattggtaatcactttctatgagcaaatgaaattacttacaataccaattcccttccattgtaatctctttctaactttatcgtacttggaaaattgctatggtgacaaagaagtttttattttccctgggtagatagaaattcattggaagactttataagtagccagaacatggtctcataatcagttagcagatttgtatcctcgactactacttgtattctgtaaataaacatcttttgactagcaagctggattaagaatgagttttcaaacatgcagtcacataagtgtgacttttaagtcaatgtgtcttttaagcaattataatttcacgtatcttatgattagtttcatatacataaggattcatagtagaggagaataataaatacaaatgtgaaaataaaaggggcatactgaagaggttaattttgttaaaatgtgataatcgtaagcctaatttataaaaaaatgttcagaatgtcatcaccttgctaatgaaataaaacttttggtgataacattttagcaaggctgactgtgtaatttacagtgtccagtgaaaaaagaaaacgtagtgccccttcgacaaaaattttaagttggtgacaacagagagtttaccaagaagaaggccctgtgtggttgcatagattgtatattcatgaagcagatcttgcttgttagtctaaatttgctattagaaaagttttgaatacagtagataaaatatctggggaatatgcttggttgtcactcaggagtgtttatacaagtgtgatcaaaattataagtaacatcaggaaattgattatacaagcatattcactatacaagtgatgtcaaaatgatctgtaaggttaacgaaattcagcaaaagtgttaatgaaatatcaatagacctttgtgaaatataaattaaaattagtaatctaaattttatatactgaaatgaagtgtgagatgtatgcctaatttacagagagcattaaaagtttgggagaagagtatgatctcccatgagtggtctttacaatgtcttaaacataaggctatatctttaataattctgttgccttctagcccacaacctgacatatcttgatatttgatgagtctcaatgagaaaaccattttgtgtgtgtgtctcctggaatctttattactctagcaggaaagacttgaacactgttttctttctttctttctttctttctttctttctttctttctttctttctttctttctttctttctttccttccttccttccttccttccttccttccttccttccttccttccttccttcctttctttctttttctttctttctttctttcttctttctttctttttttttttttttggaaacggagtctcactctgttgcccaggctggagtgcagtggcacgatctctgctcactgcaaccttcacctcctggattcaagcgattctcctgcttcagcctcctgagtagctgggattacaataagtgccaccatgcccagctaacttttgtatttttagtagagatggggtttcaccatgttggtcaggctggtctcgaaatcctggcctcagttgatccacctgccttgcccacccaaagtgctgggattataggcgtgagccactgtgcctggccttgagttttctaatgcataatgcactgaagagttctctttcataaattcagaactgaggaagaggagaaagaagacagaacaacagagctgttattgaaaaatagacgtcttggtttcttttaacagtgttttgtcattctccttgtggagatatttcacctccttggttagatgcatttctaggtatttaatgttttgttttttttgtatgtggctattgtaaatgagattgtgttcttgacttgactctcagctagaatgttattggtgtataggaatgctagtgttttttatacattggttttgcatcctgaaacattactgaagtcattttcagttctaggagatttttggcagagtctttagagttttctaggtatagaatcatattgtctgtgaagacagatagtttgacttatttggatgccttttttttttctcttgcctggctgctctcactgtgacttccagaactatgttaaatacgagtggttagagtgggcattcctgtctaggcaacacaaataaatggaaaccattccatgctcatggattgggagaattaatatagttaaaatggtcatactgcccagagcaatttatggacttaatgcatttccaaactaccaatgtcattttttaacagaagtagagaaaactattctgaaattcacatgaagttaaaagagagcctgaataggcaaagcaatcctaagcaaaaagaacaaagccagaggccacacattacctgtcttcaaactatactacaaggctatagtatagtttgtatagtatagtaaccaaaacagcatggtactagtacgaaaacagacacataggtcaatggaacaaaatagagaaggcagaaataaagccaaatatctacaaccatctgatcttaaacaaactcaacaaaaattaagcaatgaggaaaagacttcttattcaataaatggtgctgggataaagggctatccatatgcagaagaatgcaactggatccctacctatcaccatatatgaaagttaacacaagatggattaaagacttaaacataagccctcaaaataaaaaaaaatcctagaagaaagcctaggaagtgctcttctcaatatcagccttggcaataatttatgactaagtcctcaaaaggcaattgcaacaacagcaaaaaaattgacaagtgaggcctaattaaagtaaagagcttctgcacagcaagagaaactattaaaggagtaaacagacagcccatagagtgggagaaaatatttgcaaactctgcatttgacaaagatctaatatccagattctataaggaacttaattcagcaagcaaaattcaaaaacccccattaaaaagggggcaaagaacatgaaagacacttctcaagagaagacttacaatggacccacaagcttatgaaaaaatgctcatcatcatcaatcattagagaaatgcaaatcaaaatcacagtgagataccatctcacaccaatcagaatggcttctgttgaaaagtcaaaaaatggcagatgttgatgaagatgcagagaaaaggggacacatacactattggtgggaatgcaaattcgtccagccactgtggagagcaatttggagattactcaaagtactaagtgttgaactaccattcaacccagcaatcccattactgggtatatacttagagaaaaataaatcattctaccaaaatgacacaagtacccatatgttcacgcaatgctattcataatacaaaaaacatagaatcatccctggggcccatcaaaggtggattggataaagaaaatgtggtccatatacaccatggaatactatgcagccataaaaataatgaaatcagtcctttgcagcaacatgggtacagctgaaggccattatcctaagtgaactaacccagaaacagaaaaccaaatacttcatgttattacttaccggtgagagtttaacattgggcacacatggacataaagatgggaacaatagacattgaggaccactagaaaaaggggggatggaagggggcaagggctgaaaagtttcctcttgggtactatgctcactacctgggtcacaggttcattcatacctcaagcctcaacattacacattatttacctttggaacaaacctgcacatataccccctgattctaaaataaaagttgaaaaaaatggagttgataagatataggtcaaacaagtgaaagtttgctctctttcattggttgttggcaaaacattgtctaatcagggcatatttaatgaccctagggtttttccataagcgtaggtttatacctgggaaagtccaggttatggtggaaaatacatagcatataagctgccaatttttcctttattgcccatgttttacattatattctataatggcacttttttcctgctgaacttgaatagacatcataaatattttcagtacttcactctacgtagctccactaattaaagttggacttgagataaaatctgtttcctatattgggcatggtgtaatctagtaatttctggaatgtataaaacttaattaatatacagatatacggacacttgtattctgctggagtcttgcattctgaaattcttggaaaatagactgtatgcacatagttttatctgggtggtgttggaattaggggagataagaataagaatatggattataagccaatccactatatggatgtgtggaatttaaatctaagagcttataaaatttattatattctgaaagaggtagccacatagaaatgctgcagagtaagcaatagcagacttctaggaaggtgctggaattcccaagatgagataaagaattgggctaggaattgaatgaaagatttagtgtactacctctggtatttgcacaatgaagccaactcagataaactctttttctgcttctcgctgcactgttttccagcatttttttctcattgtgtgcaagtagctaggacatagcaggatataccagataaaagaaatggtctagtatccagagagccttacagtcatacctactgaccgacctcccatttccaatgattagaattgtaatccgtatgctgttataggataaaatgttttagcactaccctctagatgtgattttctatttgaactagctgtggcctgtattaatgtatggtatgaatgaaaattgtatattttgaaacacaagtagatggcttgtgaatgctagttaaatattaagagcatactgggggactaatctttgacattttctctgccaagacaacccaagcaaagaatatttaattctcatgctttataaaaatgataggagttaagggatctcgttttaagtaaatttatatcaaagaaggagataaatatccttcagaggcccatgttaataaaatatgaagttatgaggagtttgttgaatactataaagaaaaaacaaattccaacaagttggtaagaggcaaataacaaactaatgaatctgattaaagtcttttccatatctgatttcaagaacctatagactgaagtagtaaagtcactacagtattccaaatctggtagacaaactgtaatgatgaatttttgggcacccagaaaatatttccctgaacaaatcatgaagtcaccctatccctttctccctcccttccttcttctctcccttcctctctctcttcattcatttctcccttccctccctccttccatctcctgtttttttcttcttcttcttctttttaaatcacaaggactcactgaacccagagataagcattgtcacagctctggatagtaaggaggaaagggaattgcaggactgtgctgtttcatcttacatgacaaatggatccccaataaataggcctctattttaataattaaattgtatggtgtttgattgattgaactcagaaaagataaccaagaatgtggaaagtagaaatcaagagtctataaatcagatctaacgtaggtctttgattatacatgcatataaattctccaactctcctctttcagtgagagttgccagagtgtttccttgtcagtttaaaaaattagaataagaaagcccagaatgtgctgacacttgaggaggagaaggtctttaatctaaatattttatcacattggttaaagaaccattggaacacttccaataatagagtcgtatttcagcttagattattattttagtagttccattccttttgccttgtaaatcacgtggtcacattacacagcccaatgttaattcatatataaagttatttgaaattaaataggccaaaaacatttgaaatcatactgacattttcatacatccatactattttccaacttcaaaagtattttaaacacaatggtctcattttggttactagacaaatctagccttgttgtagtgtggatgttaagaatttcttagccataaaaaagaatgagataatgtcctttgcagcaatagggatggagctggaggccattatcctaagagaactaatgcaagaatagaaaactaaacgccacgtgatctcacttatatgtgggagctaaacactgagtacacatgcacacaaagaaagaaacaacagacattggggcctatttaaagatggagggtaggacagggtttttcgtagggacagggtttttccatgttgccaggaaaggcaaggattgaaaaactacctattgggaactatgcttattacctgggtgatgaaataatatgtacagcaaacccccatgacatgcagtttatctataaagtcaaggtgcacatgtacccctgaagctaaaataaaagttaaaaaaataattttttccatattttatatattctgtaaagagtgtggatttgagttatatagtttcccagcctgtccaggcccaggtgacgttctttgttcattgcttaataagaaaataaaggtgaaactattaccatatgtagtaaagtgattcataggaatgaattactgccattctcaagtctatttttatctgtattagctttttctttatggtgttggaaagtctgaaaaccgtaattagtaaccagtactttaaaaagatatctatagattttgtactcatttacatttgcaattactttattatcctggactttcagacttgaacatgagcaaaattgtgttaactaagacagcattagtttatttattcaatgaataaaaatccaacttgagtcaccatgggaatacccgtgattgacttgcctatttggctgcatttcactctcacacattgtgatgggataaaaacactatattttctaaactgaattttcaaaaaggcactaaggatgactgagcaaagcattctgttatcaatagcgctgtactcagataccagcatgtgaaatctacatttatgtctgcaattttggagaactaagaaccatatggtatcttggttttatacttcctgaatcagcttaattgcatctgcataccaattaaacttgaataaatatgtttgagtgctttttagttgttgatattttgttataaagcttttactccaatttgactaaaagcatttttaactgcacttggtttataaatgggttatcattttatattaatacacatcatataccatgttatttctttttatgataaaagcactgtttggcgtatccatatttcttagcaagtgttaagtaaaagtgatatagaaagtatctaatccatctgtgaatcaagttaaattatatatatttatgtatatatttatatatgtatacatatattattgttattgttgctgttaatttctataatgcaatctagaacatgaatgaacttttaacttgttgacactgtttctagagcattttgagtggttaaataaatgtaagtataaatatagaactaaacttgaggcttatatacattgaaataattgatgtttcagatgctgctcatctcatcttacccaaattactgtaccagcagactttggttacaaatcactgaatactattggttaaagaaagtcatatacatatacctgtcctcattaggttactatagaggctgcaatccttatgagctttttggttaagactctttaaaggagttgcatcatttatggaggacctttattggtcactgtatttcacaagagtcagattaaggtccattactctgttcaatctactcttagatccgtttgatgctgatgagagttttctatccagggtaaagggataggtgagtactaagtgatcaaagtcacatcaaagcatttggtataaggaaacaaaatgattgtgatactgcattaatggaaggttgctttctcatgctttgaaaataaacggctttgctttacctgaatatttatttccagtatatttcttccttgcaatctactacatgaaacagagggggaccgttatctagtgataacatgtttttctagttacattatatgttaagcaaactccttggttattcatatttctaatagaaacgctaatatttcatggtattttgtgatttaacaccatccccgatcccatgcaccattttgaatgattatgtggcattgtataccactaagtattctattaaatagaatttataatattcaagttaagtatattttattttttatttgtatttttattatacatgtttttaaattgttatggatacctaacagttgcacatatttatggggtacatgtgatattttgatacaagcatatagcatgcaatgatcaaatcaggataattggaaaaatatcaggataattaggatatccataatattaaagatctatcatttcatgttaagaacattacagttccactcttctagtaattttaaaatatacaataaaatgtttttaactgtagtcaccttattgtgctattgaacattagatcttattccttatatctaactgcatttttgtactcatcgagcaatccctctttatctctgcctccttatggttgaataatattccattgtgtatatggatcacattttctctatccattcatatgttgatggacacttaggttgattccatatcttggctcttgtgaatagggctgcagtaagcatggaaatgtatatctcttttcgttgtattgatttcctttcttttggatgtacacccagcagtgggattgctgggtcacatggtagctctttttttagttttttgagaaacctccataatattctccacagtagctatattaatttacattcccactgtgtataagggttcccctttctccacatcctcaccagcatcagttatttcctgtctttaggataaaaaccattttaactgggatgagatgatatctcattgtatttttgatttgcatttctcttattagtgatgttgagcaattttcatataccagtaggccattttaatgtctttttctgagaaatgtctgttcatttgctgatttttattgtattatttttcttattacatttttgctattgatttatttgagttccttatgtattctgattattagtcccttgtcatatgggtagtttgcaaatatattctcccactatgtgggttgtcccttcactttgttgattattttctttgctatgcacaagcaagcttttttagttgacgtgatatcttttgtacatttttgctttatttgccagtgcttttgtgatcttactcaagaaatatttgcccagacacatgtcctggattgtttccccaatgttttattttagtagttttatagtttcaggtattaggtttgtcttcagtctactttgaattgatttttttttttttttttgagacaggggcttgttctgtcacttaggctggagtacagtggtgcaatcatggctcactgcaacctcagcctcctgggcttaagccatcctcccatcttagcttctggagtagctgggaccacaggcatgtgccaccatgcctgcctaatttttgtatttttcatagagacagggtttttccatgttgccaggctggtcttgaactgctgagctcaagcaatctgcccaccttggcctcccaaaatgctgggattacaggcatgagccactgtgcctggccttgagttgatttttgtatatggagagagatatgggtctagttttattcttctgcatatggatatccagttttcccagcaccatttattgaagagacagactgtcctttccccaaggtatatccttggcaactttgtcaaaaatgagtttactctagatgtatggatttgtttctgggttctctattctgttcaattggtctacatgtttgtttttatgctagtatcatgctgttttgggggttattgtagctcttgtttcaaagttattaatttgaagtcaggtaatgcaattgctccagttttgttctctttgctcagaattgctttggctattctgggttgtttgtggttcaatataaattttaatttttttctatttttgtgaagaatgtcattggtgttttgatacagattgccttgaatctgtagaattcttcaagtaatatgggcattttaacaatattgattcttctaattcatgaacatggaatatctttccattttgtgcatatcttcttcaatttctttcatcaatgttttatagtttccattgtagatatctttcacttgtaaagtttacttgtaggtatttaattttacttctagttattgtaaatgggattactttcttagtttctttttcaaattgttcactgttggtgaatagaaatggtactgatttttgtatgttgtttttgtatcctgtaactttactgaatttgtctgtgagttataatagttttctggttaagtctttcagtttttctaaatataagatcatattatctgcaatcaaagataagttgacttcttcctttccaatatggttgccctttatttattcagcttgtctaattgctctggctagggtttccagtactatatttaataaaagtgatgaaagcatacatccttgtcttttctatattatagaggaagggcttttagttttttcccatttaatacatagctagttgtggatttgtcatatatggccttttatcatgttgaggtatgttcctttcacactgttgagagcttttatcatgaagggatgttgaattatattaaatgatttttttggcacttattgaaatgatcatgtgtttttgtccttcattctgttgatgtgatttattgcctttattgagttgagtatattgaagcatccttgcattcctgagatgaatcccacttgatcatgatgaatgatctatttaatgtgttctgaaattcagtttgccagtattttcttgaggatttctgtatctatgttcactagagatatcggcctgcatttttctttttttgtcatgtcattgtctggttttggtattggggtaatactggccccatggaatgagtttggaaatagcctctcctcctcaacttttttggaatagtttaaacagtttatatttgttcttctttaaatgtttggtagaagttagcagtaaagctatcaggtcctgggctttttttcattgggagacttcctagtactgtttctctttcactacctgttattgtatacattttagaaatattttgcaattttattgtttgtaaaagaaagtgaagcagactatgatttcacataaggtgacaatttcaataaagcagaagaacagtttagttcattaaaaattttatagaattatttggatagtttgtgccacttacacagtttattgatggggatgcttttttataaaaattatttttcataaaggttaatataacataaataaaaaaatgacttgactcacaacttaaaatgtgatttcttatgcaaagtgaaattttgaagctttaaataatttaattttactgaacatttgtaacagatacattttctcagtcttggacagggctagtgttggcttagaaaaattcatacacttaacattctatatttattttgcattttcctttatgcctaatgcagatctcccatgtagtagtagaattttaataaagtttgttaagtcattaacttataaacagattttacattctttggaaatatcactgttctttggaaacttcaccctgtggcctgtcttcatgacttgatttcttaaactgctacaaagaggtgttctttctctgtctgcatggcctcaagtgaattaatcattgcagaatggagagagacattttgaagaaaaataatgtagtgtgattagacacatttgcctcaggttgctgcagccagagtgtgttgtggtggtaatttactaaatggtaccctggtggtatgaatgagtttttaggttttatgactgctttacttttttccaagaagcgatttacacataggactttgctactgctcctaaaagaagcaatagaatcattgatctgaaattcaaaaaagcatcaccttgggttcttacattaataattaaaaaaaaaccctacaaaatagggtcagccaaaatcagaagcatttaatgctataaaattattatttagaagtaaaatgtataagttactttatagtgatatagtaaatattgctattttaaatagccaatgattgaaactacctacatgttttataataggagaaaccttaagtaatttgtggtaactccttttaagaaatcctatctgttaaaactttcatgaagagttgataatatgtatgaaattctttagcaggatacaacattgcataggcactttatctcggtgactcctcactgttctgcattatttccatgttacatgagtctcatcagagttttcacaaagccattcaagatgaggacatagttctgataagaacatgtttcattcaacataatgccatgtaaaggattcctgcatttaaaaataaactaacatagtagattcatgagattagacgttttccattttttatattcttcatgtcccccaaaatttccaactttgatattagaaatgaatttatttttaaagagtctattttaggaacattttgctttaaatatgaaaaagaaattacttacaagtaaatatttaatctaatttgaaactttatgtatttatgtttcatttttctattccatcctgacttttccattgtgattgtgattttgagtagtatttcttctcccagttaaaacaaatagcaaaacaacaaaccaacaactttaaacaaacaaaaaccaactgaacaacaacaaaaaaaaccctgggcatttttttattcttttctttctctcatccctctatcaataaacaattattactagtgttacccacaagattaccaagtttgttatcttgtttatctgtaccatgctatttaagcgagaatgtcgttatctctcctttggattattgcaatagaatcctaactgggtggctagttttggcaatcaatcctgtacaaagaggctatctctcttaatttagctccctacaaggatctggacctctaagttcctgacacttcatctcaaatagttattccctttactcacactgctacttggaatgatcaggcctgccccagggagtttgcacttgattctgcctctgctggaagtgttcttctcactcttcttcattcagctcaaatatcaccacctccatacttgtcttcttcattatttatctcattacagtaattatttttgtaagacatacatcactgttaaagatcatctaatatgcttatttgttttgtttatattctgtctccctcattggagtagatactcctccagaaaagggactagcccctctaattcccttctgaatcctctgtgcctggaggagaatatgtttcctgtttttgaattatttgagaattcacttagtattttgtgctagaagagtggtattcagactgtagtataataatcagggtgtaaaggacacccctgccctacataggcatggataccttttagataactaatttctcaattctcaatttttatttgtgattttccatacaaattacttgtttgagaagcttctgagttttgtcagtcatcttcctcatgtttctttcacaatctcccactttacaaaaaaacaagcaaatttatgaattcagattcacttgtgaatctgtttaggatgcattgttcagtttctaaaaacctctagtgtatcaaccaagggataaattactcagggagtcttttgagggcttcctaaataaatattggaaggtgcagtgccctgtttcctagaggcaatattctggtgagccattctcccctttccttcctcctctcctcctctctccctttggattccagaagtgagaaagtaagaatgttgctgtggggtattaacaggtttacttgatgctttcttctgaagaagaattttgactggatgatttgtttgacaaagaggattgctttgccaagtgcattgtgacacacatttgcatatatttttcttaaatcaaataagctaaatatgtggcttgacagtattgatgaaaatatattttaagcccacttagagcatataacagtcagaaaaatatgtccttttaccttataggaaatttgttaatggttaacttttaggtcttctagagattatgtagattttcaaagttattttagtaaaaagataatttgaaattattgtgctagacaatgtgagcaacatcaaattgttcaaaatatctctgtataaagtacacttgatatagaagaaagtgaaaaagagagttcatctttcacatggaatataagagaccactatctttcctcatttccagagtatctgtacactcctttaccctaataaattttacagggatagtatctctttattcaaatttgtacaatcttaatttgtagctcacatagatgcaaataagtttattaagaaaacacagttctgtagagggtgctgattcagtagtttttcacagtattcagtcaagaatttgatgtcttaaactcttgactaaattaaaaaggttaaaacactttacctaattttgtaataaaaataatgacatttatcctttgcttccctttatgttgagcagaggtctaagccctcaacttctttagtccttataatagttaaatttcttatggtaggtgctatgtatgactcaatttcacacattgtgaaattgaagctcaaagggagattaaaatactgtagattgcccaaagttagtgagagcagaaaccaaaatccaaacctagataatatgtctccagaattttttattaatacacattaggtatacatatttttagggtacatgtgatattggatatatttatataatcaaatctgggtaattggaatactcattatcttaaatatttatctttatttttaactcctggtacatttgaattattctcttctagctattttgaaatgtatattccattaccattaactgtagtctggaatgttaacccatatattatacaggaccaaaccagaatgctatactaagatgtgcagaagaaagttaaaataatgttttgagcaacattgaccctcatcagtaattattttttatattaccgaacatttatatatagtgtatactatatgctaggaaatatatacataggattccaatgccagtatgtggtttttctacaaacaaagcaaatagggtctcttttaggttttccttccagtttctgggtacccttatgtttgttgtatgatattctttctccactctgtctaagctaggatgtctgtttctttctttgaatattttattttgaatcacaaaatgttctcagatcctacataagtacttgtttagtattcaattctgaatatgcaactgttagcctgaggaaatctgtaggacggtacaactgtctctctctctctcgctcgcttgttttttgttgaaattgttgctagtggctgcatttttttcccttgtggaattaatattttctgtatttcctgtgaactatagtgattggaaagtcgcttaaaacttttcttgattacctaacagtggatctgtcattggaatactaatttggaatactaagccacttccaatgaaacattcctagagcagcaatagcattcagaatattattttgcaatattatatgatgttattgttactgttgtatatgtaatatcaggatatctttcttgtgcattcatcattgttataatttccgaatttgtctttagcatcagcaagatctagattaaaatttagatttgcctttacttttctgaacccaaatttatttatctgataggaataattatattccttaaaaataatttttatttcaaagtcataaaaaataaaacaatattcaattacaagagatatcaggtgcttacagagcaagagtgtttttacttgattgaaataaggacatatctctggcagtgagagtctctgcttttatttgattggattagatttaattctattatcaggaatactgtgttctataaatgttagtgcagctactatttgcatgtttctgagtgaagtacttaactagtttaggtttccatttattatcctcaaaaaacaagttcattttccaaatataaaattcaatacaatagttggtcgccaaggcagaactacctaaatgttccaagatgcaaaatccccacttagtggccactcaagtcggtcacatcacccttgctactgggcacagctgaaaaggcccttgtgccataaacacaagtccttttctcatgaatgctttcttacctattattctgtcaaattagcaatatattagtataaacccaatatagtttagtcattcctgatagtgatatttgatgcagtcccatagtctcaaagaagacaatttactgaatttattaacaaagtttaaagggttttcttaagaaaggaaagaaatgagctaaatttgttgtatctcctttattataatcttcattatgtaactccttttaaaaaaacttttaaagtcaaagaacaatataggcaatatgctttaatatatttagtaaagtctactttgaaataaaatttatgaatttaggtgaatttgttaattattggtataatatttaacattgccaccaatttaaaacttatttctccataacttgaaacaatttcaatctgacactctattagaatgttatattatgtaaatatgttaattatcagacatacttccttggttctaaaacctatatccctgttctaactcatgaattacaaaccaaaacattaagtaatagcagaaatgtaagaaaataggtatatgatttggttaagcccattgattacattagcaattaaagtaaaagaggaaggcaaacttgtcatcacatttctaattttatcatataccagacatactttgactgtctttactatcattttgctctttttttcctctctttttctgtaacacactacatttatgtgttagtggtaatggcttataacacattatttttcccttcatatctatggaatattgattctagtttgttgttaactttgaactagaaaaaatgatattcagatatatatgagtatatatgtgtgtatgtatatttgtatgtgtactaaatttcacagactgcatgcatatgttttaataaatcagaggggctcacataattcatctaatcagttgtctaatcttaataatagagaaacagaacccaagagaaattatatccacaaatatattgtgaaagtgttattaatgaatgtgatcattatatgttgagttcaaagacagctcttttaaaaaagccaaacccaagattctgtttttcacatgattgtaacagaattagtacacaatgccaatacatgactgaatggaaatcagcatattccttaacatgctgcagtcagcattatataggagacacctataacagcacttacttaaaaaaaaagctgcaattgtttgtggatatactcatattttttttttcctttcaccagaccaatgctgactttcagttctattgatctaacatttgtgtttgaactagaacatgcactgaaaatgttggattccatattactgcctatactgatttttattgtcaggtatctgtattactgactctacacacacagacacagaaataattataaatgtccaatgtagccaccttttaatttactatcctaacatgtattccgattagtactttaaaattctttttctcagactttggtattcatcctatgttgatataagatagttttttcattttcttctttacgttcgtatctgttactattagctgctgtatggagtatgtttaatacaataaaaaataaagtgatacctaaaatttataatcagaataaaatgttaccatctttatacatcttttacactaatatgttttctacaaagcagtacagttttattttagacatatgttcatgatgtttcaaaaacaacaagaaactatcagaaaaatgaaaaataaatttgaattgatatatatatgagtgtgaatccctttaaaaatatagatcctatacatatttataagagaaaaactttagaaactctgatttttattattctgttgtttcaagctttcaagttgaatcgagtttttctttgatctaaaaggcaatttatttttatcagatactaattgttttaaaaagatttaatttgttaatatactttaaggattttgtgatatttttaataattaaatgcccaataagagttagaataaaaaattaactttaccgtcaaaaaggaagatctcctgcaccctctgctgctatgtaaatgaaactgcaggttatttattataaacttatttttattttataaaataaaaaaagaaaataaaaaatttaagaagattttttaaagatcttttcaaagattttttaaatttaagaaaataaaaaatttaaagaaaataaaaaatttaaggcaaatccagtcattttaatatacagtaaacaaacgaaccattatagatgtctcaaaagaacatgcatctcagatatatagtttacttaaaaataagtaaaatataaactgacaaactagctttgaaaggaagaggtataatggcatcaatttgttattaatgagaaaaagtcataatgctacatacttctaaatcatcatattacttaaatttattaaccaacatacaaaaatctattgtggtttattgtttgtaatatggaaatattaaacattaaaaagattgtgaaaaacctggagtgaattatttgtgtcttatggctcactgccattttagatgaattattgtgttgttaaaataaattgactttttttctaagaggcaggaaatagcttgcaatagtgaaaccagatagaatccgagctgttacaaaagttgatcccaatttataaacagataccacttggattgaaaatctatataaagtataaattttactattaaaatgtagtttaataaaaaatagtcttgccgggcgcagtggctcatgcctgtaatcccagctcttagggaggcagaggcaggaggatagcttgagcctaggatttgagacctgcctgggcaatatagcgagaccccgttctccataaaaaggaaaaaaaatacaaagtctttatattattttaaggattcttagcacttccatatgttttatttatttaaatattttatattaaactataaaaattgaagcagttattaaaacactaggaattgatgtttgtattttgtcgaacttggtgaaattatttttagaaaaggcattttctgatatgtccaatctcctattccttcccagtggaaaccactgttaataatttttgtgtatcttccaagttgcttttaagacatttacatgcgtatttctatatccttccatattttgtagtttttaaataggctatatatctcatactcccttattttgatttttaaagtcttaaatataaaagtaattcatgaattcattctgattgttgaagcatcgtattacatataacaccatgtccccgttgacgacaacctcaattcaaaggccctctttaagggtaatcactgttaatgctttgaagtacatccttcaagatttttttcaggaagaaaaaaaatcatacacacatatgattctgcagagtatttaatattatacatactatttgataataaattttgaattgacataaaatgtattccgaatagtatatcacttaccaatttgattttattaacacaatgccttggaaatttttcctttgtttgttcatatctttgaccttatatgtttagctcttatatattatgctgtggaataaatagaccatttttagaattttaaaaattctcatattaatgaacatttatattattttatattttcactacaataagcctgagtatccctgtacatgcttctttgagcagatctgtgagtattattctagggtaaatgctgagaagtagaattattttttcattttatactttgataaataattttaatttttaaatgactttaacaatttggatttctttgtaaatgtctgtccatatatactactttttcaccaaacctgatattattaagttttaaaaagttataaatgaaaaatattgtatttatttctggttgataatggagttgaatatctgctcgtaatgttgattagtgatttatatttccttttctataaatttcctgttactattctttgctcccttttattctttgtgttttctgtttcttactggctcataggagttctttctatttccccgattactaatgagtttgagtattttaaatatatattcattggtgatttgtatttcttctttcaggaattacttgttcttattctttgctcacttatttttgattttagattctttttcttattgatttatagttctttatatattccagatattaattatctgactggcataggataccaaagaccagcccctgtcttaatgtatcaattagtgctccagagctttcccatgggatcagtctgaagctagtgtccagttttgaccacatcctggcttagcttcttatccacatatccccagtgtccccatcttattagactttctttctttaatcagcttctcatgtttgaacaagaattccttactcaggctctgcttctaggaaatctatcctggacctgtgatgacattttttttgaaatcagtgttttaaaatcaagccaattctccaatggaagatataattataaaaaaaaacaactgctctttactaataaacatatattttaagatgtgtgctatcctctttaaagttgtatttttgttatactgacattgccaccgctcaacaaatttatcaaattcagcttttggaaatcatgttcagactctgagacagtctttgaatgttcataatattgtcagttctttgctccctgactaaactattttgttgacagtgaacaattattcagtcatgtgcagtcaaagtgatcaatgtggtcaaatattttgaaattatttgtaacagacggttttaaaaatgagaagtgtctgttcatatcctttgcccactttttgatggggttgttttttttcttgtaaatttgtttgagttgtagattctggatattagccctttgccagatgagtaggatgcaaaaattttctcctattctgtaggttgccggttcactctgatggtggcttcttttgctgtgcagaagctctttagtttaattagaccccatttgtcaattttggcttttgttgccattgcttttggtgctttagacatgaagtccttgcccatgcctatgtcctgaatggtaatgcctaggttttcttctagggtttttatggttttaggtctaacgtttaagtctttaatccatcttggattaatttttgtataaggtgtaaggaaggcatccagtttcagctttctacatatggctacccagtttccccagcaccatttattaaatagggaatcatttccccattgcttgttttcctcagatttgtcaaagatcagatagttgtagatatgcggcattatttctgagggctctgttctgttccattgatctatatctgtgttttggtaccagtaccatgctgttttggttactgtagccttgtagtatagtttgaagtcaggtagcgtgatgcttccagctttgttcttttggcttaggattgacttggcaatgtgggctcttttttgtttccatatgaactttaaagtagttttttccaattctgtgaagaaagtcagtggtagcttgatggggatggcattggatctataaattaccttgggcagtatggccattttcacaatattgattcttcctacccatgagcatggaatgttcttccatttgtttgtatcctcttttatttcattgagaagtagtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttatatcctgagactttgctgaagttgcttatcagcttaaggagattttgggctgagacagtggggttttctagatatataatcatgtcatctgcaaacagggacagtttgacttcctcttttcctaattgaatgccctttatttccttctcctgcctgattgccctggccagaacttccaacactatgttgaataggagtcgtgagagagggcatccctgtcttgtgccagttttcaaagggaatgcttccagtttttgcccattcagtatgatattggctgtgggtttgtcatagatagctcttattattttgagatacatcccatcaacacctaatttattgagagtttttagcatgaagggttgttgaattttgtcaaaggccttttctgcatctattgagaaaatcatgtggtttttgtctttggttctgtttatatgctggattacatttattgatttgcgtatattgaaccagccttgcatcccaggaatgaagcccacttgatcatggtggataagctttttgatgtgctgctggattcggtttgccagtattttattgaggatttttgtatcaatgttcatcaaggatattggtctaaaattctcttttttggttgtgtctctgccaggctttggtgtcaggatgatgctggcctcataaaatgagttagggaggatcccctcttttctattgattggaatagtttcaggaggaatggtaccagttcctccttgtacctctggtagaattccactgtgaatccatctggtcctggactctttttggttggtaagctattgattattgccacaatttcagctcctgttattggtctattcagagattcaacttcttcctggtttagtcttgggagggtgtatgtgtcgaggaatttatccatttcttctagattttctagtttatttatgtaggggtgtttgtagtattatctgatgttagtttgtatttctgtgggatcggtggtgatatcccctttatcattttttcttgcgtctatttgattcttctctcttttcttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctggttcttttaattgtgatgttagggtgtcaattttggatctttcctgcttcctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgaatttaaacccagctgttcttgtatcagagtctgaattcttaacagttatgcattcactgtgtctaaaccttagtacatggaaccgtaagattatttaaacataaatatgcctcttattatttacttaagcctgggtcatatgcttttacacttctttcttcttttaccactaacttctttctaaatctgaccaaagcccatctttctctatttctcttttctctctgtttcttctggtcattaaaaactaagattgtatctggctgagtatcaagattacgtatataaatgtgtaacttatgtctttctaaatatatatcatcatcccttaattaattaatccaaacgactcatctgctttcctaaatcctgctagaataatttctttcaaatgtgttcttcccttttgtagcttttcccattgtcatgctacttgcacaccactcaccctctttctctttttatctgggggattgatttatacaaatctaatcagagacagtctgtctttgcttatataccatgttttgtgtcaattcatttttaggagtgacccaaagactgacatttcttatataagcaattatttgttttggttattatgtttatttgttgagaacaacttagtgtactcaatatagctaaattatatacaaatttaataaattgttaattaaacatatctaatcaattatgtgatttctggctttttctaccttaggctgacaatctcattctcttttctgtgactgatcatccacttggtccagattagccatccttttaatgtgtctcatattctcctcactgaccttactggcagaagtggctttcgtcattgttgtgggagtcatttagctgttaaaagtgcctccattattttcccatttatttaaggggaaacagcaaaacattttggaaatgcatttagagataaactgaaaaagtgttgagatgtagatagcatggtctttctagtagaaagagcctggactgcaagaatcctcacaagtgtgagccctgtttaaatctgggttaaatgatataattaggtaagactgggaaattacttcaagctgatatcctacttattttagtaaaaaatgatcaatgtcctttgatatgtttacatattattaattttctgccatcattttcttaatgttaaaattattacctaggaaatatctgttgtttttttggggatcttcttttattttcaccaagtataatggaagattttctttttagtgtggtcattaaggctctaccaggttattttctgaatgtttttctgagaaagaatcttgctgggaccagatttaacttatgcagcattcccctaaacacttcaagtattgataatttgttttcaaatgccaataaaaatataaatttagggactttgattacaagaggtcagactactgatctcacattatatacgtcttttcagtattattttatgtcatttttaatagactggttgggacacatgttttgttaggtagatgattttcataactattctaagagctacaccaccatgtacctcttgtttgaatatatttcctcagaaaaggcagagctctatacctaatctgtgccaagcagtgtgttagtgtctttgtgatgtagtatcttctcattcttaaaaaactctataaaataattattattgatgttccagtttatagtcttagtaagtggtagtacttgcatttaagtgccaaccaactgcatgtgtgcgtaaaaagtaattaagagagacaaaaatacttaggattatctcatatatgagaccaggtgtcatgtcattagctctgactcataatgaaaaaatatgaggggtgtccaaattctaggaaaatatttgaaaagcaatgagaaagaagaaaagcgaaggcaattttgctttccttttacctgtacagacagatagacctatttaagtgtatggtagttagcttccaagatgatacagctctgaaaccctgcaggactgttttatgctgttggttaatgtatgcatttggaatcacaaaagaaagagtatttgttttttgagacagggtctcgctctgtcacccaggctggagtgcaatggtgctattgtggtttactgcagccttgacctccaaggctcatgtgatcctcccacttcagccttccaggtagctgggacaacaggtgtgtgccaccatgcctagttaattaatttttttttctttttttctaagagatgggttctccctatgttgctcaggctggtctccaacccctgggctcaatttatcctcctgcttcagcctcccgaaatgttgggattgacaggcatgaaccagtgaacccagagaataatttttaaaatgtcttaattatgtaatatattttacttttagtccaactttaagtaggtaacatattaatgatccatatccaaattatgaatcatttaactagaattcatgtcttcttcaaccatatcaaataagaaatttgactctaattttatttagaatagatcctcctataatgtggtactctgttcagggtaatgattgtgtttactaaagttggagaggtcattgaataaagtactgtactttctggaagccttttgttaaatcctggtgctaaagaacaaaagtactgtttcttcaggttgccattgtaaatttctaagagatcaaactgagttttatttctaatagggtctgtatacatttgtgtagtagtattgtcttcaagttaatcttatcttttgtttatttacatagcattaaagttataattaaaaaacacttctcttatgtaacaaatttgttttttcaaaataaaataacgtttatggtaataaagacccctagataatggataggtctagttcaaccttcatatttttaagacctattattattaaagtgactatgacttctgaattgagaaatattagataagaattgagaaaagatgtttattttatccaatttggaaatttataaaaatatatacaaggtttgctaagggattaaaggtaactgttataaaaacattgtagtaaaaagaaataaaattagcagttatgatgttgttacatttatctttcatgaataattgaagttgctatgatgacatattgtttcattaaacttattcagcattattttttcatgttttcaactgtttattagcaaatttcagattattgaactttttacagtttggaagacttttaataaatatgcatctctaaaagttgtaatttagcataattaccctcaggattataagatttattcatggcagtgagacagaaaatatatttatgtaggtttgaaatcctgaagtgttgaagctaaaacttcattttttaaaatctatgtattctataggtacaaattgcgtattttatcaggcactgggtattaaagcaaggagaaatggtttttggcattaagaagcttaagacaaaatagtaaattgagataaatatacagatgcttactatgtaagctaatacttgaggatatgtaaaggaggagtaccaggtccaaaatgagagacagtgggaatggggtgtcaggtagggaaggagtgtcagggatggcaacttggaagaggcaatgttataatagtaggaggcttttgccatggagttacaggaagggcatcccaagctggtggacccaaatctccaaaggtcttgaaggtgaaagtgattagaatatggcagtcatgaccaagtgcagtggctcatgcctgtactcccaacactttgggacaccgaggcaggaggattgcttgaggccaggagtttgagatcagcctgtgcaacatagcaagactctgtctctatgaaattttttttaaagttaattgggcatgatgctgtatgcctgtagtcccagctacttgggaggctgaggtagaaggatggcttgagcccaggaattcgaggatgtagttaactatgtttgctacactgcattctagcctgggtgacagagcaagaccttgtctccaaaaacaaaacaaaacaaaacaaaacaaaaaggaagaaagaaaaggaaaaggaaagaaagataagaaaatggcagtcatcagtgaaagcggagcatgaagtgtgacgagaggactaatgaatctggagatgtagacagcatccaagccttaaagagccttcctaaagaatatggataatcttgacctatagtctattttcctcttatttggctgagaaactctcaagggaaatacaagttcatattaaaaataaaagacatgtgaaggatatttacctctagtagatttatatctactccaggttattcaataatgtgcagatatcttttagtatctatgatgtttttacttaaagaaactaggacaaacatatcactgacctaaatagattatttgtgcccagtggaagtctggtggttttcattaagtatttaggagcaagagtgattttaaaattgctgccaatgactttctttacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacacagatatagatcaatggaacagaacagagccctcagaaataatgccgcatatctacaactatctgatctttgacaaatctgagaaaaacaagcaatggggaaaggattccctatttaataaatggtgctgggaaaactggctagccacatgtagaaagctgaaactggatcccttccttacaccttatacaaaaatcaattcaagatggattaaagacttaaatgttagacctaataccataaaaaccctagaagaaaacctaggcattaccattcaggacataggcatgcgcaaggacttcatgtctaaaacaccaaaaacaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagagaaaaccaaacaaccccatcaaaaagtgggcgaaggacatgaacagacacttctcgaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacagatgctggagaggatgtggagaaataggaacacttttacactgttggtggaactgtaaactagttcaaccattgtggaagtcagtgtggcgattcctcagggatctagaactacaaataccacttgacccagccatcccattactgggtatatacccaaaggactgtaaatcatgctgctataaagacacatgcacacgtatgtttattgcggcattattcacaacagcaaagacttggaaccaacccaaatgtccatcaatgatagactggattaagaaaatgtggcacatatacaccatggaatactatgcagccataaaaaatgatgagttcatgtcctttgtagggacacggatgaaattggaaatcatcattctcagtaaactatcacaagaacaaaaaacccaacactgcatattctcactcatagatgggaattgaacaatgagaacacatggacacaggaaggggaacatcacactctggggactgttgtggggtggggagagtggggagggatagctttaggagatatacctaatgctagatgacaagttaatgggtgcagcacagcagcatggcacatgtatacatatgtaactaacctgcacattgcgcacatgtaccctaaaacttaaagtataataataataaaaaataaaaaaaaataaaattgtttaaaaatgtttctcattagttgaatcctttgaatacttgctaaagagttatgggactgactctttcatttactgttgttgttggtgttttttatttttttttttgagacagagtgtcactctgtccacccaggctggagtgcagtggcctgatctggctcactgcaacctccgcttcctgggttcatgccattctcccgcctcagcctccctagtagctgggactacaggcgcccaccaccatgcctggataattttttgtatttttagtagagacggggtttcaccgtgttagccaggatggtctcaatctcctgacctcgtgatctgcctgccttggcttcccaaagtgctgggattacaggcgtgagccaccgcgcccggcctcatttactgttaatgctgatccaaatgcaggaaatactttaaaaatggccaataaatattttaatatacataaatttgagtatttcagtaatgatggttgacatcttgacattcatgcattgaagtctgtaggttcacaaccagctgcaaatcattatggttgattatattctaattagagcaaaattcttcaataggcattgaatggaaataaatgttgtatataagtgaaaaatatcgtggctgtaagtgatgttagttaaaccattttaaagaatatagtcatgaaaaaatgtattattcattgtatacactttggaaaatctaagctgtgaggaaaatcacacatttttatttgtgaaaaattgtaagagctaaaatgtctgtttatgttttaggttttcttcaagcaaagccttacaagaatactgaaatgttttggagtgtttcacatatagtttgatttaaattcaaattcatatggagaaaagggaactcttgcacactgttggtgggggtgtaaattagcacagcctctatggaacacagtatggaggttcctcaaaaactaaagacagaactaccatatgatccagcaatcctacttctgggtatatagccaaacaattgaaatcagtatgtcaaagagatatctgtactcctatgcttattgcatcattattcatgatagccaagatatgtaacaaacctaagtgtacatctgtggatgaatggattaagaaaatgtggtttatttatataatgaaatgctattcagcctaaaaaagaaattctgtcacatgtcacaacatggatgaacctggaggacattatgctcaatgaaataacctagacacagaaagacaaatattgcatgatctcagttatatatggaatctaaataattaaactcatagaagtagaaagtagaatggctaccaggccccaggatggaaggaccgggggctggggtgtcggggccaggggaatggggaaataatgttcagagggtacagagtttcagttagacaggagaaataagttttagaggttgattcgacagcatggtgactatagttaataataatgtactgcatatttcaaaatggctaaaagagtagattttaagtgctgtcactacaaaaaatgatatgtatatgaggtgataagtatgttaatttgcttatttcataatataaaaatatcaaaacatcacgttatacctcataagtatatacaattgtcatctgtcaattaaaaataaaatcaatttttaaaattaaattcattgactgtagtgaaaaatcatccatcaaaaatcttataatacaaatatgttagattttatgttgtttggagaaaaatattaaatacttatgaatgcatatctgaaagcaaatatttgtcatttttgtcacatacttgttcaaggaaatgaaagtattttacttgatcagttctcatatttatcaggatgataaaatagaggattttaaattttgtatagtatttgttaatttttagtcacgtagttttggttgtaaagactaagaaatgaaacagagtctgattcaatttacaaagggagagatcgtattacagttgaaggattaagcaaaactcataaacaaaacagcaaccaaatcaggtacagtttaaaaatcagtgaaaaatggcagtcactagaatagcaatatttgctgtacaagtttgaatccttgatgtagaaacatagctgggccttcattcagcagtaggagttcatgactaattactttagtgaatgcagtatgtatcatgctgattatgagctgaccctgtagggttttttattcctgctttaccaggtgttggctgaatgacattatgcaagttgcttttctgttgtaaaatgttcatagtcttattacttatttctagaaatataaggtgtgaaagagataatctgtgggaaagtacctggtacgtagcagttgatgagttgtagctgccacatctcctcactcgtgtcctcctcctcctttatcttctccattgataccctgaatatactgacattaatatggttcataaatgttctatgcttctgattctctcagtatgtattgtcacttctctcaaggttaccaactgtcttagtttttactcaagtattttcttcaactgatacctgtggttctctcataagtttaacttgtttataaccctatgttatatccttgtgatttagtttcttcttctaatggcctgcttatctctcagcttcccaaaccaaacttgtcctggggtggggggaggggggagggatggcataagagaattacctattgtaaatgacgagttaatgggtgcagcacaccaacatggcacatgaatacatatgtaactaacttgctcattgtccacatgtaccttagaacttaaagcataatttaaaaaaaaaaaagagaagaaaaaaagtctatagccattggcttttctttgagtgctgattgtagtgtcaggctataccattgtcttgtttgtgattctgttgagctcacgtcagtaacttgttgagtcgtgtggtgtaaaatgaaaatacttctagtggtctctgacaggagtcatggtggggcatttacccagacagaaatttttatgtctgtcacgtgcctactgcatctaaataaataaacataaaaagttaagaataaacagtttaccaaaattatggaacagctataagtaggaagtctgggtcttaaatacctggtgtctccaaagccaacactcttgcataaactttaaatatttctgttaatcttaaaatgtttgcatcattacaaaatatcaatactagctattgggtcatttttactacttataaattcaaaaaatctttattaggtatcagatttttgttatttatcgtcttagtataaactaaattctattttgtgtctcgaaaagcaatattttgttttaaaatgtattatttgtagttgaattctattgacttgttgtttttgttttaacctttctcaggctgcaaagttggctttcacagtgcaagcctttgattcccaatgggggactcaggatcaagacgatctaccctggtctcccggttgccaatattcagaagaagtattaacagaagacatgattctcttccttcttcaccttcttccagtaatacagttggtgtccacagttcctctccttccagcactaactcaagctcaggtagcacaggtaaacggaggagcatattccgtactccttccattagcttccaccataagaaggggagtgagcctaagcaagagcctaccaaccagaaccttagtatttcaaatggtgctcaacctggtcacagcaatatgcagaaactgagtttggaagaacatattaagaccaggggaagacattctgttggttttagtagttcacgaaataagaagataacaagatctttgacagaggattttgaaagggaaaaagagcactcaactaacaagaatgtctttataaattgtctaagttctggcaaaagtgaaggggatgattctggtttcacagaagaccaaactcgtcgttctgttaagcagtcaacaaggaagctactccctaaatctttttcatctcactataaattttctaagccagttctacagagccaatccatttcattggtacaacagtctgaattctcattggaagttacacagtaccaagagagagaacctgtattagtaagagcttcgccatcctgttctgtggatgtaacagaacgggcaggaagctctttacaatctcctttgctttctgctgatcttaccacagctcagacaccttcagaatttttagccttgactgaagattctgtgtctgaaatggatgcattttctaaaagtggaagcatggcatcccactgtgacaactttggccacaatgattctacctctcagatgtccctcaattctgctgctgttacaaagacaacaacagaacttacgggaactgttccctgtgcaattatgtctcctgggaaatataggttagagggtcaatgtagcactgaatctaattcattaccggaaacctctgctgctaatcagaaggaagtgttattacaaattgctgaactacctgctacaagtgtgagccactcagagagtaacctaccagcagatagtgaaagagaagaaaatatagggttacaaaatggtgaaacaatgctggggacaaactccccaaggaaacttggattttatgagcaacataaagcaatagcggaacatgtaaaagggatccatcctatttcagattcaaagataatacctacttctggtgatcatcatatttttaacaaaacatcacatggatatgaagcaaatcctgccaaaggtatgctgattttttttgtataacaaatgatatgaattaattttcattatactttattcagttttcttattccatctcatgaatggaaaccacatttttcttgtttttcactttcgaaatggtttcctattcataatttgtgttaaatgtttcccctgcttgattttaaacttacatcaattgtgttatgctgaaaatgtaattcagcaatattactcattttttctcacttatgttatccataactaagaagcagcctcttagttacggtgtttattggagcaccttcagaagaaagtgaatggaaagtaattgtttgcaatgtggatttctccaaagtaaggactgtcttttatagagtttattatagaggcattggtatttcttatttaatgaaatggatatattccagctaaaatcactataaaatttgtataatttaatacgaattttataatttcctttgttaactaagctttcattattaattaggatccatgtttcaacataaataattcctatctctagatacaataacagaattgtaagcttaaaaaaacctatctttggaagctggagacaggtttcaactctgcctctgacattaactaactgtgcaactttggacaccttccctttagtttaaaaaaagtgttagtatatgtccattactgtaatatggctacagaaaactttgtttttttaacatgaaattcagttcaagaaaatttttgaatatataccacctgctgggctatctttgacatattttaattcctttttctctactatcattaatgctactactgctactaataattttcccaaatttggaagtgattattatgtcctagatattattctgtatactttatatacattaattaaaatgattgaaattgctactattattataagctattttgcaggcaagaagatgggagcaaagataaactgtgtgtccacaatcacaaaactaataattcatttattgggatataaatcctatgaggtaggctcctatgtttcccattttacaaatgtgaaaacaggctaaagaatcatacagctggtaagtagtgcagtcagattacaactctctgaatccaaagctctggctctccataactatgctttactacatgtcatgacttaaaatattaaataaaatttatgtgacataatgtcacgagtaataggattataaagtttatccataaacatagaatttcaaagttttaaatgcatgagttaattttccagctgtcttaatacttttctcatttgatacaagatcacttttatgcacgtgaccatgtttgtccatttttggaactttgtattctttagtcatatatgcctagctcctttacctgtaatataatcatgagaatatgataatgatgatgatattaatgatggttacccttttgtataattaatatatgcccaaaaatgtactaagaagattgcatgcactgtttcatatagtccttataaaaattttgcatgtcatgttaataactaaaatttataataagttaaataactttatagggtcacatagttagcaaatgatggacttgatattgaaatccaggaagttttaaaattatataaaaaagagatagaaatgcaattatcctgacatatctaattcttatttagtaatgatgactttcctcaaagcctaattgaatactgcatatttttctctctctggaaattagagaatgatcagttatcttggagactattactatgttgattgggatcctatttgtaacacaataacacattaattttgctgatttgataatgtgttggctgttcttggataaataagctggtaatgtcaacaaactaaactatcctttagtttttgaaaatattcatgtgctatttataaggattttataattttgaagtttaaaattttaaaaacagctaagtaaatgtattttatccaataaagagttgctatagacactaactttcataatgctaaatttagtttgtattttgtatgaaatatttaagccagtactttatacacatctaagtgttctaggtgtacaatcatgtcagaactaatgagttatctggcaatttaacttttattcattgtcttaaaaagttatttaaaaagaactgctatatattggactaatagattctggacagtctttaaactagtagatgagcctaattagaacaattttttcatttactcattcattcattcagcaaatatttattgttttaacactatgttaggcactagggatgtagcaatacacaaaacaggcctagatccctgccttcctgaggcttactttccactggggatactcagttaacatgctatatatatcagatggtgataactgctgagggtaagtttaaagcagaataaaggcttaggaagcagaagtgggattccagtttgcatttttaaatgtaacaggatgatacccaaggtaacatattggtaaaggtttgaaggaacttaaataataagtcatacagatatttgagagaaatatattagtgcaaggttgtgagtcaaaggctgtgtagggctggagcatgccagtgatgtaccagagcagcaagagtccagtgtggcatgagcagagtgatggaggggagagcaggacatgagattgcagaggtgagcaggtgaacagggtgctcctcctgtccctggtttggggacagagagagcagtcatatgggtcatattatgaagaatttgttatgccatttgaaaaacatcaccttttggctagaggagtggtggtgatggccctcacttatgttttaagtatatgattctggctactatgtggaatgtagattgtgttgcgggtggagaggcagatgagagtaggcagaggtaggagaattgtagcaaatattgcagtaaccaagccagcatagatttggtccagggtcttagaaggagaggtagaaggaatcagattctgtatacagtttgaaggaaataaggacaggattcatttatgtgattaatgtgagcaacgaagcaacaaaggatgactccaaacgttttgggcttcaaagagattacatgattaagtgaactaaactgatgctatacatttaaaagttttcttgtgatagagaaactttgaataacactaagagtttttcatgatctttcagtgggacatttgtaaaaactacatttaaatatttaccttcatttttatttattttcctttccatagttcttgccagtagtctcagtccatttcgtgaaggaagatttatagagaggagactgcgatcctcgtcagaaggcactgcagggagtagcagaatgattttgaaaccgaaagatggaaatatagaagaagttaatagtttaagaaagcaaagagcaggttcttcatcttcaaaaatgaacagtttggtaagtatatacatatgtctgcctctaataaaataatgctgtctatatccgacatgttcatgtctcttgcaaaatgaacacagactacaggatagacacctcatatttgaagggaaaatttgtttccatagttgacattacaagtcagagaaacaaatttttcacctaggtcaggatggagttcaccatgacagctgtctttagttcctgtcttccttgcttccatggaaagtttgacattctttattctagaacaagacacttgaatacagaaactagggaaaatgctgaacatgaggctcccctttgacaccattatttcacatcttctctccaccatatagccctccagaaaatacccttttgtaaatcacacttactccagtaccactcttagtccctgtagaccctatcctcgctgtcctcctgcagtgcccttccacaaagggtgaggagttggtgtgaagcttatgaggaccaatgtgaaatgcccatccaatgcttgcatacattggaggtaatcaagataccctattcctggtccaaattgtagagcctgcttttagtatgagggtggaggtggggtgtgtggggagaggcatggtctgagtttgtatgtgtgaactagggtgtcacagaggcattagtatgaagctccctcatggtatgagatggacccaggggtgggaagagatgaggggcgaactgcagccttgggtccatgtggcctcaggtttcacaagtattagagtgtgattgccttttggagatcactttgctcaccttctcacaaatgtgtcctttttcagcagtgtatttaacatctattatctaaaaatgttccttaaaataatctttctacctacctatccatgcatatatgtgaaaaatgctcaaaaataaatcacttatgatatctctattgttttacataattgggtttcaaatgaaaatattaggtaattgagatctgataattattttgtgaagaagccttaagttagtaaggtaacattgtgtgatagcaaaatcactgtgcttgatgttagaggttttaatcgtttttttctggtgtgaccatttcttaatcctgggcaaatttgtaaccacaaaatagcaagtgataataggtgtcttgtttccattatactaaagaatgactatgtgagtatgtgtttacatttgtacatatggaaacatatatttcatgcttcgttttgttcttttgtgcattggctattatattattattgttgcagtggatatttttggtctaagtatgaaaatatgttaaagcggatttccaattgatgcaccattaaaagttaggactaatgaagtattacaaaacatttatcatcacaacattttcagtatttcttcatggagaggcatttatattaatagggttacactattcaacttgctcaaagttgtgccttttacatattctctcatatctcatgtgtttttcatactgcatttaatttaaataattctagtttgagacaagcctaggcaaaatattgagaactcatctctaaaaaaaaatttaataattagctagaagtggttgcacctgtagttccagctactcaggaggctgatgtgggaggatcacttgggtccaggagttggaggctgcagtgagttattgcaccactgcacttcggcctgggcaacagagcaagacctggtctcgataagataaataaaaaataaataaataaataaataaaatgtaaaaagtgcttcttataatatcacaaagtcactcttctcagatttactttttttttttttttttttttttttttgagacagagtctcgctctgtctcctaggctggagtgcactggtgcgatctcggttcactgcaacctctacctccccagttcaagcaattctcctgcctgagcctcccgagtacctgggattacaggcacctgccaccatgcacagataatttttgtatttttagcagagagggggtttcaccatgttggccaggctggtcttgaactcctcctgacctcaagtgatccacccgcctcagcctcccagcgtgctgggattacaagcgtgagccaccacgctcagccctccgatccgcttttaagatttaaaacttaagaaacaaaagtggttttgttcctttgaggccttatatttaaattttcaaaagtgtgcctgtagtattatagtctgtccactagatggcagaaagacaccactgccgtggtggtggacagtatatcagggttggaacagaaacttggtaaaatattgtacatgttcattggatttacagatgaaacttactgaaataaatactgaaacttttgaatttcctaaagagaactaccaaaaactacttcacgatcttaccatcttcctttggattttacaagttatgtctcatctttcagttactttacagtttattcattttttattttaatttttaatttttttaaggcagagtctcactctgtcacccaggctggagtgcagtggtgcagtctcggctctctgcaacctcccctccccggttcaagtgattcttgtgcctcagcctcccgagtagctgggaccacaagtgtgtgccaccatgcctgcctaatttttgtatttttagtagagatgtggtttcaccatgttggcctgattggtcttgaacacctgacctcaggtgatccactcacatcacctcccaaagtgctgggattacaggtgtgagtcaccgcacctgagcagttacttcacacttaattaattaatttaaaatgcatgaaatatgttttttaacttgtagcactgtaaggaagaaatggtagggattatttagttctagatacatgtgaaacaagtgatgtatatttggaaaattgtagctgtctgtgtgaacactggcacattttctatattcctcttccaaaataatttaagcaactgcatgtatttaagaatgtatccatggttcagttattttattttaaagcaattataatagaaacatgtgtttttaatgcttgttggaaccaagtgactacttttaatgcctgacatgtattatcacattcagtcctcacaacagtactatcaactaaatgattctgtggtgatcaaattttgcgaaagaggaaaataaggtactgagaagataagcaggttgcctaaaatgacatagctcataaatggcagagataagatttggatttggatcctttctaagttcaaatcctacaatcttttgggaaaatgtattcgatttaaaattaagttgagccatttttcaattgtttgcatcaatttggtgtaatgaaattaaaacatttaaagcaatctaaccttgcttgctctaagtctaggctgcagcattctgtaagagatacaaaagaggaaaacagaaacaaaatttagtgcttaatctgaacttaaaatgcggtcatgtttcttgaaatgctgatgaatagtatcaatgtccttactgagagatatcccatcaaaaaggaactttgtcacaaaagaggatattcatacttagcagttttgtaatacttctttactcctaacttttaatgttagcattaatgcagcccttcatgtagttcatggggatttcaattctcataataaaatatggctctatttattaagatgctgagcatttcctgaaagaccgaagatattacctgatggattagatatagttagatataccacagttctgttgtttttgtgtacttctggggtatttcaatctggaagcgaaaggacaggatgtatgaactcttcaaacatcaaatgccgagaacaaattgggattggcttaggtttattaaaggaatccaaagtaaatttggaacaatttgataagtgttcacatttattatattttttcaaacctctttatagtatttttccaatttttctctaatgagtagctttctgaatacatttcttgcgattgtccaaaaaatttaaaatgctgttctagaaaaaagttaaagaacatatttctttaaagaacttacttcaggaagtttctctccagactatggtatataaatgtatacatgtaaggatttctcatgggttctccaatggctttacatagggaattctaactctaaatatttacaagattactctctaaaaaagttaatgtgagagtagattcatatataatgaacaatacagaagacctggtaccgttaaaggaaggaaaaatgcctaagtggatgagtcaggataaacttggctaagtgataaaaaataccgctgggcgtggtggctcaagcctgtagtcccagcactttgggaggctgaggcaggcagatcacttgaggtcaggagttcaagaccagcgtggccaagatggtgaaaccccgtctctatttgcattttgtaaaaatacaaaaattagctgggcatggtggccagtgcctgtaatcccagctactcggaaggctgaggcaggagaattgcctgaacctgggaggtgaaggttgcagtcagctgagatcatgccactgcactccagcttgaacaacaaagtgaaactctgtctcaaaaataaataaataaaataaaataaataaataataacttccaaatctagcgacttatataatatagatttctttctcacttaggctacatgtttattgtggaaggcattggggttctgttcaatgtctcctcctcctgtattcaggctgtggaagcagctaactctgcaaacattgccttttaccatggcaaaaagaaagagatctctggaggtccctgtaataaaatactttgaattgtgaaactcactttcttctgctcacaactcattggtcagatctaatcatatggcccaaactagaaacaaaagcagccaagaataataatgagtttcctgtatctagaggcggagacttaggtttggtgaacacttaatgactcatattcccaaatattttgttgtatccaagttcttttaattaatcgagatttactgactgcctcctctttcccttttgtccagagtcatttaatgggccctgactttgtgcttcacactgtcctggtctttgtggttgaaaagatgaaaacatctctgtaactgaagaattcatatatactacaggttttattctttagaatattctctcttccttacttaaaggccttgagatgtgtatcttaagtgaactaagtttacttttttccttgactcaaggaatctttactatttttgtaagtatttattttcattgcaccaagcagttggttttgaaggttgcattatcttcagattactcagcaaatgcatttgcaaagttgccctgtactatttgtgctaagtgattcagacaactttcatttatggccaattttactctgacacagcatgttttctttcatttagcatcctgctgcttttatgtggaaactgtgaatgacacagtaaaaacataactgtaggactttggtagaagaacaaatccgatttatatttgattaataagaagtagttagttgcagatcgttagcatctcatatcacatttaattttttggtatgttgaactgcagaatttacttattattgataatagtagaataatatgactgtaccctatttgagatagccaaacactttactattcatttacttttcttctggggcctgctgttttctcatttattagcttatcctttattcattataattcttcatttcttcattcattaaaacattcacagtttcttacaataaatatttattgacaatctgctctgaagaatcaaagatgaaagagacagtgcttgaggatttttgagttcccaaagggagagataaggttaaacattatcttgccaatacaacagatttaaccattttgaccatctctaagttcagaatgggtggggcatgcttcatttggattgtgagcatcgaaatccaaagttaagaagagttaaaatgggcacatgaactcctgtttcccagctttgtctgtgccttatctcacacactcaatgacactgttaaatatatgcataactttcttgtgtcttttgttcatttctctaactgagacccagctgctagtgctgagcaggtttgctgaaagaaagttgggacagtaaagaagaacgtacaaaatgaatctcatgattaatattaaaacaaatcagtctcaaaacaccccacttgtacaatccgccaagcaaaagaatcccactgggctcatttggtatatacaccttcacacttctgtttcacggcatgaaagttgctcaagcttgaaattaaaaacaagacagcctgggtgcagtggctcaaatctgtaatccctgcaatttgggaggccgaggtgggcgggtcatgaggttaggagatcaagactatcctggctaacacggtgaaaccctgtctctactacaaatacaaaaaattagccaggcgtggtggcacgcgcctgtagtcccagctacttgggaggctgaggcaaggagaatcccttgaatgtgggaggcagaggttgcagtgagccgagatcgcgccactgcactacagtctgggcaacagagcaagactctctcaaaaaaaagcaaagatgataattagaagatctgattttgaaaatttcttaatcttgaaatccttaatgagactttccagtatgtaaaaatgttaatggctttggggagttaaaataacgattgcagtttttagtgtaactgactgttaatagaattaaagcaaatattgcttggttacagggacatctaataaaaatggaagccattaatatttttcaggaaatggagccatatgaatcattctcctcaattcttataaattttaaggaagaaaatcacaagtatcactcattaaacatgaaattacatttgttgataactggcatacattttaggttaatagccctaatcctttatgcttttatttgtttttccagttactaatcatattttcctttcagtacccttctaaattgtatcatggacgtaacactcaccacatagttatttgaatgtgtctcattttacctgaaaggtttcaatcgtttaaatggaaggagctgtgtatatactggcatttcttgcggtcattaatatagcacctggtggaaaaataggcatctaataaatatgaataaattaaaggtaaaatttctggttaaataatgatacatgtttatatagatgtgaattaaggcttctagtacaagaattgtgtgtggagtgcttatgcacagttttgacattttaacttattattcaaatatacaggtatttcttatgatgcattgtctgataaagctctggcttttttgacactaaatccttgatcaggaaggccataccaattatgacattgttccagtggaagcacaatttattttaggattatcagccttatagaatggtttctaggattatatgagtacgatagttataaactggccatacaatgaggacaagaaatagtcaaatatttgtggtattcattaagcccattaaaatataatatcttggtcaaatatgggtaagcgaagatttttaaaatccgctgctattttatctagtccagctcacttcgtttcttataagcttatagattcagagttgcctttagaagcaggattgaataaaaatattccattcatttttgtctttctgaactttgagatgagtcattttcatttagaagctgtcacaatttgtatgtttgttgggcaaaattagtaatagtttattcatacacttaactcacttcttaaatgatttaaagatcggtttgagtaatacttagcacctacattgttacctctgtgataacataatttaataattattacaggtacataataggtggatatatttatggggtacatgtgatattttgatacaggaatgcaatttatattaatactaatcacatcaaggtaattgggttatctatcacctcaagcatttatcatttgtttgtgttagggacattccaattccaggtttttgttattttaaaatatacaataaataattttttcactatagttaccctattgtgctataaagtactagatcttattcattctacataactatatttttgcatacattaatgtccccccaaccctccaactctttccagctcctgttacccatcattctattctgtatttctgtgacttcaaatgttttaatttttagctcctgtatatgagtaagaataggcaaaatttgtctttccacacttcattaattttatttaaaataaggtcctccagtctcattcatgttgttgcaattgacaggatctcatctgatttttatggctgaataatattctattgtgtgtatgtaccacattttctttatccttttgcttgctgatggacacttaagttgattgcatgtcctggctattgtgaatagtgctgcaataaacatgggagtgcagatatctctttgatatattaatttcttttttccgagtgcatacttagcagtgagaaagctggatcatatggtagctgtatttttagtttttcaaggaatctccaaaatgttctccatactggttgttctactttaccttttcatcaacagtgtacaagggttcccttttctccacatcctgttagcatttgttatttgcctgtcgtttggataaaagacactttttatatgcctgttgtccatttgcttgtcttcttttgagaaatgtctcttcagatatttttgcctatttttaaattggattatttagttatcttttctattgagttgtgttagctgcttatatattctgagtattaataccttgtcagatgggtattttctccccttctgtgggttgtctcttgactttgttgatagtttcctttgctgtgcagaagctttttagcttgatgtgatcccatttttccatttatgctttggttgcctgtgtttttgaggtcttagtcaggacatttttgccaagaccaatgtcttggagagtttccctaatgttttcttccatagttccatagtttgaggtcttagatttaagtgttaatccattttgatttgatttttatatatggcaagagataggcgtgtaggttcattctctgcatgtggatatccagttttccagcaccatttattgaggaatctgtcctttcctccatgtatgttattggcacttttgttgaaaatgaattcactgtatatgtgtggatttatttctgagatctctactctgttccattggtctgcgtgtctgtttttatgatactaccatgctattttggttattatagctttgtaatgtaatttgaagtcagataatgtgattcctccagttttattctttttgttcatgatggttttggctattctgggtattttgaattgttacatcaaaattttaggatcatttttctatatctgtgaagaatgtcattagtattttgatatggattgcattcaatctgtagattgcttaggtaagtgtggatattttaacaatattgatttttcagtttcatcttcagtttactttatcagtgtttcatagtttttattgtagagatctttcacttctttggttaagtttattccagtaaagtttacatattttattattattgctgttgtaaatggtaatgcttaccaggcaaagtctctttttctcttccttcactttcccctaaacagaaggagactctgtggtaaggtggcctggagctgagggaggggtaatgtaagtacttccattgccaccacagctggaactgcactgggtcatgcctgaagccagtgcagtactgggtcttacccaaggtctgtgacaactgctgcatggctaccactgatgtttacgcaaggtccaaatgttctttagttagcaaatggtgaatcctgccaggtctggatccttccttccgggcagcaggttcccttctagcccaggctgggtctagaaatgccatccaggcgctggggtctagaatcagtggcttcaggaatatgcagggtgcttcattttaatgtagctgagctggttaccagttgcaagacaaaatcctctgtactcctccctctcctttcctcaagcaggagtctctccccatgctgcacagcctggaattgggagaggggtgatgcaaggactcccttggctgccacaggtgttgtctcactgggtcatgtgtaccccaagtccactggctccaagtccagtgcagaactgggatttgcccaaggactgaagttcttgtgacctgtctttcaaagttatttgggaccccatgccactttggtcagctggtggtggagctagctggagctcagattcctacccctaggagggaggattctcctctggcaggaggggaaacctctaaatggtttctctgtgagcactggcagaatttggttctgtgttgtgttctcttgtgacaagacagcaccgagtcccaatgcaaagcctcacaatcacttcactctccctcccacaagctcacaaattttctgtctgtgctgccagaggatggagtaatggtggtttgggcaatgcaacagtgtctttcctatcctcttttttttttaaattttattattatactttaagttttagagtacatgtgcacaatgtgcaggttagttacatatgtatacatgtgccatgctggtgtgctgcacccactaactcgtcatttagcattaggtatatctcctaaagctatccctcccctctcttcccaccccacaacagtccccagagtgtgatgttccccttcctgtgtccatgtgttctcattgttcagttcccatctatgagtgagaatatgcggtatttggttttttgttcttgcgatagtttactgagaatgatgatttccaatttcattcatgtccctacaaaggacatgaactcatcattgtttatggctgcatagtattccatggtgtataggtgccacattttcttgatccagtctatcatggttggacatttgggttggttccaagtctttgctattgtgaatagtgccgcaataaacatacgtgtgcatgtgtctttatagcagcatgatttacaatcctttgggtatatacccagtaattggatggctgggtcaaatggtatttctagttctagatacctgaggaatcgccacactgacttccacaatggttgaactagcttacagtcccaccaacagtgtcaaagtgttcctatttctccacatcctctccagcacctgttgtttcctgactttttaatgattgccattctaactggtgtgagatggtatctcattatggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccgtttgtcagatgagtaggttgcgaaaattttctcccattttgtaggttgcctgttcactctgatggtagtttcttttgctgtgcagaagctctttagtttaattagatcccatttgtcaattttggcttttgttgccgttgcttttggtgttttagacatgaagtccttgcccatgcctacatcctgaatggtaatgcctaggttttcttctagggtttttatggttttaggtctaaagtttaagtctttaatccatcttgacttaatttttgtataaggtgtaaggaagggatccagtttcagctttctacatatggctagccagttttcccagcaccatttattaaatagggaatcctttccccattgcttgtttttctcagatttgtcaaagatcagatagttgtatatacgtggcgttatttctgagggctctgttctattccattgatctatatctctgttttggtacctatcctctttaatgcctctccttcacatgttattaaaaccaggtactatgattgctcacctgacttttggttcttatgaatgtgctttcttgcctgaatatttgttcagtttggtgttccgatgtggggacaatcactcggggttctattcagccacattgctctacctcctacattattaaacttactataaatagtcatgttgtaacaatagcagtatgaaatatgtatgttagaataaactgtacttatttattaagaaaataatttaaaaggacagcagtaaatgagaattagatatcttttacctgtaaccctacgaatctaggatatactttagatattaatagttcatatccctttaaaattaagaagttagaaaactaagattgtttatcttttatttttcaagttatattatttttaattggatcagttaagtttatctcttaattttccgtgagaggacaactgctttgttccttatttagctaactgaatgggctgggacagcttccatagcataagagataatatttattgattcagggtctgcgacagatctctgaccatctgaatagatgcttcacaatttgcagcacagaattgaccttcagtaaactaactacctgttctgaggtgacagtcactggaatctgaggtttgtacattattcattttagacaatgaagacgatttattttatacttattttatggtgttgaaatttaaacacattaaattaacatcaataaattaaataagtcaaagaaattctgactccaaaggtcaagaaatatagtactactgaagaattatattcagtattgaccattagaattaaaaaatatagaaatatctaaatatattcatactctttttaagtaattttaaaattgagacatttataattgtctcacaaactatcacatttgtaatgtaagtgtaaaacagtgtaatttacaagtgaatctgcatatgcaatttcacaatcttcctatgtgatacctttttttttttttttttttttgagacggaatctcactctttcacccaggctggagtgcagtggcgcaatctcggctcactgcaagctccgcctcccaggttcaggccattctcctgcctcagcctcctgagtagctgggactacaggcacctgccaccacgcccggctaattttttttgtatttttagtagagacggggtttcactgtgttagccaaggtggtctccatctcctgacctcgtgatcctcctgcctcggcctcccagagtgctgggattacaggcgtgagccaccgtgcccagccgataactttttgttttaaactagccgtttctaaattagagtagctgccatttttatcacttttataatctcattcattgattattttactcgtgctaaaagtttgctctgaaattccatatatatatatatatcttctgttgttcttagtttggtacatcccacctaaaacagactacctactaattcttttaaatctctctgttaggctctttattgtatacatttgtaattatatacaaaattattttcatactcagctagttatctcaataccacacagtgattaatttatgtgtcagtgagaaacattaagaattttattgccaagagagactcacataaatcagaattcttatcaggtttcaagagagataggtgcagtagggggtggtctggaatatccctcttgctccccaggccctttctttcggcatccgatgagccctggcccagggtattggatgaggtttggagggttgggtgtgtaccagtgacctcatttgtacaggaggagccatctcaatatgaagcatctccattttatactcagtgatacagcatagatggacatttttcagggaaccatagcctatatatttttagattccatcttcatttttcataagcaattcagacatattctgccaaaagcagtatatagataaactgccctagtgaaaacccttcagtttgtttgctaggaagtctgtcattagtatgtttccaaagagatcctaccaggtcatctgctttcttactttcaggaaagcagacaccattttcccctgtaagagggaaaatggatcacaggctagctgcttaactcaggcagcaagtggaaactttgaatgctctcctcaaaatatctgttctattcttgcaatccccctcacttgtatttttacccattggtgttcatttcctttgatcttagggaaatacttgttttctcatttcttctaagcaaaaattctaccacttgtccccattttaactgctcatctactttagaacggtactccatcagtatgtttcttctgctgtcttgagtttctttcccatctcttcattgctgtcagtttaaaacactgccaagttttccatctttgaagaaacaaataaaaaataatatttttctgtatcctacttgctcctaaagttctccatcctatccctctttttccctacaaggcaaacagtcgtgacacttgccatactcattttctcactgcctatgaattcctcgatttcatgtactttagccattataatacaggttctcaacatcagcattattgagattttgtcctggataattccgtgttagggggactgtgttgtgcattgcaggatgttaaatagcattcattacccctacctaataaatgccagtgggaccccctggttgtgacaactaaaaatatttccagacattgccatgtgtgccctggtagataaaaattgcccccagttgagaactatctaaaggtatcagtgactttgccaattttcttttttttaatcttaattttgtattcatttaacagtgttgaggactctgcgcacttactctctttctttcacagtgcgaaatctcctgtggttattctcattcttctttgctcttttcagattcctttggaggcttcttcacacccacactttaaacacagctatttctgccatttgatcctttattgcttttttatttacctgtcctatctaaaaacttaagatagaggggaagttataagtggattccaaacacaaaggctgggaatttctattatattggaaatctgacaaaattgaataggcacgacaatcacaatatattagatttatagaaatataatgagggcctatgaaaaattatttccatagggagaatagccaaaactctgaaggcaattatctttggagtggatatagagaaatatgcagtgattttgccctaatagttaatggattctctccttttttttttgatgtatattgctattgtaatttttgtttttatacaactatatttcagcctgcttttaaaatagtcaagtaattcttaatatccccttctgtgtctaaagtcactttggagaagcagcaattctgtcatttaaagtaggacctccctattagaatcagaaatgtaatacattgtaatactattttctactctcactgctatcactgaccattatgcattatttttccaaattgaaagcagcttaagtcaagcaaaaggcagtggcaaaagttgcgggcattgtgcaagcagcatgtattaaacaatccaggaaacttggcaacccccagagacacagatgttgcccacttctgccctgcagtgtggcctctgctactgttgtctctgctttgtctccttcagagcttcccagggactgtgcctcaggctgaattgtgcctcaggctggctctggtccaagaggagcttgtggtgtgcagagggcatgtgttggggaggggtgggaagttttgactatgactttagaaaaaacgaaaatctataaaatacctttagtgtctaaaaataaaaaaagtaataaagtaataaaatgtactaaattagtgaacacaaacacttttgtaatattttcatgcttttccacacttctttgttttttaaaggcttttggtacctcctaatctttcatatgctgtaagaatatgcacttgtattttatctttatgaaacttgtctgaaataaaagtgcattgtttaaaaatcaaaggtacactttcttctaaaacacaatatgaacaaagtaggaaaacttacaaaattggaatacttttttgtcagttagatgtgattttattttaatcaagtacatggtatgatgaaaagaatgattgatttgggaaaggacactgaactccaatgttacctgtttcagaagataataataatactgcccacctcatacagttgtcatagaatcaaataatatagtttatgtgaaaaggctttgtaagatttaaagtgctatacaagtgaatatgacagttgttttatcaataacgtgtcaaaactagaaacattgaaaaacaaatagtattgccttttaaagtagtgatttagaaaagaaatattttaaaagtcaaactcacatttagggtatatctttaccatgacagtgttagttcctttcagccacaactaaaaattcctaaatgttcaagttatttatctattagatctttataagggtaatgtgctatttacttgatttgtatttggctattttttgaaaagtcatacatttttcacagtcttcaaaatcgatttataatcacttagaaaaaaattaattgagcagtatgcttaagatttgaatgctatgatttatgttatactttagttagaaagtttactcaactcagttattttctgattattaaactgggaaaaaagcatctgctcagaagacaggtgtcttggctatttacagagaaatttaatttgcatttttttatttcttaaataaatacaagtttaaccattgtagacatttatgtgactacttatgtaacttatataataactcgataaattactaattttaaagtatcttttgtcaaattttaaggtaatgctattcaaaataggcaataacttcaaagaccaaaaaataacatagaagaaaataatgatagattatttattttcctttaagaataaattttgaacgtagtatatttagtagtaatggtcatttctatgataatttaagatctctaatcttttgtgagagaaacttttgtaacacactcgagtttttgcacttgtctttcttctttctttattctattggaaggatacttccaccagtaggttattcagcttgaatatttaaactatcagggattagaactagagggtaaccagctgtcagataattcatatcatgtattaggcttcagttgggatgagacagtatatctcagcatgctgttaccttcagtaagatttatgttccaaagtgtggatacattaatacaaatagtgattttaaatgaaaagcagatcagccacctagctatggttcatgaatcacagtgattctcactttatctttctctcttttattttttaataataataataaaagtacatagaaagtatctctgagccaagtgggtgccagagtacattgatgctaaagctttaacttgacccagccgtccactggaagttgctatagctgagaaaaaaagaagtgaggcatagatgctgggtttacatttagaaaaagagaaaggaactattaatgcgtgcttttctctaatagcatttatctctctaggaagtcctgcataacaaaagaagttgggatgccattaagttttatgaagtgatactatgatttcttgaagggaacttactattacgctgctggaagcctgtaaggtctgttaactaaagaagttcaaagatagccacagttgttcagtatatagttttgctttgtatttttttgattcagtgcagtggggttgaacataaaagatgcttgaatcttcagcttttcatgattctctgcttgttataaatagactattaagtaatttttaggaaatcagaacaagcgacctattcaaatgatttctacagaatttttttttccttttgtaaaacaatataaaatacagtgatttataaattttggtactatagctttgctaaaaatttctatattatttaaaaaataagaatacttttaccataagataggaaattattctggttcaataagcaagcctattttactgaaacaatagataaaaacttcactaaaaatatttttttctttttttttctttttttaagaagcatgagtgcataataaagtaacagtagaaatgctcaggataaaacagcaacccaaattaaagagagtgttaaaaagatgattttattagatggacttaatgtccacctaatggacaaataaagtaaattctgtttgacccagtgctaactatgtgcccgttatgcattaggtactattttagggcatggggatgacatagtcaacaggaagagaagatttctttacttgtggcagctgagttacatggtattaaaagaaactaaaagaaagtcttgaatctgaaacatttagatttcctaccagagtcctgaaatgcctgcattctgaaaatagaggctcctttcccacaaggacaccttactagaataagtaagaaattactagttctggattctattacagatctaagtaatcaatcaaatggtgaacagcccacaaccaaatctgaaaatagaagtgaggggatataattggcttataattattggtgaggtagagcaaaggtttaagtaaagtgagtccaatgcatttcttcagtgaacgttgtggactaccatgagccagaaactgggcattatgtcttccaagaaatgtaagacagcttttttttttttttaaactttgaaaggttgtattatacatttgttcagataatctgtttccacgaattgtcagattcacaaaacagaacttgtaggaagtagaactcagagaagtaaaatgaggtatcttcatctctatttttattttttcccctctgtcccctttttctgcctcttcttagtgtcaacttatttcttaaaaataaaagcattactgaaaataacaaaactcagttgcatattaatagtatcagactcaagagaacagataaattaggtattgcttcttctactgttcccgcatgtgaatcttttactttaaagaaaaagttaaccaaacttactttcatgctttatagaacgagcatcactttagttatgccacgtcgctacagttttcataagtaaattttattttatttttttgagatggagttttttttttttgctcttattgcccaggctggagtgcagtggcttgattttggctcactgcaacctccgcctactgggttcaagcaattctcctgcctcagcctcccacgtagctgggattacaagcgtgcgctaccaccctgggctaactttgtatttttagtagagacggggtttcactatgttggtcaggctggtctcaaactcctgaactcaggtgatccacctgccttggccctccaaagtgctgtatttacaggcatgagccaccatacccggctatttttatttaacaataatttcatagttacaaggaagttagatggattaagtaaagaactctcataggacctttagatagatttacaaattggtgatttttatcacattgtctttctttctctctccttctgtctctgtgataaaacaaacatatattatctatattatttttgtgaatcatgtgagtgttggttgtagacatcatgattctttactcctatatactttagcatgtattttctaagaagaaggatattctcttacatcagaaagtaagtatcaaaatctgcaaatttaaccttgccacagtattttatttaatataaatctatattcagtttttcctagttgtttcaattaaaacaaaatctaggctccaatccagaaccacgtgttatgtttagttgttatgtctcttttctctcctttaatctgaaatagtttctcatcattttttctcttacatggcactaacactcatgacagttatttgcagactaattcatgattgtctggtttttcactattagattcagcttatgcaatttttggaagagaaactacatgtgtaatatattgttcttcttagtggatcatgtcagggggtgcaaaatgtcaatttatctcattcctggtgatgttacttttgatcacttggtaaagaaagtgtttactagttcctcacctctctgtggaaagggacacagctgaagccatgccttttacatagggtgctctcttgcctacacagttgtaaccgggagtggttcaagacaagacatagactcaacagttttgatgatgaattgtggaaaagaacatagcactaaccaggaattagacaagaaacagaataacagaatttctcagaaacaaacacaaaacaaacaaaacgaaacaaaaaaagaaataaaaccaagaaaaaaatcagaagaaaaaaacaaacagaaattcagcaaacgtgaaatgctattgccacttgaaagtcactttgagatccaagaagagacatgcctggtcttaatcagaccgtgaagttacttctccagcaatgcagtttaagtggttctagcatgtgagtttacttcagcatctcagtgagttgtccacaattgtcaaagtgtaattttcaaaagtttaaaaatgattttttacaaatatagattggacaagaatcaaagatctactcaattcattaataagaaaacctgcacaatagtaaattggttcaaagagcatttgattaactggatatttatagcaatttgatagaagaatgctagagtaatattggaaagttggatacaaaatcggttcaggtcctgcaggacaattatcaattactagacaaaaacatttgtatcatcattggatacaaatttgcaagttaccttttaacttcactgagtcagagctcttacagtaaatagcaaaatcaaacaattatataatctattgaatgtagtaatctttgggaaagccttttaggtaatacttcagtatgcgatcaccttcttggccttctttctgttttgtattcttaacacaaccattaccttggtgagctcaagagaaaccaagagaacagcaatttagaccaagagaaattcatgtataattgcgataatgcacaaagtatttcagtaaggcaggagagttagaataaaggtgagatgctatgatagaaaggggtaggagatagagaagagctaggccagggagagtcactattatataatgagggtttgggtaggaagtcaggagcgattgactttttttaagcgattggttttaagcaggaaagtagcacaaacagataggccttctggaatcatcattcatttaattttaaatatattaaatgaattcattatgtggctataggttagagtaaaaaatactttacataaaaaaagacagtgttctttattattgtgactacagaacagcacattgcttttttgttgacatttgagataaactttatattgcaatttgtttgagatactttgctgccaaaaaaaaaagttttctctcagcatttagccaaagtttcatattatttattcaattatgcattgttttatgcttgttcttaaaaataatagagttgtgtatttaaaagctttcccattagtgaatagttacccaataatcatgaacttatcaattaaatctattagggagaatggcaataatgacgttcctaagagaaggacaccaatgaattatttatattttggctatttttcttttattcagtagtttgtgtaccattctaatattttgacttcaattataaaataccacaatttattagtgactgaagtcacacagcccaatttatgataaacctattttctagtcacaaaccaaactgtcattctgtaaaatatcctcatagtcttgcacatagggtagtgtgaaaggtgacaaaaggtaacaggaagaatttataaaagtcaaaaatcttatgtgtaggcagtggatgtgactatagggatttatacttattgtattgtaagtagcagcgggtttttggtttggctcctgtgtgttaattctgaaatcaactaccttattcaaaggcattattttttctaaaagacactggacatgaagaaacaagtagccagagatgcagttggcatgagctgattgcaagattattttctaattaaaatacgtcatggcaaagaaagaataattaggtatcatataggcttcttcattgacagaaaataaaagtgccacacttaatttttaaaccattcacaaatccaattcatgcgtaaagtgaacttaaagatgacagactaattaattaatgatgagtggattagaaatgagaaatacaaacaaacatgtctgaagagaggtagtaattatatataagcttgtaggttgtcaggattttcttaagtatttattattaggagaccttaagatgtttttcctaatacctaagaatatgagctttctatgacatttcatctataattttcatgattaagccttatataacattttcccttttcttttttagccctatgaaagcaaatatttgttccctaaatttgctcattgtcagggatggaaaatttggaaagttaatatttattggaagtttattatatatcaaaacttacatagtcatatttcccccatgaaaaactgtgcacttttagtaaatggatgtagtcattaaaattctttctcctattgaatcctacctccctgtaacttgtgtattgttctctgttgcaacacacaattctgcagtgttggccaggctggactcaaactcctgattttaagtggtcctcccgccttgtctttccaaagtgctgggattacaggcgtgagccatcacgcccgacatagatatttatagcttttttatatttttggcttttataaaatatgtatattctttcaatattaagaacactcaccatttctatgccatggatacactgttttgggaaataatctttaaaaacatgttacattcatagaaaaatagcataaatcacatgtctgaaaactgattagaaagtgataattaatcctttttttctagacactagaccttagattttctaaattttgttttattccaagagaatttggccttgactgcagaaatttccacagaatgattattttggctactgactaggttaactgacagttatgtaatcttgagttaaaggactaaagagacaatagtagatttatttattttggtggtatagatttagttaaagagttatccttaggatcactgataatgtggaggaacaatatttcagattccaaacataggactctacatgtgtcatgtaagaaagtgtaaaatgaataaaaacacttaggaccaatttgaactgacaattctgtgctttcattaatagactattgaatctcaaccagttttcacctgtcttcttcctagacttaatttgaagtgactgggtttaagtaagaatggtttaagtaagaacaggctgttaaagacttcaaaaacatttaataaatttatgatttcccttatcattatgtgagaagaactacaaatcagcttggtcctttccttgaggatatgtgtcctagatttgtgtctttgagtaaaggtattgcatagggagtttatttttgctttgattgtcaagaaagtagcaatcctggtgatgatggtggtgcgtgtatactttgctaaagtgaatccaatatgtaaaaatacacatttataaagcaagggaattcagccagtttttttgcatacaatttataataaatatactcaatagcaaatccttctgcattcgtcagcaatattagctgatgtttattaatggctgatgtttattaatctacagactggccctaagcctaaaatcaaaggtgaacacatcacaaatggtttatttacaaaacattacaaactgcaagacaaggtaatatctggcctagaaaataaggtgaagtagaaaaaacagaacttgcaatcagaatcaataaggcctgaatatctgttctctggctcttcccatgtaccagttctctactcacttccatcaattatgtttgtaaaaggtggttgaatgaagaaagcagaattgcacagaaggataagttgaaatgtaatgcagtgggaacagggcctcaactgatcatataatgaactctcagactgagatgagtcttcatatttgctctacatcagggcaagaggaagcattctctatacctccatattgatcaaggagtgcagactgctcggagaaggggttgtgacccacagtggacaaggcagtaagggctgagagctgaggccaagtcgtgaagagggatttagttgagagcagatagtagtcaaaacacagcagctgggagaatgcatgtttcagtcctgattgtggggatctggaaagtatagcacttcagccattggagtatctgtcttcacaaaaatcccttaaagttagacattattatttttcacatactacaaatgaggaaattgagatatatagatagtaattaatactaataaatatgctaatgtagttgtttttaatctttttttttttacaagatcccttaacattcttaaaaattactgaggatcaaaaagaatgttggtttctgtgagttgtatcaattaatacttacctaattaataatgaaaacagacatctgaaaaaaagtaagctattttcagataatagtatttaacccattatatgttaaataaaataattttttagaaacatctatattttcccaaacaaaaaaaatgatgagaagtgcggtattgctttacagttttgcaaatttcttcattgtctggctgggattttctctttcttcattcaatctggtgcaatatgttgttttgtgaagaatattagcccacacatagatatgttgttcgaaaagggtagttcctcacagtttagttgaaggcaggatctgaagccatattgatgaattttttatactctgaaataaaatgctgatactaatgtgaatattgtactcatagaaacacttttgactctttgttcttaaaaccagtcacattcactgctagttttgggacttgccccatctaagatagtggttgtcctcacctcccactatcttcatgcttcccacttcacttgctcctttctacctattcctgaatgtctaatgcaagttcttcaccccatgtgaaactctcctgaaatattccagcctttactgacttaaacttctgttttggacaaatgattttctgattgttttctttctgttgttttcaattttcttttccttctgctttttatcatctgcagttgtatttgtaacttgttttaaacaaaaagaattgaaaaattgaagttcctaacaatgttcattcttttgcagcttacacaggaaaaagaagcaaaacccacaatatatgtcatcttctgttgtgaaacaaagatatttcacactgattaccttatgagggcttgagtgtcactgattgttttactccagcatagtgcttaagcatagtatagtattcagttaattaatgtttattgagcttaattgaattgactgctttctagctctgcattttcgtttatacaaaaaataatgaaaatttgttattttaatcagacgtactcgccttctgattcagataaaattactaattttagtgagctgcaatagtgacaaaatctatctcctgttatgcctttgtatatgttgtattcttgactgttcagctattccacataaggtacatagctttttattgtattgacatcatatcaaagtccagatctaaaccatttcatgcaataaaataagtaagtcctatgagttccaatttgtagacgatacattcttggtagggagcttagtttctacaaggagtctcgagtaaaagcagcatttgttgaataaatgacatgttgcacatacatgtgtttctgtggatttaaaggtttgttgtagttttcataaattgtttatatatttatagcgtttacaagatgatttttgggaaaaataattttctttctatagaactccagactagtaaatccaattaccaactttccccgttactcatgccaaaaaacttgaacttcttcctgcctgtgttccttctctgagaactcacatttatgtcattcccaaattcttttgtcataagacacccagaatttgaccagttctcaccatctctgtcattgccatatgtcggggtggcctctctggctggagtcttgccatcgcctcccagctgctcccctacttttggttcactcttgcttgcttagtctgctctcctcagagctgctcaattgatccttttaatatctaaattaaattatgttatgtctgttctcaacacttcccaatggcttcccactatggcctgcatttccctacacaattccattccttgctttcgctctccagttatctcctattattttaccttcctttcgctccactaaccactttatccttcttaatttttcttgggcttgtcaagcaattacccaccccagtgtctttgcacttgtaattcttgctgcttggaacacccttcctccagattactgcatgttgtcctccctcattttctttgggtttctgctcaagtgtcaccttatcattatgtcatccctgaccattctctataaaacagcaactgctgtttttttaatctttccgtatctgctttaccatgcttccttttttctcaataatatttatcactattttacataatatatgtttgcttacttatttaatgtgaggctcacccaatactggagcaaaagatactttagagcatgtactattttatatatatatatataatgaaacatccccaaagcctagaacagggcatcaaacaaagaaagcatggaatacatattaagcaaatagaagaaagaaaaagtaaataatccagaaaaatattttctaatttgttttaaccttttgttattttatattttctccttagtgacaattaaaaattccatctactattatattttccccccaacacttccaatggttttctgccgttggaataggaccttgctaaaacaggcttttcataaagttctgaattacatattaatttctcttttggcctcacagtaggaggatgaaatactgcaagtggtagaagattatttttaccttagaatacacatcctagtgcatgttgcaaggctccaaatatatctattctaaagcgttgatttacatttaccctcaaaaactaaaagcaagcggagtttgacttctttgttctttcatagtaaatatcctgtgtaatgagagacttttgttttcttaaaaaaagtcctcagagaaagctgcactattactcaaattgtttctgtcaaattgaatttcatttgtgaatttgtgctagtttaaaacatttaaaaatcagacattttggcatattgtttttggattcaaaggaaattataattacagcagttacaaagcaaggaaaaaatagctgttgaatcatctatggagcatattgcataatttgtaattttagactctcagtaattcaattaatttaacatgacaacttttctgtgctttacaatttggcaatttctagcaatttaataggtttccccctttttatttccaaacattcccataaggtttacaagtctttgaaatgctaatttcaatcaaagtacagtttaatttaaaatttcattgttaattgtagttatttatccatttcagttatcgatgatccagcccagtggcatttgtcaaaatgagcagtcagttcatcttgggtttagatactaaactggaacatttaaaagttaacctaatgatatgtttagtaataataaagctgtaaacaaatttataatctatgcttaatacaaattgtaacataactttaaaaatactcaagacatgaataacagtaatgagttttcgctgtaaagagagctgtgatataatgtgggagaaattgaaattattataaatagaaaataattttgagaactgctactgtcatagaattaataattttgcactgtttttgaaaatcactccatttagaagatcagctggaatgtctgtttcctcatagataaatttttaacagaatagcatctttactgctgcatcatgcagtgaaatcagtgaaagtgttatttgttgaagtgcttagctctgtgatcttatgagagttttattatcttcttcctagatgaaaaatatctcttcttgtaatcatctttgacattaacttgacaatgtttagatggcatgtaaatcagattatgatgcctaaccattattaacacagcaaatgaatttttactctcgagttcataaatccacaaggagcattttttaaatataatatccttttaataaacctagatatttaaaaattaatttttacattatccccaaatactccaaatattatactttttgttatatttgtttttactagtctagacaactcaaataaaatagctaatcttctatgatatttatttaccaattctatttatatttatactgcattgtgttttatgatctatggataaaagctttaacttgtcaacctgactattaggctgtttagacattaaattcagtttctttttctctaggctgaatctgatttattattgcaccaaatacagttaataaatactcttttatggaaattatttattctgacctgaatctgccttaatcatggagattaaatgagactgacaaaaaatagaaagaaccttaaggtgtctggttacatattttgttgtagaatgtttaccttatatgcatagatagactaataaaacctcaatgtaaatataagctttagaatgcaggggtttatttggtggattagatggcactgatctagtcttttcatgactacctccccttgaggtaccgaaaatctggattatctttacttccagaagaaattaccagagacccactggcaaagtatttaataagacaattattttcttttaagtgcagtaaatgcaggcagtgtgtaaaatctgaattgaatacaagagatttgaaagcgagggatatacaaagagagaacatgcttattttctggtttctttagtccaagaaagataatgttgaactgagaatgggtgagaacaaggtaactgacctggggatctcacagttttgtggaaacagtgatttgctaccaatgcatatatgaggcctttacacttgttctattcttattaccatttgggcaatttcacgtctcttgtcatcttgctctccatagctcactgttaagtcttcagacattgactatcctcacccttacgccatcctcctttctcagaaagtaatcatgcctacctttcttttcacagagaaaatggagacaatgagagttctactcactcaatttctggcaatacttcccacatatacatttctatacttttgcattcagcattatttttttcattccagtcataaaggaaaggtcatttatcaagaatcttgtttgcaagtgaaagaaccatagcaccgagtatccctctgtcacctgctcattttcccgtaatagttaatcactctgaaataatattcttattttctcttactttctcaccatgaagttttccatactccaggactttgtggaaactgatcttgttaaggatgtccatagtttcctcattgttaccatcggtggacttcatcctctttctcttctctgtcatgttatattgctgattattcctttattcttaaaacatcctttttggcttttagatcatagtattttttaagattttttcttatcttattgctcttttcttatcagttgccttctctagtatcttttccttaggtattgatgtcctccagatattgattctgggtgcctctcttcttcttcactgcattttcccccaaatgatttaattaacttcaattctcaattgatgataataaaagtctctttcttcaggtcagcctctttatctgtatgacttgcaggcatgtcatctttaatatgttcaaaataaactatccttgctatcttgcaaactttctcttctattttttgggggcctttatcaacttgcttatcaaagtcatttatcatatccttttaattataaagtcttatttatacagcttcttaattaaaacttcagtctgccttccttccattctcactgtcattacctaaattcagggcccattatttatcacctaggtgattgcagtagccttaaaactagactctaggccgggcatggtggaggccaaggtggatggatcatttgaggtcaggggttccagaccagcctggccgacacggtgaaaccccgtctctactgaaaatacaaaaattagctgggtggtagtggagcgcgtttgtaatccagctcctcaggaggctgaggcaggagaatcacttgagcctgggagacggaggttgcagtgagctgagattgcaccaccacaccccagcctggcgacagagtgagaccctgtcccaaaaaacaaaacgaaacaaaacaaaactagactatattttttagacttgatggactttggtgtattctcacaccagactttttggtaacacaaagtgtttcatgttacttttctgcaatttattttatttttcttaatttttgtgggtacatagtggtatatatatgtatgaggtacatgcgacattttcatacaggcatgcaatgtgtaagaatcacatcatggaaaatggggtagccatgccctcaaggatttatcctttgtgttacaaaccatccaattatactcttttagttgtttaaaagtgtagaattaaattattgactataataactctgttgcgctatcaaatactaggtcttattcattcttactaactattttttgtacccattaaccatcctgactcccctccccaagtccactaacctccccagcctctggtaaccatccttttactttctatctccatgagttcaattgtttcaacttttagatcccataaataagtgagaacatatgatgtttgtctttctgtgcctggcttatttcacttaacataatgacctccagttccatccatgttgttccagatgaaaggatgccactcttttttacagtcgaatagtacttcattgtgtatgtgtaccacattcatttatttttctgcctaaatattcttgacatacaaataatttttccatttagtatcatatttcaagatttaacttagtcttctcctaaagtgctgtgttctgcacgtgttcttattatacttcttatcacacttacttgaatctgtttgtgtaactttttttttgactggtttctcagtacatcataaatgtagagactgtgtggtacagatacttctcgccttacaatggggttacataccaataaacccaatagatattaaaaatattgtgaaatcggaaatgcatttagtacccccataaactccttgtaaagttgaaaatttataagttgagccatcaaagatccagatgctccttgacttatgatggggttacatcctgttaaattcatgataaggtcaaaaaattgttaagttgaactattattaagttggggagcatctgtacttatccatctgccctcatgccaggtatagtaacttgtgcttaataaaactttaatacacctctgaatgaatgtatgtgtgaattgtctaatagatgtaactaagaataaaatgaggataacttcaaaagagaacatatgtatattaaatatgctatttttacagaatttattcaatgagactactttctcgttgtgtataaaatattgaatgcatataaattcaatttcctcgtaacattcatttgaccaacttcagccagacagtccttgattcccatgtttgacagtttgctcatctgcttagaaaaagggaaaggaagaaaaaaagaaaaccatgctctttccattaaaagagttggcactatcaactgttttattgtcaaaactaaatataattttaccaatgatgatgacatttaagaatacacgtttgtgtgtaagctggcctttaatacaaacatttaacagaaatatgtgtaggaatgtagtaggagaaccaccagcattgaagtcattgattgccatgttactgacaaagtatttaaatggaagaaacaagagattgagttgtctcccaaacagtaagggtactatgtgtgtttttgcaggtttattattttggaattgaaaaattttaagaaaaagttatcatttgggatgacaaatgctaagtgaagaatcctgtagcagaagtttattgttggttactgctgctaattcttcccagtgtggtactttataaaacaaattttaaattctacttggttattctcaggaccaaaaggtgataattttttgtgtgtgtctgcttgaaaatatgcagtatgaaaactcttaaatcaatagtttgtagtacagagaaataattactgcttggaaaagagtaattttcaatcatatactaaatgaacagacaaattaacaaaaacgtttattgaacttatgctaaaggcactgagcacaaccatgaacaacacacatggcccttactctcttcgaacccagcagcataatttatctcttagattaattcaatagcctcctataagatctccacatctctctatcttctaaaccatattttagagtaattattgtaaaacagaaatcttatgtaatctcactgtttaaatcatttcagaaatcatttcagaaattaaccattactcttagaattaagagaaaaagtattttattttttctctataggctgtgatggttttggctctacctgtcttcatagtctcctttaataccctcccccatttatttctgtggtctaaccactctttccttccttaatttatgtaaataccctactttttttctgccatatgacctgtgcacattctgctttttctatataaaatggtgtttaaatattttaatgaagttaaaacacattttacccaaataatggatgccgcttggactaatggttatagaagctgttacataaagaatcctttgtaaatttatagaaatgtcatagcttaaccaaatatttcttgcataaatataaataggcaaaatgtgatcaaaacaatatttaaaattatacatttaatacagatttcttattattcagttaagtggtatatttcttaagcacttataaccgtgtagatctctcttctttattgcagtaaaattatggtaatttatatttattttgttttgtggcactttatataattatgtgatatttcaattatagctagattgtcagtgaaagcttagattatactcaatataattctacttaagtataagatttaatttgaatactaaacctgaaagcttcttaacttcgaatgctttccattatcaagtaatgcttgatttttaatttgtctagatttatgaagagctttagagtacttgatgaaattttatttgaaagcatcaatatggtcacaattttctattactgaaaaaatgtgtgcctgtgtatgtctgtgtttgtggcatgccacataaataatgtattacaatacttgtatgtacataagtactggttgctttggaaaatatattgctcttctatctagtttgacttgacaatgaaattacaaagaattgttgcagttttaaatttattatttttaatttcatcttattaataaaaataataatgtaaatggtcacagaatttctttccccagtaaccttttattgaggctacagtagacaacatatttactttcagtggaagaaatagtaaacttcccatgaattaaagtagatcagattttatagaaatgtttctatgccctatgcaggtgaattcaatatggatagctctgatctttccgaaggctctttgtttgaaggttaaagaaataaggttattttgtttgtatgtttataacttaattttatattcctgtagtttttctatatgattaagtacattatagaagcactacagagtataattggaataaacaaaagcataaataataggacagatttgcctataatttttacttgtttatcaggctgccaatttataaggaactaatttcacctcataagactaaatactatgtattttttaaacattcagtgataactattaacataagctctatctatctatctatctatctatctatctatctatctatatactttattggtagaatagaatgagctttttagtttacctaatagggactatctcttggattacagtggctatctctggtttcacttttggcaggtggagctatccacagtcatccacagtccaaaaatatgaaatggaaaattccagaaataaacaattcatgctttaaatttcaggctgctcttgtatctcaccctgaccttcccagaacgtgaatcatctctttgtccagcatgtgcatgctgaatatgtcccctacattttactctttttagtagctgtcatgatttatcagaggcccaagctgaggtcccatcagaggcccagttgaggccacagcagcaacctcaccagagaaactggcagagtaactgatagaagagggaaagaaagaagggaaagatacggaaaaataagtagaagaaaactagaaaatagaagaaaatgttcagttgaagtaaaaggcaaatgtatcaaacactttaagcaccaaaggaatgtgagaagcaaggtttaggtggaaaaacataggtccactggctctgatatcccagtaaacaccatggaatattatgcagccataaaaaagaacaagatcatgttctttgcagggacatagatggagctggaggacattatctttagcaagctaatgaaggaacagaaaaccaaatactgcatgttctcacttataaatgggagctaaatgatgaggacatatggacacatggaggggaacaacacacactggggccttttggaggctggagggtgggaggagggagaagatcaggaaaaataacaaatgggtactaggtgaaatacctgggtgacgaagtaatttgtacaacaaacccccatggtgcacgtttacctatgtaaccaacctgaacttgtacacctgaacttaaaataaaagttaaaaaaaaggtatcaatgttattctaaaatgaaagtttttctactctcataaaatatttcagtatttttgttatgtgtacgtatttgaaatcatagattatataatattattttactatgttcttttatccatttcataaaaccatattattcaattattcacatgtatcttggacattaacattcttatctcaatagggcaaatttttaattttccccaaactgtttttcagggcatgctatattccagctacattgtattgcacatagtactgtctctatctgtttttaattatcagtggacttttcatctcaataaaaattactcagtatattaagacaattgttcatttgattattttaattattctgttaatgtacactgattaaatgaaaggagtttataattccaaagatagaattatattttcagattaaaaaaaagaaaaaacgtagtgaatttagggtttagcattatctgaggtttctgacatccactggtggtcttttttcccacaaactattatgtgtatcactgccagaataattgccctaagcaacggtcttaaacgttgttgtgaaccacattttaactatctggaatgtggctttgtccatatttttatatatcttttttctattaatctctgagtttatagaaggtagaaagcattttttatttatctctgtggctagcactgtatctgatgtttcctaaatataagtttatggctttgaaagaatgagttccagtgtgcataaaaatcctaatggggtccctcctaacataaaatggaggccaaactgtaagggattctgttttatttgcctaagagacaaaaagtcagtctatattagggaatttgggaaggtgaaatttgaagtaaacaagtatattgactttctagttttaggttatcacttatttagtaggcatgaaattattttttaaatcatatcctgaacttgtatttattcaacagatatatttacaaataactcaggtaaatacgtggcaaaataattttgaaacctagcccttgcattttagatttctaattatataattttagcagtcaaaagatcttaggaataataaaataaagtaattgtataaaggcattggtgagcacttgtttaggatataggatagaaacgtggtggcatacaattctagaatttacttttctatcttgtctcctggttgtgagctctaattttagtgaaacaaattcatttctcagaatggcatgttcttatttttttgtattccattcaccttgtatatactgtttcttcctctgtaatcttccatcctttaaaattctttacccttgtttgtcacgtatttcattttcttcttttcataccattactctctgctttcctaaaagactccttatctcttagtatacattgtgtgaacctctaacagtgcttaactctattaattataacaataattagagttacaacagtaactaattttcattcttgtgctcagagctgttcaagcactgtcacgtataaccacaggaaacctctgtgagtaacactcttcattcacgtgaggtaaatgaggcatagtgagtttaagtaaagtgttcacagttccacagatggaaagacttagaaaccctaaactgtcataacccaaagtgcataatcataaacactactccatgttgtaaaagaagataaacagttctgcatctttcattgtacttttagccctggaaatacaggaatgatgccatttcaaaaatgtttaaaacaaaagtatcagattcagggcctggcacataatagatgaacaatcattattgaattaataagtcatgaacaagtaagtaaatgtatcaaaaatacatgctagagggatgactatagggtgattctgcaaggtagagggactgaagaaactcttatagagaagacgaatatgaactgagcattcaaatatgtatgtggaaaaaagagggtgcaggtaaacccagcagattatttgcgagtgttataagagaatcatgggaaaatttttggaatcctggcaatgctcagggaaaaatccagttttcccattactatgaggaataaggcaagtatattcttgattatgagtattatttagtgttgttttgaaggtatatgctaaagtaattggacaagatgaagaaataaaaattggaaaggaagaggtaagattgttattatttgctaagcatgtaattgtttacatagaaaactaaggagagtaatttgaaaaacaacaaggccaaaataaaaaccaacaatttaattaatatggcactatataatactaatctacagacataaattaattggctttttatattcaaacaaaaagtatttggaatatgtaacggaagtaaagctaccatttataatggcaccaaatataacaaatatagctgtctataaaacgggaaagatgatttcaaagagaaattttaaaagatcttgaagtacacaaaaggaatcttgaagaaaagcatagtcaaccatattctctgataaaagaatctgtttcataaagataataaattcccccagttaatctaaaaatgtattttactgcaataaaatatcaatggtttttaaaaagaattatacaaatctaaaaatttagttaatctaaaaatgtattgcactgcaataaaatatcagtggtttttttgaaagaattatgacaaatgacttatagtactaataagaaaatgaacaaataagataatccagggcatgttcgaaagggaaaaataacaagagggcactagccctatcagatattaaaatatataaagctgctgtaattaagaagggatgctgttttaacaggtattaaaatatattgtaaatctacaggtactagtgcacatacagtcaatcagattgatggaacatttttaaaaagcaataaatccaaatacagagagaaattcaataggatagtaagggtgacatttctaatcagcgggcaaagataccttgtccagtaaatggtttagggtatcttggtgttcacttggagaaaaagttgtgtctccccttttcatgttttataccaaaaggaattccagagagaagtcaaaatatgaagccatgagaagctgtaacaaagcatgcaagatttctatggagaaatctcaagttggaaaagatatttctaatgataccatacacttgaagaaatgaagtaaataataatttgagtatatataaatggaacagaattccacttataataacaaaaatttttttagaaaatagtgaataagctgaaaacagtgtgtatgttcaacaatagtgtaaaaaaaagtacattgtgtgtatgtatttctagaagaaaacaaaataaatatgtagcaatgattgactctggaaaaatagattatttatggactgggtagtaatgaaacacacacacattcttctgcagattttgtctacattttatctttgcataaaattttttgttttttgtctacttttttgtctacattttatctttgcataagaaattatgaataaaactacttagtcataataaatagaaatgttgacaatgagtgtgttgatggcagatctgtggatggatgacttccatttatactttttttgtgtgtgtttttaaatagaaaaactctataattgtttccaaatatctttatatcctcaactttataatttatgagcagtgtatcatatttctaaatctatgttctcattaaaaaatacggagattaggccgggcgcagcggctcacgcctgtaatcccagcactttgggaggccgagccgagcggatcacaaggtcaggagatcgaaaccatcctggctaacacggtgaaaccccgtctgtactaaaaatacaaaaaattagccgggcgtggtggcgggcgcctgttgtcccagctactcgggaggctgaggcaggagaatggcgggaacccgggaggccgagcttgcaatgagctgagattgcgccactgcactccagcctgggcgacagaccgagactctgtctcaaaaaaatcaaaaaccaaaaaaacaaaacaaaacaaataaacaaaaaatacagagattggccaggcgcggtgactgacacctgtaatactagcactatgggcagtccaggtgggcggatcacctgaggtcaggagttccagaccagcctggccaacatgatgaaacccgtccctactaaaatacaaaaattagctgggtgaggtggcaggtgcctgtaatcccagctacttgggaggttgaggcaggagaatcacttgaacccaggaggcaaagggtgcagtgagccgagatcgtgccattgcactacagcctgggcgacagagcaagactgtctcaaaaaacaaaaaaaaaacatatatgtatatatacacacacacacacacgcagatagtaacaggtagcatgatttagtaaacataacattgaataactgtttttcctgtaaaatgggggaataatatataccttgaggactaaggaaaacaatgttgttaaggcacttagtaaagtatactatttttgaatgtctatgtgtttctttagataatatttaatttgtttagcttactgctccccagagccatttttgatgtttaactgataccacctgtgattgtttacccagtattgatagcctgcaatatgcagagctattttaggaactgaggaaatattagcaatcatcaggcattctaataagtgatacaagtggaagatgttatgaaaaaacagaagaggaacatcacgaatgtaggagtcaggagatacttctcttcccacttccttccctgaggtgtggacatctgaggctatatcttaaatctcgagtataacttaaagaaaataattatttatactgggcatttgttgggatgggcattgagatgtatctggaaagaacctgggatttgaagtagcatacatatagctagagtgaagaatgtatgcagaaacatggtgagaattgaggattaaaaattatgggaccacagagaacactatttcatgctaaagacattgattctcagccttgaatgactttttaaaaactactttgtcagattgaacattaaatagtcactcaagaagttttcagtttggacaagatgtcatggacctgtttttctctgcttctttctgctaagtacagctataaactctgaaaatgatggaagaggcaaataaaggaaaattcttaaagatggtaagaggaatgaaaattggtttgagatcacagaatacaaataagagcacagaagaatggcatctcacatcctctcacccaacaaaaggttgtgatccaggccttaattttcctgactccaagctagcaacagaaaacaaggtaggcttatgtctcctttggaacaataggagtctttctgaaaacacaagacaatatccactgcaggaaagcactctcctcctctgtaggatctgatgcttccttctacaatgaatagatatgaggcagctaggtggtactggccggaggaaccccaccagaacaagtggcctcatgctggaagccattatggaaagagtatgacattcctcaaaacattaaaaatagatctgtcatatgatccagtaatccctacttctgactgtatatctgaaggaaacaaaattggcttcctttgagagatctcaaagagatatctgcacgccgtgttcattgcagcattcttcacaatagctaatatatggaaacattctatatgtgcaccaatggataaacagataaagaatatgtggtatatattaatgtaatgaaatactatttagtaataaaaaagaaggaattctgccatttgcaatcaattgagtgaaacttgagaacattatactaactgaaataagccagacagaaagacagctactatatgatctcacttatttgtggaatataaaaaagttggagtattaacagctgagagtaaacagtgtttaccagcagattagggggctagggaaatgaggagatattgatcaaagggtataaacgttctaagatgaatataaatatttggcattatgtatataaaataacatgagatgaatatgttccagggatttaatgtacagcatggtgacagtagttaataatactgtaatgtatagtttaaatttcctaagaaagtatgtcttaagtgttctcaacacacgcacacaaacacacacacgcacaatagtaactgtgtgatcaacttgattatggtactcatttcacagtgtgtatgtatatcaaatcatcatattgtacaccttaaattaatacaattactacttttcaattataccccaatacatctgaaataaaaagaaaaataactaaataaaggtattaatgacttccatttgatggttctcgtgctaggtattttttacagacttttatcattttaagtactacaagaaccaactagcatgtggccttagaaatgttcaaatagaatttagataacttctgatttttttttcctagtggaacgattctatctctattagaagttttgccatattgcaaatgcgggcttttctcagtttctttattctccttcccagtgctctttgtggtggtggtggttgtgttttgtaactagaaataaatttctatcttaatacaaagctttctttaatccctcagtgccatattactctccttgtttctaccatttgattcttctagtctatctcattaactctactaaaaaagagtatttgagcctcaaatagtttatttcctaagaacaaacagttaagtaatatgcagactgaagacttctggataagactcaaatctttacctaatatattaagctgtatttataaaaaggaaattactctttaaaaacaatacacatgctataaattgtttctttggaataatggcacacattcttcctatttatcaaatagatacatttcccagaaggaagtgggtaatgatatattatagtaaaagaaagaaagaaaagaagagaaaagaaagaaaaagaaagaaagaaacagtatttaattttatcagcattcctattacacagctggcatagatttttaacttactttgtgttaggtctcctgctttatgcaatttataatcttattttatttactttttgtaatcctataaaggctgttaaaatctgtctgtaagcattatgtatataaaataaaatgagttaccatacctattttcatatcagaaaatccatgtttggtggaagtcaaataacttgttgaggttcccacatactcctgctacatagggaagctgagataggatgctctgtgttaagattctaaagactgacttcttcctctgtgccatagacagtagagaatatgaacaggtctattactcttcttaatctgtaattatatattttacaacattattgacagaaaaatcaccttgcttcttggcatttgttcagatgctgatttaatgccacttatgatggaatatacagacttctgcacttgctgaacaaattggaaagtaaaggtttccaaggactttatggctgccaaagggatattgtaaattattgtaaatataaattatccccttgccagactacagagattacttttatgttagaaataggcaaatgtgaattggcttatttggtgggcattagtgaaaagtccattgtcttaattggccaactacaaatcattatatttagaaatttttagctgtatcatttgattcacttgacatcgtgtatctttataaaagtatgtaattaacaagaactcttctgtaattatcctgacaaatttcctggtttcttttaataaaattaatagtttgcccaacttacagtatatcaaacacactatatatatctattctgtgtttagacattgtaatgtctgtgtagctatactgttttataacgtctaatattttaagtcttataacatttcttccatcccacagctttccttttaaaaactaatttttcattggttatgaattggatgaactaattatcttaatgtgattgcaatatatgtagttattttaaatcataaatattgaaatgattgtatttataacatttcttgaaatagacaactatatgtattttatgtaaaaaattaaactctatagtttacagtgtcttgaataacaactagtgtttgggaatgagactatgttaaacatttattagctatttgacattggaatatcaggttaaaatgtgtaagcctcattttctttatctacaaaatcaggataataatccctacctcatagatatgaagtgagaattaagtgaggtaataaatttaaaatcttatagggagacaataaactttagctacgatctttatttttgttgcattttaatattattaaatcgtttatgtatccaatactgataccatataaattcatgcattaatcttgtaacctttttatttttaaatattttctgggactattttagacggcaatttagatagtatctaatctgctagaaaatatcaatgaagctgtctgatatttacaccataacttactaagattctctgtattacagattctgaaaactcaggggatttaagagggaaataaagtgagcttgttgaaataaatgtatacataaatagacctgcagaaaacattcctatcaatcaaatgtatttggaatatttaagtatattataaaactactttttgcgggtctggtaaaaatggtggtgcctgcctcttttaactcaatagaaaaagaaataattggagatgaatttaatgttctttggcctttttatcatgcaacccttatttaattatagaatttcagtgttatattacataactgtgcaaaatattacttaataatcacttctgagatggttttaaaaaaccatattatgcatgtttatcatagttccccatagcaggtataggccacttatcaaaggaacttgcatttagtaattctgtgcagttagtcttattgaggtccacttgatggcagtattgcacttggtaaggtcagtctttttgcgtgatttttttatacttgatttcccgtgtaatggtggaagtaaacttttcaattaaaccatgaattatgagagacttattttctgctaatacctcagaggttatgattcagaaatgttttgtggaggaaccaaatggaacatagtaaaattgttacacgtcagaggagagatactcttgggaaatgagaaaatcaggattttccaatttttaaaattcatgactctgaaggattttagctttcatcatttttaatagaattttcacttataggaaaaggtaaccaggaattgtattaaaaaaggaatgtgcattcattagttaagaggtcaagtaacaaacttaaaatttgacaaatcatggtgtgtaccacaaaaataattgacctcaaacatcaggataaatgtttctgcttctatccaattgaaatgatttagaaggtcaattctaaaactatcgtgtcagcttctttgctagcaagaagcagtaaaagggcatttcctgcttctcagtttttaaagctttactgaaagcaaatctcacaaatgatattcaaaatattatagtcagaaagaaaaaatagttactcctgtccttattgttaaaaggccttatcccccaaattaaatcaatcttccataaagtccctaaaaaaaatatgaagtccttgggaactcacttggttttaaaacctaattaataaaactttagtgagataacttttagtttttatctgaagtgtaactataaggaaaatgatattataaaatgatattttgacaaaagatgttttaaaaataggagtaaataatacatcaaatattcacttcaatatggtgatttttttgtttatctatttaaacttttgtctagtacacatttatattacctctacttgagtgttaatgattcagatttaaaatgaagttacacattccatgtagtcaaagtgcttctgtctctagtctagtcagctaactccactgacttttacatcctccaccaccaactagctctgtatgactttggtcagattacttaatcacattttcctcacttcaaacctgatagtagtattgatattaattagtacatggaaagtacttagaaacagcagcgagtacaaaataattctcagtaaatgtcagttattttctttatccagcacttgatgataatttgtggacttatatatttaaaagcatatcttaaatacattttattaggagaaaagattaaattgatattttatgtggtcttgccaaatttgttgtatttataatacaaaatatgagttatattattaaatatggtatatttgatgttttgtgaagattacatttgggggagaaacaaatattaaacctttgtaacaaaataagcttagtaaaatgtcagtataatttgagttaataaattgcaaacaggcatcagggaattgtcatttttgactctattggttgggatgccagttatgaatgcttaatcacaaacatcaacaaatattcattcattactttataaggcacttaagtcattgtagagcatgccaggaattataaatgatcatttcatccataagttactcagaatatagttggagatatattgactaaaattcatgaaaagatacttttaaaaatgtgatgacagtaatctggtgtcacatggtatcatgtatccaactgccaaatgaacatcataaggcacgatgtgttacgaattcagagagaagatatgacaggcctaaatgttgctgaaagagattaacagaaggggtgatagtctagttgagcctgagcaataagttttgaataggaacaacagaaagaaaagaccatccagagagactattgttagtccacagtactcaaaaaggggagtaatgttaatatagcaatttaaataaaaatagtatatgagaatgctttcaaaattgtaagctaatataaaaatgagttataactgtgtacttttggaaaccatttttaaattcagtagagtatacctctttcatttatttatttgccaaaactagtagtttacatactgagcatataacctctggagcatggcttttagagtacataaaatcagtcctctgggcagggcgcggtgcctcatgcctgtaatcccagcagtttgggaggctgaggtgggtggatcatgaggtcaggagttcaagaccagcctggcaaggatggtgaagccccatctctactgaaaatacaaaaattagccgggcgtgatggtgggcacctgtaatcccagctacttgggaggctaaggcagagaattgcttaaaaccaggaggtggaggttgcagtgagccgacatgtcaccactgcactccagcctgggcaacagagcaagactccatctcaaaaaaaataaaaataaataaaataaataaatcagtcttatctatggttttatggtagataacttgtaaaaactttatatatagatatgtgtatatatatgtgtatatatatgtgtgtatatatatgtgtatatatatgtgtgtatatatatgtgtgtgtgtatatatatatatatatgtatataattttttttttttttgagacggagtctcacactgttgccctggctggtgtgtgggagcaagatctcggcttgctacaacctctgcctcccaggttaaagcgattccctgcctcagcctctcgagcagcaagggttacaggtgcccgccatcacgcctggctaattttttgtatttttagtagagacaggttttcactatgttggccaggctggtctcgaactcctgacctcgtgatccgcccgcctcagcctccgaaagtgctgggattacaggcgtgagccaccgcgcccggccacaatattcttataataaaaaaacatccacggccagacgtggtggctcacgcctgtaatctcagccctttgggaggccgaggcgggcggatcacgaggtcaggagattgataccatcctggctaacacggtgaaaccccgtgtctactaaaaataaaaaaaaaattagccgggtgtggtggtgggtgcctgtagtcccagctactcgggaggctgctcgggaggctgaggcaggagaatggggagactgctcgggaggctgaggcaggagaatggtgtgaacccgggaggcagagcttgcagtgagccgagatcacgccactgcactccgtccagcctggacgacagagcgagactccgtctcaaaaaaaaaaaaaaaaaaaaaaagcttccacatgggatgcgtccaagggagcttggaaacgtagaagcttcgtcgttcttttatggtctttgtctggtgaggtttaagagtccattctgcagaaaagagttgttcatggatgtatttctgtcaacatccattggcctagctgatcatggtcaatataatgcttcatggccaacataatgcatatgaattaccatacggttaaagatcaccatattttcaaagaaaagattgtataccttctgatataaattagacatttcaagcagtactcaactttagtttattttatagtgcacaacttttgtcatagtattttcatttactctgagaccataataaagataaataaaattgaatgatttttatgatattaatttacataatttacaatggtacatccatagttcattctgtctaggtaaaggctttaaaggacctgtaggtgacattatctaaacatactttgagtctaattttctcaaaatgaatcaaatgttgttttcctaagaaatgacaatctatattttttcattcccaatgataggcactctttaaacatatacgatggtttctatagtagtagagaaatagtttatgatagtagctaaaaagttaattattaatttacctcaggtttcagcaaatagcaggttctcaataattattagcaactattgtgagtggtacaaatcctactgctctccatgttgcttctgctccacctctccctctctatttccatttgttttacaatatctaactaaaataaaattacaacttactttcttctatttgtcctttttgactatttctctgggaattttagattatgtccaaattggacaagaaggcctatgcctcaaaattgacttagaaaacactctttttaaaaaattttaagttttattttgggttcgggggtatttgtgaaagtttgttatatgcatatattatgtgacactgaagtttagggtgcaattgagcctatcacccaggtagtgagcacagtacccaataggtagtttttcagcccttgccctcctttgcctctcgtctagcagtccccagtgcccattgttgcagtctttatgtccacatgtacccaatgttttgctgccatttttaagtgataacatgtggtatttggtttagaatgaacaattaaccaatattatggtggagccaagggataatgggagacagttctctgtgagtctcttgtgtttctgcaagtcttgtaagcagaggcactgactatcttcaacttcaaactacctttccaggcaagtttatataggaatgtctgtttagaagatatatacagtttctttcttgagcaaaaagcaggttgttcactctccactataataatgtgtccttctagtgcaaaagtcaggcaggcttactttctacgttaaaagattctgagtctcaagctcaggattcttctcttgtgttaccttaatgaaaattagggctcagagaacccaagcaaatactgacactctggttattattgttgccatgagtagtaaagttctttgactctcacacagggatcttgtgtcttatgtcaacatgcatgaaattatttcatgaaatttaaattttggacgataatactgtcatgcatggtaaaatctcacaacctttacagttcttgatagggtgtagggcaatagagaaagttttggtgaaaaacaattcagaatgccaaaatgacatgctgaaggtatttaatataaacttatacagttaaaattacatccagaatttaagaaaacatttagtgtttttcatatatcaccacaaatgtaaaaatgatgctagtcaaatggtttagaagcattaatcaatacataaattctttcctttagaaaaaccaaaggctaggtgtaattgagaatgatcacatattgatttctagctcttattcaaaatctcatttcttcagaaaaggagaatattggaatattagaatgggaccaaattagttagaaaagagtcctacccacatgctgcctgaatatttctttccttttccgctggcttctccacttttcttgccctgattctgcagagaggctaccatagccacagacgtccctctgtgtttttgatcctcagtctactcttctttgatttgccaggagtttctggtaaagcagaaaggtatcattccatgggctacattctgattacaatgaaccaggcttcctcctttgcagttaacagtataatatcaatagtttcatacaagggatgcctttctaagttgtgtgagtacatttattttgtcaatctgtagacttacagatttgctcttggataattgcaaattgagtaaatttatattattatttagagtgaatatggatctgggatatttatttattaaacatttaatgttgtactgacatgagcttatcagtattaagtcattaatccacacaataattctgttatccctcttttacattatagaaagcttacctaagattatacagtaaaatatggcaaagctgagacaaatatgaacaaaggaacatagagtcgaaatagctgtggttcctgttttctaattttctacaaattctagattgcttctctccttgtcaattgcttatcaagcacttgtcatagtattttgtagtcatttgattttgttgccttcttaaaataaatagtacgcacactgacaccaagaatatatttaatttttctgttaaatttgtttttctttcatttttgcattgctaatcctgaagagaaaatcatagactttttgacatataatagttgccacataaattggtgaatgaatatcactgtggcacctaaagtacaccagatctgttggggggttctctttgttttatatttcctgactttaagtgcactcatgtgtttgagagttttattctaaaaagactacttatccaaatgcaacttggctgcctaccatgatttggcaaataaagactttcaagggcagaaagaaaaaaaaaatcttaagattatttaataacagcatgtaccttccaaagaagctaaagaaaattgtcaagtgaaacagaaaactgtgacattattttattaaaatatgacctacagttttaaacttaacgtatcttataattttatttttcagtaattgtatccatttcattttcccactcattattagagcagagcctttctgtagtggtctgatgttgccaggtagagtgtggaaaaattttcctatagatacatgttcattctgcaaaaagatgggattatattctgtaatgtaaagtgaatatttatgcttttgtggtatcccataaaaaatgtttgggaacaactttgcctttttagcttttgaaaatgagcatttttttatgtgaaagtttgctttattgttggaaagcaagagcaagaaaaaaaagtaggaaatgattttgctttagtaaattgggtttaccaagtctttcttcttctcttgaaacatagtgggaggagagagctttatattcaagctaaaaataatctttgggtaacacctacatttttaccctgaaatagacaataaaatacattcccagggactgaccataaaggggtgtggggagtagaatacttgagccttttcaaattgtctgtctctctcccccaagttcaggaaaccatctgtctccctctactcacatttttcccactaactgaatcctctttattccaaggattaagttcagtgtctttaaatagaaaaatgtggagattttatgaattgccaaatgaaaatgaaaggttcggaatcactaaaattgatggtgttctgattttagaagttagaagaaaattgcaattaaaaatatgatattcaacttattcattggtgaaaatataagctatggaataaaatgtaaagccaaatatatatttatcaaaaatctgcttaaacattgtatagagtttatataataaaaagcattaaagtagtttgatatttaaaaatatgtagtcagttctactttaaattgcatttttattactatgtactcagccctaattcacaagttggggaatattaatgttttgtgcctaccagattgattgctgtaaagaagacagttagtgtgatgatgtagatattaaacaaagtaaaaggcagttaatgcctgaaaatgggaagttcttaaatgtggagctcacactgaaaagaaaaacataaaagagaatcttataggtcaaaataaaattttgaaaatatgaaacaaaaaattataaactaacctatttttttttcattaatccatacaatgactgaacattttacagcagtatttcatggtgtgataaagaacctaatgatagctatttttaagaaacaccatcagtatggaactttgaaggcctaaactcaggacaaaatatatgagatgttgacagcctatggcagatttttaattgatattgcaatcagtgaaattagtagtattgcatatatttttgaggggaaaaagataaaaggaaattatttttgagtttgaagtttagtgtgtgctttagcctacagctagtattcacagaagattttcacagtctcagttgtgtttaatgtgaaaaatttaaagcataatacataaggttaatacagaattcaatgagcaacataaattttatatttttataacatcccatttggctgtcccaattcatgttgatgtgtgtgtattctaataccatatttacatatgtatataaatatatatgtgcatatatacatatacacatatatacatacatttctaatatgttccttctatttccttctcaatttctacttgaactaatcaaaatatgcagactttaaagatcataatttaaggaattcgtgataatttttaaacaattgtatgtacataggatgattttaaaattcatgtgtgcctgtcagttaattcactgctttgtaggctcctatttgatgctcaaaattaataggtaaacactggatatgcaaagggttattggacaagacaatcctttgaatacttactattttgaaatacttgaagaatcagaaaaccataaatatataagcaactgttgaactgtgaataaagtctgagtgagttaagagaaggaaggtgatttcgtcttttaaaccatgtttaaagtaaatacatatttaaatattcctgcttgataatcataatcgataagtgagcaaacatttgtttttgcaatgggcaaagaccttgctatcaattatacatgtgagattatctttgttttagttttccttctagcatattattgtaaaattaatagtatatagaataacagtttcttgcatactacagcatttttgtctgattttttttcgtagtagccatagccaaatattacatttcaatgccaaaaaaacatgaagctcaatatttctataacaggcgtaatcaaagtatgattgaaaccttggttaccagtaaagctgttcagtattcatagccatggtaacagtaagatttaaaataatagcaatagcatatctatcatgacattatattcatgttattcttattagtcattgcatttataaaattataattatgtttccaaataaatatcttagcaaatactactttctattcaggttcatttataacagctgaagacaaagatgttagtatcttaatcactttggaatcaatatcattgtgtgtgtattttctctttttcttctaacagagaactgggtttaactttttaaattgtaaattaacaattcataagtgtataaatttatggggtacaaagtgatgttataatttatgaatacagtgtggaataattaagccagttaatatatccatcacctcaaatacttaacatttattatggtgagaacatttgaaatttagattttgaaatgtgcatactctattattaactatattcaccaggctgtgcaatagaactcaaaagggaaaaaaaatcccacatttctgagattttgtaccctttgaccatcatctcattctccccacctccagcctctgtaacccattgtgtattttaaacacaacatttgaggtaagtgtttaattatttgggtttttagtatacccagtgaaaactggatttaagggacacagttcaggagatttcattaattttgtatggaatagttgaactaactaaataaataagtggatattcttagaaaccatgtgtagagtaggagtcttttgtgatggccaaataaagagagatcatagaattcccttagtacgaaatttaataaaaggtatgtataacttaacaaaatcaaaacaaacaaaatattttttaacctgtttgcatacaataccatgtctctaaaatgaagcatataggggtagataagcaatcactgtggaaagccaatgaaaatttacatgcgctcattggaatgattacatggtattgagagaattgtcagcattaataaaaccaaagagagatataaaatgaagaattgtgataactaacactactaaagcaaaaagacaagagacggtaacaaagagtggaacaaacaaacatttaaaaatgcattctggaagcaatgacaaatattctgttctggaaaaaaacaactacaaacagaagaaaattccctacaaaaagtgctatgcattttagggtagcgaatgagcatgaaggctttataagccggggatcccttatgatcttgtacaataacttaaagtttctgtgtttagtgtcctcatatataatatgaggtaacatgaaataataataataacattttcctccagaatttgtatgtaattagtagtggtatcatatggaaaacagtgcttggcaaatagtgcttgtgttttagctagccatattttgtctttagacaaacttaaaagaaaaaaagaatttaaaaataagtaaaggaagaaagaatttagaaataaggccacaaagacaaaagaatatatgcacaaaagaaagcagaatttgtacagctaagaatataaaatgaggaaaaaaatgaaacagaaagacctttgcaagaataagtaattaaatataagaacaaacatgaaaattatgactgaaaacggagttggtgacagaggtgaaaggttccagaaaacagtccggttgaatgcagagggaagtaccagcaattaaaacatgtaaaaaggacaaactagatggacagagttttccaaatgagcatgcttggggtccctgaaataaagaagttaacacatttgagcagaaaataatcctcaactatttactaatatagaaaattactgaaaaaaagaaaaatatatggattaaaagagttttacagtattttagggaatttgatgcaaaatgtttaacaggcctttcctgttaggttctgaaattcaataataaataatcataaaaactttaggcattaaactcaaatgcccctcagaaaaaattatgaagtttctcagacttctacaaaagaacactccaatgctataaattaataaattaacagataggaagttctgatgaacagaaagtgtgatctgagagtttataaatacctggttgtcattcaaataaagacaagctgttaaacaggcagaaactcaggcaaggtgactccctcccatggacccatgagcacttatgagaaaaaccaaaaacaaatgaaattttgtcaaccatgatatgaatgaataagtttttgcttaaaaaaagggaatgcggcttggcatggtggctcatgcctgtaatcccaatacttttggagaccagggcaggaggatcacttgaggccagggattcaagaccagcctggtcaagggaacaagaccttgtctccacaaaagaaaaaaatacctgggcattgtggtgtgcacctgtagtcttagctcctggggtggctgacgcaggaggatcacttgagccaggagtttgaggctgaagtgagccatgatggcactactgcacttcagcctgggtgacagagtgatactctgtctcaaaacaaaaacaaagtctttactcaaatgtcatctctcaattaggccattcctgatcatcatatatgaaattgaaacttgtctacctcgccttccttatctctgttttatttttatccatagcatcatataaatacgcacacacacacacacactactaaaaaaatttaaatgacaaccaaaaagtcttttccatatagatcaaataaaaataaaatgaaaaattttaatttgtatcaatcattattagaagcaaaacttatggatgttgctgtctgtgtcagaaagaaatacaaacccttaaccatttattccactaatcaataaaataaaaattaattaagctctaaaataaattagaaaacctatacaatgaaacaattgaatgccaaagaaataaattttaaaaattatacctgcagaaattttaaaatcagtaaataatatctgtggaattaataaataaagccaaaagctatttagtaaaaccactggtctggctaattaattggaaaacaggaaggaaggagaggaggaggaaaaggagaaggacaaagattaggatgaggaggaagaaagaagaagaaagaaagggggaggaaaaggagaaggacaaagatgaggatgaggaggaagaaagaagaagaagaaagaaaggaggaggaaaagaagaaggacaaagatgaggatgaggaggaagaaagaagaagaagaaagaaaagaggaggaaaaggaaaagaaggaagaggagagaaaagggaaagaaagggaagaaaaagaacatgtaagtgggagcacagaggtataaaaaaagagaattgaagaagatatagggagattgagagtaaaataaaagaacattagaatacatgatatatttatttacaagtatatttgagaagttagatgaagtaataattttcttggaaacctttaactaacagaattcaacaatatatcaaaaatgcagttcactccagaaatgtgaggtgggtttattaattgggagtgtactaatataaatgtatctattaagacatcacaggagaaaactacatgatcttacagatcttagataaaaattgttaacattacttaaggctctgaaagttttgtcctccacctacccctccagttctaacttatattacactctaagaaatattttgctgctgtttctttgagatactgggaagtgataaatgtgttgcattttcttagcagcacttttaaacttaatattacttgacaattaactggtataatgaaaacttttcagtttattagatgaaaataaaattcaaagaatataatagtattgtcttttatgtcgttaatttttgttttatttaatactaggagttttacctaacaattatttttaaaaccttactcaaagaagcacagcaaatgtttgtcttcttgttttgtttttgtttacttttccaaaaaagccaaatgaaactgtatacaaggaaacatgttggttattaggtgtcatgccatctggcactgacatctgccaccacattgaccccaggttattttggctgctttgcctggcaaggagggcacctgcctcttacttcacagctccatgctgggcattccacgtctgcagtttccgtgaagatgtcaatcttcccacatagaggagtatgttttaaaattaaggttataggaaaaagaaggtagctttctagaacttctaagtatgctatggagtccataaaaagtatgctgattttcacttatttctagaaaattaagtataaatggtaggttggattttcactttcaactactgaagccttaagaagaggttatattgtaatcttgaatttaaaataaatggattcacatgtttcatatgcttttggtcatctacatttctccattttaatagtaaaattaaacattattcataatttaccttgttttgtatgtcttctttgggagacttgcttataaaaatcacatcacaaggtttgcaaggtttgtgtttccttttccagcctattacacatattcttttaagaaagctcattttaaatgagccctttcaagaataaaagctttttagattattttttgtatgaaatatattcaaaagttacacctcatgcacctagcattttaaaccatggttccaaaggattctgcagatttaaaggtcctaccgttttttattgttatttttattacttattttctttttcctttgaagtatttaaagttacagaaggtggaatatttaactttggccatgaattattcatatttgtttagaattaacattggcttaaatggcttaacatttttctttagttagtgattcttagattttctaatgcagctcataaggctacatttctcagctgggtacaaaacttgatgaattagcagctacaagctatcacaggaaacaaacccagaccttgcctataaataactgtctagttttaatctgattttcttgcatcatataaggtacagctgcatataggtttatatgttgtgtgttcatatctacttttgagtagatagtggaagcaaatgaatccaataaatctccttaaaatatttctgcttcaagaaattcagtatccttccagaaaataattgctattttgtcttttttttaaaataacaaattgtgaagtatatagataatatattcttcaggaagtaattcttttgattctatattttataattacactagcatctataattgaataattgaataaaatttgtttacaaatatattgctatgccttaagatatgacatattttgcacattttacataacttgaaattgtgagataacatcattattcaaaatatgagtgggagtttatacataatgaaaataaataataaccaactcccttaagactagtaataagccaaagaaaaaaaacagttatgaaaaaggttaacttaaaggcaccatggaaacaaaaatactgttgtttttataatcaacatcataattaggaataatttggaactacaagaggtcctagccatcatttagttcaatttgtttttattgtggacaaacagacttggttaatagcaccataaactaaaaacagtgttaggatcagggtcatatcacaggtcaaatgataataagaatttccttgctaataatagtttgatgagagccatgggaaaaactgtccttaggagactgcctgtgtcaatctattataaacaaatgtgggtggcctcaaaaatatgaatgtgaatgtaattaatttagaacactaatgaataaactgtgtacactaacctatatatatgttaaagagaaaatatgaaaataaattacaaagatcaatctaagaatgtgttcacatattaacccatacctgtggtctctgaaagttgacgacttgttcaactactgatcaaaaatcgtttggaactctgtggatatgcttgtttttttcaattgctgtatacctccatagagtacaaaagactgggggacctagtttctgccatcagggagctcaaattcctcctgggaaaaaatgatgctgaaatctaaaataaaaacataacactctgtggcttatatggccacataactctgtggtctaatctaaataatttgttcaataaaagtttaaaaatggtaactcactttgaatggaccaataagagaaagtttaaaatttgagtagcaatgaaatagtgggtaatgggagaagaaagcaatattgtgagaaggataatgtaagtgaaggacagaaggggaaatatctgagtgatattggagcatggtgtgagagatgtttagtagatcatttttaaaagctagattagggggctgggcgctcaggcctgtaatcccagcattttgggaggccgaggcaggcagatcacttgaggttagaagttcgagaccaccctggccaacatggtgaaactccatctctactaaaaatccaaaatttagccgggcctggtggcaggcacctgtaatcctagctactcaggaggctgaggcaggagaatcgcttgaacctgggagatggagtttgcagtgagctgagattgtgccactgcactccagcctgggcaacagaatgaaaacccatctgaaaaaacgtataaaaaaaaaagctagattagggttatacttttggggttttgaaatgccatgtcaatagcctgggaatcaatctctcattttattataagtgattatgatttttttcagaagagaaatgatataagtctgatgcttaaagatatttatctttagtatgtggagcacactaaagaaataaaaggataaaggagatgcaaactgttgcattagccatggtataagatattaaggaccccaactttattaagtcacactactattcaagcatccaaccatccatctgtccattcaacacttatctgttgagagttgactgatttttaggtagtatgctggagcaaaacaggactcaaacagatatctcatcctcaatttaccttgagtttacagatgtatagggagtgtatgtgtgtgtgcttgtatgtttatggatggtatgtaatgaagtgacgagacatataaagtgaaaattatcatatatattgctctaagtgatatgatagggttatatttgggcgtaaagacccataaccaccatgatgaggaagattttctagaaataatgctttatggactaaaaaatcaccttgatttacagaaatattggaagcagtgggattagtatgtggaaaatatagcactggagagtattaaagacttgccaaacttaatatggtgcaatatggttggaataaagttcatagtgaaataataagtcatgaaactggaaacagttgcactccttgaaagtacagttaaacaatactcttctatcagaaacatcactccattatttttcattttaattaggtcatttatttagtgatcaattgctttaagacatgtagttaggtctatatttaaaaagtgtgaaaaaatgatacaactgatgcataattttgggggaacattctaggtctttcatgggagacaattcttcatgggtctccagcattttttcatgtgttgtgagtaaacttgctgtttttgttatggaccgtcttttcaaggatatttttacaaggaaagctatagaagatatagtgcctccccttggaacaaaggacaagtatgtttactacccatggtaaaatatttgagtttataaactcatggttcttctcctgtaatgcaaaccactgcatgtacagatgtccccctttgcattcccctgggggagctagggcactgaattggcaaagaaaatgccgatactctagatactgctatagttgtgactaataaagtccttttccttctgacccaggagtcttgtggcttttgccaacatccacgaaactgtagcaggctaacttattagcttgcaagtaaggtaaaatcttagacccttcatagttcctgacagttttggctatgaggatgtgaaaataaaaaatgttttatttctagaataggatcgatgagacgcttgtgggtcaattaacagaatttgaagaaagtgtataagaattggcagtaaacatgttgatcacattaatggtcaaccaagcaataaattatccttcacttcattgctctttaataaggagaaattggaaagttattagcagatagaatactggaaagcgtgcataaagagagctgcttgaacagtgctggacttgttgcaaattcgcctccttttttgggaggggggatttccttgacaatcaattcaactgatgggattcaggcaaggtttgcagtggagcaaggaatctaaaataatcttgtgagtgaggccctttgggaaaattctatgtattgttttggttgctgtcattctgaatatatattagaaatttgatgcattatatgctcatacttccctgtcccatatgtgtcaggtaaaaactactgatgaggaattacacaaagcattgtcctcacccactcatggtacattgacatcattggacaattgacctcctctcagggcacttagtagtacctcactgctgatggtattttttcagattacaatgctattccagttaaatcagctgactttggccatacctttatggaccttgcaactaatcattgtcatgtactttaattttcagacttttgcagtctgatattagtgcttcttttattaccaaaaaaaccccaataattaatgggctgatagttaaagtatatccagtggaacttccacactccctaccatccacgattatctgttgtttttgagctttggaatgggctcctaaataatcaactcaaaaataattctcactctactcccttcacttcctcctggtcaataaacctagaaagaagattggccatgaagtgcagctgtcaacagaaaaggatcttagtttggcagcctcactttggcctggtttatctaccctctgagtagtatctcagccaaaatggggactcaaaacttaattctagttcatccaactggattcttttgttagactgacatgcttctagattggttatgttgctcactaggtcctcctggaatagtccacatgaaccaaaatgggcggtacatcgggtctgtgttggatttaataaaatgtctttgccctttctcactcattccttccagatgacagagctaggcatgagttggggatgactggaaaaaaagtaaaatatagctactagaatgggacacatgggttttgtgttagtagaaggagagtaactgcagaacctggagagagaacaacttagaccctgacaggtacagaggaggaagggccatccgtgatccttctcttcagaaccactcctagatccttcctcgtagagcaaaagaccctgctgtggctctcttaaactactgaaatatccctaaacttaactgaatgctgggtcctctgtgccccaccacataactctaaccatgatttgataatcatttcccttaattgtagtgagaaatctgttggatgcagctggaattgccccagattttccacctcccatgcaaaacattgccaaacctctggatgtcctccacatgctgatttcagtagctgtctccagtcattttgtagagcagacacataccatttgctggctggcatggacataaatgcaagttggactgattaacctgaggcagtccctccaaaaactaggactagattcaagtattcaaatttaaccggagactgtaaggcttcctggccagctgggaggccatgttggaggcactgccagcttgacctccacatggggaggaaaaacagttgtaaaaacacttgttctaggggcactatgtgtggccctgggactgtacattttgtgtagatgccaggaattaacttgcctctcttctgaaaacacagtcatatgcattatagggtgatcacaattgaccttcaagtgtttaaggaaaacatcaccagtagattatataatcttcagatgactgcagagatctcttcaaaattaggctgcctgtggttactcaggggatcttcttggaagagtgtttcattattattgcacaccctatgtgaagttatctctaaaatgggattcactaatctgaaaaggcagtacaacatttctccttgtcttcagctaaagtaatcagtgacatagctttggctcttgaaggcattcagtctcagcctcaattaactggacatggcagacatagaagatagatttgccctagactttctccttacttccaaagctgagcctgtgtgatttctaatacatctttctgtacacctggattaatgccttggatcaagtggaaaggtcaataaagaaagccatttggctttttaaggtagtccctgatgggttgtaggatttgtccagttgtctgtgtctggaaccctggggcacatggttgagatcatttctacaagtcagtctcttattgctgctcacagtcctgtgtaactttaattaaatgctttatgggataaattgaatggatatggtcccagcctctgtcagattaatcagagtggctgacaggtgatgcagtcatgggaaaattctccaaaagttaagacactgtagaaggagtttgatgttaaagacacaattctccatggatctctcatacttcacttcttgcaagcagaggcactcacataatatttttaaggatatttgtacagtgaacagactttgaaggtagagataatgtctccttccagaatgaacagcaggtatggttactgccagtcatcaaaggtttgcgtttcacctgcaccacacatacagtgcttgtctcctgtaacacaacccagagcatgtgcaagtatcatctagttcttcgtgtttacctgtgaaaatggcactcagggaacaggcacctaaaaatgctgtcactctggttattgctattgatctagaaaagttctttgtgtctgtaccaggatttttatgttttcttctagcatgcacaaaatcatggtggactaatagcttacagatgggataaaatttcagacactgcacacacattcttcacagacacattatttttgaagttataaaataatattaatgtgttgttaaagctaattttcagagaggggattctattccaccaacatttatgactaggtaataaaatctcatttttactgaaatttagctccataaaatgcattctatttaaaatctgaacatgtgccaaactatcatcaatactgtataacaccagtataattaggtagaagtactggataaactgtatgtaatatgtgcagcagaatcctaaatcattctaatggaaaacagattatgccagcaacatgtaaatacaaagaacagtggtctccaaggaaaatatcagtagcacatcaaaatctattaatttgttgaagaaatagtatctaagagattcaattaaacaaaataaccagagaatacatgccttatttttggaaacgtaaatattactaaaattgtattaattagcaatctcatgaatattatgttttactaagatgtaggaaaccccatgtaactcaatgtaatatttcataatagatctgattataactgagatgagcatttttacagggattaacaaaacataattggaaataaatgataattagataaattaactgtgggtggaaaattttcatagaaaataattgtcattcatttaaaaaatgtgtttttattatgaagatggggcaaattatagaaatagtgtcattgtcttttgttgttaccattttaaaatttcatctctaattctcctagtcatttagtttttatttcttccctgtccacaaattatattaagcatttgttcattcattaattcattgccttattcatttggcaagtatttatggaacatgtattatttattgaacaatgcttttcagctctttatggcattgtttagaatttaataatttcaagataatcctaggtctgctatcactgaacctacctctgccttcagtaatctcagtgcttgtaaatgaaacagctatttttagctctgatagaactaaaatctatacctgtcttggaaactgcaataattaataacctgtacttgtaaaatactttatagttttctgtcagaattttatgttaacaacaaatgtgagctagaaaagcagaaccgattgtttctattgcacagagaaagagcttaagtctttaagagggtaagtgacccaaggctaggttgcagagtcaaaattagaatttcatttcataataaattgtatgtcctttcactatgctgtacttatactggcaaatgatagagtgggttcagagatttctaattgcattgtgaagttaatccttatatccttagtggcttttggaaattacagtttaagactggatctgactgaaccagcattgaggacataagcttattttactggcaactctgtgatatgtcaaatatgcctaagacaatgtatttgattttgaagttgagaattgcataagtaaatcaagaaatcgtttagtgttataaattggcacctggtttctgacatagttgtttaggttattatttttagcaaaatagtacattataaatgtgcagataccctagattgttttacaattgagacatgaattcttctcccatatgagtttatattattaatgtctctctacagagaatagtactttatcccctaatttaaatatatagtaactcagttcttgccacatcccattgttcatggatgtgaacaggaacacacatctacctagtctcttctagaaaaataattatcaggaaataacagaacttaaagacaggattagaatagagagcatatcagataagagcgaaaacagagtgaaaatttattataatcgactgagctatataatgccaagaaataaaccatgaaaaatttctgtagtttaacagcaacacagatttatttcttgctcacacaaagtttcagttgggtccggcagctcttcaggactgctctcttctatattgtgactcagagagccaagctttccctattttgtactcccatcattttaatgtgtggatttcctgagctatctggacaggggaagacagtattaaaggtttatacgggatgtttttaaggtcaaaacctggccacatggctctaacataactccaaaggaggctgtaatatagaggttaatgccatctataggacatagttgaggctctgaggttaagcaacaaaaataaattttccctcgcgtcagataacaatgtgaggcacactttcaggaacttgtcaaggagcttggggatcagtgattgcaatgctttcccacatgattaatggtgatatagaagatagaatattttgattataggggaaggaaaaaatggtatatcagaggagccattatcccagtagagtgaggcaggattggtgatgatagagttaaggtgttatgactgaaatctataaaataaagaaatggcaatttaacttctacagacactgggatatatatgatatggtataagaaatgggagattgtgttagtctgttctcacattgctctaaagaaatatccgagactgggtaatttataagcaaaagatatttaattgactcatggttctgcaggctgtacaggaagcatagtggatttggcttctggggaggcctcaggaagcttccaaccatggcagaaggcaaagggggaacaagatgtctcacatggcaggagcaggggcaagaggaagagaagggggaattgctacactcttttaaacaaccagatctcaggagaactcactcactttcctaaggatggtaccaagagggatggtgctaaactattcatgagaaagccaaccctcatgatataattacctcctatcagaccctacctccagcatttgggattacgattcaacatgagatttgagcagggacacagatcaaagctatattaaagatcttctcagggttataataaaagcactagtagttgtgataagcattgtgaacgtctcagaaaagtggttaacaaaaataagtgatactttagaggacagatgtatgatgtggctaaagtgagaaagcaataaaatgaattcctctctctttataaaaatacatataaattaaataaatcttcaggttctaattttgataaatcctaaaaagtaatattttagttacttaattattaagtagttaatgatttttaactatgttcaaagcgtttgatatgatatcattattggtgtcttcatatacttttccattcacttttgattgtttgcttattcattatgtacggaaagatacaatatttagcctcgactgaaattgctgttgtccctcagaatacatttaaattgtttgactttgtaaatgtacaagttatttattcccttattcttctttgtaaatttgccttctttgtattttctgaaaatatttcaactattttcaggtttctgttatctggatctagccatgcaaagaaaagttgtcattttccatacctttaaaacttaaaattgacaaccattcccaatttatttcaatttctaggtgagatttagagtttcatttatgatggaatgacctccttagggacagacatctaattaatagttaattcatttaagaaattcaaggtactgtgtttcttctccctgctcccaaagagcttatagtccaatcagggaaacaaacaggaagtgattgcaattcagggctgtgtgctaagtgagaaataagcaggaaacgatgcgggagcacaaagatgggcactagcctggaccagagttgggcactgatggcacccaggagtgctggcccagccagtgtcaaaatcttcaatgaatgtagcaagaacagaggaactaacaatgctaaagcatgtgcctcctatgagcaaggattgttcagtgagggcagagtggccatgacctgaaagcaagcctgggaaaccagtgctgatcgtgccccactacccacccttgtgataattaatatgcaggataattagggcagaagagaatgaccaggcaggccttcattttaacatcctgaattactttggattattcattttagatgtaaagactttttaatttcatatttatgcaagacttttctcagatttatgaaacaaatttgaaaagtcagaatattttggaactaatggtatattttacgggaaaatggtgaaaacaacagctttgtaaaaatataaaggctgattacaaaaggctgaatacatatatattttatattatatatgggtgagtatgtttataaaatgcaaacaaatttatatgtaactattgagaagttttagtttttaatattttcattccatagaataccatggtgtacacagtattaatcatggtcactttgtttcagaaatgtaatgatcctgttgctgtaaaggaaaataaagaaagagggggaaaatgcacttaataaatgcgttccagagtaatgttcatagaaataaatcttagtccataatcatgagaatgaagggttgataagttgccagaggaaaaaatgatttacagtaatatgaattttaacacaactgtaattacatttaaaatttcaatttgtttaattgatgtttctccaaacttattatttttaatactcatcattatttatataccttcaataattattttttaaattccactaatttatatattaatgaatttgaattgactggtttgtatctgtgggtttttagtactgaactagatttctgttaattgtagagcacttcatccatttagaattttttagtctagttagatgcagtaaaaactggtgtgagtggttggacaggaaacaatatttcaattttgtgtctaattttttgagtgatttggataaaataaaaacatttgtgatgatctaatcagtgggataaattcatctgaaaatctttatatcaaataggtaagttagcaaacatgccaaactaaagaaatgaaccacttctattttagcttgactttcatttgctacaattattttttatcctaataatattttttgttctctgcattttagatgaaatgaatattgacatgtatatatttatgaatacatttatgtttgactgtgtttgttttattttagagtatatgtcaatattgtgtgttttaaactaatccttcaaagactaggaaatagaactctataccttaaccgatcagtaggtacttaagcactaaagaaattcctcttgataataaaatacttccaaactactcatgtttgtatattaatattgctgaaatgtttgtccttctttctctgggatgaggtagcaatgattttattttagtaattgaagtataattcttttcagaaaatggaatataaagttagtctttcaaatgaatgggaaattctaatttacaagaaaaataaaagcactctgtaattgcctatgatgtactacttctgcctgtgaggttgcatttctctgtaccttaatacaaagtacagtaatagaaaaatgattcagtaagtgtaattctattactttctaatatgacaccaatatgatacttttaatgaatgaaatacaaagttattttaaaaactgcagatttgtcattaactaaaaaatgttacattttatgtgttagagtgttcttattcaactatttattgctgagtattaaattgcacacttcaacaccgtgtgttattgcacagtacttaacaaatagtaagtccagaataaatagttattgactgaattaatttattaatatattcaaggctgttccaggtgttgtgggagctgcaaagggtgagtaatacaccatagcttctttcaaaatgaatgatacaagtaagaataatatgagatcacatgggaagaaattaatgttgaccgtagccaatgagagaatctttataaaagtcatagaatataagttagatattgaggatagggtaaataaaagagaaatttggctaaatttgcaaccgtggaaaagaaagaaaatgtcaagtaaaatcggaaaggttaggcttaaaaaaaacattttgaaacagcacagtaaagtatcatttgaatacaaaaggaattatagataggcaaaatgaattacagattatcatgaataatacgatcaactttaccctcactttacagcaaaaagaatcacaggccaataggtgagtttacatgtttgagattccatagaaaatagtaaaaatggtagcataactgtttgggaagtcataaggaaagaagtcaagacttctctttcaaaactttccaaactcacgtatattcaaacatctggaaaaatgctagcagccttctaaagaaatggctcttagtatttgagaagattacctgtagtattaccaaaggccacacacacacacgaagggaagcgtagtggagaaagttttattcttcaggccaaaaacacatatatttaagtcttggttcagccacttacttgtgttatggccttaagcaaactatataatttttcttcctttcttttttttttcttttttaaatacaggattttgttttgttgcccaggcttgaggacagtggcacaataataggtctttgtaactgtaaagttctggactcaatcattcctgctattgaaggctcctgagtagctaggactacaggcctgtgtcctgccaccatgcctggctaactattttaaattttttatttattttcttatttttatttttgtagagacagggtcttgctatgttgtccaggctgcgcttgatctcctgggctcaaacaatcctcccaccttgacctccccaaactctgggattaagtgtgaactaccaggcccagccaagctgtttagtttttcgaaccctcgttttttttgttgttgttgtttgtttttttggtgcaatcattttattttattttattttatttttttaattatactttaagttctagggtacgtgtgcacaatgtgcaggtttgttacatatgtatatatgtgccatgttggtgtgctgcacccattaactcgtcatttacattaggtatatttgctaatgctatccctcccccctccccccaccctttgtagggacatggatgaagctggaaaccatcattctcagcaaactatcacaaggacaaaaaacaaatcaccacatgttctcactcaaaggtgggaattgaacaatgagaacacttggacacaggaaggggaacatcacacatcattttttatttttaaaacaatgtatgcctttctggctgttaggatccatttagaaaattttttcttgcaatgcattcttagaagaatgggctaggtgattttcctaaagtgaatatctgagtatcttacattctggtgatttctaaacttcttaccggcctgaaaggtattacaagacctagacactgtattcctctctaacttcctcttggagccactcctctctgttccagtcatccaaggcttctctatgccccactaatggaccaggcttacacacactttacattttaatttttatttcaatagatttgggggtgcaggtggtttttggttacatggatgaattgtatagtgaggaagtctgaacttttagtgtacctatcatctgaatagtgtacctgtacccagtagataattcttcaaatctcactcctccttgcaccattcctctgagtctccagtgtctattataccactctgtatggccctacatatccatagcttagccccaacttataagtgagaatatgctgtatttggttttctgttcctgagttacttcacaagatagtggcctccatttctatccatgttgttgcaaaagacattatttcattcttttttatggatgagtagtattccatggtgtatatgccacattttctttatctactcatcggttgatggacacttagattcattccatatctttgcaattttgaattgtgctgtgataaaaatataagtgcaggtgtctttttgacataatgacttagttttctttgtgtagatacccagtagtgggattgctggatgggatggtagatctacttttagatctttgagaaatcttcatactgtttttcatacaggttgtactaatttacattcccaccaatagtatataagtgttccttttttttttttaaccatatctgtgtcaaagtctaatgttttttgactttttagtaatgaccgttctgactagggaaagatggtgtctcggtgtagtttttttttttttttttgagatggagtctcactctgtcgcccaggctggagtgcagtggcgcgatctctgctcactgcaagctccacctcacgggttcatgccattctcctgcctcagcctcccgagtagctaggactacaggcgctcaccaccacacctggctaattttttgtatttttttggtagagacagggtttcaccgtgttagccaggatggtcttgatctcctgaccttgtgatctcagtgtagttttaatttgcatttccctgatggttagtgatgttaagcattttttcatatatttcttggccatttgtatatcttcttttgaaaaatgtctattcatattgtttgcccactttttaattgattttttcttttttcttgctgatttgtttgagttccttgtagattctctatattagtcctttttcagatgtatcatttgtaaatatttttcccagatacctgagagtatgtttaaccaaagaggtgaaagatctctacaagaagaactccaaaacactgatgaaacaaattgtagataacacaaacaagtggaaaaacatctcattctcatggattagatgaatcaatattgtgaaaatgaacatactacccaaagcaatcgacagattaaatgcaatttctatcaaaataccaccatcatttgttcacagaattagaaaaaacaatcctaaaattcatatggaaccaaaaagagcctgaatagccaaagcaattgtaagcaaaaagaacaaatctggaggcatcgcattaccttccttcaatttacaaggctatagtagcccaaagagtatggtactggtataaagcagatacgtacacaaattgaacagaatagagaatccagaaataaagccaatatctataagcaattgatcttctacaaagcagaccaaaacatactgggaagaggacaccctattcagtaaatggtgctgggacaattggagaggcacatgtagaagaatgaaactggatccctatcactcactatacagaaattaactcaagatggattaaagacaaatatatgacctgaccccataaaataccctaaaaattctaaaaggaaacttaggaaaaactcttcaggacaatgacctacaccaatgatttatgactaaaaccccaaaagcaaataaaaataaataagtaggaccaaattaatctaaaaagcttctgcataacaaaagaaacaatcaatggagtaaaaggacaacctacagaatgggagaaaatattcacacctactttagatgaattgcacctgctgtttcctattttgggaatctttttccttctgattttcatatggctgctgcttatcattcttgactcagcccaaatgacatctttagaaagacattctcggcccacctaatgtaaagtagctgtttcctgcaactaatatggtgtttttttatgtcatttatcagtagctgaaatgatctgttcatttgtttatatatttgtttattgtctaggttaggaaacttttctttcttgttcattgttcagaacttagtactatcctagttggtaagccctcataagagttaatgaataaggaatacgttaatttttattaccagaattatgagttcaatatggaagatttggcggaaagacataaagaaaaaccaggaaggctttaacctagacatatacaaacattttggttattttaacattatgttactttagtaaaatatttgtttttatttttcttaaaaaataagcaatgattaaaaaaaaacctctatgatactccttacctgcagatatggctctaaaatatgacaaaatagaaaatggcacctttttttaactttaggcttaaataatttaaataaggctagattagaagaaagccatgcagagcctatggaaacatagtgtatgtgtaacaaagaatttgaccttgccaaagaaaagaggtctgtcctttgccctcggtttctgagaggtaatctgtgtcatacctgataggagtgtctttgtttagaatggaggctggccacacttaataatcttagagtagaggctgactaagccagaaagatcaatcatgtgatttaggatggtggctttgggtcatgcaatatcagtcaacttggaggctgagattaaccatgtagtcaatcaatcaatcagtcaatgatacctgagtaatgaagccttatgagaaactctggacattatagctcaggcaagcttccctttttggcagtactccatctatgttgccacacatcaattccaggagggtaataggtcctgggtacaacagaagcttacatttgaatccttccagtttctaccctatgtgtcttttcccttggctggtattttatctgtaccctacctccataataaaccataaccaaaaacatagctttcagccagttctgtgagtcctttcagtgaatgattgcattagagggtggttttgtgaatcctgcaatcttgctgttggtgtcaaaagcaaggacagttttgaggactgtgctctcagactttgagtttggctatctcttgctagtatatcaccatgagaaagaagatgttggttgtcttatagatgttaacattttagacttgaacggcttgcaggtaatacctattctaatatttcattttatggaaaagcatgaaggagtttatgatttgctttagttcacaaggctgctttagtgactgggtcagagttagaaatcaggtttatcaatctcattattttgggtttcccactatatactgtgttatttgacacaagagtgacatagtaagtatcacttgagtacaagtgatgtttgtttgtttgtttgtttgtttgtttattgagacagagtctctgtcacccaggctggagtgcagtggcatgatctcagctcactgcaacctttgcccgctgggttcaagcgattctcctgcctcagcctcctgagtagctggtattacaggtgcctgacactgtgcccggctaaattttgtatttttagtagagacggggtttcaccatcttagccaggctggtcttgaactcctgacctcaggagatccgcttgccttggcctcccaaagtgctggaattacaggcgtgagccaccacgcccggcccatttgatgtttatttttaaatattatgataatttttttttttgagacgaagtctcattcttgtcacccaggctggagtgcaatgtcgtgatcttggctcactgcaacctccatctcctcggttcaacggattctcctgtctcagcctccaaagtagctgggattacaggtgcctgccaccacatttggctaatttttgtatttttggtagagactgggtttcaccattttggtcaggctggtcttgaactcctgacctcaggagatctgcccgccttggcctcccaaagtgctgggagtacaggcgtgaaccacctcacctggccctatgataaatattaacttataaattagtaagatgtttatctcatagtattgtatattcaaagataaacttagaataaaacttgtatcttaattacaggaaaaatatccatgccacaaaaatgtccattttttaagaactacaacgatttttaacaagaaggtcttaattttgctttgtgattaacattatggccactggtttaacaagttaatgtattaggttctctttggctaactccagcatatgatgagataataacgtgatgggaaattcatacaattttcagaattatacacactgacagttgtgaaaaataaacatttccagtgaggctgacatgacaactttagggaaaaaaagcaagcattactcggaaatgctaagacaactaagcaagtatagggctatatagcaagtaaatgtctttaaacattcctctgtattacatatgagtgctttttctggataatgtattttcatcaaaataaccaacatattataaaaaatgatgctttaaaaaggaaactgctgttcttcatcaaaatagtttggaaacatgacatctcatttcctgtaattaaatgagttattattatcatttagtgacatcataatgggatattattaggtaaatgagatattattttctttacattatagtgatacaacagtagagactctgaaacctcaagaactgatcagatggagcacaaagagtgagatagttatatttctccagacttttctagcaggaagtacaataaatagtccgtatttattcctttgtaactatcttctacttaagtggacacagcacatggtgtgtctgttctgtgagtccagcacatgctgaacataaaaacaagtattttttaatttctagtttttttttaattaaaagtattatagagatgcagtcttgctatgttgcccaggctggtctccaactcttggccttaagcaatgctctcataaaggtaattcttttgagaaaagctttttaacttgtctgtcattatcatgaggcatttttagcacctattatatgtattgtaaagaaaatctgtcatataataaaatctagatatattaccttgtgtttactctaccggcatttgagaaaaggggatacactcagtaaaggtgcaatgaaagaaattcaaatgacatttttagaaggcagtatgtttggctaaagtctgcaggaatcaattttgcagaggtagagataatgtaggcatttgagtaacaagggatttactgtttagtgttctgtagacacataccatttacatctttttgtgtgttgggcagtgaatatatacaaatgagaactgtatttttcatttcttaatttcaacttttattgaatattcgggggtacatgcacaggtttgttacatgggtatcatgatgctgaggtctgaggtacaatagatcccatcacccaggtaggtagcattgtacccagtggttaggtttttcacccttctgaccctttatctcccacatgccaagtagtccccagtgtctattgttgccatctttttgaccagtattacccaatgtttatctcccacttataagttaggatatgctatatttggttttctgttcctgatttaagttgataatggcctccgcctccatccatgttgctgcaaaagacatgcttttgtccttttttatggctgtgtggtattccatagtgtatatgcaccacattttctttatccagtccaccattgatggggtcctaggattattccatgtctttgctattgtgaatagtgctgcaattaacatagatacaagtgtatatatctttttggtagaattatttattttctttttgatatataccagtaatgggattgctgagttgagtggtaatttcgttttaagttctctgagaaatctccaaactcttttccatagtggctcaactagtttacattcccaccaacaatgtacaactgttcctttttctgtgcagccttgcaaggatctcttgttttttgactttttaatagtggcccttctgggctgggcatggtggctcatgcctgtaatcccagcactttgagaggctgaggcggacagatcacctgaggtcaggagttcaagaccagcctggccaacatgatgaaactcccctctactaaaaatacaaaaaaaaaaaaaaaaaggctgagcatggtggcatgtgcctgtaatcccagctactcgggaggctgaggcaggagaatctcttgaacctgggaggcggaggttgcagtgagccgagatcgtgccattgcgctccagcctgggcgacagagcaagactctgtctcaaaaaaaaaaaaaagaaaaaaaaagaaaaagaagtagcccttttgtttgtaacacaaagaaatgataaatgtttgaggtgatgaataccccatttagcctgatgtgattattacacattgtaggcttgtatcaaaatatctcatgtaccctatatatataaatatatgggggtatatatatatatatatatatatatatatatatatatatatacacacacacagtgggtaaatatatatatatatatatatatatatactgtgtactcataaaattaaaaataaacaatttaaaaacatcaatagtaataatagccattttaactagagtgagatcgtatgtcattgtggttttatattttacaaatgggtaatgagtagtgtgtagaacaaattataaatgagagttgaggaactagaatggtggctggcagaagtttatgggaacacagattagaaggtaatgaagtacactttgttactgaaatattcaattcctctagtacacaaagaagaatgaaggttagaaataatcacttttcccagattttttttatatgtgaaagttttaaatattttaactcttatattattttcccccttaccatgtttatcacctgccaaagaactacagtataattgaggtattttattgaagagaaatgttgctttcagtggagttgactattttataaagaatatttaagtattgctttattgaccgtgatacaaactcatgcagttaggtttagaatcaaggagatggtgtctgtgatgttagttctactttgtcatgagagtagaacctctattatttttgtttttcttctctaatattttaagtgataaaaagaaaaaagcatgaatttttaaactaacagcagtcattaaattttaactttgaaataggaagttttctacttaagtaatatatttatactcatcagttttctttttctattacttaataataaaattatatttactttattcccatgcacacattaaaatgaaagtgttctgagtttagttttaaattttgtatggattcagatattggtttaaattcatataaattatgaatccatataaatattagctttttctaaacagcaaagtattatagcataacttttaagttttagtattttagtagtgtgctacttggaaaaattaatattgtaatttaccttttctcagcataagaggaagaatgaaaaattctgggcatacctttcagaatctcattttgctagatatttcacatttaaatacaaaaacacacagcaatccaaactaaatattctcctttgcaaaaatgtataatgacatcatattataataaggaataacataagctctctattcatatttgcaaaatatatgtttttggacttgtaatgggacttgcctccagagcaagaattcatagaattaagacacatttttgaaaatattcatgaaagatgtattttgagttactcaaaaccataaggtaaatcaatacttagcaaagaacaagtgaaaatactttgtggctgctatgctgagagtttaaggcaattctatcataaggattgagtatgctttcttaacgcaatccagaaatcagagccaaataactatcctcagagcagtaattatataatattgccaggttaattgtcttttcaaaaaataacagtgaaatcacagtattaaaaatatatgcactactggtgtattgttttctcttctccactgcatacgtagtgtgtacaactcaacttttaccaaactgtatgtacccagtctattcctatgtcttgctcttgactgtgtcaatgatgaaatcttgtcacttgtacatctctcatttttttgcaatttataatttatcttcctgggataatgtgatttacttaaggacacttacctaattagtttatctctttttttcccaagtaaaaaggcaaatgtaattaattgtaaggtaagtctcagaatgtttgtgtttagactgacacagggaagtttgactgaggatcttctacaataactatgtcacaagtgttttaataataaaactgtgtttccctgtgagtcactctgtagaatcctatggttggaatagtggagacggaaatgtatatcttggcagcacctgatcgtaaggtagaatgactagaagaatgctgactaggctgtaaacgtcttattaatttaaataatcctctccatttttagacctcacaatgattacagcagttatactatgtcaagtaaatataaaataaaaaaccactgaagtccaaagcagcatgtcaaatattgcccttagatattttaggcctgttctgatagttatttgactaaaatataacagtatagatatgtgattaataacttctctatgagacataattaatgactgttttagtaatttaaaaatattaataaagagattcatgaaactactgggttgtttgggaaccgactttatacaatagttatatcttccttttttttttttttttttttttgggacaggaccttgctccatcgcccatgctggagtgcagtgtggcacagtcatgactcactgcagcctccaagtcctgggctcaagcagacttcttgcctcagccccctgcgtagctggactgtaggcatgcaccaccatacttggctaattaaaaaaaaaaattgcagagaggggggtctcgctgttttgcccaggatggtcttaaattcctggctttaagtgatccttgtgcctcagcctcccaaagtgttgggattacaggtgtgagccactatgcccagctgaatggttacatcttacttttttttttttttttcaattctgtagcttcagaaattcattatttctgccattaggaacaatgatctggagaattgattcacactaaccaaacataaggggctgatttataaatcatatttgatttacttatgaaaggcattgctatttttttactagaatatagttatctataagatatatgaggagagacaccatgccctttacattcattgtcatatccctagagcttagaaaattaattcttgaattacttcactaataattactcagtttagtcttaatgcctcttgatatcaagtcatttgggagattacatgagtagtcagtatggctgaaagatttgtaaatgtctccttttgaagagaatacttcataacattgtgtttggtttagtatgtaatttactaatcttttgacttttgttaataattagcatttccttacagttaaacaaactcttctaaaaatagctacataaatcttacataccaattaattagaacacgtattacataacatttttgatggcctttatatatttgtttaaattttatataagtaaattctttccagtgtgtaattaaaatgcccagtgtaatatatcaatttatcttaaatgctttaaccactttaatgttatttattttatacatatatctttattttttatgattctatgacatttcatgttattagttgaaaaataaaaattctgttttatggattcatggtgtacaacatgattttgatatatgtgtacactgttgaataaatcatatttgtcttcctggataaataacatagccatcacctcacatatttatcatttttgtggtgaaaacattttactttctcagcaattttcaagtatacaacacattattattaataatagtcaccatgttgtacaacagatcttcagaacttacttctcctaactgaggctttgtacttttgtccttgatctcccttttccacacatacctcagcctctggtaaacaccattcaactttctgcttctctgagtttgtttggctgtttaagatttccacacccatgtgagatcatgtggtatttatgttctgtgcgtgacttacttcacttagtgtaatgtcctccatgttcatccatgttgttgtaaatgacacgatttcctacttttagccacttttaaaggagaaaattgtacatgttacagtgatccaaaagcaaatcagtatgcttccattaaaactgattacaaatgtattaatgctaggcatttatatttcttttcatctttttcttgtttttacattttgcagatgtagcatttatatttctctgggatttcagaaatgtaagacaagtccattttttcactttcttaggctttaaccaaactaaacctacatgaaagccatctcttaaatgttaaaattctgagttgtcaactagatgactgtttggtctagtgattggaatttgctgtatattcagagaagcttcaaacccaccatactggccataatgttggagtttgcttttacaattaaactctacttgctatgtgctcttatgtcttttttttttttttaagttaaagcccaccttttaattttgtgtaatatgggtgtcctctcacaaaatgattttctttttaaatcccatttgcttgtgttatttaacacttttcttgttcctgctatgttaacattattaaaaccttcatgcctgtaatcccagcactttgggaggccaaagcggcagacatgaggtcagaagttcaagaccagcctggccaacatggtgaaaccccgtctctactaaaaatacaaaaaaaaaaaaaaaagtagctgggtgtggttgtgcatgcctgtaatcccagctactctggaggctgaagcaggagaattgcttaaacccagggggcagaggttgcagtgagccaagatcgcacccctgcactccagcctaggcaacagagaaagactccatctcgaaaaacaaaaacaaacaaacaaacaaaaactcatggactttcattattatttctttattatgtagggctatctagtgattttatctaccaggagatgagaaactattttttcttagttatcactctacttctacattctgctaatttatcaaatgtctgaaatgcataattgcaccctcttatatttgagatatcatcattagtgttaatcaattgctggatttctttttttacctgattcctacatgtgaccattggtgctaaacagttttttctattcctagtacagtactacttttggtactactggtttacttacagatccttggctatacagacagaaggaaatacatgactacattttataaacataagtataataagaaaaacaaaatacccatatataaactgtaaaaccaatataaattaacaattttctactcaatttgtattttttaaattagtagtacctttttatatccttcattttttcttttctagaaaaaagctaaccttcaacagtctcaaattattctatttagtcatactgattacttttttttcatgctcatattgccagagattacctagggagaagccatctaagttgctttccttatctagcttttgaaaacagccactaatttttttcttaggtgaattttgttttctcggcaacaaaatgattgtcccagaaacattgttttatgtctttcttcttttctttctttctttctttcttttccctttctctgataagtaaaggaccttgatttttattagcattatttattaatagatattagtcagcaagtatccagctgctaggactgaccaatatcagtgctagctgtcggcaaaaggactgttgctgctattggtgactgttgctgctattggtgtcttttagggagagatctggaaaagatgtttttaggtttatgaattcaccattgattattttctgtaacatatcatgttgctgcatctactgttattttattatgaagtttcaccagcttcaaagattctcctctacagtaacaagaaagttgctttgtaagcacaatatcaaaggaaggcaatttagaataagtagatttaggaagcaattcatctagaccagtggcaaatggaaccctgctagtccaagtgtcaagtgttacctgcaaaaggaaaataaaatgagaacaatgtcgtgaattttccaaatttagtttgttcactttattggtgttgctgtcttatgtgaaatgttagaatagcagtggcagagattttaatatttccctgttcaaaaaataaaatattttaaaattttatttcaaattgtgggtgaatgtattaactgtcagaattcaaaaaaggattgaacaaccaccttgaaaacatcatgtatgcctctggatctcaggaactgctggaaacaggaacaacatgacctacctatgacattttttaatttttcaagtaggcttagactggtcttgactacacaattaaatccatagcccctgtgatgacagtgttttgcatcttgcagtatgtatcaccagacagagactttttttcatttctgggatggggctttggtcaccaagtttggttaagatgtccatcttggaccgttcaccaaggagaaggagtttggctcatataagaatctggtagctccctttatagctagatggattgggtagggtggttccaattaaaaaggaggaatgctgtgaaaatctttttctagaagtttacaatgtctaagatgtcctcacttggtataataaaaaatggtagttatgtgctttgcattcatttatttcctttgttctgtccttcactgctttctaagtcttgttggttgtattggtttgccagggctgccataacaaaatactacagactgggtggcttaaacaacagaaatttgttttctcacagttctggaagctggaagtccaagatcaaggtgatggcaagtttggtttctcctgaggcctctctccttggcttgcaaatgacctatcttccctccctctgtgaattcacatggttcatcacatctctgtgtcttcatcactctctgtgtgtgctgtctgtgtcctaatctattcttataagaacaccagtcccattggagtgcccatccatatgagcttgtttaacctttattgtctctttcagggctctgtctccaaatgcagtcatattctaaggtactgggggttaggattttttataaattttggaaggatacaattaaatcccatgaattcaaaatccaagtgtaaaattatttaccccaattagaaattggataaattagtatcctttcactataaaatgtattttgactaatatattattaactaccaggttaagagtctctcatttggatagtgtgtttgataaacactcacatcagtgtcttcacaaaattctccctttaaaaagcttttccttttccacaacttcaattatgttttgttgttgttgttttaattttctgttttgcatttttagtacgacagcttatcttttgctgcctatattttctcatttttaaatgtatatagataagtagtttattcttattggactatcgctgacactgtatggaacagagcttccaataaacaagtgattttatttatagtttaagttattcattaccttcgtttggagaaagaagcacttagatttgggtatacttatcacctttcaaaccatggtatgtgcactattcatggatcccacgtgtttttaaagtttaataatgtttaatttgaattgttaaagaggtttatttaaaagccccagtgtccttacttttaaacccaaggactaaagtgttcactgtctatttgaaaatattattagctttccgtaatgaatactactttaactacaaattatgctaacattcgaattagctgaaaagtgacctgagatggcatgccaccatttagtatttaggctgtttttttgatgtctttgatgttctatttttctgtacatttgttatttcattgttagtctctaataagttcttacttttcttaatatacttatcacccatttatatatatacaaatatacaaatcaggactttattccttcttcagcaattcctgcctgtgcacttcagcacattaccatctcttctcaagacttctcagtgtagccttctagtttattttgctatttgccctcttgaaaataaaataggaaacataatctcagctctgatatattatggtataatgcaagtcaataattaattttaatcgaattaatatagattgttttcctgcccattcttcctgatgtaaaacaaataattggcaaatggtagccaaattttcacttccaagcatggtctaaattaatatttcacagttgtcacaatatacaaaatttgtttgaaaaacaattcattaaatgtgttagaagaatgttacctacatttgaaatataaatattagaaaaagtaactggagtttcatttcacagacttctatttgaaaaatgtgtatatactttttatgtgtttgcagtgagcaaattcctttttaatatcactaaagaagtttttattcaaataaacacttacctgtatttctcatatcaagaaatcatttcctgacttctaatatctttcatatctgcccatatgtacttccatttaattataagttacataaatatcattaaaaaagaaaaaaaatgaatgtgcagataattggaaaagttaagaggttttagaataagtcttggaattttttattggactgataattttaaagcccataggtgtcaaatgatttctgagactcagttaaaacttttcattctgatttggaattcatttttgcttcacggcttccacatatgagtatttcctcatttactcagtgttttggtttctaattgttggttttgatttttcttcaggatgttttgaataatttgggatcttgtgaactggatgaagatgatctaatgcttgatcttgaatttttagaggaacagagtcttcacccttctggtaagtgttaaagagatgaataatatcatacaactcctaccctggtcagtagctttcactgatagcctaaacactgttaaggctgccttctatcttttcaggcctcagtttttatagtctatatgcaaagaacatgctaggtaccatggagacataatttgggtgcgttaaatgattttaaagccttttatggaaatataaatcctgttggaagataattataaataagaaaaactataaaaaaatctttccaaaataggaaatattctagttaaataattaacaaaaagtttaatattttcttctgttttgtggaagaaagcaataattataatctcacttttcatttattttatataaccaaatggaagttttgtggatctaagatttactgctccaaatcttagccacttcctacataggttaatgttgatgcaataaggttgatctcaaaagtactaattaccagtagcagtcacaaatgcacactcataaacatatacacacacatagagttagagaggaggtaaataagtttttgttgaatgacttgagggagcctgatatatttgtaatggcttaaatttatattaaagcataaaatattatgtctccaaattccagaattactctctttaaagttggttataggaattattggtcgtccattcaaatttagatatttgacagcaaaagtaaacatttacacttaatttttttgttgctaataatgtctttaacatagtcattttcaagtggatatagcattaaactaaagctttagaacgttgggacctactgcatacatttaagaaaatcagtctcttatatggtagtgtctttatttttaattcgtggaaattagacataacctctgtagttatttttagttgtaaaactttatgatgaattttcatttatgtagtatatttggataatagataatatcatattatcaattgtcaaaagaaggcaataacaatgttgatattttcttacactctattttaggctaataccaaacaagaaactgcatttaaaattttttcggttgaataccactttatgataaaaatttcttgggacatttttcctgtagttgatttgacagatatccttctaaaaatgtagattttcacacttttatgcagatggtttttacaacttagatccaacaacttaacttctagatatctaattctatgatactggcaaaagacaaaatagtacatgcatataattattcactgcaaaatatttataatggaaaaatattggaagcacctgaaatgctcatcaataggatacttgttgaatatacaatggtttaccgaacagtcattaaaaaggaggaggacagtatccaaatctgctatggcattattgtaaggatatattatttgtttttgttttgttttgtttgaaacaaggtctggctctgttgcccaggctggagtccagtggcgtgatctcagctcaccacaacttccgcctcctgggctcaagtaaatctcccatctcagcctcccaagtagctgggactgcaaatgcatgccaccacatccaatttttgtattttagtagagacagggtttcaccatgttgcccaggctggtcttgaactcttaggctcaaaagatccacttgcctccgtctcccaaagtgcagggattacaagtttgagtcaccatggccacccgattgtaaggatgtattgttgatagagaacttttcttttcaaggatggattagatagggaataccaaaaccaaacccactgatcaattctctaacatcacaaaaagtgtaatgaatatatagtttgcccctcttgatgcaatgctgactgaagtacaacagcacaacctctgaagtgttcgtgtcctctcaccccttcctatccccgtcccagaagaaataatccattcaaatagttcaaactttgattttataggaattattggaatgggtggagggaaaatgttaaatgtcataaaaagattgtgggcaaccaaatataggatttggagattctgcaagataaatggtctggtttcttcaaaagataaatggcatgataaaataggaggagttggagttgtaggttaaaagaggcaaatgcaattgacattcttgttggtatacttatctgaaatatataaactttttctataaagttgtttctgagttaatcagagaaattagaggattgactgttactgcagaattatagttaattttattgggtgttgaaatggtattttgttttgtttagtttttttcaggaaaactttttatagagataaatgtggtggtaccaatatcgtatataggctttgctttaccaacaagtatgagtaaggaaatagatgaaacaaagtagacaaattcttaaaaattgtcaaagccgggcaagagttgcatggggtgaaaagttcatgaattaattataatattctctctattttgtatattttttgaagattttcattgtaaaaaataaaacaaagcaacaattagaaaacactacagttaacatagcagtctcaattatgtttggtagtcaaccacaatgacgagaaaataatgatttaaatatctgaagacttatttcagtgtgtttacttggggacaaaatcaacctctttaaactttagtctctcctttacgaagtaataatggtactgtgtacttcattaatttattttaaataaaaatgaaataatttttacaatgaatctcttgagtctactttaaggtgtaggttgcttagttaaagctcaaaccagggtacctgatgaatcaactgagtcatataaattgttcacaagataaatggtattagtttgcatacatgaagtgcaattctaatagataaaatattacttagagtgactttggattgtttaatgtcacttaataaactgtcttttgaaaatctatttcattttagatgccatgttgtgtggtttttaaaaagcagcaaacacgtttatatactttagctgagaaagaattatttccagttgaattggttttatacaatttattttatttattaagcaacataattaaagacctcagattaggccgggcgcggtggctcacgcctgtaatcccagcactttgggaggctgaggcgggtggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccaagatcccgccactgcactccagcctgggcgacagagcgagactccgtctcaaaaaaaaaaaaaaaaaaaaaagaaaaaagacctcagattataagaagcttatgattgataattgatattgataaaaatcacagcattaaacattcaaaaatgatgtttttaataaaagaacagcgattttcaaaagtctgaaaagtgaaataatgatatcattatattccactgcttatattactgaaaatcattaaaggggttgaaaaaatacttcttaaagacaatgcatatgaatttttggctacagagtcttattatggtagtttatagtagggcttactataatggccaagattgactttttaaaagaccacagaagacaagattaagattgcagatgggaggaaggactagcttgtagctcctgcttggatgaacagagcagggtgtggagactcacatcatgaacttttgctccaagaactaccgcaggaacataccaggaaagccaagagaatccacagacctttgaaggaattggatcaccgccacaggctccctgagatggcaaaaaactgtgagtctgcttgctttctcaatgggaggctcgtggtccggggcaagttctcagttctggtcactggctgcttggaaaatagactcagtgctgttgtgggacacgatgggagtgagataggcccttaagaccgtgggctgcatgggagtggggtgaggcatgtgactgacagctttccccagcttccctggcaaattatatgactcagcagaggcagccataatccccctgggaatataactccactggtctgggaaccacacccccattccccacaaaagtcacagcaagacccgctgcccaaggagaggctgagctcagaaatgcctatccctacccccacctggtggtctttctctaccctccctggtggcctaagacaaaggttataatctcttgggtgttctatggcccttcccacggcctgagaaacctgaatacttaaccaagtgtccctagggcaagtttgcatcctctctatagaactgcagctgatgccttcttgaaagtgttacttcctggctggaggctgaccaacacaaaaccagtgcactaaacaaaaacacaaccaaggaccatcacagagtccacttcactcccctgctacctccaccagagcaggtgctagtatccaggtctgaaagacctgaacatggatctcatcacaggactctgcaggctcagcccagaaccagcccagagcccagtagctctgctggttggctagacctggatgggcaaaaacaatcactgcagttcggctctcaggaagtcccattcctaggggaagggggagagtaccacatcaagggagcactctgtgggacaaaagaatctgaatagcagtccatgagtctcagatcttccctctgacacagtctactcaaatgagaaggaaccagagaaacaattctagtaatatgaaaaaacaatattctttaacgttcccaaaagaccataccagctcaccagcagtggatccaaaccaaaaggaaatctctgaattgccgtaaaaagaattagaaggtcgattattaagctaatgaaggaggcaccagagaaaggtgaagtccaacttaaagaaataaaaaacatgatacaggatatgaaaggaaaaatcttcaatgaaatagatagcataaataaaaaataatcacaacttctggaaatgaaggacacacagaaatgcaaaatgccctggaaagcttcagcaatagaatcaaacaagcagaagaaagaacttcagagctcaaagacaaggctttcaaattaacccaattcattaaagacaaagaaaaaataactaaaaaataaaaataaatcctccaagaagtttggcactgtgttaaatgtccaaacctgtgaataattggtgttcctggggcagaagagatatctaaaagtttggaaaacgtatttgatggaataactgaggaaaacttccccagccttgttagagacctatacatctaaattcaagaagctcaaagaacaccttggaaattcatcacaaaaacatcatgacctacgcacacagtcatcaggttacctaaagtcaagatgaatgaaataattttaagagctgtgaggcaaaagcatcagggaacttataaatgaaaacctatcagattaacagcagatttctcagcagaaaccttacaagctagaagggattgggttctatttttagccttcttaaacaaaacaattatcagacaagaattttgtttccagcaaaactaagcttcataaatgaaggaaagataaagtcttttccagacaaataaacactgaaataattcgccactaccaagccagcactacaggaactgccaaaaggagctctaaatcttgaaacaaattttcaaaatacaccaaaagagaaactccttaaagcataaatctcactgaacctatataacagtaacaaaatgaaaaaaaaaagtatgcaggcaacaaatagcatgatgaatagaatagtacctcatgtctcaatattaacattgaatgtaaatagcctaaatgctccactgaaaagagacagaatggcagaatgggtaataattcactaaacaagtttgttctgttttcaggaaactcacctaacacgtaagaattcacatgaacttaagataaaggggtggaaaaagatattccatgcaaatggacaacaaaattgagcaggagtagctattattataccagacaaagcaaactttaaagcaacagcagttaaaaaaggcaaagagggacactatataatgataagagtagtccaataggaaaatattgcagttctaaatatatatgcacctaacactggagctcccaaatttagaaaacaattacaattagacctaagaaatgagatagatggcaacacaataatggtgggggacttcaatacttcactgacagcactaggcaggtcatcaagacagaaagtcagcaaagaaacaatggacttaactataccctacaacaaatagacttaacagatatttacagaacattctacccaacaactgcagaatatatgttgtattcatcagcacatggaacgttctccaagaccataagacaggccactaaacaagtctcagtaaatttaaggaaatcgaaattatatcaaatattccttcagagcacagtggaataaaattggaaatcaactccaaaaggaatcttcaaaaccatgcaaatacatggaaattaaataacctgcttctgcatgatcattgggtgactaataatatcaagatggaacttaaaaaattatttgaactgaatgataatagtgataaaacctatcaaaacctctgggatatagtaaaagcagtgctaagaggaaagttcatagaattaaatgcctacatcaaaaattctgaaatagcacaaatgggcaatctaagctcacacctcacggaactggagaaacaagaacaaaccaaacacacacccagcagaagaaaataaataatgaaattcagagcagaactaaatgaaactgaaacaacaacaacaaaaaagacaaaagataagtgaatcaaaaagctttttcttcgaaaaaaataaataaaattgatagaccattagcgagattaacctagaaaagaagagagaaaatccaaataatctcaattagaaacaaaatgggaggcattacaactgataccacagaaatataaaagattattcaaagctaccatgaacacctttacacacataaactagtggagatggataaattcctggaaatatatgaccctcgtagattaaaccaggaggatataaaatctctgaacagaccaataataagcagcaagcttgaaatgataatttaaaaactgtcaacaaaaaaagtttaggaccagatggattcacaactgaattctatcagacattcaaagaagaattggtcccaatcctgttgacactattctgaaagatagagaaagagggaatcctccttaaatcattctatgaagccagtatcaccctgataccaaaaccagggaaagacataacaaaagaaaactacagacaaatatccctgatgaacatagatgcaaaaattctcagaaaaatactagcaaactaaatccagcatcatatcaaaaagatgatccagaggtggagccaagatggccgaataggaacagctgcagtctacagctcccagcgtgagcgacgcagaagacgggtgatttctgcatttccaactgaggtactgggttcatctcacgggggagtgctggacagtgggtgcaggacagtgggtgtggcgcaccctacatgagccgaagcagggtgaggcattacctcacctgggaagtgcaaggggtcagggaattccctttcctagtcaaagaaaggggtgacagacggcatctggaaaatcgggtcactcctaccctaatactgcacttttccaacgggcctaacaaacggcacaccaggagattatatcccgcgcatggctcagagggtcctacgtccacggagcctcactcattgctagcacagcagtctaagatcaaactgcaaggcagcagcaaggctgggggaggggcacccgccattgcccaggcttgagtagctaaacagagcggctgggaagctcgaactaggtagagtccacccagctcaaggaggcctgcctgcctctgtaggctccacctatgggggcagggcacagacaaacaaaagacagcaataacctctgcagacttaaatgtccttgtctgacagctttgaagagagtagtgattctcccagcacgcagcttgagatctgagaatgggcagactgcctcctcaagtgggtccctgacccccgagtagcctaactgggaggcatcccccagtaggggaggactgacacctcacacggccggatactcctctgagacaaaacttccagaggaacgattaagcagcagcatttgcggttcaccaatatccactgttctgcagccaccactgctgataccgaggcaaacagggtctggagtggacctccagtaaactccaacagatctgcagctgagtgtcctgactgctagaaggaaaactaaccaacagaaaggacatccacaccaacaacccatctgtacgtcaccatcatcaaagaccaaaggtagataaaaccacaaagataggggaaaaatagaacagaaaaaccagaaatctaaaaatcagagcacctctcctcctccaaaggaatgcagctcctcaccagcaacggaacaaagctggacggacaatgactttgatgagttgagagaagaaggcttcagaagatcaaactactccaagctaaaggaggaagttcgaacaaatggcaaagaagttaaaaactgaaaacaaattagatgaatggataactggaataaccaatgcagagaagtccttaaaggacctcatggagctgaaaaccacagcaggagaactacgtgatgaatgcacaagcctcagtaactgatgcgatcaactggaagaaagggtatcagtgatggaagacaaaatgaatgaaataaagtgagaagagaagtttagagaaaaaagaataaaaagaaacaaacaaagcctccaagaaatatgggactatgtgaaaagaccaaatctacatctaattggtgtacctgaaagtgacagggagaatggaaccaagttggaaaacactctgcaggatattatccaggacaacttccccaatctagcaaggcaggccaacattcaaattcaggaaatacagagaacgccacaaagataatcctcgagaagagcaactccaagaaacataattgtcagattcaccaaagtggaaatgaaggaaaaaatgttaagggcagccagagagaaaggtcgggttacccacaaagggaagcccatcagactaaaagctgatctctcggcagaaactctacaagccagaagagagtgggggccaatattcaacattcttaaagaaaagaattttcaacccagaatttaatatccagccaaactaagcttcataagtgaaggagaaataaaatcctttacatacaagcaaatgctgagagattttgtcaccaccagacctgccctaaaagtgctcctgaaggaagcactaaacatggaaaggaacaactggtaccagccactgcaaaaacatgctaaattttaaagaccatcaaggctaggaagaaactgcatcaactaaagagcaaaataagcagctaacatcataatgacaggatcaaattcacacataacaatactaaccttaaatgtaaatgggctaaatgctgcaattaaaaggcacagactagcaaatcagataaagagttaagacccatctgtgtgctgtattcaggaaacccatctcatgtgcagagacacacataggctcaaaataaagggatggaggaagatctaccaagcaaatggaaaacaaaaaaaggcaggggttgcaatcctagtctcggataaaacagactttaaaccaacaaagatcaaaagggacaaagaaggccattacataatggtaaagggatcaattcaacaagaagaggtaattatcctaaatatgcatgcacccattacaggagcacccagattcataaagcaagtacttagtgacctacaaagagacatagattcccacacaataataatgggagacattaacaccccactgtcaacattagacagatcaatgagacagaaagttagcaaggatatccagcaattgaactcagctctgcaccaagtggacctaatagtcatctgcagaactctccaccccaaatcaacagaatatacattcttttcagcaccacaccacacctattccaaaactgaccacatagttggaagtaaagcactcctcagcaaatgtaaaagaacagaaagtataacaaactgtctctccgaccacagtgcaatccaactagaactcagcactaagaaactcactcaaaaccgctcaagtacatggaaactgaacaacctgttctgaatgactactgggtacataatgaaatgaagcagaaataaagatgttctttgaaaccaacgagaacaaagacacaacatacgagcatctctgggacacattcaaagcagtgtgtagagggaaatttatagcactaaatgcccacaagagaaagcaggaaatatctaaaattgacaccctaacatcacaattaactagagaagcaagagcaaacacattcaacagctaggagaaggcaagaaataactaagatcagagaagagctgaaggaaatagagacacaaaaaacccttcaaaaaatcaatgaatccaggagctggtttttcgaaaggatcaacaaaattgatagaccactagcaagactaataaagaagcaaagagagaagaatcaaatagacacaataaaaaatgacaaagaggatatcaccactgatcccacagaaatacaaaccagcatcagagaatactataaacacctctacacaaataaactagaaaatctagaagaaatggataaattcctggacacatacacctcctaaggctaaaccaggaagaagttgaatcactgaatagaccaataataggctctgaaattgaggcaataattaatagcctaccaaccaaaaaaagtccaggaccagatggattcacagccgaattctaccagaggtacaaggaggagctggtaccattccttctgaaactattccaatcaatagaaaaagagggaatcctccctaactcattttatgaggccagcatcatcctgataccaaagcctggcagagacacaacaaaaaaagagaatttgagaccaatatccctgatgaacactgatgcaaaaatcctcaataaaatactggcaaactgaatccagcaacacatcaaaatcttatccaccacgatcacatgggcttcatccctgggatgcaaggctggttcaacatacgaaaatcaataaacgtaatccagcatataaacagaaccaaagacaaaaaccacatgattatctcaatagatgcagaaaaggcctttgacaaaattcaacaacacttcgtgctaaaaactcaataaattaggtattgatgggatgtatctcaaaataacatgagctatctatgacaaacccacagccaatatcatactgaatggacaaaaactggaagcattccctttgaaaactggcacaagacagggatgccctctctcaccactcctattcaacatagtgttggcagttctggccagggcaatcaggcaggggaaggaaatagcgggcattcaattaggaaaagaggcagtcaaattgtccctgtttgcagataacatgattgtacatctagaaaaccccattgtctcagcccaaaatctccttaagctgataagcaacttcagcaaagtctcaggatacaaaatcaatgtgcaaaaatcacaggcattcttatacaccaaaggattataaatcatgctgctataaagacacatgcacacgtatgtttattgcggcactattcacaatagcaaagactttgaaccaagccaaatgtccaacaatgatagactggattaagaaaatgtggcacatatataccatggaatactatgcagccttaagaaaggatgagttcatatcctttgtagggacatggatgaagctggaaaccatcattctcaggaaactattgcaaggacaaaaaaaccaaacaccgcatgttctcactcataggtgggaactgaacaatgagaacacatggacacaggaagaggaacctcacacactgaggactgttgtggggtggggggaggggggagggatagcatagggagatatacctaatgctacatgacgagttgatgggtgcagcacaccaacatggcacaggtatacatatgtaacaaacttacacgttgtgcatgtgtaccctaaaacttaaagtataataataataaaaaaaagaattttgaatgttaaaaaaagatgctgaatcataaatataaacatcaaaaaaaaaaaaaccaaaaagataatccatgatgatcaagtggttttcatacgagggatgcagggatggtttaacagatgtaagtcaataaaagtgacacacaagcaaaacagaattaaaaacacatatcacatgatcatctcaatagaattagaaaaagcctttgacaaaatccagcattgctttatgattaaaatcgtcagcaaaatcggcatagaagggacataccttaaggtaataaaagccatctatgacagacccacagacaacatcatactgaatggggaaaagttgaaagcattctccctgagaactggaacaagacaaagatgctcacttttactactactattcaacatggtactggaagtcctagccagagccatcagacaagagaaagaaataaagagcatccaaatcagtaaagaggaagtcaagctgtcagaaataaagagcatccaaatcagtaaagaggaagtcaagctgtcactgtttgctgaagacatgatcatatacctagaaaaccctaaagactcattcaaaaacctcctggtaaatgaatttagcaaagtttcaggataccaaattaatgtacacaaatcagtagcccttctatacaccaacagttaccaacctgagaatcaaatgaagaacacaacccctttcacaatagctgcaaaaacataaagtaaaatacttaggaatatacctaaccaaggacatgaaagacctctacaaggtaaactacaaacagtgctgaaagaaattatcagtgacacaaacaaatggaaacacatcctatgctcgtggatgggtagaaccattatcgtgaaaaaaaccatactgctataagcaatctacaaattcagtgcaattcccttcaaaacactaccattattctttgcagaactagaaagaaaaaaccctaaaattcatatggaaccataaaagagctcacatagccaaagcaagactaagcaaacaaatctggaggcacattacccaacttcaaattataaggccatagtcaccaaaacagcatggtactggtataaaaatgatacggggtgtgaatgtttagtttttgctgattgtattgaataatttgaatagtttcataaatccttgtaataaagagtcctaaattaatatatgttcctccctcacgcctgtaatcccagcactttgggaggccaaggcgggcagatcacgaggtcaggagatcaagaccacggtgaaaccccgtctccactaaaaatacaaaaaaaaaaaattagccgcgcgtagtggcgggcgcctgtagttccagctactcgggaggctgaggcaggagaatggcgtgaacccgggaggtggagcttgcagtgagccaagattgcgccactgcaccccagcctgggtgacagagcgagacaccgtctcaaaaaaaaaaaaaaaaaaaaaaaaaaaaaaaaaatatatatatatatatatatatatatatatcttcttcctaaaaggagcagtagtacaaataatgatagaaataaaatatgttttatagtgcagtaagtggatattattatttttatgaaagccaggaagaacaatttcaatgaaagaatggtatatgaattcaaagtgagttcctaaaaggagatagccttgagaggaaaaaaatttaaaaataaaattaaaaatttcaataatttaccatgatcttggcattatctaattttattgttttaaattctaatataaaggctaaggttttcaatttaaaaggttttagatttaaaggatttttttattatattttcttgagtttctgaaaaatgttttctggaaaccattttttgtgaaataatacacattatgtttcaaacacaggattataagttttttactaccagacatttctattttcttgtggtaaaatattacatttattgtttctcctttaaataaataatttataaagcatatatgatcaagcacagggattttatgttagaaaatatgagatgctagcatttatactttgataaactaaaaagtatattagtgacccttcacactttttatctgtcctcactttcttattcatgtttgtatagtattgtttttgtcacaaattgagtcatgcaatatgttagcagcgaggttcgttagataaacctcagcatatttttttaaaaaggggttttaatgatatttactagcatttaatatttcaaagacttgaccttgaaatattcaaggtcaatatttcaaataagttcccttgaagttttcttcacagtgaagtatatgttatgaactatacaatttgtctaaggaaaaataccagcaatacatttttgtttgtttttctttatgtagtttcacatttgttttgaggatatttttctattcacttatgcatcttgcaaaatatttataacacagataaaataataatcatttaaggaaaacaaagtaaccaggatatgaaaaaaaataagatgaggctatggataaggttaaggcacaaaaagtttactagtgttatgacggtgaattgaaaatgttattttgagtgtcctattagcatgtatgaagaaagaaaatcagttgaaaaatcaaaatatatatcatcaatcattcaatcagtgaatgtattttcttaaataaaataattcttgttcctaagaactgaaatgtattttgctcacatgtcttcataaggtgcacatgatttgaatcgggaataatttgcttagcaacccccttcagtacaagctgagacatcatgctgccagttcagtattaacagttctaaacggtgccacgtcagtgtggcaaaagcttggagccttataaggaacgtacttaattcaaaataaaatcgattaactttttttatactttgtattcctcaaataatttcaatatggaaattaggtaaagtaaatattgtcaagaattttagtcagacagaaagtaattaccataaagcttaataaaatatcagatattaagcaatgttatttcctgatgaatcctctgaaatgagctgttgatgaaagataaccactgggtaacaaataagacaattttgcaaatggctgttatcaaataactggttaaatattaagcaatgcatattctaaataagaatttgggtttgtgttttggaatacttaatctttagctatttaatccatggtaaactaaaacaaggtcctgtttctatttcggctactcataggattatcttcgtagtggcagaagctgatgggaaatatgcacctgggtaatgagagtgatgcatcataattaaatgaattaaagttaaaagagggctaaaacacattttagtgttacccatttggagtatattacttacaatactgtttctttaattcttaccctgacttctgtgttagtactggggtaggttgtacataatcattggcaatttatagctggagatctcagttgatgggagtagaactagcagtggcttcagggtagggaaatggagagatgatcaaaagatacaaactttcagttgtaagatgagcacattctgaggatctaatatacagcatgaatggtgagggatgtgttaattaatttgtggctatcactgcacaatatgtacgtatatcaaatcattaccttttttttaccttgactatattcaatcttatttatcaattaaatattttaaaattcataaagttaaaaataggttgatggaaaggaaaattgaatgcctataatgagccagtctctttttgtaaaccctctcaacttaatcctcacaataactctgagagaaaattgcaccttaatgattcattcaaaataaagaaactacaaattaatatcaaaagagagcaggcattttaaagataggcatatccaagttagaattccagctctgcccacagttgctttcaacaaatgatatttctgagctcagtttcctcatttgtaaaatgacaataattatgtctgtctcaaaatataatcctatctaaatgagtgacatgcaaagttctattctcagttgcccaaaatagggtaagagcccagtacaagttggttaccattcttgaaattttagacagttttaattccttgttaaagacgttgtcccattattggttattttttgtagaccctagtttcttaatgttttatcattattataaattattttaaaatgtgctttctgatttaaatgttattatctaaattttatgtaacattttaagtgataatttactagtactaaatattcaaaaatcaaataggacactttgcttataataggtggtatatttctttgtgttaaaaccagtgcatttaccataaaaaagaatgagttcatgttctttgcagggacatggatgaagctgaaaaccattattcttagcaaacttaacacaggaacagaaaaccaaacaccacatgttctcacttataagtgggagctgaacaatgagaacacgtggacacacgcaggggaacatcacacaccagggcctgtcagtgggttgggggcaagaggagggagagaattaggacaaatacctaatgcattcagggcttaaaacctagatgacgggttgataggtgcagcaaaccaccatggcacatgtgtgcctatgtaacaaacctgcaccttctgcacatgtatccctgaacttaaagtataataaatataaaaaaaatttaaaaaaaccaatgcatttaaatgcatgaactttttttctggttgttagtcaaatgtccaaattgccatagcatatttaaaatagaaatttatttgaaaaagaataaatttctattttaaataccttaaaaattattaaccattaatattaaccattaatcattaatactcaaagagaaattatggctgttactttgtattaaggttgatatttacaatttgcagaagagtttttaaattaaattaaaaatatatcttacttatttaatgtttttggataaaaagaatgtaatggtcatttggatgatagaatgaagatattttatgttgttttggttatttatttagtatattagatctgaaaacacctagggcagtgtctcttggtatatatccaaaggaaaatggggaagtaatggcccaatgatatcaatgaggaattaattgcgtagttgctaaattattttgagtttgatgaacaagcaatataaaaattctgcagtgagttaggaactcctcctgtgcctattaattagggagataatttttgttattaatttttaatgaataatagtacagcagagcagagatgaaaccctagtggttttcctaatacgaatggtaatgtacagagaattgcaacaacattcacacagggaaaattatagaaatcaactataaatttctacaagctctgatgtgtcttggtcagaaaaagtgtgtctaaagtatttttaatctgattatataaaactaagaaacatacagcacttaatttttgaagtataacataatggttaaaaatatggatgctggctctggaattagacaaatctcaaccaccagccaggctatgtaaacttgagcaagttatttaatcttttgcagcttttcttcttcatctgaaaatgggcgcgatgatgtatctacctcataaatttgatggagaaacaataagttaaagctttgtagaatatgcaatctcatgtccagcatatatatttttaagaactactgctaataccattttaaaaatatgcatgtaaaatgtgatatacctgtatgtaggccaatcagcatctgattctgacagatttagtgatctttccagtctctattagtggaaaatcttaacatttttaaatatagaatttctcaaattttaagtatagaatgccacagcacatgcaactaatttttatcatttatttctaagcttataaaattatagcactaaataaaataatgggataataaataatatttattgagtctaggtgccaatttatgaggtaaataacatcactttctcatttgagaaagttggagctttgagtgataaagcattataggaataaatatcccagctagactcaaacatggtatttctgactctgaggctctgtaattagccattttgattctgttgactaataaaattaattcatgtaaaatgttaaaatcacatgttcactgaagcatttgttttaaactgaccttctgttctaatagctttttaagttatgggcatcacttaatatatatttgtctttgacttcacctaagaagttggaattaactatgtttatttattgaagcatatacattgtgctgaccactggcctgggcactttgttgtttcaggttttgctttagttttaagctataatttctaagcattttggattatctaatttaatcctcacagcaattctcagaaagtgttatcattctctcttcatagatgaaggaagagaaacccagaagagcactgttatttgtgcatgattacagagctattcttgggtttcaattatgcctatgtggctttgatacccacttactgtttccactataaaagctctcaatgatgtttagttactagaaggagcagttataatagcgtttccaaattttctattacactacaattttgataacactttagtgaggatgaaattgtgatctcagttgtcactttgtgtgtttcatcagcagatcctattactctgtatttctacttcaaaagggatacaatacctgttatctgcttggttgccattagatggcaatcttgttcttctaacgatgatagtaatcctgtcatacatttgtattcagctttatagtttacaagctatttcaaatatgttatctcatcaaattatcacagtaacactctgaaatagatgttaatatacatcaagtacagtggagggagcaaatactctggttaaagaacttattcagccagtattaacctagatcttaacattaaatggcagtttcttttaactgtttttctagaccttgatgcttctaattttatgtacagttctaatatacttggttatatgttttccaaggcactgaaaatcataataacatcttagaagaggagagagaagaggagagagaagcagcagggaatgaagtattgctgtattacaatgtggcacaccattactttttaaaaactattattgtagttcttaatcatcaagaaaaaatacattctgcattattctgagatggagagctgtataattcactttggaaatatatctaaactcttatttattctttaatttattgaatgaaaataaaccctcagttcttcatatgctttaactatccaggaagtgtcattttataatgattccccatggcaaaaatgtgaatataccttaaactttttatatgttttttatgtttttccccatattctttccccaggttcttgcaaaagactacttagatataaggatagctgtgcgaaaggctttcctaattgtcgtacttgaaaaagcagtaatttatagtctactaattgagtatggggaccatgatattccttaaacacaagactatataattatcgataatacatttttagtgtagatatttcaaaatttaatattttttattagctgtttttgctcgaccaatttacaaattgaccaattgattaattcattagtttgatacattcttttacactcccattaaaaaatattgaacttattaattaaaatagtaacattcacctgggtgcactcttttcatactctgtgttaaatgatgtacttaagtgacagaataatgttctaactgggagagaattttagaagtagaagctcctcctacttcttctcctatgaatattaatagttttaaatgttttgttcagggtcacatagtttgcttgtaataaagagatgactcttaagtaagaaattgactagctccatgtagtaagatggcaattatttgatttttatggtagttgccaacagactaaatcatttgcatttcctgatttaaaagtgcttctgcctatctattttgcctttcagactttgctatatttttaagaggattgcttcagtgacaaagaaggcttttagatggaacagttttctaaatccaatcaacagtagctgaaaaatgtttatacatcctgacctaatttagtattaaataacaacaattttaatgaagtcatagtatttacttgtaacctgctattgtagcatttcctactgacataaactctcttctgctgcacaaaagggcagtcaatggcccaagttcattagaggatacagtcaaaagaaaagatgtatttcattcggcatggtttttctggtgcaattagaaaagaaaatatgtgtctcaatataaaatttcatggcctcttacaattatgtggtgacatctccatacaattgcttgaataatgccaggaacatcagctgtcactatcaaaatgaacaagtaattaagaaagcaaacgctggtctttcttctaaaggaatagaatatttatgtatttaaagttgttcaccaacaagaaaaataaccactgacatgaaacataatttcctatcgtgcctgaggcagaaaagagaaataataatgaagattcacacaattacaacaaattaggttgcaattgtgcatactaaaaacaattatagactttctattcatcaggtcatatgatagcatcttatctcttttatttattttctgatactctatcttattaatcacattttctaaaagcttatgatggaattgggaaactcttactcttatcaagaccacattttctgtacccttacatcataacgtgctagcataacctaaagtaggctaagccttgtctggatagtagaatgatagtagatctgattgaagccataatagtgttaaatgctggctcttcaaccttttgataagacagtgttcagtttattgtttactgaggtaagggaaaaacgctaccttgactgaattctggtagttttctgtagaggaaagtacaagataggatttactgagagtatgaatgtggtttaaggcagatgtttcaattgaagggtttgtttgaattggataaaaataatgatttttttatccttatatctatgtagtcttttgcaagaacctggggaaagaatatggggaaaaacataaaaagcatataaaaagtttagagttgtaggattggcggaaacagtgaggggaggattttaacatgaagaatttaatgactcttaggggttgaactctctgttgatgctttttattgaaaaattggtgggtctttggggacagtcagtggtgtaaaatgttttggaattgttagggtacaccaaaaagacaataaaataggaaagtgatgttaaagtagacagtctgctgtttgtgggttggtggttttgggcctcagtctccctactgagggagggagaaggatagaacatttttaactaaaggcataatcaatccagattttcactaatgtttgaggtgttacaatcacatatcagatttctagggctcattatctcaaatgtccatgaaagtcagttttttcctcttgaatgacctttttctttgttggagaacttgacagggcagcagatgtgcaaagtcatttaagactctggaaatcacatctctgaacacaacaacacaaatagaaggattattatcagggtttgtgtccactccttggccagtggccaagagtgctcaattcaacaacggaataaatttcatccctattctgaagagcccatagaaccagacacatgatcctccagcactttgggaggctaggctggaaaattgcttgagcctaggagttcaagactagcctagacaatatagagagaccctcatctttacaaaacataaaagaaattatccaagcatggtggcatgcacctgtagtcccagccagttgggaggctggggtgggaggatcgcttacacccaggaagttgaggctgctgtgagtcatgattgcaccactgcactccagcctgggcaacagagtgagtctctctctctctctctttctataagatcaatgtcaagtcatagagaccctgtttcgaaaacagaaaaaaaaacaccaaacgaacaaacaaaaaaacaccagatatgggattcttaaccaaattacctaattttctgctatgtttatttttaggcaggcgactttgggtaacattacagaagcatcttcaggctgtgtctcaaatggatattcgggataaggtttagatggaaagaaatctctcatgaactaaaatattttcaaactttgtcccaagtgcagtacactctcaacagcctcaaaatgacagggtaaacaggagcattactgagagatggattaaatcagcttatcgttgtaaattcttccatattcgataatgatgacttgggaagtctcttttgttttctccttgtgagattttgtctacttattgaacatcagtatatgcactgaaagatctagtttttttcacatatcttggcatcaatagtaacttgggcctgctcccatatgtagagcattcatagatcagaaaataattaaaatatatattatttggtgtaaataatgataaaaatattgaatgaaaatggaaataaaaattatcaattttaccaggtggttctttttatttatttatttatatttatttattttgagatggagtcttgctctattgccaggctagagtgcagtggcgtcatctcggctcactgcaaccttcacctcctgggttcaaacgattcccctgcctcagcctcctgagtagctgggactacaggcgcgtgccaccatgcccgaataattttttgtagtttagtagagacagggtttcaccatgttggccaggatggtctcaatctcctgatgtcgtgatctgcctgccttggcctcccaaagtgcggggaatacaggtgtgagccaccgcttctggctccaccaggtgattcattttctttttttattaacctccgcctcctgagtttaagtgattcttctgcctcagccccctgagtagctgggattacaggcaagagccactatgcccggctaacttgtttgtatttttagtagagacgggattttaccatgttgcccaggctggtcttgaactcctaacctcaggtgatccgcctgcatcggcttcccaaagtgctgggattacaggcgtgagccactgcaccaggcctaggtggttcttttttaataacacattttaatgaatgaaatattgggctgggcgtggtggctcacgcctgtaatcccagcactttgggaggtcaaggtgggcggatcaccgggtcaggagatcgaaaccatggtgaaaccttgtctctactaaaaatacaaaaaattagctgggcacagtggcgggcgcctgtagtaccagctactcgggaggctgaggcaggagaatggcgtgaacccgggaggctgaggttgcagtgagcagagattgcgccactgcgctccagcctgggtgacagagcaagtctctgtctcaaaaaaaaaaaaaagaaaaattcacagtattttattttttacatctatgatattgatgtgttaataaggtgttttagcattgattagcaacttttttttctttaaagaggtacataaaatgtgcgtcttgcaagtaatgctgtcttagttccaaaaatatattttagataagaaatacaggaatctgaaaaatccataggggtgatttattaattcatgtatcattgccttcagatcttgtccatataaagaattgtgaacagcctccatttctcattatacatccttaatagaatcatgtttgcttttttgttttattttcaaaggtaaaatatgtatcatcctcagtataccgctaactataatactcatatttctttacatgcatacatgaattatatggcaaactttattgttttatgcctatagatgcatttatatatgtagattttgtccaatccctacttactatgatcttcactattctcacatataagatactacacttgagagaagctttgattactaagaattacattactcatagtctacatttttatacccctgtgaaactagaagaagccagcttcaaccatcccttagaatgattgtctccaaagtctacttccagttcagtcctctttcctgatgtgcacatacatgtatttcatggcctgctagcaattttatcggatgtcaattatatgcatcagatttaacagatccaagattaactttattcttcctgcccataactttgtttttgcttcatatttatttcctcttttgtgaatagcaccaacatcagtgctgacttcaaaatttgaaaccaggtgtcactagttttaacggattctactttttacctgttcttaattctcacatttctttttataatttttgttttagtctttattcaggccatcgttttcctctaactaactttatgtgatccagttggtcttttacggcccttggtctggcatcagtgtccattagtgccatctttgttgttttttgttttgttttgtttcttcctctcattcttcatacagaactcagagcccctctcagattttatcttttaacccactctataaaaactttctatcatataaacactttcatgattagtatttatttcattttagattttggagtgatagggaggaatcacctggtgcaggtaagagcacagcagttgaaaatgcatgaaggagagagagagagagagaggaagagagagacagagagtattcaagagtttcattttgttatctcttctggactttactcagtttcttccttgtagccatgttcttttccaaattttgagcactttgaattcttgcttttcttaattcaagcaatgtacatctatagtcaactttcagagctaagtgtagactgactcaatgagcccaaaggcacagtctccgccatcaaaaatagcttagcagagaattttctcaacaaaagcaggtctttcccaaatggattttcataacagctgccagagtaataatctagcctctatctccagtttgacctcttatcatccattctctgtattgtccacaaggtgtgctgacccaccaaactgatcttgatcattaacctatttaaaagtcaatattacccattactttcattataaaatctgattttgttggcagagcttacaaagttctcaagcttcaacaccaccactttttctacacactaaacttgacttccagcaaatatttattgaagatttactgtaggccctaggattctagtaacaaataaagctgtgcagcatacagtctaatggaagattctattttttttaaaaaaaaaacgttaatgaagaaaagagcagtatgcaggacatagcagttttggtggtaagaaaagacatcctagagaagtgacgtttttccatgaaggataagtgggtattgataaagtggcatggtgccagagatggtttagaaacttggaactcttcgtggaaagtgcgatacatggtaggacttcacagaggcccaacattccttggcagagtagggagtcagtggcatcagatgaatgacgaatgcagcacattctttctcatctataaaatatttcaagtgctgatttcttaccctgaaatgatctctcttcatttacagttatatcactattcaactaacaaaatagagctgatactcattgatttatttgaagtattaatatttgtccatgaggaagaaagtataatactaggcaatgatgatcagggctaaaataatgtattatattcaggggaaagagatatttctgtgggccgcattaggtgggataggccttagaaggggttgtacttgaactatagtttaataaattgcaatagaggttgggggagtggtgacatattttatgagcaggaatcaatatagggaaaagactgaaggaaaaattccccaagtgtagctgaaaaacaatagaaggtggtaccaacctttaaaagccgagatttcttaggaatcatgtataaaaatttaaatttcataattctttgtctgttttttcttaaatagaaacaaaatacagctttgtttataacttgtgatatgaaataaaatactgagtatgtaaatatttgaataattaaagagtttgttcttcacaattatatgactctattctctatatcagtaaaagccatcatcaagttattaaacagaagtgatagctctatgaattgggagctggcaatatgcttttctaaataatgctctactttatttctactagaataggcttcaagttgttctgaaccattttctcaatgaaaatactgaacaaaacttctagatgattcttctaaaaagtctttaaaaatgtgtgtttataggataagaaaatgatatatctgcaggaaatgaaaataaatgttaaataggaatccttaaaagtaaatacttatcaaagacagcttcctttctaaccagatagtagccaatttataaacgtttagagacaattttgtgtgtctaatagccaaaactgtattcatgtgtttttccctagtggaaactaatatagatagttttcctagctcagtcacttagttcttccaggaatttttggtttgatttgtaactaacattggagaattcggacaaaaattattaaattatgttaaaaaataatagtttaggaaaagaagagacattagatatatttcttgtcttacactctttatatgaggaaattaaaatcatgttactgatggtacatcactaagtaccatctaactggcaaataacagaatataaaatggaaggatttgaaggaatcttttgtttatatgtttttaaaaaattaataaatattataaatataaaaattagtaaaagctttgttaagtgattatgactaaaagtaatatactacaaggcccttctatggcactgtttaagaaatttgtcattcactatctaattgttgttgtcaaaagctatagtgattattttcatgaaacatcatggaacaatcagtggaaagaagagtacagttttaatgtagttttatgcaagcgtatttctttagcacctctatgatctttagagaatatgcacatgatcaaatgtagatctaaaattccacgtgtattttaaattttattttaattatattcagtaatatatatttatatgtgctaattttgaacttaaaggcatgatgaaatttttattctagaataaagcaaaactatactcttaatgattagaatgcaatgttattcagccctattttgtaatctagcttttattatagccatcaggaacagaaactcatttctgtaagcagcatacctatggttttgttatattagctggatcttttattattgatgggtcctgcttgacacattttgtagataatatgcccataggttctgaatcaaacaagtgttatagattgatgtgctaatctaagttttatcttttctttttctattttcagtagtcctcaggaaaccaatatatctgctaaaagtataaaagctttagcctattatgaaaaatgcagatttgttttattatgcagaattttaaagctgaatctgtcctttttattttcctccttctacattaccatctttccctgacctttctctttttccctctccaacaacatcaacaaaaagaaagaaagaaagaaatactttgatgcatttaataagtaacagaattctgtaggaaaatacatacagttagaccttgaactactcagggttgccaaacccccatgcagctagaaatccatgtataacttctgactcccccaaaacttaactcttaatagcctgttgttgattggaagattaatgataacatgaacagtcaactaacatgtatttggtatgttaagtgtattatatgctgtattcttataataaagtaggatagagaaaataaaatgttaaagacaattaaaaggaagataaaatgtatttaatattcattaagtagaagtggatcatcataaaagtctttgttctttcatctccatattcagtaggccaaggaggagaaggaagagaagggattgttcttgctgtcttattgggtgcaagaaatttctcttataagtgaaaccacgcagctgaaacccctgttgttccagagtgaactgtatttatttttgataaagtaaaatattaagtaaacattatgaacatcagaatgtctaaattggcaagattatcaaaaacaaggaaagtctgagaaactgtcacagccaagaggagcctaaggagatatgacaactgaatataatgtggtatactggctgacatcctggaatagcagagggatattaggtaaaaactttggaagtctgaacaaaatatgacctttagttaataataatgtgtcagtatttttgttctttgaaacaaatgtatcacactattgcaagatgttaatatggtaacatttgtgtatttgtgtgtgttggggggtattatataggaaccgtcagtactatcagctcgcttattttgtaaattcaaagtagttttaaaaaaataaagtctattaatgtaaagaaaataataatgcttaaaaattatttgcttagtgttcactttcaaaattagggtcaaatgtgaagtattgatgaaaaaaagatgtagccacattgccattgtagaagtcctcacattattgtaacgacacagagccattggttatataaaaagctgtttggatggcacagtctgttggcaatccatcagaagatagtcatttgaattagtaaactatctgcacatgtgaaatttgaggaatttccgcatgtaatgtttataagcatgcataatatgaaatttaaaggattaagggtgtaagtctttacaattcaggaaaacctactattatagcttatttattttatttccaagcattatagaacaatataggaaaagagtttgtgatagcaactggcatttgaaaaatattgtcagaaaactgtaaattgttacaaactgaacttggtgacagtgttacggacaagaattagttgagactatattttaagtgacataagcagacaaagacttatagttcagaaaatatagagtggacaattattctgaccataaaaatcaacaatatatcatgttgataaagattatgtggcttgtcaaaatttaagtaacaagattttccttagtctggtaaatgtataatttgaatggtttgtatattcgttttccattttcaattgtttagttagagtgaaggtagtagagattgggataaataaatttcatcattttaaaaattttgtttcatatttcacataatttcagcagacactatgtgttgaggaaagatctttactaagtctcacatataattcttaaaatgaaacaaacctgatgttcgtagaatatacaggtagactttaagtccgctcaaaaatctaactctactctccagtgaagtaaatgaacaaacagaggaagaaatacctagtacactctcaaagaggctttcaattgcattttcttctttgtataaattgatgacattacagttacaatttgtacttattttatccaataactgaatttttgataagttatgcaagtgaatatttatgtatcatgttatagctaacatttgaatttctatttcagatttattctcactaaggaataacatctttccaactacactaaaaagtgaaatgtaaaaagagggcaaaactcactgtgacaatgtcaaaattcattttcaaggagatttcagtctttgtaaatgtggagtcagtatgcattgaaatttccaatacaagctctgagtgaaattcattaaaagggaaatcaatccatattgtcttagtactctttaaagcatatgtaaaataaaatatattgcatagcgaattctaattttattgacacttcttactgcctctcagggatttaaatgtttaaatattttagcagccacactggttaatgtttcaggaatgtcagtgcttcaaaagtataacaaaactttactgctgtgaaaaccatacagcaaactttttttcaagttttttttctaataggaaaatatgtgggttctgctagtaaataatctcacttttgtaaaagaaaagatagaaaaaagttgacaacagattgcaagtagaaataacaaaataggactaatgaaatttgttttaattttagggaattatatttatggactgttaactatctttctgtaatgctggcttaaaaaggcatatgctcaaattttaataatttaaatttttagtaggggagtgattggtgatgtttggtgtaacatttttaaaatgaagaacagaaccctttgagctaatttttctcatgctgaacacaaattttttaaaaggtaaatggatggcctgtttttagtttcacaggagcctggttttgttaaggtgattgaaagattcatgtttcattttagatcctcacttggcccaaaggaagtaatgtttgttaatataagttaatatggctctatctttatttagacagatataatggaggaatgttaatttaaaggtggagacaaagagcactgtcattacaacatagaaacacagatctcctaacagctcagtatggagaaaagttagcctttacttgaaatctcagctgttagtgaagttaaagttatattgtgttgtctagctctgtagaggaattagtatggctagaaagagtgtgtaaaataaagccacatgattcatctttagaataccttttataaatccaggaaaattccacaaatgcctgccttttataagaatagtacaccagagagtcttagtgtggggaaagtctcctgttactgatagttcaagaaataataaagtaatgaagtcctatgtcagcttcctactcactgtttcttacgatgcttattgttttaaaacccagcaattttacaactaaatggagataaaatttagaaatctttctgtagctaggagagtgtgtaagaaataaaatagtattgacttgttgctttttattagtgtagccctaacgttcactcagtatttgtatatcttccaacttaatttcatgtagcattgttgggttaggggatgcccctgtatcagcacttatcctctagttgaaataaagagcatatgctctttaaagagtaactttaataaatcggtagtgaatgtttatggctgacaaatgaccattcccacctcctcaaatttgcatttgtcatcagtccttccactagccttggacagctgaatacagttgttctcccatttggtcctctgtccatggacactaatgctggcaaactctggatttcttggaatatgtcactggtcattggtgactctgctgcacggcagtccaccttctttaatttttaaccccctagatctccccatgggtctagaaatcttgggtagtgccagagaataaatgtgttctggcacatagtcctgaaaaatactgttttgaaaggatcaataaataaaatttgagttattacatgatagagtcattatgcaaagtcttagtaactataaccttaaaaataatgacataatacttatggtagtaatcttcttatttcataaaataaagtcttaatcagaggcagttgtcaaaaaaatttgctatttgttgttcaaaaaaatgagagatgggcttagcttttgctgtgcagtcacctgcatgtatggttttctgtctgggataaatgaatcaggctcttatgtcagccacaactctttgtgaactccagttctgacactaactttgtgaacataactagttacttaacgacattgtaatgttttttcttttcagtacaatgttcataacacatgcctgaatcataaaatatttcttcttttcttcttcctccaccttcttgttcttcttccccttgctccctcccttcttccttccttccttccttctttcctctctctctctctttctttctttctttctctctttctttattttcttttcttctgtttggagactgggtgttactgtgttgcccaggctggcctgaaaatcccacaatcaatcaatcctccccactcagtctccccagtagctgagactatgggtatgtgtcaccctgctgggcttaaataataagacagttctaagcattattttcaacaatgaacattaaaaaccaagacattcagcattgagtaaatactagttgttactccttcctcgaattcttaatttgatttctggggaagtatattcttctgtttttctgccttcctcaaaatctccctacctaggtacctcccatctccacgtttggtatgttttaaagctcagttcttagactttcttcctactttgcttatacctacaactttgatagtttcatcaaatctcctagctttaagtggtggtaaatcacaaagcctctaagtttctatctttatcccataaatttcccctgcactgcagacatatatgtatattaactatctacttgagatcttcacatggatgtttacgaggcctctgaaacatgtcccaaaccaaactcctgatttttgtgcattagcgccccacattttgctctttccattataattaatctcaacaactattaagtctattctttcagttgctaagtgttcgggccacccttgactcctcctttttaagttttacatgttctaatatcttgataaattctacaggctcttgtaatagggataaaattgctcattattgactaatctaccaaggggattgaatgacaattattaatttcttagacctatagttcttaaagtatggtcaagggactcttaagagtccccaagaccatttctaggaattcatgatgtcaaaactattttcataatgataccaagatattaaaaaccctaatgtttccttgtctttagcatgataatgacagcagtaccatcaaatcttagcatagtgactcacaccgagtatacattaaaatgtggactacacagcaagttaggtagcctgatttacaaagtcaggctctttactataatgctatagtctatcaaaaaataaaatatagcaatttatttaaaaatctgcttaatgtggaacctttgatggttttctatcttttcttctaataatatcataatttaaatcttttgcataaaattgcaccctaatttcttaggacagcacatataatggtatttttgaatgaatggatgttcataattttgatttcctggagatatatatatatatatatgcaaattgtaagacaagaggtttaaataaaattataggccaatagctgcatatgacaggaactattttaccatattctctttaggattgttatcatctttaagtttttaatatttttatagtttaaaagattatatattattcgaagttacaactttttccccacaattatggttgaaggttttttgtttctctttgtcagttttctcttttgaattttatttgtcttttatatctgtcatattgtccttaacagaattctagtttatccctagtgataacagattatgcatgagctttttcatttatttctcttcatatccattttttccttttaagttaagcaaaaataatttttgatattttattttcagatgaaaaatgtattgtaaatggttagataagaaaatagaacaatttactagtagcccctcatatttaaataattctaccctgccctgttttaaaatggcaagctgaatttttaacccttttctacctgtatgtattcttagacatagggaaatgtggccatcattttttccaggcttatagcctcacatggtggtaaaatttattgggagccacaacaattactaaaacccagcagaactgaagaacttcaaaaatataacatttgactttagttttaaatgataagaagcagtttgttgagctgagaaggaaatgaagcaccatattaaaggcagagagaacagcttgggtaaaaagcagaaacataaaagaccagagggtatttgggatacagcaagcagtttggtgtgatgagaaaggaagatgggagatgagcctgtgaagctagtggtggctgatttgaggaaccttgcattcaatactagagagtttttgctttatcttattagtagttggggatttggtaaagattttctatgtagggacagactatgatcaaacttgtagtttgaaggcattcataaaattttagcagcgtttagattattttacttgttaaatccttttccccacttcttttcgtcttgtcattttcatatcggacaacaatgtggttggtattggcctctgcgtgaatgtaaatggtacctagggagcctccagccatgtcaggatcatgagctttctcactgcttcttcttctttgttttgattttgttcttttaatacaagcaaaagtaatttttgacctttgattttaatatgataacacattaaaaacaagcaaatagtacagtttcctcagctttactaactcagatttcattactataaaaagacaaggaaaataataaatatatatgcgtgaagaataggaagaaagctaaatgtattaatgtttttgtcagaaaattttctgcagactttttaaagcttctgtttattgaataatagcttaaataaagatgttaaaaatatttgtaaatatttcatattgatattgggccattcaattcaaaattaatttacttcttagtaaaataaaaataaaagaaacagaagccctgtttctcctagagagggatctcatctcttaaaatatagatcctatgattatcatgtactgaggaagaaactaaatgaattaactccaatattgtgctccttctattgataaattctgtggaatgtttatctcttgagtaaaagaataatagagtaatagcattataatattctcgtaacttaccactaggctagtaaaaattattcctttggccttaattaagtttgaatctctgtaagaggttgggagacatttagtgatggcaaattaacagtgttttacttgtgctgatttatgtataccattaatgtggcagtattttaatttaactgttcttcacctaagctgtgtaatacatgactgcctcaggtaatgatacgtaaaatttcaatgagtattaaggtttattccagggcagcagataatagagactagtatgtttgaagtatttcttgttggtgaatacttcaaaaaaatcttagattttttttttcaatctatatatgttagatattaaattgtttatggactataaaccaatcaaacacaagggctattttaatttttaccttgcttaattttaactgctttatttcatttaaatggcgtataatgttcccaacttgtttaagtcaaaatgcaaaaatgttaatattcatgatattataaattactagaaaattatgtttcacttacatataagatagcttgacacagataaaaattaaacttgaattaaagcacataacagaaaaaataatagcaatctttacaaattagggttgtgtttttacttaggtatactagcataatcagttatatttaagtgagagatcatgtcttgattaatggtgttattaatcatgaataagcaaatatgtctttttctggaacttaatttgggttgtcttttaagaaaatctaacaaacaaaattctaaataaaatttagatgcttataaatttgttgtgtgaactttcagcagaaaactaagttcaactcaaaatagaaaacagaactgtacacagcttagcagtgatgtaaatattgtgaatgcaaggtgcaaggcacatttgaaaataccgcttgtatttcaaacctcaaagcagagcaataataaaagcttacagctagaaggaaattaaaaatcatctaaattttagttttcagtgtattaagtgaagaaattgagacttaaagttatataagcagttaaactcagatatgtttataagaatccgattttcttttagtctactatgtttatatcacaaaaaattgattcatctgacacaattatatacacatctatagaatgatgtaagagtatatgacatataattatgcatatatgcatattagtaatatatgtacacatatatgtattatattagcatttgtaatcatggagaatattagttccttttttttttttttgagacggagtctcactctgtcgcccaggctggagtgcagtggcgcaatctcagctcactgcaagctcttcctcccgggttcacgccattctcctgcctcagcctcccgagtagctgggactacagcctcccgagtgctggcacccgccaccacgcctggctaatttttttgtatttttagtagagttagggtttcaccgtgttagccaggatggtctcaatctcctgaccttgtgatccacctgcctcagcctcccaaagtgctgggatttcaggcgtgagccaccgcccccggacgagaatattatttcataaagatgaatacccttaaaattagaaacaggaagagaaacaagtactcatttttattttatgttagatttgaagatttaatttataattaaaacacacacgcacacatgcacacatacgcacacatgcacacatgcgcgcgcacacacacacatatatatatacacacagatataggtgttttagtgtacatatataatctatagtgaacaatatatttttatttagatacatgtttttatcttttgagtgataattgtcattgctaaatgtagacagagataatatgatgagataggaatacaaatagtggaagcaaaaaacttaaatttagatttccctttttacttactagttggatgtctttaaaaattgattaatatctctgaatccattttgctttcttttctgtataatgaggataagaaaacaaaatttcctggttttgggaaggttccagataatgcatataatgtggtcagcatagtcatttcatgttgtttggttggtacctaccagaacataccagaacatagcagagagacatcccagaacactgaggcaagcaacctcttcatttgtatctcatcatagtagttccaatgtactaatatgattcaaacctgaaaaattatgatatactgactacttgggtacataattactagaaatgaaattatattaataatattagtatacatgaaatgatccttgagaactgaatagccagaggtgatttcatgtttattctttttggctaattatgatctgagtttttatcaacaatagttaaaaatatggactttgagataagagaggcttggtttaaagtgctgggtttaccacttagtagctgtgtgaacattttatctacatctccacagttctgtaaaatgcaataataataatatttttctgataaagttattgtgaaattaaagaaatagcacattgaaaaagcttattgctatacttgatacagaaaagtcaatacatttcaggtgttatatcattgatgttattactaaggcagtggcattttttgtttctcttaagaaaccagacttgatctttgcacaactttagaagtataaatcttatggttaacaatatagatagcaatgcttttggggcaagatatataaattaagagattcattgctattaatagggtaaaacaattaatggagtaattttattttaagggtcatcacattttgactaagatcctttcaaaggctaattcattcattattttatagtttcacttgtgttcttatgctgccaaatattggtgaatttctgtatactataagagaacaggattataaataacattgttaaggtgatttaccaaaaaaacaaaacaaaacaaaacctgattagtactatagtagggcaataatgaaaagagacaaatttagaaaaagtaaaggaaatgctaaatcatgcacttagacaacatacttgtgaaactgttttactgacataatcataaagtctaatctaaaaaatgtagatacatacatacacaaagatttattgaaggaaaacaggatatgtcatggtagatcagcatccttgacattaatcaaaactgatgatgtcattaaagaatttatagattcttttgatatcttctatctatctatctatctatctatctatctatctactttctgtcagagaacttgattgccctttgattctgaatcattagaaaaattacattcttatttggcacagtgcagatagtgaaataattaattgatctatataagcatattggaaatgagaaacagcactttttatactatttgtgattttttaaaactggcatgctattatgctattattcatttttttaaaaagccttggctgggcacggtggctcacacctgtaatcccagcactttgggaggctgaggcaggtagatcacgaggtcaggagtttgagacaggcttgaccaagatggtgaaaccccgtcactaataaaaaatacgaaaattagtcagtcgtgggcacctgtggtcccagctactcgggagtgctgaggcaggagagtcactggagcccgggaggcggaggttgtagtgagctgagatcacaccactgcactctagcccgtgtgacagagcaagattccttctccaaaaggaaaacaaaacaaaacaaaaacaaacaaacaaaaaaaaccagccttagtagtaaacacacgcatttctaattttatttctatatcatttaggttattgttgttataaactttgaaagaatatatcttaaaatactatttttagtaactataaaacattcttttaactcatttgcaaaagactatacttctaatatatccctaccctaatctttgttgattggagttagaaatcagtttattctgagtctcattctgctctctgccaaggcttttccaaattgtccccttagatattttgcttctatatatcctaattctggcttaaagacatttactgaaaaaagtacaggacaaactggagtaacttctgcttcagtatttacctctgcttgctatctaatatagaagaatctatccctaaagtcttcaatagactaatcctttctttgcttgctggactggattagagtgcagtttgtgttcacaggaatgagtttggggatagcctccaaaacatcttctttcagagtccagatgttctaaaccttttactttttgttctatgcaacttggagtattttatgtcaccctcaagatcttttttatttgttaaaacaattatttttcttttcctgagtgtatagcctatgaaacaattgatatagacccaggagtactggattatatcttcctagtaatgttttgttattttatttttttttttagacagaatcttgctttgtcacctaggctggatggagtacagtggcgtgatcatagctcactgcagccttgagctcctgggctcaagtaatcatcccacctcaacctcctgagtagctggggctacagtagtgtgccactatgcctggctagttttttttactttttgtagagacagcatcttggttagttgcccaggctggtcttaaatgcctgggctcaaggaatcctcctgtctccacttcccaaaatattggggttacagttatgagccactgcatccagtccataggaatattttaaatttctgtgtaaacatgtttctattctgtctaactaaataaaagacaaagagagactctctaaaagccaatgatacttattcaggaatggacactgacatgagaaacgtatgccatagtaagctgtgtatgtattcagggaggtaaagaaaggcaatggcttaggaggattacataattgttttgagataattatccttggctacaagaatcaatagcaaacataactccagtcaaaggttggacaggcagttggtgggcaaatgttcttgcagaattattgttttgtgtaagggtagggtaggctttgtgcagtgctgtgggttttgcagttttttgtgacagttctttttattacctatttgtgcatgagaactcttccttgacgactttccccagctcagtttatcaagatttttaacacaagcgactcatgtttattttgagtttaaatattttaaatttctctgtgaatatctttctattctgtctgagcttcagaaagtcttaaataatcgctcttagctcataacaagaccagggcttaaaatttaagttccttaaaagaagacacttgccctattctcagagagctttaactttaagagccaatttagcttcgaggattttcttctgactagaaaaaaaaaagatagtagggttagaaaagatagcagtgcaaggtaatgaatgcacaagggacgagggaagacaaacaatggcataaaggccattagttagatttaagtggtgttttgggaggatctgaaagagatggtttgaaatttttcaacttagccaagcaatcctttaagaagataattttagaatcagagtttcttttggcggcttcctcacgcaagaaaatctagacacctgaatacttggaattttcctctctctgcttgtgttaaacttccccaaagttgcctatattattgtcgtttttagttcatcttgccataacaaaatagcatagactaagtggcctaaacaatagatatttattttctcacaattctgaagattagaattttaagatcaaggtgccagcatggtccattgctgctaaaggctgtcttcctggcttgtagatggccacctttttgctgtgtcttcatatggtgggggaaagaaagaacaatctctctggggtcttttttttaagggcactaattccaccataagagccccaactttgtgaccttgtctacacctgattatcttccaagagccctgtgtccaaataccatcacattgggggttaacacttcaacataagaatttgggggtggtgacacgattcagtctatagcaattatctgtgttgctactatgccatttagaatgatagcacttgaattgacttatagtgtgaatgtattgcatgtaagagacaaacgtgggagggtccacaagtacctcgtgtctgtgctcctgaacataatagttggctgtgtttaatagaaaacacaagaaataactaatctctgatggatgaatgattatagatgtgatatatctacaattaaactgttctgaataaaggaagactagctaaggaaagttctcataagttttggatagttgccctaaggcaaagtttgtcctgtatgactgttatttaacaagacaatttacttgttagtcctgtgggatggcacacatttcagtcctgtggaacctctgtctactctcggccctatgaactaatctctatattactcacaaaagaaaaagatgaacacaatcaagaagaacagcagtttttttttagtaacaaggcagatttccaccaaaggggagtcttaaattctgatcagacaatcaaaagttctcacaacgaggggggtcatcattcttaagagctaaaataaattggaaactcaacaaaaaaatgagacatcagacttaatacaggatctccctcactgtcacagtcagagaaacccctgaggaggcctgatgtggcctcaggagaactccctgcttacaagttgagggcactaatccatggcaatcaatgacttttactggtgaactctaggattgtctacggtccccaaggaccaccagaaaaacctattgatcaagtaaagctcaatttattaaacttacggcaacagggaaaactctagttccacagagttttcagagtgcctcaagaggagaagttgaggaaagagatttataaatttgagtatctgggatcaaatggtattaagtgttttggagaaaattgagttaaattggagaacttgattaggttgtgggaattttgtcatctaatagttaagaattggtagacacaggaaagcaagaattgaggcaagttttgacgatgtgctgataagtgagcccttggttcatgtaaacaaatagttctcctgataagtaatctgttagcccatataaaatcagtgtttacccagaaatatttaacatatctttccagaagcaaacagtgaattatttattggcaagtaattttatcctcctgggagggaattactgggagaggattatgctgacagagagagtgccggtccttggtctagttaagtggtattgctgcacaaggtctcagttcttacccaaatacagtaatagccccttatcctcagggatacattctaagacccccagtggatgtaagtcccccagtagatgtctgaaaatgctgatagttccaaccctatataaaccatattttttcctaggcatccatgtctatgataatgtttaacttaattaggcacagtaagagattaacaacaacaataataaaatagaaaagttataacaatataagattcacttttatggagagaagattagttctttccatggatcttaggaacctcagcatatgattttttttgtttccttagtaagtcaagaaagttcaccttttcacttaaagggagcactttacagcttctctttggtatatctgaatttccagcatcattattcttctgcattggggccattattaagtaaaataagggttatttgaacagaagcactgagatactaccacagtcagttaggtaactaagatgtttactaagtgactaatgggcaggtagtatagacaaggtagatacactgaacaaagggaagactcacatcctgggtgggacagagcaggacagcaggaaatttcatcatgctactcagaatggggttatttctggaattttacatttaatatttttggactgtggttgaatgtgagtaactgaaaatgcggaaagcaaagccatggataagggggactactgcataagagtagaacatgtgggattacttgtttgctaaaggataaaatatattttatatttttcattggcttcatttctattataagcatataaaatatgatttttcatacattaataaagattgaagtcattaagcgagagcaattcatccaaaattacttattcaaaaccaaatatactagatgctgttttagcccctgccttcatgaggtttaaatttcagaaaacagaggaggttattggtactttataatgaatgcacgcatatacatatagtttatataaacatagaatacagtaatacagacacatataaatataatctttgggaagattaaacttcattctaatgactttttagagtatgcatgctggtaatataattaaatattatgtagggtgtagaatttgtgaatttgtgttttgggacaactgttggttggctggccttgagggggaatggggtaaagaatactataaagttattaacagagaaaatactcaattgcttcctagaatgtgtggaatttcctgcttccttttatcttttgagattcagaagtggtatggaattattttggcacaccgaggtaaaataagttactttaaaagccaggatcaatccataacacgatatagtactatggccagagagagcattcttcatgctttaataatgtcttactgccattctttgttctttttcaatatgtcaaagaaagaagataagtaagggggaagctagaatgcacccacacgtttgaagcattgaccctgtgccacctccataacaattttacaaagttgtcatttttctcatagctatttttagttggtttcataactatttatagttggtttttgccaacttgtcaaaaatgtcatgtttcaaatttcttcagcgtatttagcatccagtatatgataaggatgcattttggtttctgtttgttaatatttacacttcccatggtaaatgacaatactgcagttactgtgatgtcatattctatgatggcaggttagtattattaaggacatttgctgataataatatatctcattttattttctcttgtcacacattttgccatcaataattcaagacagaaatagtctgtatatcaaaatttgaatattagaaactcatgttttatgtacatatagtatttcgacaatacctttattaaaagggtgaaaaattacgggcaactataatttctcaaccaacttttaactgaaaataagaacacatgtcccttaaagtctcatttctgatgtttaacaaacataatttacagtgaacgcatgacatttattatattggaatctaatataacagttccaaaatggtatttactgacacttgttattcatcgtgaagctgatcactgactagtagtcatcacagataaacatcttccctcaattaaaaaaaaacagttacagattagtcattcatgtaactttatatagaaaaagcattagaaagacttgggttccttgccttgaaggagcaagcctggagaaggaactgttaggtcttcaacttcaggatatacattataactcattgcatgccacacctcatgaaattggaactactcacattgttttcataccaagaatctggaacttcatggatctataacacattatttctcatgtcaaagaatttaaatattaaccagtcatattaaatatcgcttcaaagagtgatactttctctgggaagagatcaatagctttttggaaatggtatttcaacaaatacttaagtggaggtttgtgattgcagtgattatttcaagatctttgtggactgggagtcttccattcaacctggggtgtgaattaaattatgctcatgccttatttagatgtacgtgactgcttgatattgtagtgatgtaaaatgtagacataacttccataccattcaggaaagttagcggggcttgagaaaagggagtgttgtaatgcaggaaatgccattcttaagaatttaaaaatctgttagtaaagtatgaaaaattaatgtcctttcaagtaactaaccttttgaagagaggcctagaagaagttaagagaagttttatattgttgatgatgttatcattgtttttgttctcttcttccctattagatagcatgacattcctgtggtaatattgggttattacagttacatttgtcatatttgattgaatgcacagaatgttgctatatatcttgacttgattatgtatttctatatcattttatttaactcattgaactagcaacacatattactcaggattagcttctctggaaatttagcatttgtttatgaattgagaacattggtccaacaggatgaaataccaacaacttgtcttgctatttattgctctgaatatcttggccctattagcctatgcaattgtactccctgcttttcaccaaacacttcacatgaagtgggatagaaaagggcagagggaagaaaatttgtatttttggcaacttagaatctgttctatgatagaaagtggtgagcaaactaaaagcattagctccagtatatttgagttctttgtgttatttcaatcacccattaaaactgtacacttagcacatttctttttggtttgtaattaacatattaaaaatccagaagaatttgagctttggggagataattgaatattttatttaatttcttaaaagtgaggatggacattatgtagattatatgactgttcatcattttgcaaagtgaagcccattgaattactgtcagtattacacaactaaagactaatcaactatgtctcgtaacctgagagagattcttgatatagctaacattgttttttcaacaaagattaataattaatttgatacttattctttttattttggtcagcccaaaaggtagtgcaaggaaggagcagagaaaaggaagatgtaggggaaagagggaggagaagagatggaatgtgacttgtcataaaataatattggctagattatgtttcaagtaaaaggaaatctcttaaggaaaaatataaatacagttgacccttgaacaacatgggttggaactatgtgggtccacttgtgtacagattttcctcaatacaacttttgcggaatgtgccttcctttcctgcttccccttccaccttatccaccttatccatccttgagacagcaataccggcctctcctcttcctcttccttctcagcctacttaatgtgaagatgacgaggatgaagacttttatgatgatccacttccactcaatacattttctcttccttatgattttcttcttaacattttcttttctctagcttactatattgtaagaatacagcaataatgcatatgaaatacaaactgtgtgttgatctgctacttatattatcagtaaaacttcctatcaacagtaggttattagtagttaaatttttggctggtcaaaagttatacatggattttcaactctgcagggattgaaaactgcacgttgtccaagagttaacaaccctgtattgctgtgtagttttgttttcaacagaaagacttagctgtgagaaaatggtccttttttgtatttatttaataactacctgttaattgattatattcaactaaatagtgacaccagagtgtaaatatgtagtggtgcaaaaagtagacaccaaatacgtgagagaaaatttacttgtggtcttcctggggaaaaaaaaaaaagaatgaaatttactagaatgcattctcttactagaacttgagtagttcagctgctacctttctggctgttgaaatcaaatagcaaaaattctctgaaggggcaggaatttctgtctgctttgtgtactattgtattttcagagccaagaatatggctgtctaaatatggactcaatagtagtttttgaataaattgtgttgtttatttaattaagtcacatagactaaatatgtaaagtgactagttatattagactataaattccaggcagattaaaaactaaaacttgcattgtatcttggtttatattgtgttgtgtgtaataagcatcagtattaaaaacaagcaaacacctaacaaaatacccaagtcaaaacaactttgggctgataggtgaaacaacgttaatggatcataacagctgacacacatgaaaattagatatatttttggtaataaataacatttgtagaaaagatatattcaacagttttatttgcatataattacaaagaatattttcttatgcataatttttaaataattgcttttaaaatattatagagttaatttttcagggttttttattgtttccttggcaaattcaggtagaatatgtttcctaacagtgtgtaattttgacatacttctctagatagaatgacagcaaaatgcattttagttaaaccacccttcccctgagggcattgtttattgcttatgtgaaatactttgcaaattctttttattctaatatatcaagcaccttctttttctcctttaaaaaattattgttttctggactctaggatatcagattatagcaattttaagttaagcattatttaaataaaataggccttgtcatacatgttttcttagaatggataacaaccatgattttatcttatgtttggataattcacaaagcattgttttgagtggagagcaggttcttatttatatgtacttgctatagcaaaactgctgcaaggatagctccagggatctttctaagtttgaaatgagaaacataactgggagagtcagcatatttatcagactgctttttttttctctaggtgaattgaatatatatatatatatatatatatatatatatatatatatagcacttttcttctattgttttctacttctgtagtattaagctgtagacaactgctgaatgagaattttaactatcactcccttgaaatcttcgttcataaattccacatacacataacatggacaaatcattgtggcacttatgtcaataattttttttctgtatcatttaggtaccaaatttaatgaaagtctgcctggggaatcaaaatctatttttgttgttaattataaatgctctttacaagtgtatagtttgatactgggccacaagagagaaagcgagaagggctgcagctcttctctccttctctcttttgtcttctttctcatgtttacaacaaggtgagcggagggacgtgtttcaaccctgtttgtgttacagctcttttggtccctccattaggcaggtcccgagttcttgtcctgcatccaggaagaatgaggtatgcagacaactggagggtggacaaggcaaagaggtgctttattgagctacattacacctctcaggagacctgaagttggtagctcatttctgcaggcagattgtcccaacatctgttcagctctcagctaggagggaaaccacagtggatagctcctctccacaggcaggtcaccctgacatctgctcagctctcagctggaaggagacccaatgtggatagctcctctctgcaggcaggtcatcccaacgtctgcctagctcccagctaagaggagacccacagtgggtatctcctctgcaggcaggctgtcccaacatttctttgagtctggctgagtctggggtttttatggacttcacaggggaggaagtgagtgctgatgggttcatgggtggccatgggcaggcctggaaaaagcacagtaaattttcactccagttcacaaaactggcagcccagttcccaggtttcaagctattcccagattcaaggtggggcttcactggggatccacccttttctgcccaggagcctgtcttcctcctgcttccatcaacctgccattcatgacgctcatggtgcccaggctgtttctgccgaggagtgcctgcaggctcgtgtgagctgcccacaacccttcccttggcctccctcccatgctcatcagctctgaaagtccaaagaaggctgaggcagcagggagctagcatatcagcaccaccctgagtgtgtgcacacctggctgggtcataacagttgtcaggcttggcaacaactttgctccgaaatcagagcaggcaccaggtgtggggagaggccagacagtgggaaggtcacttccaagcctccaagagcagagaggcttcccagagagtgcatggatgccagggtccacagccacagctgggtggctgcatctttaccaaggagggtgaggctctgcccctctaacttggaaggggtggggcttttgcctgttcctagctcctgctggctccatggagtgtacagccctggctgtacttccctcatcgcagctggcatcttctcagtggctgccccacacaggccactgttgctatcaatcccccttctgaagaggtacatctaactgctgtgaggatagggatgatgctgctcttcactgcttcgtgctgacaagggacattgttttggggaaaacagcagtcacatctctctcagaggcctatgtaagggtccctggtagaaacggagccattatccaaggctccagttgtatgaccacttggagcatgatggcctctaggtgagaagaaataattttacaaggaggttaaatatgtgaaagaaagtatctagtgctggagataacacaaataagaagtaaaatagactaatcattctgaaaacaatgttgtcactagagtcgtttcacctttgtgaaagaaattaaatcttgtataggtgcagctaagctttaaaggagaaataactgtttagggctgtagggaggtcaagaataaaggggccttgacaaagatgccttatggtgaggaacagaacaaaagcggtaacagtaagcgtagggtatccatggagggttgattgttggtacttatcttttgtgattgttaagttgagatccctgatttctttactctggtacttcgggtgctctcttgggtcaacagaggaaattccgtcagttccctggtcttttactaaagtgtaatgaatccaagaatcaatttcagtgacctttactgctgtaggagtagaaagaagtacacagtaagccctcacccccattctgggactagagagagagaaagggaaggaggtgcctttaccagtgctaagtcccctgggttgaatagaagtggccttattcatgcgattgggcctctgatagttgttgcagtttgtgttgcaaatgggccaaataagttgtatgcttaattaaatcagagctttttcagtctagcaagaaatcattggtgagaaaagtctacaccattttgaagggacttaaatccagctttgaaagggtgtttctaacacatagtagggctatggagagaagagtaatccatggaatatgagtatcttgagacagtttactgaggtgccttttaataatctcatttgtcttttctacctttcctgaggattgtggtctccaagcacagtgaagatagtattgtatgcttattgccttttatacccgctgggtgacagctgccttgaacaaggggccattattgctctgaaggtacttgggaagtccaatgtgaggaattatttcattaattagtgcttttatcacctcagagcctttctctgttcatcatggaaatgcatctacccagttagtgaaggtatctacccatactaggaggtactggatgccccttgtctttggcatatgggtgaaatccatctgccagtcttccccgaggtagactcccatcctttgggttccagggggacacgccattgactgaggggattatttttgaggcaagtctcacaagcattaacaacctgtttgaccatttttagcagattcttacctgagaacaacctttgagcacttgacaggttttatctttatcaaggtgaaaggcttggtggaggatttttaagaacccagctggaacccagctggaagctggtagatgaagcttgctctcctctaattgcagccatcctgaggactgaagtgtgtatccctgagatacagcccattctatctctgcagaggaatactgaggtttcatttcttttatggagtactcccagatcagagggcttcaagtggatcagatatatgaggccctcttgctgccaatttggctgcttggtctgccaacttatttctttcagctattttatgcatccccttttgctggcctttacagtgtattactaccactttccatggaaagaataccatgaataataatctgttaatttcctgatgacacttaatgagagacccattggctgtgaggaagtttgtctctttccagatagtagcatagacatggaggactaggaaagcatgcttagaataagtataaatgttaactgctttccccttgtttaattcaagtgccctcatgagggcaattagctcatctagttgagtactcgtgcctgaggagagaggcgtactctcaataacatcattcagggtgactattgcataccctgccttatggaccccttgctctacaaaggaacttctgtctgtaatgagagtccagtccaggttctctaagggggtttttttgaggtcctctccggctgcataggtttgcactactatctgttcgcagtcctgttcaagctccccagcttcgtctgggaggaaggtggctgagtttagggagagacagtttcttaactatactacagatccctctaatagcagagcttgatatttgagtaggtggttgtctgttagccagaggctccccttagaagacagcagtcctcccacattatatggcacataaactgttaagttattccccatggttaacttaatacctctggttgcaaagctaccactgcaactgccaagaggcaggctggccattctttagctgtcaaaacaagctccttccttaggtaccctatggggtgctgggctggacctcgggcctgggttggaactcccatggccattgccttcctttctgagacataaagattgaacatctcctcattgggaagtctaagggctggtacctcaagcaagatttgttttaataggtcaaaggcccttttagcctctggttcccaagttagggagtggatctggtatttcaccgtgccatgtatctatacctgcagaatactgtagtgcccaagaatgcctcagttgcttgagggttttgaggcaaggaaagaaggacatgggcttgattctttcttcacctagtgcctgggtcccctctgacaagactagacctaggtacttcaccaaagtctggcagagctgagccttagattttgagaccttatatcctgttatccagaaaattaagagctttactgcctccctaagagatttcatcagagttgggacataaaggataatgtatacatattgtaaaactttaacctgagaataaaggaactcagagagatcttttgacacaccttctcaaacaggtgggggctgtctcagaattcctgaggtaacactgtccaggttaactgggtggcctagttggaggaattcttgaatgcaaacaaatactgggagttgaggtgtaggaaggaaaaaggaatcttttagatccaggactgtgaaccatttagttccctcaggtatttcagttagcaggttataggaattgggaaccaccagatgaatagggaccacagcctcattaatgaggcagaggtcctagaccagtctccattccctgttgggtttttgtatccccaatatcagggtattacaagggttgttacagggtttgagaaggccctgaatcttcaggttatcaatgatggcttctagtcatttcctaacttctggtttcagaggatattgtctctggttagagaaggaggtgagatccttaaagtggaccgagaccagtgtggcaattgtggctcagccaattttccctggagtagtccaaacttctgtgttaatattggtctctactatggggagacaaagagtctgtcctggagccataaagatagtggttcccatgtgagccaaaatatccctgcccaagagaggagttgggctttcaggcatgattagaaagcatgagtaaacaagaggtcctgccaactacaactaaggggttgagaaaactattgggttaaaggctttcctgagacaccccttatggtagcactaagagagaagggagtgcctggactggagtggagaacttaaaggactacttcagtgtccaggaggaggtcccctttcctcccttcaactttcagaatcaccctgggttcctggaatgtaatggtggtctggaccaccagagccaggtagaggagccctgggatgtgtgagtcctgctggaccacttgagagactagctctggacctggtgacctgtgtctctggggatagtcttccctccagtggtctccattacctactggacagggtcaaggtggctttctcatgttgcctgggcagtctttcctgaagtgccttggcttgccacatttgtagcagttaacaggtacatctaggggactctggggtttgtgagcctgcaaagagtccattagagcctctgccttttcttttgtttcatgtttttttttttttttttggatttcctcctgatccctattatgaaagaccatggtggccaatttcaggaggttctctaaagtactatctggtcctacagcctatttttgcagcttccttctgatgtctggggctgcccgagtaataaacttatccttcaggttcagttatccttcaactgaatcaagagatagagaggtatgctttaccaagaccccttttagcatttccaggaaggcagtgggtttctcattgaatcccttttctatcatgtttagcttggagtaattaagaggcttagttctagtccttcataagccctccagtatgcacacctgagagtgtttcctcttccattctcccatttcatcattgatgtcccatttattatcctccaatgatactactattcttctaattggattggcactctatgacatacaaagcttatcccccaaattatctgctgctttctgggtggcctgcttttccacagtagtcaggatctgattcaaaagtaacataatgttcttccaggagagttaaaatacttgggttaaattctggaaagcctctatatgcaaatgtcagggtcatttgaaaacttgccaagatctctcttaatctgccttaagttccgtagagaaaagcaaatttggaccttaatgagactatatttgccagcctgttgtaggggcaaaagtgcctaaaactaagatttctaggatggaacaaacttagagagaacctggataagggaagtggaaggagatgattcccccaatggaggtacctctggggtttgcttctctatttccctgggattgccccttgcagccttttctgaaattgccaccaggagggcagaatcaatcctacaatgttggcaaaggtccgaacttccctgcaaggcaaagaaagtctgcacatgtgggacttcaaaccatttgctctcatgtctacagaaaagttccagcttcagaatggtattaaaattaatacttcatttctgaggccatgcttctgcctgcagaacataattcagccacaccttagtgcaaaggaatataaggcagattttctccagagtctgagtattaaggagtcccaggaattcaagatacactctagaggagtataggttaaagatggttgtttacccttctggaagagagaacagaggaggaaaaggtgatttttcttctctccagagtctgagggtcaaaggggtctcagtgattcaggatgcagtcaagaggagtgcaggttgaagatggttggttacccatcaggaaagaggggtaaaaagcatccctttgttcctttctctttccagcaaatacccagggtaggtgaggctaagaaaaaagggcatccctttctttcttctgaccttatatccctaaatccccgtgatctttgcaggtgttgaccatgtgtgcaagtgtgacttcacccatgaggtggggaggcatacccaacaggagtattcacacccacctatatggtgcctaatcctcctgcttttggtaacctttaaattccctagaccttatctatgccatgggtaggaggatgacctccatccacgatgcaggagggcctagttggcaggagttagtcatgctcacctgcgccgtgccccctaaacttcactgtcatgtgcctttggatctctcacatctagtttttctttctagggcctcaaaactaaacttgggacaaaaaaatgcctcaggagggtgtatggacccattaaattagtggcctcaccaaattgcagccagaaactggtggggcagcccatctcttgcttccttattatgaataggtgaagctgtgggaccaggtcctctgcaaacaagggaaagaaagggagtcctgggaattggggacctggcctaacaagatgcttcccaaaagaatgatttaagttcaggggtggggaaggtgcctggggaaaaaaccttttgccctgtgcaaatgggttccttcaacaggggaaagaaaactctcaattgttacatccttcttgcttctaagaatagatagacatcacattgttctgatttacacttctgatgaccaagccaagtgcttattctacccggtattattatctctgtactttgcaacaacacccttatcattgtatataaagaagagataggagccacgacaaccttgaaagaaagaaagaatgataggaaagactggaggtcctagtgctgacaccctaacaggcagtcggggactggagttagttcagaggcctttggataacactgagatatagcctcagccagataccctcatttgccccaggacctccttctgatcccacacgatggctagacctccatgaagggaaactggattggaacaaagccaacattcccaacacccaagggtgatgggggattggcagtgtcctccccagcaagcctgtcctcatgtcttaagtccagcagctatgctagtcactttcaactggccaagagaggcatggcatttttctttcagtttggttgtagtggagtttagggattccccaaaaaaggacagaaagcagcaagtttgcttttactcacccttttgcagatcctggatgagccccccaaaatgtcataggatcctcagggtgttgctttgccagctagaaatctctgtggctggtggtgcctttgcccaagttttgctcaggaccactggacttgatttgctcacttggcctggcagtctgcactcggcttgtactactggctcagatccgatgcctgccaatggtgagccaggcatgaagcggtgaggagtgtgtaagcgagcgatcccagggtccggccactgtgtacaacaaggcacactggctggggctggcgggctgctccaggtgctggcacaggtgctggttccctgcgaggctatggctggaccaggtgtaccgcaagtggcttccactgcaggcaccagggaacactttgtcacccagcagcttggagatcccaggaactgcagaacgccaaatagcgtgtaagagccctggctcagggaactcttagagctgaactccccaaagagcctcaacttttctctcctcttttctctcttttttcttctcctcttctcgtgctcacaacatgctgactaggggggcatgtttcagccctgtttgtgccattcagcaggtcccaagtacttgtcttgtttccaggaagaatgaggtgcgtgggcaactgcaaggtgagcaaggcaaagaggtgttttattgagctacagtacagctctccagagacctgaagtgggtagcttctttcaacaggcagatcatccagatgtctgttcagctctcagctgagagaagacccacagtgggtagctcctccccacaggcaggttgtcctaatgtctctacaaatctggctgagtccaggcttttatgggcttcaaagaggaggaagtgtgtgctgattgttccatgggcggccatggctgggcccggaaaaggcaccataattttcactctgctccaagcaactggcagcctggcacccaggcttcaggccatccctagcataaaggtgagtcttcaccagggacccacctctttccacccaggagcctatctgctttctgccatcatcaacctgccatccacagcctgcagacccatgccaaccttctctttgccgtccctcccatgcttatcagcacccaatgtccagaggggctcgagacagcagggttctggtgtgtcggtgccaccctgagcatgtgcatacccagcagggtcatggccgtgcccaggctttgtcacaactgtgctccaaaattggagagggcaccagaatcagggaaatttcaggcagcaggagcctgctgagatcaggggaattcctgggccctcaagagctcaggaattcctgagtccatagccgcagctggtttgctgcggctcttaggagagcccctccaacttgtaagggggcagggcctccacctgttcctccttccacctgctccatggagtgcaccgccccagctacacctcccacactgcaaccagcatcttcacagccaccactccacatggaccactgctgccatctttagaaaatagagtctgccacaataagttttttttttttgagatggaatcttgctctgttgcccaggctggggtacagtggcaccatcttggctcactgcaacctccacttcctgcattgaagcaattctcctgcctcagttcctgagcaattgggactacagacatgtgccaccatgcctggctaatttttttttattttgagtagagacagggtttcacccttttggccaggctggtctcgaactcctgacctcaggtgatccacccacctcagctccccatattgctgggattaaaggcgtgagccaccatgcctggccttgccacaataagttttaatggtcctgccaatattaaaatgaaatctttaatgaacaacaagtcataaaccttctatgtgaactacttagaaggagcagactacagatgatgatgccattctaatattatgtgtggaatttttgtcagtgatgaaggacttcacagacctccagtggtgctaaagttcttacacatcgcttttgatggaagcttgaaaaccacttaacctaggtagcatcttctgctctaactggtggctgtgcaatggagaaaatgccgataaagtttttaatagctaatttatcagcaataataattgtttgtgactctgttctttctaatgctatctattgtatgcatatgtatgtgtttatagtatatattatatatgttatatatgcatacatgtgtatgtatgtgtatctacatatatagatagtgtatgtgtgtacgtatatatagatacagatataaacacaggcaaattcttacaactatacacgatctagttttaaatacactaaaagcttatgtcacattgggaaggagggaaccataatgacaaggtaacgtattttccagcattagaattattgaagtatgaactggacatctgtcagagatatttggaatgggagaggataggagtagtagcaatgtagattcagccattaggtgggagtttggagtagaactctgagatctttttatttaattattaatattagtaaaagtaattctgtccccctaaaatgctctttaaattagtttgctagggctggcataacaaaaggtattattgtcttggtggcttaaacaacaaacatttattatctcacagttctggaggctagaagttcaaattcagtgtgtccgtagagttgatttctcctgatggcttctttctgtgtctctagacatcttctcctgatggtttctagatggcttctttctgtgtcttcgatgttttttccactatgtctgcctgtgttgtaatctcttcttcttaaaagggcaccagtcgtactggattagcgcccaccataatgacaatattttaacttaattttctatttattaaaataaatgacactttattcataatttgttttactttacaattagtagggactttataaatgcttatttcatgtttgacattcaagaacaccattggctatatcagcttatatttgaagtgaaggacacttttttgccagccccaaacatactaaagtgttttgagttttaataataagataggtaagcttacaaatggagttcataacttttgctatttttctctatcacttgtgagctttcaattttattgtagaaaaaaatttcacaacgaaatatttgtgaaaagaactattcaaaaactaaggcggccgggcgcggtggctcacgcctgtaatcccagcactttgggaggccaagacgggcggatcacgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaactaaggcaagaaaaaaactgagattaaatgggtcaaaaatatgcaatttcaattataatagacctgatatattccaaccatctgtcataaaatgaaaggttactattggcacacagcgacaaagttaccagaatttgggtgatatgaggtaagcctgaccaaatttaatattttcattttcactttatagttttgtctgagtttccagggtatagttattttcatctgtttttcatattttaagaagtttttacttcaggatattgacagttttacgcaattccttcacatcttaacaaatatctcaagatgatattagccttaaataatatggttgtatagaatacttttaaatttaaattgtaaactaaattgtctcctaataatttgaaggtctttgctttcttcttttgatggctcttctctcacacccatctgtactgtggctgtattttctgattttgtaatgtgctgagaattgtatttcatcttaataaagaaaataagtagatatagactgtgactatatatttgaaatgaagtgttaacatttctgaatactctgcactcgactttttcccctctagtccactacactgctacttcaaataataagaagccctcaccatttctcactttgtttatttcaatagtgctgtcagtggtttcactcagtcttgttcctgtacttaggtgttgcccaggctattttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttttagccgggatggtctcgatctcctgacctcgtgatccgcccgcctcggcctcccaaagtgctgggattacaggcgtgagccaccgcgcccggcccggctatttttaaaaatatataaagctgatcatgttgctctttgtttaatgatcggtatcaattcccattaactttaggatcaaatactaatgtttttaagtttttaagtttagaaggtgtttaaggtattgccgatgacctatgcctccagctcagtcttccttaacttcttgtgtcttgtgtcttgtctaggccccaatcacattgaattatttccatttctcaatatatatataacattttctcatatctcaatgccttttagcacactctttcctgtgcttggctagcatcttttcttttcccccatgcctcacttcacttttcttcagtctctcattcatttaccaaagattattgagtgcctcttttgtgcctggcactctactaagtaacaggagtgaacaagactgcaacagtcctactgttttgatcctgccagttactttacttggctggcttctatgattacacttcctaaatggtacaatctcctactacactttaagttactgcaaggcaaatgttttatgttttatcttcacaagttcagcacctactacagtgtctggatatggaatagttcaattaatgctactaaggaatgaatatatatgcctgcttttgctcaatgtgtgctatttacagtcatgatgcaatggcttgtatcttatctgcttcttttttttcatttcttctttcaattctggattaatataatttcatcaaaaaactttgtataggcactaaaaagaaatatttactggttcagtaaatatttactggttcattttggtatttacaataccaaaatgtcattgttacttatgtatttatcaaccaggaaaacagaccagtaaaagatataaagaagtttcttttgtgtatttgtttttgtaacaagtaatcaacgtatgtgattttggagaccggttaggtaagtccaaaatatgtagagctgactatcaggcagagcaggagggaacttttgacaaggatgggatttctatcttcaggaagcctcaactctgctttaagccttttttaactgattgactcagacccatccaggttacctaggataatatcacttaaagctaacagactatggactttacatgtagagaagatattttcacagcaacacttgggttagtatttgaataattggggcttgtagcctagccaagttgacatataaaacaaacaaacaaacaaatcagccaggtatggtggtgtatacctgtagtcccagctactcaggaggctgaggcaggcggatcgcttgagcccaggactttgaggggtagtgcatcatgattgcacctgtgaatagccaccagactccagcttgggcgaataataaaacaccatctcataaagtaaaacagttataaataatatttgctaacattttaaaagaatatcattttcctgatattatactaagcactttacatgcattaattcatttaatcatcaccacaacccaagtgcaagattattattcatagtttactaatgggaaaacaaatgcaaaacactcattctccagtggaacaatagaacaataagtcaatagacttataaccattgttataagtcattttgaaggacagagcttagaacccaaagtatttgtatggtgagtcaaagttgtgatatgttctgatatggattattttttaagaagtttttactttaggatattgataattttgatgcaattctttcacatcttaaaaaaatctcaagatgatattagctttaaatcataaagttgtacaaaatacagtcttaaataatgtggttgtaaaaccaggctgcttgacgttttcacagtttttcttagaataaagaatccagatgtagggatattattgagtataaacaattgaaaaagataaactattacatttacactattacttcagagcagttgatatatttaaatgagaatcagcatgaagtatgttcaatagcatgaggactagcgagaaatagatcaaatttgggtttttctatactcaagctgtgtgaccttgaaaagtgcaatgacagtaataacaatatgccatagaacttttctgaagggtaaaaacaatacagtaagagtaaatgcacagttagtgcagaattgtgtctatcttgtcatttaaatgtttgttaaataatgtattcttttgctaggttaagctttatcagcgggttgttatgtggtagatacatggatcctggatatttggaacagaaaatggaaaagtgaacactctaccaagtcaaaagcaaattctttttttttaaggctgcaatttgccaattaatagtaaactattttggtgaattggagtggtgatctcaaatgtaataaatatgtataaataaaatataatacaagaatatcaaaaacacattacttataactactctaggcaccttcagtcacttaaatgttttaattttgcatgaaagacaaaaatgcctctctgatgaatccttagtagttttgcgaaatttattaaaatataaaatatactgcttttttatgctttaacaatgattttataaattaaaaaaacgatagaaattcagttattaaataaaattattttgatgtagtcaaactggagaaaaggagtaatttaaaattttagtgtttaaatttggcatctcagtttaatatgaatctggaagaaacattttagggaatacagcaataatagaaagtcatttcctgtaatagcatagtttttgtggtgtaataaaaggttacatgacaaggtcagactacttcatttcaaagctaaaaatgatttctactctgccctgaggtttgcagatttctgactgagtggtccctggaaggcttgttcattttgttgtttatatatttaataactatctagaaataaataagactagtgcttagaaccaagttttaggataagcaatttttgtgactatcaagtattttttcttattttaaagtccctatttgtataattaaacatcggtttctcaggcctgaatcatccttttcttatcaactgatggttgctgataaatgacttctactaggtacagttccagtagttgtttagtgaccctgatcttggccaaaaggcctcatctgtctagaaacacatggggacttttattttccaggtatccttgctctgacactctctagtgacagaagcctaagacggaatattctgcacttcatgcaatacattaacaacaaaaattcttttcacagaagagcaaatttagcatataggtttttatgttgttgcctcaaactgttatttatatctatggttggaaataatcgggaaaaatgtattattgatttttcaacccatggatgctgcaaatctatttgaatatggaatggcttgacactgtctcatgttttttatattacattataattgtctgctgttccataattaacctttataaaattaatatgtgaataaaattttttatgcattattaactttttaagtgcaattaaataatggagtaattaaaatttgagtgtttctgtttgttgtactcagtttttatatttgattcaaatgtcacatcagcagtatccattttgttttcgagacggggtctcgccctgtggccaggctagagtgcagtggtgtgatctcggctcactgcaacctccaactccctggatcaagtgattctcctgcctcagcctcccaagtagccgggattacaggcacgtgccaccacatccagctaatttttgtatttttattagagacaggctttcaccatgttgaccagaatggtctcaatctcttgaccttgtgatctgcccacctctgcctcccaaagtgctgggattacaagtgtgaaccaccgcctctgcctcccaaagtgctgggattacaggtgtgaaccaccgcgcccaggcagcactttccgtgttcttttttttttttttttttgaggtgcagtcttgctctgtcacccatactgcagtgcagtggcctgatctcggctcactgcaacctcagcctccccggttcaagcaattctcctgcctcagcctcctgagtagctgggactacagacgtgtgccaccatgcctggctaattttttgtatttttagtagagacagggtttcactatcagtttttatttcttttctctactttcattttcattggcaaattttttccttacctggtctattttttataaaatgtcacataaattaatcacggggagacaaggaagcaatgcaagtacacattattatttatgtgcttgaactgaataagtaatgcctagttatcaataattgacagaatttgaaagaagtgatgtgtgtgtgtcactgatcatgatgtacctcttttgtttacatagtggtttgtgtactgaagtgctagtaaagaagtttgtactttatacaattactcacagttgatataccatgtgaacttcagtttgaaccctgtttttggggagtgactgatgttatttaactaaaccatgtaagtgaagtttttgcatattagaaccatgtaaaaagaggactgaatatacagtatatatattcaatttcattcattatcaggaatatataaattgaagtaacaatgccatactgcactacacacttaaaagaatggctttggtaggcagaattctaagatgacacgtgactccagcccttaatttttatttactgggaagatgatagggcatcactgctgtgattatcagttggcaaaaaggattttgcagatgtaattaaggctactaataagttgactttcagttaatcaaaaaggaaataatgtgggtaggcctcacatgagccctttaaaagcagaaagaatgttttttccctagttggtagcaaaagaagaaatcagagatatttaaagcatgagagggcttcaatgtgaaggatgttccccactgctgagatggatgggccataggccatgaacctgtgagtagccctagaagctcagagtggtccctcgtcacaacagctagcaaggtaaaaggagccttgaatcctgctactggaaggaggtaaattctgtgaacctgagtaagtctggaagtggattattcacacagagacattagataagagcccagattcattgataccttgattttggccttgtaagaccctaatcagggaacccagttgagcccatctggacttctgatctctagaactgtgaaatgattaatggatattgttttaagctcctaagtttgtgttaattttttatgctacaatagaaaattaatataatattaaaactttaataagaaaaaagtgacaaaaccaagtgttggtgtggatgtgaaacaactgaaactctttctctattgttggtaatgcaaattagtacagacagttctgagttgtatttggcagtgactactaaagcagaacataaaacatgactatatcctagaaacgattacagcttattgatatttttccaatataaataagtttgtgcactgtttaaaaaagtacaagaatgttcatagacaattgaaatagccccaaactgaaaatagcttgtgttcattattaacgaaatgtataaataaatcgtggtatattcaccagtggaaagccacacagctatgagaatgaaccagctactactagacatagatgaatcttataatcacacattgaatgaaataaaaaacacataaaagaatatgcgtgggccgggtgcagtggctcatgtctgtaatcccagcactttggaggtggaggtgggcgtatcatgaggtcaagagatcaagaccatcctggccaacatggtgaaaccccgtctctactaaaaaatacaaaaattagcttggcatgatagtgcgcctgtagtcctagctacttgggaggctgaggtaggagaatcacttgaacccaggaggcagaggttgtgttgagctgagatcatgccactgctctccagcctgggtgacagagcgagactccttctaaaaaaataaaaaataaaaaagggcctggctggtggctcatgcctgtaatcccagcactttgggaggctgaggcgggccgatctcgaggtcaggagttcaagaccagcctggccaacctggcaaaatcccatctctactaaaaatacaaaaattagctgacacggtggcgggcgcctgtaatcctagctactcgggaggctgaggaaggagaatcccttggacttgggaggcggaggttgcagtgagccaagatcgtgccactgcactccactctgggagacagagcgagactccgtctcaaaaaacaaaacaaaaccaaaaaaaaaaagaaaagaatatgctcacaaaagaatatgatcccatttgtgtaaaggtcagaaataggcaaaacttatttatggttctataaatgatgataatggttaagttcagaggttccagtagtgtttgggaaggggtaccacaggaggatttagggtgctggtgatgcactgtttattgatcttgatgctgacttagcaggtgtggtcatgttgcaaagattcatttaactgtttatgtataacttaagcacttttcattctttgatgaaaagcttttttagagaaggactataaactgttggcaataccttttccaccctgggatttaaaaaagaaaaattgcccaaggtcatatagctagtgagtgaaaagacttagagcagaaaatatttaaggataatttaataattaatgttttattagaattagatcttttattagactaaatatagaaaggggaaaaaggagatgtgagactagttcataaataattttgacatttacaattcctcggtttttttgaacagtttgccgggaggactcatatcactctgtcgtctcatgtgccgcagtagttcttactcctatggaaccaatgatagaaatgaagaaaagagaagaaccagaatttcctgagccttccaaacagtgagttgttcatttaatttttcaaggccttgtaaaatcaattagataactgataagaaaatgtgatttataataaatgtgttaatattagtataaagaaagaagaaataaattttatgggttaaaaaatcatctattctatattatcttaatgaattaacttctgtgtctcctaacttcatgtctttgaaccatgtgtcattcaagtttcattttgttaccttatcttaaggacatgggcaagtaggctgatgtactttatttccctactctgtgattgtgggtacactgttcttggattgcttactatataagctgtaggctttaatgatataaaatgaaatcagtttttaatataaagtttttaaagttggtttgcatttttataaggaatgtaagttattattttaaaatatttttactaaattagaacaaatttgaactttatactattttagtgttttcatattttttccatttaaacagttcaagctttaatttaaattaaaatttgatcttctattatataaatgataaacttgtactcttataatgactaaagaggcttaagttcatgatgataaatgtaagcttatgtagatgtcaaatattaaataaatggggattatttctgcttatatattaaatacatgaaaaggaaaaaacctgctgagtatttttcagtgagaaatagtatcatgcctcctttaaggtttctggttagtgattaggtgatataaggggctgccaaggattttgggctgaccaccgtaggagtaaggcggaagatatatcttgatgtacctaccatttttctccattggattacactgtgttatagttatttgcttcttgtatgtctttttactagataataagctcttaaggcataattgtgcttgatactgtttgtgaatagggcaatgtatatatttgattgcatgaagatattcagtattaatattcttattatagagggaagaaacactgaccaatttagaaaataatgattttaattcagttttaatacaatctaaaagtcagttaatttaactgctcttcatatagtcttaatttttaagttccaaaagccatttttgtctaatagataattgcatcatgtttgccaattgaattatattagaaagctcaaatgtgttttcctgcaaaacacacacacacacacacacacacacacacacacacacacacatttccttatcttttatttagggtgatatcaccactctctttgttagtattatgtgaaatgatattgagaaaggacctgaaatctaataatccataaagttctagttatgttgaccattctatagcttcagctatcaacattatgggtgacttatggttatatattcttttcatgaaggctcttctgaatgcaaatgtaatatttaaagttgttcatcagacttgtctaactaggcatcctaccgaagtgtcatgcaggttgaatgtcccttattcaaaatgcttgggagcagaagtgtttcagatttcagatgttttcagattttgcaatatttgtattatattagttgagcatcctaaatccaaaaatatgaaatttgaaatggaacatgagcattttctttgattgtcaagttaacactcaaaaagtttcagattttagaacattgggattttcaggtttgggatcttcagtctgttgtaaatatgtctgaagacaaattaataatctcctctaagtactccgtaaattctcaagttgttccatatttaagtaaagctaccatcatttttctttttttaaaatcttggtatgttttcttcctcacatctcatattcaatcagttatcaattacttgattaatgtctccattatattttcttatttcagcagacctggaaggtatatatatcccatattttaaatatctcctaaaatatatcttcagttgtaatcttaatgatgccatctatcaaatggaaattgtttatgtcctacatacccaacactgttattttgagaattaaaagataggtgtgaacatatggcaagaacagagtataaatgcaagcacagtgattaactcaaaactcttgtttgccagtgacagaagccaaatgctaactggtttcagaaaaaaagaatcaagagtgctggtggttattggctcatgtaatttataaagtacaaaggtagcaatttcttcaagtacagttttggttctcaaatgatatcatcaagggtcattctctctatctacatgttttttgcttgactcttctgtctgggcttttcattttctgggaggttcctctagtggtgatattactgccttcagcagccactgggattgattttcattttctccacaaatccagtggaaggagataatttctcattccttttaatcaaagcaaaaaaaaaaaaaaaaaaacaaaacacccagatttgagtgtcattggattggctttgactagcttgccttgtttgacatggcaattctgaaacaatcactatatccaaaagtatttggtggcgattgactagataatttgttgatgttgcatgacaagccctggaacacagaatgaaatttagaggggaaaggtgattccacaattgacatattggtgatattgataaaagaaggcagagatagatgaggtgtcaaaataatgaatgttccatataggtaataatattattatcaccattaattttaaaagtcagaattctttattatatttaaatcataaacattgatatactgaaatataatgcatgtatctttatttcttattttaaatgattttttacctacttaattttattttatgttatttgttctgggtgtgctattgagaggcagtataacacagtggttaggaatccaggcattgggcagattctttccccccaacccccaccaattttcttaacccctgggcactgtggcttgcacctatactcccagatactcacaaggctgaggggaaaggatcatttgaacccaggattttgaggctgcagagagctatgaccatgccactgccttactccagcttgggtgacaaagcaagactgtctctaaaagaaataataaataaataaagcttcttaaccttagtttatttgtttctttttaatatgggagatactttacctcataatgcaatgcctaaaacataatagagatgcaagaacatataaattttgtaatttttttgcaacaaatatatttgttaaatagccacatcaactgtttataaatggtgttactaatgcccttatgatatcagttttgtgtattttggatttcccataagaaaaaaaaaatactagatagggctggacgtggtgactcacacctgtaatcccgcactttgggaggccgaggcgggcggatcacttgaggtcaggagtttgagaccagcctggctaacatggtgaaaccctgtctctactaaaaatacaaaaaaattagccaggcatggtggcagtcacctgtaatcccagctacttgcaaggctgaggcaggagaaccacttgaacctgggaggcagaggttgcagtgagctaagattgtgtcactgcactccagtctgggtgacaagagcaaaacgccatctcaaaaaaaaaaatagtagacataaaataatcacccgccaatataatactaatgctgaaagttgagacactgtctttggataacaaatatttctttttaattttggatggaattacttctttaagtaaattttccccttgaattttacagtcttcacatataaattcataaatcattgagtctttgaaatataggattcatagagtcatctgattcagaacccagtaaattcattgctaagaataactgaaatagtcatctcagaatatgtaagattgtacataagaaagaatatgtaatatataattacatcactttagaaggtaagaaacattttatgactgagatatttgtattatctaaccaatgtttagttatattctgatgataaatattttacttttgactttttttattaaatattctcatgtatttattagtttttagacatttgataaggagaaacaagaattaggaactcctactaggaatgaagtataaatttttcagcatagcaggtgatagggagaaactaactaaatcgttaagaaggaaagctacattgctcattacagtggcggaggaccagagctttccacttcctgcaatatctaaaattcatcttaattcagaaaacaaaggtggggattttacttcacttctgagtttagtttggtatgtaactcagaataccatagaaaggataaactttttaaaaaatagaataatctatgtaatccaaaaagagtgtacaattttcaaatatttaatcataagcatagaatgctggggtcaaagctttgagagtgactgttcacaatagcagagtcatgaaatcaacctaagtgccctcaacagatggttggataaagaaaatgtggtatatatacaccataaaaaagagtgaaatcatgtcttttcagcaacgtggatggagctggaggtcattatcctaagtgaaataactcagaaaatcaaataccacatatccatacgtaataattgggagctaaataatgggcacacatggacatacagaggggaattataaatttataaaaatcctactgttaaaagtataaccaagtatccagctacactcagcatgttcctcaaaactctacatttctcaagtcagttctatgtaaatgagcatttcatgaaatgtacatagaactcaaactctgaagagaatgaaagaataaccatgattggctttggattatattttgtattaatacttttttagaaatgtgcttgttgaaatgcaaatattctgtacataccataactcaatgtctgaatgaagggatttttgtgaccattgtaaagttagaaatgcagaggtaaaagaaaaattattctattacttctttgtccatttccacatttttatattattttatataaataaatctaaccttaggaatagatttgatttattgtttactcttgcatagatgaagcattacttaaacatattgtcattctctccaagtttcaatacctctttgtaatgcttcagtttcttgtcatgaagtaggttctgtaagctccttctgaaaggtaacagacattatcatttagtacaaacgtctcatttttaaagaattgctaacactaacctattttattcttagagggtacttaacacacaggcttaaagttttgtcagctctgtttgtttatttatctgaatgaatagtatatgttagatttggaacagttaagtactctctctaaggtcacctctttagactctctaaagttgttacacaaactctgtggttatattggagacatatcaaagaataatattactagctgatctccaattttcctttaacaatcttcaggagaacatatttatttatgcttttaggcagatatttatttgttaatttatcaaaaataggtaattcttcagtgtctgctttgtttttggcactctgcatagtgctaggggttttgtgttgaaaagcaggtgaaatcccttctgtactaaaaatacaaaaattagctgggcgtggtggcgcacgcctatagttccagctacttgagaggctgaggcaggagaatcacttgaacctgggaggtggaggttgcagtgagccgagattgcgccactgcactccagcctggtgacagagcaagattccctctcaaaaaaaaaaaaaaaatgcaaaagtgtagctgtggctataatgtagatgtgtatctcattataagggctgtagtaagaagttgtaacatagccaaggaggtcaggtaaaacgtccctgaggaggtgactctcgagctaacatccacaggctattagttaactaactgaaaaaacaaaatagcttcttaaagtgttctgtgatggatgggagtgtggagaaattgaaggaaggctcgtgggaggaaaaggaagccaaatcatgttagcagggccaagtgacatggttagatttgccttttgaaaactttctctttgtttgttatagagaacgaattagatgtggttggggtaatggtgaaatggagccgacttgggagagccaatttgatagcagttctccccagctctagattcagtgatttcacagtgaaagtttgaaatcagccatggtgggtgtatttacatcatagcattgggaaattctataaatgaggactttcctcctcccctggagagctagttaaatatttatcagcacattagtaaatggaggatagactgagtggctacagtgagaacatttaggtgattgctgatagtagcttgcactaggttgctggcattgggagtggagaaatgtgaaaagagaactgtgtcaatatgtatttatgaaccttggcaagttaaatatagttattaaactaataacttataatacattactaagtatttgcaataaggatgaaaatgagaaattatctttattactaattgtaattatgttaaatatataatattgtggaaatcctaacatgttatcttgaattagtaatagtttaatgaatggagagtcatgatattcttttaatttatgttgagtattatatcagttgaactataagtgtaacatgcacacacacacacacataaatgcactttgcataaaattcctgtctgaatcattgtcattgattttcactgaaaatgtccacaatataagtaaattccacttaggttcttatgtaaattcttatgattctttactaacaattttccttcatttaccctccatcacttcgtgccttcaaattcttccatttaaaaaattcaatactgaggcatggctaggataaatatcaggataatactatgattaggaaacagccttcttcctcatgcaggcattcaaaagaaacggctagtgtttcatgattttggtcaattcaagggtggaagcagcatctgaggagatcagtgaggagataagatttccatggtgaaagctgttgcctaaatataggtctcttccacagcttttggaggaagttagggatgggaggagaaactttctaacctcaagtctatagtggattttcagaagaatcattcagtgcttcaaatgtgttctctgcagttggaagcacaagggacagatgtggattcatgcctgagaaacttaagcagactgcccagaaaacctcgagggtgaaaaatcgctggccagctgtgaaagcagcaccatctaggactctagagttagtcagggaggctgtagtgtttttgtgaattatctggaggatgaggatacccccataaagaggggcaaaggactctcatgcacccatgactagggaactacagaatactggcccagaaggagacctttgaaaagatcacttgtgggccaatttgctagtctctaaagccaattaaatctccttaaagctcctctgaccgagtaccactacccgctacctttcaccctggtagcaggaatgcattagctgtaccactgaggaagtttaatcttcaggggtcagctttacaatgggccccacataaagccctagaagcaatcctggaaatttttccttcttttctcgtgtgtgtgtgtgtgtgtgtgtgtatgtgtgtgtgtgtgggtgtgtgtgtatgtgttttgagatccctccagatttcataaacttcagggctcacataacctggatttatccctttgtaccatcgcctttagatctgggcactcaggattcttgccttaggccctgcatgtgagagaactgtgtcacatcccttctccagctgctccgccttacataagatgcatttcctgaaagccaacagctcccaccactaggagactatgccttcaccactcactctgtccagaaatcgctgctcaaatggccctaggtcctaccctctggaggaccacataacgcacaacccatgggctgcggaggaacagtcaatcactggtagtggtggacagagcttagagggtcggtgggggcattcacctttctgactgccaggccttggtggaaaggcagccggctagatgttttgtcaactatgctgtattactggtaccttgtgaaaggactgattgccatcaatcttctgtatttttttttatcatctctattcaaccttttggaaagatatgagctcattattcgctggtttatatatattgaaaaaaactaaagaaggttttcaaacgtcaagaaccaatagattttaatatgaaaaataagaatgtttaaaaattcccagagaaactgctgcccttgattgacagtgttgttattttatctctctgctgtttattgctccttagtgagtcataatatttggtcccttgtgcagttaccctgtcaaggcaagaaatcctattgtaacgtttgcatctagtttgacaacccttctttgtacattgagcacacaaatgctatttttcagataagttgggacaacccgataatatgactgaagtgttttagctcaccagtgcagtacagttatcactgtactctttatagagtactataaatacagatttgtcagatcactgaaaaagattgcaggtgcatcaccattgttttgaaagtagctcttatgtgtgcagaaaaagcatggtgccaactttcaattccccgtgctaacctcatcccatgaaaaaaatcgatttgcaaatatataagatattttatttgaatgtgttctataatttaggttttagtataagtcttctagtaatactataaataaatgctatataatccaatattgattttctacttttccccttccaggggagactgactagcagaaaaagcagaaactttgaaatctgaaacatctcatctctatttggcagttagatgacatggagcaaggagcgggtactactgttattgaagtcaagtattcttatatatataataaagacaatagcacctgctttgtaaggtcattgtgaaagtattcaattttcaaagtaaagcaggtagaatcatgctgggcaccaagaggaagcacaataaaaattaccagatttaatatctcttgaatgaggaagttgggcataagaataagggattggatctctaagaatacataatgttctgtggcatttatgcttttagatatttcctcaaatttgcctattcacaatatgtgattatttgcccatttttaaaagaaagtattatcttttttttcctctggtatattaagcccttttacaacaaatgtttcctggttttttttttatcttctattttacttagaatagcaataactagtaggtactcaaaaaatacctgagaattggttaatttttatttacttttgaggtaaaacacattttcttttatttcgaaggtagaaccaaccatgatagttgtccaacattatcaaatttttaaaaattagatatgaatagagcatatttactgttaatattttaatattaacatatttaacatttgaataattaatattgaaaatatcacagggaattaaaacagcaattttgtcatcagtattgaaaagaaagatctgaaaacttgaagtctagaaacctgattgccagccctggaaaagtgctatgttttgctgcatgctaattctcttaactgtgaaacaaacattagcaacacagtgaaattctaatgagcaaaagtctgggaatgcctgttgtaaaatgtgaagtagcataccttacttctttgttttataggggtatctaaaataaacattcattaatatttttaattctttgagttaaagggttcccctgattgatggaaaaatcaaagtacttgtagacagattgattcctgtctgtttctataatatttgaacacctctattatagtactcattagacagaattacaattgcctatattcttcattctctctcactagatattaaagacaggtattttttgaaggacagatgtttctatcattttctttttgaaatattgtgtgtgtaggatgaaattttacattgtaagcataattacgtgttgaatatataaattagggttgtaaactattgtttaaatctagtctttaaaataataaattggtttattcagtaacacttaaatgtatttaatattaggcaccatactgtaatctaagctttgcaaacacgtatccatttaatcttcccaacaagattatatgttgttattatctgcaagctacaggtcagacaacaaaggcacatggagattaagtaacttgtccaggatgacaatttaaaaaaagaataaattgtactttctttctttcttttttttttttttttttatttttttggagatggagtcttgctgtgttgcccaggctggagttcagtggcgcaatctcggctcactgcaacctccacctcccaggttcaagcaattctcctgcctcagcctactgagtagctgggattataggcacgtgccaccacactcggctaatttttgtatttttagtatagacgaggtttcaccatgttagtcaggctggtcttgaactcctgacctcgtgatctgcctgcctcagcctcccaaagtgctaggattacaggtgtgagcccccacgcgggcctgtactttcttttaaattactttaattactaaatttagaatctgacacactgtgaaatcattcttttttttttcaaatgcagttctttttgtagtcttttgtaatctaaaaaatatgaatgtcattataagcaaataatgcttaagatgattagcatttataaatcaacataatataaaggaagaatataagtaacaaaattcttcactgatgattatcacaatcagtacctcttcatttatgtgtatgtttttctctcaaatgagccaggaggaaaactttttttcatgcttctgttctacttagtgtcattagtgtcattattcattttactagctatttctttttcgtctttttatactttaagttttagggtacatgtgcacaatgtgcaggtttgttacatatatacatgtgccatgttggtgtgctgcacccattaactcatcatttacattaggtatatctcctaatgctatccctccccgctccccccaccccacaacaggccctggtgagtaatgttccccttcctctgtccatgtgtactcattgatcaattcccacctataagtgagaatatgcggtgtttggttttttgtccttgcgatagtttgctgagaatgatggctgccagcttcatccatgtccctacaaaggacatgaactcatccttttttatggctgtatagtattctacggtgtatatgtgccacatttacttaatccagtctatcattgttggacatttgggttgggtccaagtctttgctattgtgaatagtgccgcaataaacatacgtgtgcatgtgtctttatagcagcatgatttataatcctttggatatatacccagtaatgggatggctgggtcaaatggtatttctagttccagatccctgaagaatcgccacaccaatttccacaattgttgaactagtttacagtcccaccaacagtgtcaaagtgttcctatttctccacatcctctccagcacctgttgtttcctgactttttaatgattgccattctaactggtgtgagatggtatctcattgtggttttgattgacatttctctgatggccagtgatgatgagcattttttcatgtgttttttggctgcataaatgtcttcttttaagaattgtctgttcatatccttcgaccactttttgatggggttgtttgtttttttcttgtaaatttgtttgagtttattgtagattctggatattagccctttgtcacataaataggttgcaaaaattttctcccattctgtaggttgcctgttcattctgacggtggtttcttttgctgtgcagaaactctttagcttaattagatcccatttgtcacttttggcttttgtttccattgcttttggtgttttagacatgaagtccttgcccatgcctacatcctgaatggtattgcctaggttttcttctagggtttttatggttttaggtctaacatttaagtctttcatccatcttgaattaatttttgtataaggtgtaaggaaggcatccactttcaactttctccatgtggcgaggcagttttcccagcaccatttattgaatagggaatcctttccccattgcttgtttttgtcaggtttgtcaaagatcagatggttgcatatgtgtgggattatttctgagggctctgttctgttctattggtctatatctctgttttggtaccagtaccatgctgttttggttactgtagccttgtagtatagtttgaagtcaggtagcatgatgcctccagctttgttcttttggcttaggattgacgtggcaatgcgggctcttttttggttccataggaactttaaagtagttttttccaattctgtgaagaaagtcagtggtagcttgatggggatggcattgaatctataaattagtttgggcagtatggccattttcacgatattgattcttcctatccatgagtatggaatgttcttccatttgtttgtgtcctcttttatttccttgagcagtggtttgaagttctcgttgaagaggtccttcacatcccttgtaagttggattcctaggtattttattctcattgaagcaattatgaatgggagttcactcatgatttggctctctgttattggtgcataagaatgcttgtgatttttgcacattgattttgtatcctgagactttgctgaagtttcttatcagcttatggagattttgggctgagacaatggggttttctagatatacaatcatgtcatctgcaaacagggacaatttgacttcctcttttcctaattgaataccctctatttccttctcctgcctgattgccctggccagaacttccaacactatgctgaataggagtggtaagagagggcatccttgtcttgtgccagttttcaaagggaatgcttccagtttttgtccattcagtatgatatggctgtgggtttgtcatagaaagcgcttattattttgagatatgtcccatcaatacttaatttattgagagtttttagcacgaagtgttgttgaattttgtcaaaagccttttctgcatctattgagataatcatgtggtttttgtcattggttctgtttatatgctggattacgtttattgattttcgtatgttgaagcagccttgcatcccagggatgaagcccacttgatcatggtggataagctttttgatgtgttgctggattcggtttgccagtattttattgaggatttttgcattaatgttcatcaaggatattggtctaaaattctcttttttttgttgcatctctgccaggctttggtatcaggatgatggttgcctcataaaacgagttagggaggattccctctttttctattgattggaatagtttcagaaggaatggtaccagctgctccttgtacctctggtagaattcggctgtgaatccatctggtcctggactttttttggttggtaagctattaattatagcctcaatttcaaagcctgttattagtctattcagagattcaacttcttcctggttgagatttgggagagtgtgtgtgttgagcaatttatccatttcttctagattttctagtttatttgtgtagaggtgtttctagtattctctgatggtagtttatatttctgtgggatcggtggtgatatcccctttttcattttttattgcatctatttgattcttctctcatttcttctttattagtcttgctagtggtctatcaattttgttgatcttttcaaaaaaccagctcctggattcattgattttttgaagggctttttgtgtctctatttccttcagttctgctctgatcttagttatttcttgccttctgctagcttttgaatgtgtttgctcttgcttctctagttgttttaattgtgatgttagggtgtcaattttagatctttcctgctttctcttgtgggcatttagtgctatacatttctctctacacactgctttgaatgtgtcccagagattctggtatgttgtgtctttgttcttgttggtttcaaagaacatctttatttctgccttcattttgttatgtacccagtagtcattcaggagcaggttgttcagtttccatgtagttgagcggttttgagtgagtttcttaatcctgagttctagtttgattgcactgtgatctgagagacagtttgttatactttctgttcttttacatttgctgaggagtgctttacttccaagtatgtggtcagttttggaacaggtgtggtgtggtgctgaaaagaatgtatattctgttgatttggggtggagagttctgtagatgtctattaggtctgcttggtgcagaactgacttcaattcctggatatccttgttaactttctgtttcattgatctgtctgatgttgacagtggggtgttaaagtctcccattactattgtgtgggagtctaagtcactttgtaggtcactaagtacttgctttatgaatctgagtgctcctgtattgggtgcatatatatttaggatagttagttcttcttgttgaattgatccctttaccattatgtaatggccttctttgtctctcttgatctttgttggtttaaagtctgttttatccgagactaggattgcaacccctgcctttttttgttttccgtttgcttggcagatcttcctccatccctttattttgagcctatgtgtgtctctgcacatgagatgggtctcctgaatacagcacactaatgggtcttgactctttatccaatttgccagtctgtgtcttttcattggagcatttagtccacatacatttaaggttagtattgtcatgtgtgaatttgatcctgtcattatgatgttacctgattgttttgcttgttagttgatgcagtttcttcctagccttgatggtctttacaatttagcatgtttttgcagtggctggtaccggttgttcctttccatgtttagtgcttccttcaggaggtctttcagggcaggcctggtggtgacagaatctctcagcatttgcttgtctgtaaagtattttatttctccttcacttatgaagcttagtttggctggatatgaaattctgagttgaaaattcttttctttaagaatgttgaatattggcccccactctcttctggcttgtagagtttctgctgagagatcagctgttagtgtgatgggcttccctttgtggataacccaacctttctctctggctgcccttaacattttttccttcatttcaacattggtgaatctgacaattatgtatcttggagttgctcttcttgtggagtatctttgtggcattctctgtattcactgaatgtgaatgttggcctgccttgctagattggggaagttgtcctggataatatcctgcagagtgttttccaacttggttccattctccccatcactttcaggtacaccaattagacgtagatttggtcttttcacatagtcacatatttcttggaggctttgttcgtttctttttattcttttttctctaaacttctcttcacgcttcatttcattcatttcatcttccatcactggtaccctttcttccagttgatcgcatcggttactgaggcttgtgcattcatcacgtagttctcgtgcgtggtttttggctccatgaggtcctttaaggacttctctgtgtttgttattctagttatccattcatctaattttttttcaaagtttttaacttatttgccattggttcgaacttcctcctttagctcggagtagtttgatcttctgaagccttgttctctcaactcatcaaagtcattctccatccagctttattccattgctggtgaggagctgtgttcctttggaggaggagaggtgctttgatttttagagtttctggtttttctgctctgttttttccccatctttgtggttttatctacttttggtctttgatgatggtgacatacagacgggtttttggtgtggatgtcctttctgtttgttagttttccttctaacagtcaggaccctcagctgcaggtctgttggagtttactggaggtccactccagaccctgtttgcctgggtatcagcagcggtggctgcagaacagtggatattggtgaaccgcaaatgctgctccctgatggttcctctggaagttttgtctcagaggagtacctggccggctgtgtgatatgtcaatctgcccctactggggggttcctcccagttaggctactcgggggttagggaccctcttgaggagacagtctgctcattctcagatctcaagctgtgtgctgggagaaccactactctcttgaaagctgtcagacagggacatttaagtctgcagaggttattgctgtcttttgtttgtctgtgcccagcccctagaggtggaggctatggggcaggcaggcctccttgagctgtggtgggctccatccagttcgagcttcccagccactttgtttacctgctctagcctgagcaatggcgggcgcccctcccccagccttgctgccaccttgcagtttgatctcagactgctgtgctagcaatgagcgaggctctgtgggcgtaggaccctctgagccagttgcgggatataatctcctggtgtgccctttgttaagcccgttggaagagcgcagtattagggtgggagtgacccaattttccaggtgctgtctgtcacccgtttctttgactaggaaagtgaattccctgacccgttgcacttcccaggtgagtcgatgcctcgctctgcttcggttcacgcacggtgcgctgcacccactgtcctgcacccactgtctggcactcccccgtgagatgaacctggtacctcacttggaaatgcagaaatcaactgtattctgtgtcactcacgctgggagctgcagactggagctgttcctattcggccatcttggctccaccccccccccccaatttaacttttatttaaagtttaggggtacatgtgcagttttgttatgtaggtaaacatataccatatacctatgtgtcatgggggtttgtgatacaggttatttcatcacccaggtattaagcctagtactcattagtgatttttcctgatcctttcctttcttccaccctccagtctctgataagccccagtgtgtgttgttcccctctatgtatccatgtgttcttatcatttagttcccacttgtaagggagaaaatacagtatgtggttttctgatcctctgttagtttgctaaggataattatctccagctccatgcacattcctgcaaaagacatgatgtttttattttttgttttgttttgtttttttaatggctacgtatatactggctaacttctattcatcttttgttttgaaaagtcacttcttcaactcagaggactctgtcatgtggtctacattctgcaaatttcttttaccttatttaccacagaaacaaatatggaacctaatcaacaattgtagatgttcacaaatcagaggtcctttattgtttcacttttccttgatagtcaaataaaacattcatgggctttgattccaagaactgtgttaagtacagtggtccccactcccacccctcaatctaggaaaattataatcaattcttttcctcctggttgcatcttttcccaatattctcttttgcttaaattcttgatctatctggactattttttaacctcttatgtataggttccatgacattattgtccttaagttccattaaagtcctgacatggactgcttctctcttgctataattttcctcagtcttctatcaggacccttcttcacttttctacatttaccccttgagtgcctcatagtcacttcaaagttgctacttgaaaacacattgtggcaagtagtggtggttgtctacacagttttcagctttcttgaagtaaatgctttctgttttgggatcagcaatgcacttgccacaggtgatgaatcatgtctggtctaaaacttcactagtcatgaaaacctcatttctactttctaggtttttgtcttcaggtgggtatctgagtcagttatggacaaagagacataataggaagtcagccaagggcttccaagaaatattttcctcttgatacatagataaaaactgctttttttgcctcgttctctcccttatgatttgggttttgtctatgaagactgtataattgggcctagagcaccaatcttgagactggaagactgcatgtattgaagtaaacagtaagctgaaaagaaagccagtccaacttttagctactagactttatgctagctaaataacaataaatgtctgtctttctctctatatatattttgagacaaagtcttgctctgttgcccaggctggagtgcaaaggcaggatctcggcttactgcaacccctgcctcctgggttcaagcaattctcctgcctcagccttctgagtagctgggattacaggggcccaccaccatgcccagctaatttttgtatttttagtagagatgaggtttcacaatgttggccaggctggtctcgaactcctgacctcaggtgatccacctgccttggccttccaaagtgctgggattacaggcgtgagccactggtcccggccgtctctattttttaatacctctttacaggatattctgttatgtaataatcaacacagccagaattcctgcttattttcttgaacagagcaacttaacttttgtttttagttgtctgacttagatcatgcacagaaggtcatctcattaagcaacagaatatatatgtcactttgagacaatcataagtgcacttccctgacaattttaatgtacagtagtcattttatctctctgtacataatattcctttctatcatatacttgtttgttcagtatttatcatataggttttcaaatttgatgaaagcagggattgttccccttatgcatgggtgcgtttgcaggtctttgcacaacaccagattctaaaagggcctcaataagcatgtatggaataaacagctgaaagaatgaatatttaatctagtgtttctttgtttgtttgtttgtttgacacgaagtcttgttctgtcactaggctggagtgcagtggcacaatctcggctcactgcaacctgcgcctctgggttcaagcgattctgcctcagcctctggagtagctgaaactacaggcacaagccactatgcccggctaatttttgtatttttagtagagatggagtttcaccatgttggccaggctgttctccatctcttgacctagtgatctgcccaccttggcttcccaaagtgctgtgattacaggcatgagccaccgcacctggcttaatctagtgttttaatgagttgcagtggagaagtcaacacttagtagattgtcttcttataaggattgccatttgaacagtcttgaatgttcagaatagttcataacccagaagaaatggggaaaattagaccttcagagatagcatgttccctgttcctgattcatcaattgtgaggaaatttaaaatgagtgtctggactacatgattgtttaagtcctctctatttttattttattttattttatttatttattttgagacggagtctcgctctgttgcccaggctggagtacagtggcgtgatctcagcacactgcaagctccgcctcggcctccatggttcacaccattctcctgcttcagcctcccgagtagctgggactacaggcacccaccaccacacccagctaatttttgtatttttagtagagatggggtttcaccatgttggccaggctgatttcaaactcctgacctcaggtgatccgccccactcggcctcccaaagtgctgagattacaagggtgagccactgcaccaggcgacgtcctctctattttaatatatttcaatcaagaaagcctcatacatctaaagataatatgtattaataaaagccctctaagtatgaatctagtaaatgtggagaccaaaattgcataagaaataatgagaaaaggtttaaatggtgggaaatgagacaacatgaaaataatttgtttagccttacattttacaaaacttagggtataattgcaatgtttgaaaggtacaaaatagaatgctcgctctgaacatatgacatctgtcacttcaattgtatataatgatgttaaagagggtaattttcataagattatacaaggatattgttgattttccctgaagtcttttagaaccatcaattaatgtaacaattatatttttaagcaccttgtgcagaggagagggataggcatgtcaggagaggtttgaggagggattaattttgtaggtagtcagttcactagtgaatattttattgtatggaaaattttacttctctacacagaatcataaatataacaacttggataatacataccagaataatgagactgccttgtactttactgagtttgggattaataattaatactatgggtagacagttttccaaattcatgattaagttttctctgataacaaaagccatttttcaacttttatttctttcaagaagcatacccttgattaatgtttcagtatatcctacagggtcattaacaccagtgtaccagaggaagatgaagagaaaatatttctgcatagagaaatggtatatgacctcaagtattaaaaatgaattctagtatcttagataccaatcttataagtgaaaatcctcttttgagctgcaaaagagaactagtgtgctattttaagatatacccctttaaaacagttttagggagtatataggactggggtaaagaacagagtcttgggagtcagcattcttatatcaattgagtttgctaatcttgggcaaagagggaaattattaataggtagtacgtcacttctaaattctttttttaatttttatttattatacttcaagtgctagggtacatgtgcacaatgtgcaggtttgttacatatgtatacatgcaccatgttggtgtgctgcacccattaactcgtcatttacattaggtatatttcctaacgatatccatcctccctccacccaaccccatgacaggccctagtgtgtgatgttccccttcctgtgtccaggtgttctcattgtttaattcccacctatgagtgagaacatgcggtgtttgtttttttgtccttgcgatagtttgctgagaatgatggtttccagcttcattcatgtccctacaaaggacatgaactcatccatttttatggctgcatagtattccatggtgtatatgtggcacattttcttaatccagtctatcattgttggacatttgggttggttccaagtctttgctattttgaatagtgccgcaataaacatacgtgtgcatgtgtctttatagcagcttgatttataatcctttgggtatatacccagtaattggattgctgggtcaaatggtatttctagttcgatatccctgaggaatcaccacactgtcttccacaatggttgaaccagtttacagtcccaccaacagtgtcaaagtgttcctatttctccacatcctctccagcacctgttgtttcctgactttttaatgattgccattctaactggtgtgagatggtatctcattatggttttgatttgcatatctctgatggtcggtgatgatgagcattttttcatgtgtcttttggctgcataaatgtcttcttttaagaagtgtctgttcatatccttcacccactttttgatggggttgtttgtttttttcttgtaaatttgtttgagttcattgtagattctggatattagccctttgtgagatgagtagattgcaaaaattttctcccattctgtaggttgcctgttcattctgatggtagtttcctttgctgtgcagaagctctttagtttaattagatcccatttgccaattttagcttttgttgccattgcttttggtgtttatacatgaagtccttgcccatgcctatgtcctgaatggtattgcctaggttttcttgtagggattttatggttttatgtctaacatgtaagtctttaatccatcttaaattaatttttatataaggtttaaggaagggatccagtttcagctttctacatatggctagctagttttcccagcaccattttttaaatagggaatcctttccctatttcttgtttttgtcaggtttgtcaaagatcagatggttgcagatgtgtggtattatttctgaggcctctgttctgttccattggtctatagctctgttttggtaccagtaccatgctgttttggttactatagccttgtagtatagtttgaagtgaggtagcataatgcctccagctttgttcttttggcttaggattgtcttggcaatgcgggccctttttggttccataggaactttaaagtagttttttccaattctgtgaagaaagtcattggtagcttgatgggaatgccattgaaactataaattaccttgggcagtatggccattttcacgatattgattcttcctatccatgagtatggaatgttcttccattttttgtgtcgtcttgtttccttgagcagtggtttgaagttctccttgaagaggtccttcacatccctcataagttggattcctaggtattttattctctttgaagcaattgtgaatgggagttcactcatgatttggctctctgttggtctgctattggtgtataagaatgcttgtgattttcgcacattgattttatatcctgagactgctgaatttgcttatcagcttaaggagattttggcctgagacgatggggttttctaaatatacaatcatgttgtctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagggagtaggtccagtttttggccattcagtatgatattggctctgggtttgccataaatagctcttattattttgagagacgtcccaccaatacctaatttattgagcgtttttagcatgaagtgttgttgaattttgtcaaaggccttttctgcatctattgagataatcatgtggtttttgtctttggttctgtttatatgctggattaagtttattgatttgcatatgttgaaccagccttgcatcccagggatgaagcccacttgataatggttgataagctttttgatgtgctgctggatttggtttgccagtattttattgaggatttttgcatcgatgttcattagggatattggtctcaaattctctttttttgttgtgtctctgccaggctttggtatccggatgatgctggcctcataaaatgagttagggaggattccctctttttctagtgattggaatagtttcagaaggaatggtgccagctcctccttgtacctctggtagaatttgggtgtgaatctgtctggtcctggactttttttggttggtaggctgttaattattgcctcaatttcagagcctgttattggtctgttcagggattcaacttcttcctggtttagtcttgggagagtgtatgtgtccaggaatttatccattttttctagattttctagttggtttgcatagaggtgtttatagtattctctaatagtagtttgtatatctgtgggattggtggttatatcccctttagcatcttttattgcatccatttgattcttctctcttttcttctttattagtctggctaggagactatcaattttgttgatcttttcaaaaaaccagctcctggattcattgatttttttgaagggctttttgtgtctctatctccttcagttgtgctctgatcttagttatttcttgccttctgttagcttttgaatgtgtttactcttgcttctctagttgctttaattgtgatgttagggtgtcaattttagatctttcctgctttctcttgtgggcatttagtgctataagtttccctctacacactgctttaaatgtgtcccagagattctgatatgttgagtctttgttctcattggtttcaaagaacatctttatttctgccttcattttgttatgtacccagtagtcattcaggagcaggttgttcagtttccatgtagctgagcagttttgagtgagtttcttaatcctgagttctagttttattgcactgtgatctgagagatagtttgttaaagcttctattcttttacatttgctgaggagtgctttacttccaactaggcttcagaagatcaaacttctccgagctaaaggaggaagttcgaaccctttgaaaagaagataaaaaccttgaaaaaagattagacaaatggctaactggaataaccactgtagagaagtccttaaattacctgatggagctgaaaaacatggcacgagaactacgtgatgaatgcacaagcttcagtagccgattccatcaactggaagaaagggtatcagtgattgaagatcaagtgaatgaaatgaagtgagaagacaagtttagagaaaaaagagtaaaaagaaatgaacaaagcctccaagaaatatggaactatgtgaaaagaccaaatctacatctgattgttgtacctgaaagtgatggggagaatggaaccaagttggaaaactctctgcaggatattatacaggaaaacttccccagcctagaaaggcaggccaacattcaagttcaggaaatacagagatgccacaaagatactcctcgagaagagcaactccaatacacataatggtcagattcaccaaagttgaaatgaaggaaaaaatgttaagggcagccagagagaaaggtcgggttacccacaaagggaagcccatcagactaacagctgatctcttgctagaaactctacaagccagaagagagtgggatccaatattcaacattcttaaagaaaaaataattttccacccagaatttcatatccagccaaactaagcttcataagtgaaggagaaataaaatcctttacagacaagcaaatgctgagagattttgtcaccaccgctcctgccctaaaagagctcctgaaggaagcactaaacatggaaaggaacaaccggtaccagctactgcaaaaacatgctaaattgtaaagaccatcaaggctaggaagaaactgcctcagctaatgagcaaaataatccgctaacatcataatgacaggatcaaattcacacataacaataaattaaccttaaatgtaaatgggctaaatgctccaattaaaagacagactggcaattggataaagagtcaagacccatcagtgtgctgtattcaggagacccatctcatgtgcagagacacacataggctcaaaataaagggatggaggaagatctgccaagcaaacggaaaacaaaaaaaggcaggggttgcaatcctagtcttggataaaacagactttaaaccgacaaaggtcaaaagagacaaagaaggccattacataatggtaaagggatcaattccacaagaagagctaactatcctaaatatatatgcacccaatacaggagcacccagattcataaagcaagtacttagtgaccgacaaagagacttagactcccacacaataataatgggagactttaacatcccactgtcaacattagacagatccacgagacagaaagttagcgaggatatccaggaattgaagtcagctctgcaccaagcagacctaatagacatctacagaactctccaccccaaatcaacagaatatacattcttctcagcaccacatcacacttattccaaaactgactacatatttggaagtaaagcactcctaaattcttgttctatctcatgagagtttggtcacctttgaaatttgaacaaactacaaaatttctttgaatctcagggatttatccttttggaaatttatgcccagtttgtagacttcattagagggataaaaacaaatgtctgcaacgtatctggtatagttggtgctcagtaattttattgaagactacctattttttgcaaataaaagttaaaataaaattctattactaaatcaactccctataccctaacacctatggtcctaagtccaacatatacacttttacaacagttcacgccatagacaggaaatggatatcctggggtagattttttttttccttcaaaatactagtctttttcagctcctcgtacagctttgttgatgcctatatcccttgttttggttactgaccctgggtctccttgcctgggcacctgatttctgtagcttctgttcattcacattcatttcagatgctcttataatttctagttcctaatcttaatctagcttcaacattgccctgcttgcaaatttactaccttttaaaatgacttgaatcttctctattttcacagttcttgtctattttttccctgtaacagtttgtatgaacactaatgtggtgttcaaccctccctttcaattttagagaattggattctatattggaacgtcacttaaatttttgagtcctcaaaaccaaccttgttgaaatggttaataactttgtgaagcatgttgtgactagagaatagtgctttaaaagctataaggattagtgttgttatgaatttgacatgcattaacatgaccattgttaatggacagcttggtacttaatctcccaggttggttaatttatttagacttttgcctacttactttagaaatggatgtctagccatctgctaggcaattacagcttagctgcattgacatctgctttccttcattcttatagacgactgggtgcttgaaaaggcaaatatataaataacttctccaaaataaacagtactctaaaatataatacaattaattacatttgtgcttaaagatgcccactaatttttatatggatacttaaagaaattgcaagtaattataatagaaatgaacaatgatttatagattatatcataatgtcatttatttttagtgacagttctgtgaattatagcagagatcatcatcttccataaggagatattaaggatccaatacattaaataagaggcccacatttatacagtttggggttctagattataaatagatatttctataattatcaggcccctgcagcaatgcaatagaatggcagggaggaggaggaggaataatcaaaccactttgcttttaccacagaaagacagtcagacattaaaatgaattaaagtcaattcatgtttttatttagctcaggaaaagcattcatttaaatgacttttgcaaaaatctttttattatggttatttgctcagagtttaaaataaacagaaacctctcaaagaacaaacattacttatttaatagtgtaactttacccgtactggggaacataatttattaatagataacattggttctgagtgattcagcaaaaccacgatggatgccacttgaagtcacaacaattaaagaagcttaacagaatggcctcagtttctatggtgacagttacagaactattcagggatagcatgaaacacataaaatattgtgttcttttcagaaaatgatctgtgacagatttatttaaaaatagaaaatagaaaaaattatactcaaacttatttcactcaataacatctgtatttaggagttagaatttaatataaatacattcagtatggagatttgcctcagagattcacatggaattaaaaccaaaaagtttatcaccagatttcctacatttcactgtttataaaagacaagtaggttttattgtcttagaattgatttgtcctcataaactaggtgtgatttcaattttttcagatatttatggagtcttcaggttaacattgaatgaatgtattgtttattttagttaaacacctctcagtttaatcaactatgattcattcaatcaatattttcctttaaatagattgaaggtaactaaagaaaccttaaagaaaataaaagtcatcggccaggcacagtggctcacgcctgtaattccagcactttgggaggccaaggtgggaggatcatgaggtcaagagatcaagaccatcctggccaacatggtgaaaccccgtctctactaaaaatacaaaaattagctgggtgtggtggctcatgcctgttgtttcagctactcaggagtgctgaggcaggagaatcgcttgaacccaggaggcggaggttgcagtgaaccgagattgtgcctctgcactccagcctggcgatagagcgagactacaaaaaaaaaaaaaaaaaaaaaagaaagagaaagaaataaaggaaataatagtcatcaaatacatagaaggaaagagagaccaagataaatcattatttatttgttatgatttctaaggtaacaatgttgaaatgctaataatcaaagtaacattacaaagttatattttattaaacaacaaacttttaacaacagtactagtcatccacattttgcatggtaccttgttaactgaaaaccaggcatattggaaccatgtccttgctttgatttaattttagttacacagaaccatgcaaaatgagaacatagttctgatacatatgagtttcagttaacatggtactatacaaaaagaagcctgtttgtatttacctgttagataattcctatattatgctatgaagacaaagcaagccagaaccattcatcagtattaatatatatggggtgtatggagagtattttgttctttttttgttattacatcctcctcataactaagaataaaaacacatgtttacaatatattttagctacagaatttttatagtacatcttaaacaatttacttttacaaactatttaaacttgttgtttttaaccttgccagattccacaaaagagaagaagtagctcaatgcaaacatatgtaacgtgataataacctagaaattgaataaagaatatcaatataaagccaaagaagtacactaattactgtatttgttatgcttcactaacgttgcataacaaacagctacacatctcaatggtcactggtctttggaataactgtggttctgttttgcttgtctggattaagctaaagagatgtaacttggctttatctaaaggtgggattcaggtctagtatacctgtctcctaaatctggcatcagcagctattcagggaaggttcttctcatgagggagtgcaggaggacaagagggtgagatggaatcatgaacagtctcttttttttttttttgagatggagtttcgctctttttgcccaggctggagtgcaagttttgatatacttgctataattgagccttaatgtttattttggttctagtaatccccacttatccatgggggataaattccaagatccccagtggatgcctgaaaccattgttcatatcaaatcctatgtatgctatgtttttgcctatacatacatacatagatacttatgataaaatgtaatgtgtaaattaggcacagttggagattgacaacaataatgaataattaaatagaacaataataacaatttactgtaataaaagttatgtgaatatagtctctccctctctttcaaaatatcttattgtttgtaatattttcagactgtgatcgactgtgcagtctgaaactgtgattgactgcgcagaactgaaactgcagaaagcaaaacaaaagataagtgtagactactgtataatgacattaaaaataagctgaaacactgacatttacatagttcttattatgttcagaatattaacattttgataaagtttaagttgagagtatcctcatgaaatctgatacatacaatagacttgaagtataagttacaaagtcttaactgcctcattgtaaattataatggcatgattattccatcaacaattgtttggtttaatattatttcagtgaagacaggtgccatgcattttagatgataaaaattctaagtcttgtctgtgttttccctgaaatgaatcaagggattaatgttttccatgcctcatattctttaagtcttcatattcacatcacaaaaagaattaaatagaaaagaaattctttatatgtgttttaaatacttacaagtcttatattgttttagaggttacaggtattatagagaagtgccacttaacaatttaaatagaggcagaaatgaagacaaagattaaaattaggcatcattttctcataaaacgtgaacagactttttaaaactccacttataagttttaaaaaatctctctgcaattgatgagttgattatgtaataaatattgaagccctaattaattatttggaaatctttatcaataaataagccctatgtttctaaaaatagttatgaaatatatatgtgtgtgtatatgtatgtgtatatgtgtgtgtgtgtgtgtgcatatgtgtgtgtttgtgtgtatttgtatgtgacattttaaggctttattaccatatggctgaatcgatgccctaatttcaaattgttaatttggtactgtcttttaagtgcctactatatgcaaggtacatataccaaatgtatgtcttccaaattcccttgttaaaaatcacctgcctcttactcaggaactaccaagagatctatttcatgtctctatatatgaaatgctgcccttaccaatgctgaagtgtctcccattttctgcctatttaaatttctttgatttcttagcaaaaactgtgcatgtgtaatgaaatttgggacactagttaatggtgcttgaattaaactcttcatttttctttataagcttctcttggtttctggacatgccttgtgattaatatcaatatatatgaattactcaatggttttgtttttatttttttcacactatctatttgcctgagcttgtatgtcttcataaccagttatgaccaaacctgttgttcaaccctggttcataacaatctaaccaaaatggtatcataactccaggagcagaagaatttttgtcagatcttaatgacaattataagcaaggaaaaggataaatgaaattacatgatttctcatgttccatcatagcttgagcttttagggcaccctctaaaagaactatttggactattttgctatgaccaagccatcagttgtttctcctttggggttaattcagaaagcagctaggaataagtttatttcatggaaaaacacaaacatggagggaccaaattagtcatttatggggacaattagattttaaaattgcaattttatacactacataaaatcaaagaagagaaatttaaaagtactgcatctaatgttcctttcttattaatggtgttttctgttccagtcaccattttggctttcttcagagtttgtaatcaataaagaccctggcgtttgaagggcatattattctttttccctttttttcatgctagaaacatcatctctatgagttcatcatgtactcgattaattctcaacagctgctctttaatattattttgaagccccagatagttgatctgtgttttgaattacccacagtgttctaaaatgggcatctatatgtgatttttataatcaggaaaaaataagagtgagaaaaggtcatcatacttgatccacattttttttttttagacagttttgccctatcacccacgctggagtgtagtggtacaatcacagctcactgcaacttccatctcccaggatcaagtgactctggtgcctcagccccctgagtagctggaattacacacgtgtgccaccacgcccagctaatttttctattttaacagagtttggatctcactatgttggccaggctttttttgaactcctggcttcaagtgatctacccgccaactcctcctaaagtgctaggattaccggcgagaaccactgctcccggcccacatcttttgtttaaatcatatttatatcattttacctggaaatagcattacagcatagacttggaagagaagcagccaagaaaacaaacaagcaagaaaacaaacaaacaaataaattaatatttttattataaagtttgaagacctattctggtggcaatgtgctatgtgatttcgaaattatgcccaatataggaaattaacagtagccctgcattgcttcagagttttattatttttctaagtaaaatatatatgatgataataattgggaaacaaaggaaaataaaataaaattctgactaaaaacaaacaaaaaataagattgtttctgaaggagaatatggctctatatattctatataaagaatatatagagcaaacaagtatagtctaacttaatgaagtgttttcactcttgtcattttaattggaaaaaatttattctagaaagtaatatagaaagataataaaatgacatatcgatgaggaatttatccctttgtacctttgctgaccttcattacagattcatttttaaatcattttgttattgatggtaataaatatatttgatattcacaggaatttcacttgaaaaagataaaagatttcatagtagtaatagaatgttggctaagtagctaattattgcatacttaaatttccggtctttaaagtgacaaaaattctagatcttgcaattaacgatattaatatgtgttgacataaaatgagactgtgttgatctaggggtgataaacactgccatttttggaggattatgttttagcaagtaaattgtgtcctttgacttaataataattgcttctcgtttgtctccactcttttcgttttgcttcgactgtccacaacaaccagctttgtcctctagaagcattttaattttatctatgacagttcaactgttactctctatgctcacagtgggaaaatgtcagtggaaaaatatcagtataaatatgatttttgtaagatgcaaacattttgaaaatataatctatatgcccacttgtcatgtgtttctaagctgtactatgttgttgtggaaaacattggaaatttattttttaaagtcgcctagcagatgaaggaaacacaattaagatgatcttttcctaaatatactttggccctttatatgtagactgcagttatatttttatgtattgtataccttgttaattatccaaaattatttttttaaacttgatgttaaattgctttatagaaataaatttatcatcttttatcaacggttagctgtcataattgctgataggactaatgtaataattacatttttatcttaaagaattctgtaggtttgtttgaacaatccagacacaaaactctaccatatatatcaatcaaatattttacaacatataaaattatagagcaaaatatgacattttaaaagctgaacattagtaattttagattttctgaatacatcaattctcacactgctatcaagaactacctgagactgggtaatttataaagaaaagaggtttagttgactcacagtttcataggctgtacaggaatcatggctagggagacctcaggaaacttaccagcatggaggaagtgtgaaggggaagcaagcaggtcttcatgtggcagcaggagagagagaaagagagcacaaggggaagtgcaacacccttttaaacaatcagatctcttgagaattcactaactgtgaggagaagaacaaagaggaaatctgtccccatgatccaatcacctcccaccaggtccttcccttaacattggggatttcaattcaacatgagatttgtgtgggtgcacagagccaaactatatcactaaaagtttgtgttctctaagtagcacagcaaattgtacataagaggatctaagcaaatattctgctactattgtcagaagcggtggacaatgcctcaggtggatgttgagggtggcaagatgacagactatagaaataaattacttcactgggaaaaacaccactttttctcaaggaaaaaaaacaagatcgaagaagagaaaatgcataaaagcatttgagaaaaaatatacatatatgtatatatcttggatatttatttttaattaagctgacttttaaacacagagctcttttaaaaataatccttttaaatctctttataccagacagactatagccagaacaaatagctgaaacttctggcttttaagccatttttttttctttcctcaaaggtgttttctcaagtgaaaccaataagcatcactaaggttttctgacttaaccacagatgcacaagatgacttcggagagatgccaagcatctagaatcaccgctaaggtagctcagagaaaagaaaattcacgtcagaaaatcagaaactgtacatggagggaaaaagaataaataaatgcaaaagtcctacaagtgtcaaaccagaaaaaactgagtccctaagccaggaattgaaccctagccatcattatgaaagagcaaatctttagctactgagctgcagtatgagatgagtgttatattgttttttcccagaagaaggctagaacagtcatttttgagcttgcaaagggtacacctttacaagggaaaagaaactgatgtaaagctgagacgtcttaaaacagattttagaattaaaagtcagtatttcttgtggtcttactataagcgaaccaatacttaaataagaaaacttgttttaacacaggggaccaaaatttagaaagattattattttttctttttttaattatactttaagttttagggtacatgtgcacaacgtgcaggttagttacatatgtatacgtgtgccatgttggtgtgctgcacccatcagctcgtcatttaacattaggtatatctcctaatgctatccctccccactccctcaaccccataacaggccccagtgtgtgatgttccctttcctgtgtccatgtgttctcattgttcaattcccacctatgagtgagaacatgcggtttttggttttttctccttgcgatagtttgctgagaaggatggtttccagcttcatccatgtccctacaaaggacatgaactcatcattttttatggctgcatagtattccatggtgtattataaataaattttatttcagttatggctaatttaattatatataatttttaaaataagctccctttttataaaccttatcatgacttacatagatcatctatgacatgcttagactttttgacttatcgtatacttttttctttcctaaaaagtcattctactttaggacaagaatttaccacacatgatcctttctcatataacatttatttccttttacctttatcaccaaaaatacataattgtattcataacctttgcatttttctttcctactgattttttatctttttcacttatttctgatttcttcttaaatcgatattttaagacccacttttaagtaatgtccaattggccaattttttttcaataagatcatatcttctttggcatatttcatatacagaattatatacaaatttttattaatcctaaatttccatgaacttatcacatgaacttgaaaaatgcttggacttaacttatgaatggtcttttatttataagcctgtttggcactctgtagacacaatatataacataatgaaatgtacatacacataaacacatctagatatgtatacacacacataaacaaagatccaatagcttttatcttaggactctagccatgaaataataacacaaattcactgttttataaatgatagctggatccaaattctctctctaaaaaactgggacttttccacatggctaagcttgatttctaatttgaatttttctgattgcctaaaagactgcctagtgactagttcttcgggactggccattgtctccatgtctaataaggatctattagacaaaagtttttctaagtctagcaagagctcagttattttcctctcaaattctcacctcatatagcaaagtgtaaaataaagtgacaataagaaaaatggtaaaaatgtgtaaatttgtagaaatgctattacagaaaatgatgactttaggatagaaaacaagaaaagggaaaaccatgatgtccttagggtggactctaactcacaatcctagagagaatgccaattccaaacattgcagagcatccaggggcagccagtggtattaaatgccaaaaaacccagagtatccaaatatcaactaacaagggtccctgcaccaaatgccaaaaactgaaacatctttgggttgccaatagtgaaccccaaagacactaggcctaaaacaactggggccacagaacaacatgattttggcattgcaaggtcaacacaacaggagacatctcacaaccaagtgtcctgccttaaaccattgcccaaataggtaaagcaaagactacaaacacgataatgaaataaacataagcatgcattttggcactaagaacagaaaagtaaaattgccagttattagaaatgaacgagaaaaggtctgagagaaggggcaacagatgggctacaaaggacttggctggccagacgtgctcccatctggggcacccagacaatggcagactgcaactgggcttcaaagccagaagccttacggccacttccccatctgtccaaaataaagaatgtagggaaagacagaggaaccaaaatcaaagcggggcagggaaaagacagtaagttgaatctagactatgggagacccacccaccaattaggtctaagtgatgctgattgatcttaatttggggtcttgggggatgtctccattgtcacttcatcagtcatcagaaaagatgtcacagagtgagccctgagggctgctgctgattggctacttttatggtttttttgatcatgtgctaaacaaggcgtggattattcatgagttttggaaacggacagggcatttttgaaactgagagttcatctttctttcagaccatacagagtaacttctggatgttgccatggtatttgtaaactgccttggcactgatgggagtttcctttagtatgatagtatattataatttgcatataatgagcagtgaggacaaccagaggttgctttttttgccatcttggttttggcagattttcgccaacttctttaccgcatcctgttttatcagtatggtcttgtaaaacaatcctgctgaattcctaattcactcccattaaagtctcttagtcttatttaaccgtttgggtaaaatttctccccctctctccttccacagtactttgatcttatctctgtaatacacttacaactttgtcttgcgattctatttgcatgtctgtttagggacaaagggatgttttattcaacttctaccctctgtaccttcctcagacctagcacatgttgttgctcagaaaatgttgaattagtgtatgagcacaagaagcagagttttaaatattctagtcctctatgtaggttatctgtatattgaaggaaatttttcccaaagggataacattaagtaaagccaatgattattaaaattttttttcagaattttcatctagttaattttcttataatcagaaaaaaatgcagttcagaaaatattttttcatgtcatgagcaaaattctagtaaagaaccagaagtaaaatataaaatatgcatatgtttcttgtttgtgtttttgaaactgaagaactcttgtggttggcttgtatttcaactcacattttttaattcatccaaataaatgtttttcagcatttaaatattaactttaggccgggcatggtggctcacgcctgtaatcctagtgctttgagaggccaaggcaggtggattgcctgagctcaggagttcgagaccagcctaggcaacatgatgaaaccctgtctctactaaaaaatacaaaaaattagccaggcatggtagtgtgtgcctgtagtcccagctattcaggaggctgagtcaggagaatggcttgaacctgggaggcggaggtcacattgagccaaaattgtgccattgcactccaacctggatgacagagtgagactccgtgtccaaaaaaaaaaaaaataaataaataactttcaaaaataacaagaattgttaaacattgttaaactaaataataggttctatgctacattctatatttcactcacattgcttttcattttggacatcaggtattctttttaagcttgtatgccaataatttggttctgttcctaaaaaataaatgaatagatttggttgacgcactctcgtttcagttctcttgtctcaaataaaatctttaactagttattgcatacgtttactatcttttattcaaaattttgacaactaacaaggaaaactgaagaattaaatgaagcataaaggaatgtggttttgtacacagaaataaaatccaagcatgaaagaacacactagttttgttcttaacactgattgctatttgctaaaacagcagtgattacttctttcctgcatccgcaataaagtcataatggctcagaacaaagcttaaaaaaaaatagacatgttgaaagttgtgccattattccttactgcccttcctttgtccctgaaaaatgcaaaaaaaaaaacaataagaggcttgtaagagagaaaggagaaaataataaagaatgatagaggactttataccgtctaaacattatttgaaaaaaacatacaactattaaatttcaaactgtgacagttaatctctgtgatttttatagtttatttttcttacatgaaaaattgctacattctttctggacaagagaaattgagatagagatagaaatatatatatatgtatcatatatagaggtagaaaaagacaaaaatacaatcatttcatacattttatagtctataatggtcaatttaagctatacagcagttattcagtatggaatattggagagaaagagataaaggtatgattttatgtatatccattaccattcttttttaatcaaggtaggactgttcctcatctggccacttctcttcagggcctctaaattgtgaatgccaggagcaaatgtaaaggctaatttcgatgattactttgaattcttttttagttgtgctagctttcatttctacagaaaatctgcttttaaaagatgatttccattttctaacaaacatttgacaactcagtgagaagattcaattttattttatatagatattttatattttatatggatataatattagtaagcatgaacataaaagaactctgaaaatgaagaattttcataaatgtaaccgataatgtagtgtgcttatatagaaataccttagggctgaaatgttaattcatgtgtgaatctggtttcattgtgtggttttaggttaaatatatttaattgtttatcttttggttggatgactgggaaagtaatggatgcacaagaatttttaggattttggaaaaattgtactgaaaattgcctctcagaaaagcagttacgttgggtatacagtgagtataagaatgaagttgttcataaaatctaataaaggaggaataaaatttggttagtttggtctatttatctatacattcatttatctcaccttgaatgtccttcaacaatctggtttattaaaattaaagttgtcctttttctggattttttttcatttagacctcacagacttgttcagtttgtttctagatgaaacaaacttgttatcttgctcacatgaggtttcttccccgctacatttggaatcatttaaatttttctctacataggaatcctccaatctttctcagcgttatagcatttgggcctaacctccctcaagaaaggagcaaactctaagtgattccatatgtcctcctattgaaaatcattaattccgagctttagtatagtgatgagacatttagggaacatttgggtattgctgtcaagtaattttattgcctccttcatgaattagttccactacagtatcagatgtaatggagactgttgaagtttcattactggtaaccgggtgatctagcttaattatagtataattaatatcttttttatttaaaacataatgctgattttaacataattaagcacttaagctcattgacaatagaaataactttatcttaaaggttgattgtcttatctcaaatactataactaaatttggggtatctgatttcttgacatttgctaaacaaccttactaaaataggattagcatatattgttttaatatatttcttttttaggaaactttgaattttaagatattttgttaagctaatatgtgtgtgtaaataaataaatcacacacacccatttaataaattaaaagattcagtctcaggtggaaatcgcaatcatagaagagtttgggaattaatacgtttttgctattgtgtattttcacatatgtgtgtcaatgagtatgtggatgtgtttgtgtgcaaaaagagcgttttttatagcataaagtaggtaattgtttcatttaatatctaagcagaaggccaagttttacttcacacttcctttttagaaggtttagacatatgaagtgcaaggattcttctgttaaagaataatattccaggagactttgtctacagcacctgggaagtgtaataaaaaacaaagaataataagagtgatgcattgttccatatcctataaaagaactttctgaaatttgctaagtcgtttgccatctacatgtaagaataagacagttatactgattaaaacaaggaattgagtcatattttctaccactacaattgcaatcattttttttataactatgtgaaatgcaatttccttaagccaagtaccatctttaacctgaaagtgtaaacccttgacttagaacaattttagagattaaccttttcattctgccttcttcctgtcagctgatttctggatcattgtgcttgaacgttattatcacaattatttcctgattttttcccctcatttattagttccagttgcatcctgaattacagcagaatgatggttagatgtatattgggtttactcatgtcaccttcactgctcatagctgggtgggctagcacattgattagcatacttgaatatttaaaacgtgctttatagaactaaatatttgggttatgaatattaacatattcaatgaatatagaaacaattttatctaaccaattgttttgctatctcaaaaatcataactaaatttttatgggacatagtgattaaatctgtgtctaaaagcaattaatgccctatatctgtagtaatgtcagattttcatggtttattaatctcacagtgtgctagaactttaacatttctccttagatgtgctcattcacattggaacataagatatgatattgaaagaattcttaaaggacaaatgcaggcaaaaataaatgaaatggaataaatatatcctataatatgcagaaaaatattccattaccaataacgtcatgcattttaaaactctattcttttaggtatttattgctttttaaccttcgctgaaatgagactgagatcaataaaggtattaaatggtttctaaatagccaaaatacgcaagtatttttgttttctaaggtgaattctttagtgaactttttgaaatgtaataattggcattgtctttcaagttaccattacaaaaacaagtgagaattaaagtagaaactataacattaattttttttatgtcttatcttaaaaataaacccttggaacatacatttcaactggcttaatcacatatgagacaaagaaatgagaagttataactaggcaagtcctggacttcaacgttgtcttttccagcttttccatgacactattgcaatcaaatgttatctttctttcatgctttggaacattcctattgcaacaatgaggagaagaagatttggggaaatatagcagattaagagcttgagctgtgtgctgctgccatgagcagccataaacacctgctcactgatgacatctcatagctagtgttataattgaagttgtagtgatatctccagagagatcatagagcaaaggataggcccagcagtagaaaaagactctgggccttcgtggtgctcagtaagagttgatgatgagtcacagtagcagggtcctggcccagacctccgatgaccacatggacaaggaagttgatgcaggggaaggagtctgtgagccattgtggcccaatgagcacatcctaactcattctaatatgaaaagattagggagatgaggaaaaaccagcaaagagactggaagggagttgccaatgagatggaattggaaactgttagcaggaaagtgtttctaccacaagggagtaatcaaccaactcaaatgttactgagagatagagtaagatgaagctagaaatcagtctgggtgcagtggctcatgcctgtaatctcaccactttgggaggccacggcaagcagatcatgaggtcaagagattgagaccatcctggccaacatggtgaaaccccgtctctactaaaaatacaaaaactagccgggcgtggtggcacacacctgtagtcccagctactcgggaggctgaggcaggagaattgtgtgaacccgggaggtggaggttgcggtgagccgagattgcaccactgcactccaacctggtgatagagcaagactccatctcaaaaaaagaaagaagataaaaatccttggtaacttcaacacagctttacgttggtgaagattcaagtgctattcgaatgagttcagagacaatagactaaaaggagttagagttggtgcatataggaaaccctcaaccagttttgttgtaaagtggaatagataaatgaggcagtatcttgagagataattcaggttcaggaatttttctaaagataggtgatatagagctcctgtttggatgctctgcagataataaaagatgaaagatttatacaatctgaggagaaagcagagtatgtgcttcaagtaataacgtgtaaagagaacaaaatgatggtatgggaggcagaaagaaaataattgatgagagaggaatttctcaaataggtataaggggaggtaatctagttaacctttagaggggatggcttaaccacaaagaacccagacaaagaggtaagcaaatatatgataacatccttgtaggtatgaatatgtggtggtgggtttgagaaagttttgtttgttctattttctgtgaaacagaaagcaaggtcatcagctgagagtgaggatgagataagaggtactggaggtttgagaagagagaaaaaatgaatacccagtggtccaggacaaggtcggcaaactgggcaacatacatatttttccgtagatatgtggtcacagatcattttttaaagttcactttcaaaatcctcttcttcatgatgtcatctctaaaactgatctgcctgagaatggagatgcaatataggcttttctttcccacctctcctttcactgtctctactccataccccactccttttctgggttctactatggtgccttgtctctggttggtaaaatttcttgaattccaagcaaaaaaaaaaaagaaaaaaacagtatcaggaacaaatccttttgaaaatcaaatggtttataaattctttgattttatcaatactgaggaagggcttaatcaatataacatgtgttagataactaggtattacatttgatgatttattgttatgtgatttttggcattcttagtagttcaacagactgacagacatgcctataacaagactccttccattctcttctactttcttattcttatgtctgtaagatggataatgaggatagaaatgacatgaacctatgttaattttagcaataattcaaatgtgaatcagaaaaataactgaaaatatgtttgtatcttacactgtgatatattccaataaaatgatacctttgtacttgataattactaatccaatcacatttagaataattactgatctaatcatatttagaatatgtttatctattttgattaactgtaaactgctaataattgcaataagtcattatagtaggaaacaatacttaaagcttaatggtcacaaaaataatttgtgtaagtaaaacatgtcttcttctggacaaataacacatttatttatcagaaattaaatcatttataattattgaatttatggtaaaattcattgatttcatattaacaaatgttgaagttatagaattttttataattattttagaagattcacaagcaaagccgcttgtgggtaactggtagaggagtgtggcagaatgtgtggactagggacatgaagtaaacttgtaaacttgcccagcaaaacataagactcacttgaggttaaagggcatgaatgtaagggaagtctacttagcatggttttatgtttttcttccatcatgttcagttgcgtaggtacacacatggagtataaatagtactgcattttaacaggatggttaggccaaagaaattgaggatgtatgaataaagcggtatggtgatgtaccatggaatttatgctgtgcaaagagggaaggaagacaggtaataggtaagaaccactgaaacaactgatttcatcaatgaattgtagctctcttcaaggtagaaaaattattgcaatctggaacctctgataatgagcatgtcaacactggaatgtctgaaattgcagtatttgcatgagttgcagttatgaaaacaagatccaaattttactgatttcatagtattttgtctttttctctcgattagaatgcagaatatgttagggcaggtatttttgtccctcctccccatctgctgcattctcagtgcttgattgattcagagaagctgcacaatggatctttgctgaaatctttgttgaaagatgaatgaagagtgtatgactatgggaaataatggctgaaattgggtagatgaagagttcataattctaggagactgggcttaagaacgggggaggtatgagagagaatttgaataaatcaggaaacaaaatttttaaaaattgagaaggtgtgagggacatgatggacaactacaaagatgaggagcggttggtgtgatctgatgttacgagtttcaaagctgtgggtggattacagaggtaggaggcagaataatctgaaaaataaagaagcagcctgaagaaaatctatgctgcctacaagtgcaaggagaatagggggatcggagagaaaacagctgccatttgagagaatcgtgggagaagctgtgacttcaagcaggagccagatttcagctagagctcatggagaagaacatttacaaaggagaagttgagatattgcagataactgatctgaaatttcagaggagagaatgaaatggttttagaaattcagcaggaaattggggattcttagataatgaattctttcataactcttgaatttgacgagattaagctctggatgaatgattactaaaatgacctatatattttctaatacaattttataattattttcagtgattaaagataaattttatcagtgcattgcctttgatatttattttagatggaattaatcatacatcattttctgtggtgtatttctttaaataattatagactatagatgtaaaatgatatagttcataggacaattttaatagattatagctatagaatgctatgaagatacagtttagaaaacattttaggccagacacagtggctcacatctgtaaatctcagcactttgggaggccaaggtgggtggatcacctgaggttaggagtttgagaccagcctggccaacatagtgaaaccccatctctactaaaaatacaaaaattagctgggcatggtggcaggtgccggtaatctctgctgtttgggaggctgaggcaggagaatcacttgaacgcaggaggcggaggttacagtgagctgggatcgtgccactgtactccaacctgggtgacagaggagacgccgttgcaaaaataaaaaaaaagaaaatattttaaacctttataataatatatatgattacatataggtgtatgaatatataattcatagttaatctctatattacattattacatagttaattactttttttttttttgagatggagtcttgttcctggagtgcagtggcgtgctcttggttcactgcaacctctgcctctcaggttcaagcgattttcctgcttcagcctcctgagtagctgggactacaggcatgtgccatcatgcccggctgatttttgtattttttgtagagatggggtttcaccatgttggtcaggctggtctcgaactcctgaccttgtgatctgcctgccttggcctcccaaagtgctgggattacaggcctgagccaccgcaaccggccacatagttaatttccatgtatacaattaatagttatttctatatccacactacaaaagaggtaaatacaagtataaaattttaaaaatgtctgttctatgcaatgacatttaaaattcttgttgattatagtttttggtcttagtgcagtcagtttccacttcataaatactgtcttgcctagcttgtgatggttcacaagttttacatgccccacataatgaatcattgatattttcttagtacattgggcaacttttgaagcttttgcataacttttatttttatgtattatcagaaagagcaggttactggtttagtggtgccctagtgatattgaaattatttttatttaagcctttattctctccactgggaaatcttcttaaatttagttttgattgtgtcttcattgtcttctgtattgttcacatgacatgatagtaataatgataatacttacatagcacttattctaggcctgtaaatctaagcactatacagatgttaacttgttcaagtcacatatcaagtacatgtgataggttctattattatcttcccccacccttatataaatagaggagaaaactgagacatagagtgagtaacttggttaaggtcacaaattgttatatgtcagaactaggattcaaaccctagggtcacactgcagagactatacctttaactatactgtctctatagggtacatagctggtaaatattttgtagtaaatgatggtgaaagaaaggactcttattgatcttttctcttaataaatatttagcaggcacctacagtgtcaaatgctctgttttacatttaataaaacagaaatggcttcatgaagcctggaatcaagtgagagaaacagaaatataatttgcacgtgcaattgcaatattgtaagtactaagaacaaaaagaatgaggtattataacacgcccttctttggactgtgtgggtaggccctttttgaggaattggtatttaagacttgaacaatgatgagaaggaggcagccaggtcatgaataagagaagagttcctagcagaagaaatagtatttaagaagaacaggatttctggagcttatagaaagggtgcccttattttgtctttcacttgaatccaaacaggaaacagatgacataccaaaaagtaaaatattttatggggattcatttataaagaaagctggatacaggcattatttaagggatggtgtagaaacttggggtgagcgttagaagagctagtatgtactaccccagggcctgaaggagaagcaagttgttggagctgagaaggagagggttatagagggcagacttccttatgagagccttatgaatctcttcagttgagggtcacactcagctagagcaaatccaaataaagggaaacaggaaaatagattcctgaccctgctttaccttctgccctttcatctcctaatgaggctgatcatctattgcctaaacacaaagggaaagggtatgagagcccactgattaacccattcagttcagtctcccgggacggagtgtagagcgcaaggtcaaagaggttttggatatccattagaatttttggccgctgaacgatcatgctatgcctttagttcatgttatagaatcttttattttaggcaaaatggggaatctttgaagtggtgtgcttttggaacagggagattataatacttttatgaggtggattttgctttgaaaatggcacacattgtagaggcaattgcacaaatggagtggggagatacaaagttatttggtagtttatatggtggctttgattacagatgcttctcaacttacgatggggttacatcccataaagccaccataaattgaaagtatcctaattcgaaaatacatttaatccacctaacctgccaaacatcatagcttagcctagcctaccttaaatgtgctcagacacttatattagtttacagttagcaaaatcatctaacacgaagcctattttataataaagtttgagtatctcatgtaatttattgaatactgaactgaaattgaaaaacagaatgttgtataggtacttgaagtacgacttctactgagtgtgtattgtttttgctttatattatatagaaaaatcttaagtcaaaccatcgtaagtcggggaccatctgtagtgtggttgcaaatctgtttaaaaggtataaataacaggacttgattatagattttatgaatagcttggattgaaaggtcacagtgactctcgtgtatctgactcacataagtagataggtgttggtgccacaaactgccacagaaaaaaaattctatgaacagaatgagttaaggatgttgaccaataatttagttttacacatgaaatattcaagtggaagtgtcagcaggttgaatatacagatttaaactggtgtgatccagaggcatacatttgggagccctctgcaactagatttaaagttatgtaatcatgatatcatttaagctaagagtgcattgagggactagaaagaagaaacgactaaaccttgtaaaacttacacattcagagaaggctagttagagaagaagtcagcaaaggaatccaatgttaggactaagctcgcacttgtgttatcccacttagattataataattctgtgaggtgggtattataatattttgaatcaggatctgagaatcagattaatcatcctggctttgatttttgcctcactccaaaaccatgcatttttcatgacaccaggttgtctgttacaaattataaatacttgtggaagtcaacatcttcctagaatagtgatagaaagcaagcattaaaaaaaacataatatgaataagggaagtagttttaaacactgcttaatttgtaaattacttctgtgatgtataaattaaattataattgactatccttgttttccagagttagttggaatgatatggttttaaatcttttaaataggctaactcatgtaactaaaacaaattttaaaataaatttttccacagaggtgccaccaatttggttttacctcctaatggataaaagcttaatttcagccctgatctggatctatgaagagctttggtacttacttccaacagcttgttcctaagaactgagtgtgtaatttattaatagagactagagagtaggtgtttgaaatgtacagttgaaaacaagtcttgacatttaaacttcatcacataaaaatatgaaatccattattttctactaggatattaacaatagagttttaaacatcttttgtaatagcacagtttcataactagtccattaactacatgataactgtcatgaactcaaataagtgtccataatgatcagtgagtgcttccacttaagtgtccatatacttaggagggtgaagcacctttcagttggtaataatacagtgactataataagttctgagcagaaaatattaatgaatctgtggctttgtcttgatttgaggtattaggatagaaaatatcatctcaaacttttcaaagttggttacatttctagacattataatttgccatgtgaaaatcatctatgcattattaatatcttacttatattttaatcttataaaggctaaatatatatctttatataaggatatatagataggatagttatcctatagatatccatataaagatacatagataggactgtttctatttacacatttcatgatattagacttccagcatgtttgtgtagcagacagtatttgggctgaaaagagcaaatttgtttccaataaatactatatctttctacttaacataggatgataagtagaattattacatgaaatatttgcttggagtatggacagaatttgtactttaaatttgcattgaaagatttttatatattcatttgtaaatttagcattaattttttttggattgtagtttaactttcgccataacttctaaaatctccattcattcattcatttattcattcattcattcattctgccttctatgtgccagatattcttctacctctgaataatatagttttttattaaaaaacagctaaagcctcctctctcatgaagcttacagtaatgaagaatgagaaataatataagtaaataaattttaatgttgctattataaatgttttcccagaaaaaatgaaatgatacagttgagtgacaatttatattattctaataatttaagcttcttaaaatttgatctagctgatacagttgaaactcggcatttgttatgtatataagctgcatcccaaaaacaagtgttacatagggaagaataaaaacaatgagatgtttccaaagtattgtcagtttattaattaaatatttttgaattggtattaatacattatagtatgaactgcttattacaatttttttatttctaaaacagaggctgattttattaaataacattgagaaaaataatgtaactccactaatagtaattatgatgcttaatacttacttttggttttgccagaatagatttaaaatattgattgatggcacttttattaaattctaccagatactgaggagttgtaactcttggactaatactttggaagcaaaagatcatttacatttcattaacatttaattatctcagaacatctctgttctaccaatgactaacagattcagaaaaaaacttaaataatcttaactcttacactattcaaaaacacggttttctttgaagtgaaaactacattgattggtttaaaaatgtgtagtacagtggttacaacatgaactttgaaattatactctcttggatataaatttgtgtgccaccacatattaacaatttaagcctcccaaagctccatttacctaatatgtaagatgaatatatttaatagtacttatagattaaagtgatatcatatgaggtaacctatgataacagtgctggacaaaaaataagcttttaataaatggcagcttttatttctgtagttgtttttagtgtttgtatcataattattattctaatataattatatatgatatgaaatttataattgtatataacctgtgtatatatagcaattataatcattttataattttaattattatttgaaaaatactaagaaaatagatattctttttcataatggaatttgtatccataaattagttttaaattatatagggagcatggaatctgctgtcacctgaaaatggtttgtggatgttaatgtcatcagaacctcagttgactgattctttgttgcttttactaacattgtgtttaagcatgtagtttcagtttcttgttggctttcttcactaaattccaagttccttcaggactatgtcttgcttatggtggaattcacaatgtttagtagacttttttcttacatatgaatgaattaatcagatattcatcagcattattttaacattaaaagaaaaccttactacttaatggtggatcaaatgtgcaaagttcttttatgaaaggtacttgtatactatgtcttaaaaaaacaattgtgcgcaaaggaaggaagaaacatgtgatgcaaatttaggcaatgtttgttaaaatagatatgtgaaacctggagcagtggcatgtcccagggactcaggaggctggggcaggatggcaggaggatggcttgagcacaggaatttgaggtcagcctggacaacggagtgagaccccatcttgtagtaaataaataatagataagtgagtaaaatgtgtgtttaaatttttataataccttgcagtgggaagaggaatatgaaacatccaagctagatgtagcataattacttgtaatccttgacactttcattttaaaaaatctaatacgcattctaggagttgattctttttttattaaattgaggttgaaaaataaacactcaatttgctttctgattctctttgctttaagcagaatataattcttgtgcttctcttaagttcccaatctatactatcaatgcctaacatatatcaaatgtatgcatatgccaataacagacttaaaaatatcctttagtgaaaaaacccttaacctaaccaattagtaaggaaaaagtaaagaaggacaaaaggaccaattgtgatgaatgtggttatgacagtgcatttgtttgtcggaaagggtaggtagagtaagcattgagatttaagaatttacagaacaaatataatacaaaagggaatttggcacaattcatgtgatgaaagaatacacatttacctgcattttcacccttgtcattgaccacccacaagctttttaccctcaagaagagaataagtcctctgaaatataactgtccactggagagcgcaatgtatgaatggctcatagcaagaaaaagaaaatggtaactataaaattaaattgtagtcatgaaaagcaaatagatggaaactgattcctctcttcaggttagagatagaaacactgcaggatttttttttttagactgagcattcttttctttctttctttttgccccagaatatcataaataaaactactgacttattttctttatgttttctcctgcaagtaggatttttcttttcacatatgagttccaggcctttctgaaacaggggacattaatataagcctaagagaatactggtcaagatagccatttgaaatagaaaccactccctgtttcttgaaattttctcctgttcagaatgccaggccaaactggtcactcctgttcagttttcttcattgatctgttttctcatttcactctgtaaatgtttgttgtttgtaacagacgtcacatttgtctactctctaaccactctgcctggattacctggttattttaatttaaatgctctctagtgaaaactccaaaatctggtctgatttctgtcattgagtttcagaactttatatctgatgtcctgcatggacaaatctaaactgattttagactcaattccataaatttctgcttcctcctgtattctcatttgtggttaataatatcatcatctaatgaatctctgaagctaaaaatttcaatgtaatataggactcttattcccacacctcagtctgtaagtcactacattttgtaggttctgttatagaatatttctcttctaatcagagctgttatgtgtcacagctttaggtcacatatttatcattttcctcccacattgttgaacaatcttctaactgagctgtctggcacttctcttaacctttaggagtccatgatctatactggtatcagttatctactgaaatctggtttggctctgttattcttctgctaagatatctccacatggctccactgaccatcgcctcaacttcaagcccaagtttttccctctttaggaaatgggttctattctacatggccagtaaactctaagacccagcataaaatcatcacttctgttaagaattcttctgtgaagactttctgtgacttcatggtctcagaagactgtgacttccatgaagactttccttacactcctttcttttatgctccattacagaacttaacaggcatattataatttctgtttataaatattccttaataagaaaatattttttgttgaaattatgacttaaattctctatgcataacatagtacctgtttcatagttggcattgattaaatatgaattgaatgattttcttctattgacttaaattaagtctcttagagtggtttttctacaacctctatgatactattggctgctcattttaatgtactctgattttaaatcccataatcatttacccccctctttacccctgctcctacctctatggtcatcctgtcattagattagggacattaaaagaatcttcaggtaggaatatattggtttgaggttaagaatggcagaatcaaatgattattgactgttattttaagccaggttcagtattaaatgcattaagaatttactcaataattcttagaacagaaataatgaatatatttgttttactaattaagaaaaggagaaattgagtaaatggttcaagtttatatggtgatgatggacatagctggaaaccagacacatatcagtccagtgcccaaaatgtcagtataatagacaactcatcaccaatttaaatttgtttctatttgtattgtgacttcacacataattgaattaactgggctcttgctttcctctctggtaccagcctttattccatttcaaggtcatcctcatataattagaactgattacttggcaaataaaggataatattttcacagcttcttttacctgtactacataagcacaaatgtacagtgtttatatgatattaatataatcacaaatagcatgggatttgagaatacagttttgttatcatttttagtagtatttagaagtaaaatagaatatcaaagttctgtgatttaagaacttgaagttccacagttggttctactcatattagccatttaaccttgagcaggtcagtttcatcatctggaaagatgattttcatgatactccaaactataaatgatagtagacctgaaaagtacgaagatttcctaaaagtttgtggaagaattgagaagaaaggcatatctgaaaaaaatcactataaaatgccagtaataataattataggcatataaccatgaaattaattctgtatatagtattaagctaaagatgtcactatttgaatagcatatcctgtgtacatgaagttgaaaacctaggtgaagagatggaacatatttccatctctttccatatatgactaacaattctaaatatcatttgtagtgttcaaagtcataagagctcaacataaccaagtgaaaaaaaacatatatttatgagactaggggaagaacattccaggctgggacaaaattggggagaaattctgagaatgagttagaactgttttaatctttttgtctgaattccttaaagatgggactgttttcttactttataaagataccttaggagcttattaaaattaggcttagttgtcgggaacaacatattcttacactgataaggaaaacttcaggccttttttgcagggagataagacttaaatatcaccacagcaagctgccattttagcattcagtggttaagccaaggggcaaacagctggagcagagctagcagaaaaacagtgggatgtagtttccaaaccacaagtaccttgtgtctaattcttgcattcttcagcatgaagattgttttttttgttgttgttgtttgtttgtttttgagatggagtctgactctgttgccaggctggagtgcagtggtgtgatcttggctcactgcaacctcagcctcccaggtacaagcgattctcctgcctcaacctcccgagtagctgggactacgggcgcgtgccactacacccagctaatttttgtatttttagtagagacagggtttcaccatgttggccaggatggtctctatctgttgacctcatgatccgtctgcctcggcctcccaaagtgctgggattacagacatgagccaccttgcctggccaaatgtttttaatattacaaaaatcagacaaatgaaattcctcatttgtcctcgcatgctcttgttgttcctaaattccttcagttgtctaattatgtcacctttttttcaatcaatcaaattataattgccagtattaagtatctagttgtagtgacagaaaggagtgaaagcagtaaaagatatatgaaacttaatctcctcatttaaaatcatgcaaatgactgaacaatcttacaataagaccatttctatcagaaaagctaggaagtttatattaaaatactgtttttaagatttagattcattcttttatatgaagctaatacaagatagaataaatcattttttttaaaaaaaaagcaaatctcatcagaggcaaaaatcaatagtttcatattcaaataaaaacagtgcttaaaatcagtccattgtaagttgtttgctgttttctaattgtttagaacaacttccttttatctttcccaggtgttttaatgaaatagtgaccaatttctgaaaatgtttttctgtaatataaacgatagccaaatgccttggagaatattttcttttataatttctgtctttataaaaagttagtctttgtaaatttagattgcttaaagtctccaaagttcttagatgagaagaattgattttaacaattctgtatactattaatagtaatgcttcaggctcattataaaaactcaaaaggaaaatagttaacaaattgtaagttgaagtattattacctaataatattattattgctcaaataataatttgattattattgtactttcttctctcaattacccttattttgaatcttcatttctaaatttgccttcctactattattttcagactttttttgttccctctgtcttttaatgattaaatcatcatcaaaggctggagtgcagtggcagcatcactgctcacagcagtccgtaactgggctgaagcaatccttctacctcagcctccccagtagttgggatcacaggcacactccactgttcccagataatatattttattttttgtagagatggggtctcactatgttgccctggctggtctcgaactacaaggcacaagtgatcctcccgcctcagccttcataacttctggattacagacatgagccactgcacctagccaatatttagttttcttgtttgtagcatctatattattacatagcaatgtgttttagttaaaatatcaacttagttaaaaaaatattttgttagtttttctcaaaatagctatagtttcctaattctttaaaattatttaatatatgcctttgatataaatatacttcccttaaaaattgagaaggtatatgtaatataatttccattaacccaaagaggctaaaatgctgctttgaaccttctcagattctctctacttgtaacttacactctgttcttactgtcctgtatgtggtttgccaaaaatattgaccacctaaaccaatttcgctgtatttcaataaaacaaaaccaagttttcgaatcataactccaaagtttgaatcatagctctctcacttaacagctcatgatttaactgccatgagcctcagttttctcaattgtagctaacatcagaaggcttttttttttcttatactttaatttctgggatacatgtgcagaacatgcaggtttgttacataggtatacacgtgccatggtggtttgctgaacccatcaacccgtcatctacattagatatttcttctattgttaacctacccctagcccaccatcccccacctgtgtctatgtgttctcattgttcaattcccacttatgagtgagaacatgcagtgtttggttttcggttcctgtgttagttcgctgagaatgatggtttccaatttcatctgtgtcccttcaaaagacatgaactcatcattttttatggctgcatagtgttccatggtgtatatgtgccacattttctttatccagtctatcactgatgggcatttgggttggttccaagtcttcactattgtgaatagggcttcaataaacatacgtgtgcatgtgtctttataggagaatgatttatagtcctttgggtatatacccagtaatgggattgctgggtcaaatggtatttctggttctagatccttgaggaatctccacactgtcttccacaatggttgaactaatttacactcccaccaacagtgtaaaagcattcctatttctccacatcttgtccagcatctattgtttcctgactttttaatgatcacaccaaaagcaatggcaacaaaagccaaaactgacaaatgggatctaattaaactaaaaagcttctgcacagcaaaagaaactatcatcagagtgagcaggcaacctacagaatgggagaaaatttttgcaatctatccatctgacaaagggctaatatccagaatctacaaggaacttaaacaaattaatgagaaaaaaacaaccccatcaaaaaatgggcaaaggatatgaacagacgcttctcaaaagaagatatttatgtggccaacaaacatgtgagaaaaagctcatgatcactggtcattaaggaaatgcaaattaaaaccacaatgagatatcatctcatgccagttagaatagcgatcaaaaggcttttttatgagagataagtgggagaaataacacaaaaatatcatcccagtgcacctctgatataataattcttattacatgttagatgatgttattaattacaatatttgccaattttaacataagttgggacaatgttttaccagcacagttttttcccctgaagaaatcaaggctcattagacttttgctataatggaatttatattagctaaaataaaattacaattagactggtgaatatagtttccagaaagtatataatttaaattgctaacataaaagactgatttttcttaaagtcagatcttatttatatatttgttacatcttatatatcctgccttttatgaattttaaattttgtagctattatattttagtaaattgatggtattgtttaagtagaaatgaagaaaatatataatagtttttaaagctttacctaaaatatacaagtcttggcaggaatacatactattccccatttatttatttatcattgtattaaatctttttgctgacagcataggggaaattatgatgatttaaagagtgagtatcagtatttgacagagaaggaaaatgatgataacatacaagcagttatttataacaaaatttaactttaaagtggcaattgcttcatatttgatttatgcatttatcctaggtggtagaacagacttcccctgtccaaggagtgacctttaaaggtggctattgcaatatgaaaatatacattttgagagtacagtgattatggaaatgcagaagaaaaaatagttgtgtggcatgttttgcagattttttttctttttgcctcactaacttaaatggtggtttgtgattttcggtattgactttttgaattatcatttaaccttttcatattcagtaattggcaccaaccagtttttctttgctgccccatcttctaccagaaacagccacactacctaaagtctaaataaaacacaaataaatatgatccagaaacacagctaatagagaattctggactttgtgttccaatgctttggtggactcagtttgatttagaactttgtctttagcaatgcagttttagaaatttgattttattcagttactcatggatactctgggttataattcatttactccaaccaaactttaaagacttcataatattacttcatttgtgaaccataagtttacctaaagaaatgctgtttagttctttgtctataaaacacacgttccattaaccagtgacatttttttctagtcactggagaaagtaaatttgattaaaattttatctgtgcatctaaatgttgttaaatgcaacttactcattcccaatgggttgtagagaagttttaaaggtaatattaggtcaccttgtctgtttttaaattttattatatgttatcatcattttcaaccagtttccattgttgattgaatcatgccttatctcactggttaatggttgagcaaggatttttagagtctttttgtgttggaattttgttgtccatataatgatttgtatactggacagctaaacatcatagacagatgtctgcttttttttttctaaaacttatgataaactattcttgctgactaaatttatatttggtaagtattttgtataagtcactctcaggcttgatgagaaaacagaaataatacctataatcctctttcttccagattttatgttgtagtacatgtatatacacgttgtgtttctagggcaatttgactttgtaatcactattttttatttattttattttttatttttttgcgagtgagtctcactctgtcactggggctggagtgcagtggggagattttggctcactgcaaactccgactctcaggatcaagtaattctcattccacaacctctcatgcctcagcctcttgagtagctgcgactacagacgcatttcactatgcctggctaatttttgtatgtttaatggagatgaagtttcaccatgttggctaagctggtcttgaactcctggcctcaagtgatctgcctgccttggcctcccaaagtactgggattacaggcgtgagccaccatgcctggcttataatcactatcttttaatgacctactactgatatttcctaaaaacaactaatggtcccctgttttatctctaataatttaatcacttaagaatggtatacagaaactagttgtttttagagatgagtatgaatatgctgctttttttggccattagctgtttatcaacatttaacgaaatgtggatgttcaatttcttaaaataataacataaattttcattacttttcagctcctctattaagagttctgctctgatgctaggcaaaatattacaaactactacatgagggcccacctttcttttagggaacgttgctctattaagtaaagggaaatggtgttatccctcaaatcacttaggagtatacaacctcatagatcctttagcagcatattaaatagaatatatatatatatattttttttttctctaatggtagagaatatctgatctgttcttatgaacatttccctgctctttaatatgcatggggatatattctatgcattaggattaaaagcacaaatgaactacattgtgtaagtaaacttcagaaaaacaaatagacattcattgaacacctactaggtgacagacaactggacaagaaactggagatgccaagatgaataggggtatggtcccttaaagtatgaagctgaaggtacagtggagaaatatagaacacaatttaatcaagtcagtaatcatagttttttctgttattctacttaaaagattaacactcttatagttttcatagattattggtgtcaatgaaactgatattggtgggcaaggggaggccagtgggacctctaccccagctggtgaacaggctcttgacacagtcacaagaaggaattcaaggacaagtcagaaaatagtaaaagtacagagattgttgcaagggaaaaagtacacactcaagaaaagggagtgtgggcgtactcaagagagagagtcacgtgcaagggactttggggctgctatctttatgggtttctttagccaagggatggaatattcatggagattcctagaaaaagctggtgatttctcagaactgtggtgccacccatttttacatcaaatatgagtgctcctggaactgtcatggcgcttgtaggtatgttattgactatgttaatgagcatataggaagatcctaggtgaaacccaggacagatacagtgctatgttgagtccaccagatcttagccagcttggtccatgccctggttttcagggtcttatctgctcctggcttctgcagctatttcggcagtttccttttgctagtcacatgaaactgctgcctggaattttctattctcttgcaaccaccttgtgctactcctgcctcaaaactgtccccataaacttgctccttatcagaagaaaaattaaaatactgtcagaagcaaatattttacttaaatcagtaaaatgattgtccttaaaaacagatttgttgagttcaccttaattagtaattggctgacaatgagtacgaatttagttcatgtttgtttataagccatgtaacatctgtgaattagttttatatgaattgcaatcttttcagaaaagaaataatgtaggctttttctggtttggccttttgttttttttttaaccccccaaggagccacagtagaaaatgaaaaacatagatctgtaaaggaaatggcattttctaaatactcttttctccctgtataaacacattgattgttagtttttaaattgctttgacttataaagaccttaaaaatctcaaaaatgagtatttacttccctggagatttcttcattgagtttaataaaatccttagtgagattcatacactgcaggtttctttttttttttttttttaacttttctgcttttgaaattacaagctgttactcaccaggtgtatttttattagtttgtgtgattctgagcctgaatatttattttacaagtccatttagcaaactatgaagctttttaaatctgtaagaagaggggcaatactttcattgcaactttgaatgtcaaatgtttaaagggtaattacatgcttgaatcatattcggagtcaggatagtcaggacacacttgctgatttggaactgagaattagttacttcaaaatagagagttattttttacccaaatgtataatattgttaaatagcatcactgaaaattctgtgaaaaactggtctgacatacatacacgcatgcatacatacacatattttgccagttgagccttttcacaagactcagctacctagttttcttattaaattttgctcaaatggcaccaaataagaaatgtcagcatgacttgtataacaacatactttcaacagtttgtatcaaatgatttgcattacactagagtcttggttagattggaaaggtgtttacaataggtaacataaagctaaattcttagaatttgattttaagagtatatatatatataatgagaataaagaaaatatgtttgtaagatttgtcttagcaaattttataattaatagtaagtaatagtgcagcaagagaaagctatatagtatctttataaatcaaaagtatgattatttatcttatatgaccacatagcctactccagctattgccccatctctttgaaatactctaaagctaaactccttgagagagtgcacactttccattttctcacaccatttgcttcccaggcaagtgatttccgtatctctaaattcagcaggcacattttagtctgccttttacatggacctagcaaaactggaaacactcacatttgccatcttaaacacttctttttctttggcttctgtgattccatattttcctctctcttctgcttgttccgatgatttttctcaatctgcttttatacccactttctacccatctagccttgtctgcccagagtttaaaagttggagctttttacggtggtgttctaagtctgagaaggcaaaccttttggtaaagggacaaatagtaattatctcaggctttgcataacatatggtgcctggtgcacgtttgctgttgtagcatgaaaggagccgtatacaataggtaaataaatagctgaggtttctagatatgttattctgcttctcagtttctttatatcaaaataattttgtatggacttctaccaaaattcttttctatttcttacatttaaaggaaattagttttacatttccctaggatatttttgtagctttatatctctagaccgtcccactatgtacaaatagatcgacttgtactttgagtagcttcctcctctacttctcccaagtatctatcttggcttttttgtattctgttcttactgtttctgttcaggtcactttagattgtactccctcccaggagttactttctagtgtgggactttggctaaaaagagagctaggttttttagttttgagattttacagggttgagggtctcctattttctgactttactatggtccctttgcatttacccacaaatttgaatatgcaaaatttctgtgggtttttttttttttttttttttttttgagacggagtctccctctgtcgcccagactggagtgcagcagcgcgatctcggctcactgcaagctccgcctcccgggttcacgccattctcctgcctcaccctccctagtagctgggactacaggcgcctgccaccacgcctggcaacttttttttttgtatttttagtagagacggggtttcaccgtgttagccaggatggtctccatctcctgacctagtaacccgcccgccttggcctcccaaagtgctgggattacaggcgtgagccactgctcctggcctctctctgttttatctgctattctcagattgtctcactgtgcttcccataattctctgatcagatggactctaagggccatcagaagcctgaatgccttctgctctctttgcataattgcagataccttccagattttgtagctatcagtgatttttattcactcactggttttttagagctcataacgatttggagtttataactgatacttgtagaagcctagagatcttttggtttggctatcctgtttttagaggaatatttgggaagactcaaaactattccatttctgcattttccaataatcctgtcatagacgttacctagtatatttattttttaaggtggagaatgtaaatgccctagtattctatatcattgtatttttatttatttatttagccattcattcactgattgattcttttattcattcaaaaatgacattcatttattgagtatctattacattacaggtacttgacaaaatgtgattcagaaacagaatgttccagatatcatgtcaggtgctttaacaaagaatatcccatttacccttcagaataatacagtttcctgaaagtaattatgttgccaaagtttacagacagcttcagtaccaggtcttcgagttgattgtacaattgaatgaaatatgttgcttaagcagttgtttgatgtttacaattggtcactaggctaggcacttggaacagaaatatgtgccagctctttttgtttgtttgtttttgagacacagtctcgctctgttgcccaggctggagagcagtggctcaatctcggctcactgcaagctctgcctccagggttcacgccattctcctgcctcagcctcccgagtagctgggactacaggcgcccgccaccacgcctggctaattttgtgtatttttagtagagacggggtttcaccatgttagccagtatggtcttgatcttctgacctcgtgatccgcccgcctcggcctcccgaagtgctgggattacaggcgtgagccaccgagcccaggctgtgccagccttttgtgtgtgtgtgtgtgtgtgtgtgtgtgtgtgtgtgtgtgtgtgtgtgatgtttacctattctctatattaaaaactttactatggacgagccccactattacttttggcaggaattaaagcagatattgaaaggctaaagcaaatattaaatatttcacatgctcacacagagatacataaaaaaataggtgagatcattgctattgaaggcttaacattaatctttacttttaaacaatttaggataggaaatcaattcaggttgcactgcaaggaagaaatattaactggtctaccagttgagcattgtattgttattactatagagtatttttggattagatgtaattgctactgaagttaatcatttattatacacacacttagatttcttctcatcagcataccatctgcatttaagggtgctctaatgccatgctactcaaaatgtggtcaatggaccagcagcatccaaatcacttgagacctagaaatggagaatcttggatctactgaatcagaatctgtatttaacaaaatcaccaggttatcttatgcatctgaaatattgaggaacattgttctaatgtgtcagtgcttagattcatcaggaataggaagaaaataaataacattaactaccaaattctttttttttacttagctacactgagaataattaactgccacattttaaatacattattaatatattttaaaaatagatatctagaacctattaatatttgaatatttgtgtgaattttttatttagcattttaaaaattatatgcaatattttccacctagctcaatgttttggcagagctttgttagtataggcattagacatcatttgggctgagcacagtggttcacgcctgtaatcccagctcttggggaggtcaaagtgggaggatcatttgagcccaggaatttaagaccagaccggacaacatagtggaaccccattaatacaaaaaacaaaaaaacaacaaagaaaaaggaatcattttgtattactttaatagtagtaaaactcatttgatttaaagagaatttttttaaagaactatattgtttacacttagcacagacagccactaaataaggttgtgcagtgctcaaggaggggactatgggcagctttgtcacatctatacctacactggctcatagctagaatgtaagcactataagtacagggatctcttttctccatatacattaatgatagaatactgccaggcaaatagtagttcaataaatatcactgaaactttttttttctttgtatgtgaagagtcacagatgacattgtaaaatgatacaggaaggcagcacacattaaaaaaataaatcaatgggaatgatactttgcataacttatatttttaaaactcagatgctttgctttgacttgagcaaatcctattaatcacattaattacagtttcacagatgaggagatggagactgtagttaaatgacttgagtatcatatgtcttgactataatatgccttgattgtaacataacatacaaactagaatgtgttgacactaatatttctttttctttctttctgtttttttttttttttttttgagacggagtcttgctttgtcgcccaggctggagtgcagtggtgagatctcagctcactgcaacctttgcctcctgggttcaagcaattctcctgcctcagcctccagagtagctgggattataggtgcccgccaccacactgggctaattttttgtatttttagtagagatggggttttgccgtgttagccaggctggtcacgaactcctgacctcaggtgatgcgcccgcctcggcctcccaaaatgttgggattacaggcgtgagccaccgtggccagcctaatattccatttttatgaatactttacatcttctccctttagtgagagttgcgataattagcctatttgcaagatagcagggaggattaagtgtatatactgtaattgagaaaaacatactcatggctcatccatgttaatggcttgcccttgtttccatcatcttctgtctgattattgtactctagaggcaaccaggtattcaagtgtgtggcaactgtggccttcgatgtgtatttggagtcagtctgtaccttgaccttgattactctaaatgaggagaaagctatgacttaatggcaagtacattggcctgaaaattaaagacctgggtctaattaccctgataattgaagatctggcttacatcccagttctgttactgatgctgcattgaatttagtcttttcacttaatctttttcaccattgtttcttttttgatggaatgaggaaaattctagctaccttacatggttattgttattaaatttgaatgaaactcatttgaggtatattcttttaggaagactgatgaaaacagaatttccaaagtccctaggtgttgaaaacgcttttctttatcattgatatgtagtgaattttctcgtttgttctcttgcttcgtatattggttttgaaaagcctgctgctaatctgattatctcatcttagtaaattatttgccacttttgccgggaggccttgatgattttatctttaactttgaaatctaattgttttaataggatatgtttcagagtaattttctgagttaattttcctcaggtgaacctttttaagtttagattgttgtcttgttctttctctgaaaggcttccttaagctttacacttgtaaacattagctttgttgcattgttttatttttcttacatcaagttaatattttataatttaaatactagttctttttgcctgtcttccatttccattactttctctctgacccttttacttttttatatctttttcgtttttaggggcttctttcttgcctttcttcaatgaggctttgtgaattttcattcgagttttttctcatttggacattttataatgtattcttcatttcagtgataattttgtttttttcttctatttctttcctgaggtcaatcagctcttttccatttgtccgttttttccacttttgtttgtaaattttgaatttctgattcgatagtttttaaaaatatcatgtgtcttatttgcgtatatttaatcctgcattgtgttttaacttaattttcttctgctttgtggttgctttgtatgaaggaattatcagttggtatgtgtggaatttagcttcctacttttctgcaacagctgtgtaaggacttttcttcacttttatctactggggttttatacaacagtgctagtttagttgttccttcttctttcaatatagcaaatctaggtactttagaggatctttgttatggtagtggggaaaggattgttaaccctccagttttatgatttgcattttatcttgcaagaccctaaattttattttcttattgtctcttctttatcatccagtagcctgtacttctctcaccattttttctcttttctgttttctaagagctcatctttaaattgcatctactgtatctctttaaatcatgtctgccttgaaaattatgtttgtctctttaaaagggatgggaccttttaaattgtgcttacttagaaatttctttcccgttgtccctgctctgatctgcacagatatcttttcattcttttcagatataaggtggattttatttttctagttattgttgtaagtcactccttcttttgttttccccattgtttgcctgtgagtagggatggggctgggggttgcagcaggagacatgatgctctgggatttcctgattttcctcttttcactcatagttatgcagttttgatattctctatataagatatgcttgaataatttacatagaatttaacttttaatttaatttacatagtatttaattttcctagttttttcttaaatgtagaatttgattttctttctcttttttcttatttgcaggggatattatgggagataaatagttatattgttgccattgccctcagctatcctgaaagtatttttaaaaagtttttacttgaaaaacttggcttctgttgttttactgcttgacaactttgatttacattttctcagatttgtttctctcataaactttagattgagtgcacagtgtattattttgtagcatgatatactgtattttataacaaccttaacggctagctcatttaagataatattctagcatgtttataaaacaaaattaatccattgatggattatttgcttgttctgtaattgaaatatttgaaatatttaccttatgaaatctctagattgtctccacgagagttaatttttcttcagaaataatgaaatgctatcttaattataatgagaaatataatggtgaggactttgtgaactgaatcattcaagtataaaatattttaaattatttttccagtttttgcattatgtgaattactttggcatctgatatttttgtaaatattaataaaataaaaaaattatcttgcataaagttgctgacaaataatttctttgtatggatgtttctgcaagtgacaaaatccatgaaagaactgaaaatgcagtataatttctatcataacttttttcaatcaacttttcatatctaaataatttcagaaaattataaaggtacgtaaacttattatatcacaattttgttttaaatattttagatactgttttgcaatatagtggctttcttttataatcctaggtattttattttatgcatgcaaacacataattctaagaatgggtccataggttttacaaaactaacaaatgagtgtaggtcatgaaaatgtttaagaaccccttccctagaatatagtcctaaggaagacagggattcactgatgcagcctaagtgcctgaaacattctctggaatataggaggctctcagtgcatatattctagattaaactcagactttcctagcaaaatctttagtgacttttttatgtgataaaataccctgttgtaagctctcataagaccaaatactgctcatttttagctcttgtggcaattacacgtttacattcattgttattataatttgattgtgagccactggaatacagactctaattgggtagggatcttaccacttttgcatgcattttctgagccccacacagagtctggcaaataaatgtttgttgaatgaactataaattatattgagacacaaaataagtaagatttactttctgtctcaaagttttgtagggactgtgagaactgtaaaatattgtagcaaaaggtagtaccccagcaaacaatcatccaaccgactggctaaatgaataaataaaacttataagaaagtacaaatacattgttatgggaattgaaggtattaagtgatcactttttgtgtagaggtcagtgtgtggtttatataagtagtagtaatttacttgaatgtagaaggagaggttggatttctaacacatttatagagacccttctattctaagaaaggggaataaaagcaaaagcatggaaatggcaagaaacagggcaatttcagacactgaccataagttatctataaggaacggagcaaattagtttgtgcagttagattttgagtaatttcagtataaacctgggtgctaaggcaaggttttggactaagcttctttggtagctaatgctaccctgtttacagtttttgaaaagtgaaatattcaatgcaaactattagggagattcaacttaacatagaaaaataatactgtgaaatagatttttctagtaaaataagtataaaacacatatttcagattaataagagttcttaaattcaataacatattttgtgtttattaaaaacaccatagataaattttgtgtggatacagagaaataaaactagataaggcctattataaaaattttacctctaagaggtaagatctgcatttttacttatgtcatgtgtggataatgggattaatactcaatttatctccagaggaaggtcagcatgcctgttcaatagcattatatatttcaaaactgtaatagacaacagcagaacctttgcttgcaaattattttatttttatgtagttaatattttgatgacatgagagaaaatgcccatggagaagagaccaaagaaagccacttccacttaattgatatatttgtattaatttctagatttaaatctaggtgtgaggttacagagtaacatggcagagagcttaggaaatcatggactttcagccagacctgggtttcaacacctactgggttgcttcccagctcttgagtcttaggcaagttgcataactaataagagctttagtttccatatatgtaaagcaaaaacaacaaaaatgggaatcacatgacatgatgcatagtgcatagcacagtggttgtttagtaagcaatcaataaaattgttttatgattaaaatattatgatcatgcatgatagaggtccaaactatgaaatactcctctctttattttctaaaatcctacatttaaaattttcactaagttcactatttgaaattccaccatttattgattcattaggtaagaaaatttctttgctactgtaaccattagacagttgtagatactggctttacttctttcatcctggcctgatgctgtggctaggcaagtaaagaagaaaatgaagagggtaaaaagaaagtaattggaagaaaaggatgtagaaattgctgagtatcaaagcaagaagacagagaacgacatgagtaaaataaagacattgaagaaagtctgagaaaaaagccaaatgtaagagagaatgaatactctctctaccattcgctactgctcattaagattataataataacagtgttgataagttaaattttttgccttcaaagtcagcttttctctgccttgctacaagatactgagaaaatgtggagagccccgatttagctgttggccttcaaatcttatcccaaactctataaagtgactgatctggagcaagttacttaacaactatgaatgtgagtttaccaatttgtaacacggtgaaagttagcaaaggaattaaatccaggaatgacacatagcaaactataccactataccacacacaggaagtcttctttatatgttagctgctatgtataaatatatgtagtgttctctcctgttctctctcactctctctcaatatatgtatatagcagctaatatctgtatgcatatatatttgatttataaatgttatgatgttatgttatttataaatgttatgatgttatgtttgaaaatagtttgaaactgttttcaaaactggcacttttattttgtggatacaaataaatgtttttctgtcatcctactgccacaaattcttttcctgaaaatggtttaaaatgtattcaacaacagcattatatatctaatgaaacttgtcacttaatttcttcaagttcttcattccatattatttatttcttaaaaatttgagaatcagatacttatcaatttactttttagtttagtatgatttcataaaattgtaacatttataaattattatataatttgcttagtaatagtcatacgactcaatatttcaatcagattttataacaatttgtttgaaactttgaattgtgataaaagaacttttcagagataaattcagattaaaaagcaaaaaaatttaaaagccttttgatggggagtaccagttacttgtccaaattgagagaaaaagaaacagtcatcaaaatgaccaagagtaatatagcctcagatttctctttgttacctgatgacactatttaagatggactgtcagatcccattaggtttgcggataatattctgcagatgagatgaaaatggagttttcgctcagcaggaggaaagtgagaagtacacttattctagtcaggctcagagatgttattctttttctgttgttgctatgggataacattgcatcaataacaggaaagcgatccaactaagcttcatgcaccgcaatcaagttgttttgatgcaaataaggttcagtcacttagggtactcagttatgacaaactgtgctaacaaactataaatcaaacctgagctgaattgcaagtgtatatgctagataaaaaagaggaaaagcttttatcttttagtagacttaagagttattttgaataactataaagacctttacaatatttactgcaaaattaaagtataaatgttgttgttgataatttttaaaagtcaatttttattgtcccagaaatcctaatggagtttttattaaaacaatattatgagacaagtaagcctatgttatatttgggatagtatgtttttctagcatacataaacaaacctctgatcatagctctttttccctttcattttgaaattgtagttggtctggagaatgaggaaaaggaatttactaaaattatttgctctttaaaaagttatgcttatgtattatacatattcacatttaattcaaaatccttattttttaaaattttattcatagaaacattggcatttagggcccatatatttacctgactgacatttgctggtaatacatgtctgtcaaactaaagtattagaaactgaatagattttgaactaggagttcacatgcaattgcccatgtttcatactgttgtatcatttgttcacatttcctttagtggttgtggaatagaaattataatagccatatatagagagaccttacatggagccgaaagaatatatatcaacctaaaaacacactgagttactataagaatcttagccatgtgtatctaaattttcatttttcactgccaggtgcaatttgagaatgaatctttcctacataagaagacattgtaaatatgcaggtgggccctaaatcctgcatttgtagagcagtcatactgtgctagcttgtagtcataaatgtttctagatcagaattagatttggaaatttagcaaccaatgaaaataagcatttcaaaaccttgtgggtgattgttttttgtttgtttttaattaagtctgaagagagtgcacagaatgtcacacagtaaatagatgctgtcatctttcattaccaggcaccccatgacagagtccattgcagcagagctgaggaccttcatatcacaaaatgagtttgcttatcaggcatagagtgaaatgtttctgtatctcacaagaatgtctgatattatgcttctttaactgcacctgtaagcctgttcactgcaatttaaagacagtatcatatgtaacttgaagtcattttcaactggccatttgctcactcttagaatgagttttctaattaataaatatttttgaagacatggtgaataattggtcagatatagttaggattagtattaaaccctcggatctgaaattgtgatgaaagggtctgagatttcaccctgcatctcagctaatgagtgagcctgtcacagttttacagatattgacagaaagatatgaggcatctgtgtcagagacaagagtttcttccagtaaaagcagcagtcgaagtaacattgtaatgctgttccctgagccccaattcccaggggactaccggatgagggccaggtgatgcctgcacgtgtgaggggtatactacagaagaaccgtgagattagaagactgttttttatagaagctattggaatcctttgtcgtggagaaaaacgttatctttattaccctgtgcaaaattaggaaacagtccagaggatcatcctcacatttgagctcagttgtaagtccaggtgtcccccaaaccaccttaagtatttataattcactgcctggatgaatagaactcactgaaagctgttatatgcgtggttatgacttattatgtcaaaagaatacagattaaaatcagccaaaggaagagatgcatgtggcagagtctaggaaagttcctagcgtgaaacttctgattctcctctcccagtggagttacggacaacactgattttctctgcaaccctgcatgataatatggatggagtattgacaaaccccagaagctcatcaaagctttggtgtccagagtttctgtggaggctctgttatgtaatcatggtctactgcccgtatggctagtcttagtctacagcccctccagtgtgtgagctgaaattgtgactgaagaactccaccccaaatgacatctggtgtgacattttctaccctaattcctattgttagagtatctggtatgatccaagtccctcaggcaagcaaaggcactcccataagtgccttttatgaaattccaaaggcttagagacctagcaaaagccaaggaaaaagacaagacatgaatttgggcgatgttaaattatttattacaattcttagaatgtaagcagatctctctggggaggggaacaagatgtgtttatttttatcatctctgtctttccagagctttctgcttatacaaatatttctgaaaaaaatagtcctggagcaaattggctgttaatgtctagatgtgtagattcatggagaaaagcctgccaacaattagctagtgctttgcatttgataaaactcatcttttgagattccctctttcaaatttctggctctttgggtggactaaagagcacttcttttcaagctgtatttattaaacctagagaaagtgatcacactacttttagtagcttttatgttggtaacagaggaagtctttcgacattgggaaggttttttacttccctcatgcatacatatatgtgacttgaccaaatttagaaggtttttgaagggaacagaaatcacagattacctgcaagcaagcaatttcatgagatggcaccactgaaatttatttcaattttttccctcctaaaaacaaggcgattttcttcaatgactataaggttaacaaaacctaaccatgatttataatttaaatatataatttcatgtgtttcttaaaatgatattccattgctgagagtgacagtctcctctctgcctcgaaaccctaatagttggaaaggagaggacaggtactctgctttctaatcctcctgccttcaatcattactcctcattcctattaatacacttatatttttagccatgactattcctcaccctgcccctcccaaattcactttccctttagatactttcatggatccaaaaggaaaagcgatgcttctttttatccatttggttcaagcatgaatatctttccttgatatctcatagtaaacttcggaacatttaaaaagatttttgtaaaagctaggataactttttcaaactattttccctaaaacatagtttcctttaaaacaagaatttcactgtcaaatacatttggaaagtgttgtaaacaatattttcctctagggaaattcaaaatacacattatgcctaaaaggctgtaacaaaatcctgcagcaaaatttagacagaggaacaacaataggtaaaataaatacagagtacagcatgcaaccaacacagtttcttataagatatagtttgtcccttatggcatcagatgtgagtttcaagggctgccttttatgtgaaagagtcatttcttagccttcacacccagaagcattggctgaaatagtttgacagcttaaggtctagacctaagaaagtgaagctcattgaaagaggttatttcctctcctgcttacctaatacttttcttctaagttttttccttttctctgtggatactggtatgactaaatctacctgggaagagtaagtcctcaggctatggcttcgctctgtgaccacaaaggactgccaaattcagtgtaagacaatgacttaataattcttagataaaatgtggtaactagagcaaacaggaagtagtggagctaacagtgttatatttcattgtgtgcagttgatatttcataggtatagcttctgcatatcccagggatcagagatatgctctgccctgaataatggctgaattaattgtttattttcctagatatgacttagtatgtttgactatgcattagtatgctaatggtgtatgtatagaacaactaaagtcaaagtgaggcaatttagtagaaaataatttcaattccttatttatgacaaaatttaagtcacattttaactcagaaaatgagtgacttttaataaaaaaaatttcctataaaagatactgattttctttttactggaaacaatatttttcaacattgtgttctttcttcgagagcttagcatcccctaaatatgagaatcatctacttaaggaacttgaaattcctgagaagacacaaaacatgtatatataaatatactacaatacatcagcaaatagtcattctttttcaggtttaccttattttttattcattatcaaatctgcttttaactttttatcagaagcagaacactagatttaaaggctttccaaagcctaatgagtaagtccagtgttctctctgtgaatattgcatacttaaggctgtcatgttttgattaagcataagctttaatagatttgctggaataattattaaaatatttgaagacctacatttcatactggaaaggtcagaaagataaaacatacattagcggataaattcatatgagataagttttagaaaaattaatttcatggtatttatgactttttggagtgatagtttgttgatgcctattgttaatgccaatacaatgtgacacaattaaataaaataaaataaaaaaaagaaaaaaaaaggtgaagaatagttgtgtattttataaagatttttttaatctttatactcttgatttactcttttgaaactgtttctattagaaatgcctgatgccacatttttaaacaaagtgtctatttcttcacaatttgtatccaggaaaacatcatttctattaatatgccagtgccagagagaaacatattaatacactttcactttcatttttatactgacattttatttttagtcttgcagtctaatttttttttctacctgaactgtcttatggactaggtaaacttaaacacgtatcattcctgagaaaggagaaaaaaatgaaaacatactctatgtcttatcctttcaaaaactttaaaagttggaattctgaattcgagaaagcattcagaaaataacattctaaggaaaatatcctagttctttctctaaaatacacctctgctaaatattatcagatatattttcactgatcttaacttcgaaaatgatttcaaattaaggatgacttgctagacataagataatttggctctaatttttttgtacctttacaaattgacttcaattcagaggaaaatgatttgtgaaaagtctactttatgccatttgatttatataacagtggcaaaatatgcctaactggtatgtgagtaaaagatatatttgctaagttattatttgctaaacaaatctccaaataaatagggccatcttttagaaaacgtataattgatgttttagctaaaattttactcaaatgaggtaatgagcaaggctaagcctcacgttggtattgagtgtgtattcttacatctctgaaagtgaggaatggacaagggcaatcattctgggatgctatttgcattatagaccagaaaaaaaaaattataatgacttttaagagggccaagtctggatttgttagaaaacaaaactctggtagtgtgtaggactcttacgcagctaaaggaaaagtaaggtggattaatttattagcagtcacttgctccactccaggttcaggcttcaacagtacatcccaatcagccctttaaagtgccccttatctgtgcaccactcatccttcagccccacattcaatctttagggcctacttgtctgttgcacatgagcatacacacacatatcccagctggcacaagtaatgttatcttcactgacaatttcaaaggacgcaaggaaaggggagcctggcacctgggtagagcctctgggactcatgactccgagggtggctagagaacagatacaccaaacatcgtgaaggtgcctagaaactctaagactctaggtccttggattgtagggcttcagcctagtatgacgtgtctcctagtgagtggtaggacctgggaaactcctattggtatttgtgtcatgctaagcagaattgacttagaaaagttagttacaataacatcttataagcaaggtttatcatttaaagatatatatatatatatatatatacacacacacacagacatatatacacacacatacacacacatactagcatattctttatcaataagtgattactctgtactattttcaaacttcagaatatcaaagttcaaaagaatcgtttgaaagagtgagggtaagaggttttaatatgtagttttctgagccttgttcttagactctgaatcaagattgagttggtttgttctggaaaccaagaatttgctagccaaacaaacatccatgctggattgaataacaacagtcttaggaacacactttacaaagcatgaccccactgtaattgtacctatcaacatttattttgcagtatataatatgtgatgcccaaccacaatagtgtgagcatttttcactaatcatccactgctgtttccttcactgcattctttctgtaatgcttcatttaacaaatgttagttggccatgatttagcaaaacatgatgtctacccattaataacctgtatcataatatgagaacatttcattcacttaatgtttgctaagtgtctataatacagaaagatttacagtgaaactcctctttcaacaaactttatcaggaaaattgtcacatctagaaacactcacaagaaaatgaagaaagtaagaagtgccataagagaagtcacgataaaagtttttcccagaaggggattgctttaagcttagggtagtcatgaaaatagagtatttcaggtgatcattcatggcactgtttaaatatgagtcaggctgtgaaactcagggcaaggagagaagcagtggcagatgaagggaaggtttagggtatgcacagggaactgtgtaccatatgcgtatatagaacacatttggatatcacataggataagtgaatagcaataaggtaaatttggagcttggtaagagaaccttttgaatgccaaataaataaataaggactataagccttactgtgtagatgaggaaatgccagtaagggttggggtaccagggcagtatatcatgaagatgttccaggtaagtttgtgatgagttgaagtgaaggaaactgttctataggagaccacagagactagataagatgtaaaaatgcctgaatttaagtacataataaaaggaaaataatgtaaggaaaatttaaacaattatattgaataagtcttggtaactactggacatgggggaaaggaaagagtcaaaaaacaatgcccagaatttgaaagctgggcaactaagattattgtggtgacaagaacaaaaaaaaattcttttattattatcaaaaccttgcattagatcctttgtaaatatttaaattaatcttcctcccatcttagaatttggaaagcagggaagggggtcccaggggaagagtagccagtggacagttgaggagagcaaggggtagttataaagagattcttgatatgtcttcctgtatcacagggcgtgctaaactttctttttcaagggcggatgtgtgtgtgtttacagcatactcaaagtaatgtttacccttgaagcacattatttattgatatatttacatttattgaacatggaaattctctaagaggaaaataaataacttaggtacttgactttcatgaaatttattttctttatttacttagtaatcctattagttcctgttttgtttgagattctatagtattgtttcatttagccaaatatttcaagacaactttttggcagaagaacttttcatttatttgcatttctttcacaattttattttctaatccatttaaactatcacaaattaatatagaaaaatatattattgaggcaaacaagtttttgtgaaataaattgaaacccaaaaggatgaagaatgtcattgacataaaagtgtaattgttcttcaatgtaaccttacaagtatagatataatatatcataattgaaaaagaaggaagagggaaaactaacatccaaaccacttgaatgaagtaagtttttacacagcaaaaatatatacgacttttatttgtcaagtatactttaataatgctgggggtgggtggaattaattagcagtaagttggggggaaaagtagattacgtggtggccattgtagtagttgagagcccttcataaatgattgttaacatcgttctagttgcaaatattatctgaatatgaaattcatgctaccgtcattctgaatacttttattcttgagtttattttattaagacattaatattgttttcatgatcatcatcataagtgtgaccatctcccctctattctacctagcactatttttcttctaggaagtgcatgtggtgtttcagcatattttacattactttggttacaattaagtgaaattttatgtcataaatttatatagtttagaagcttagtttataagatcttgctatggctttctatttctgggaatgatgtttctgacaaaaatgtgtgatagaatgcatgatagttatccatttcattccctatggctcttagtgtaaagtccaaatctcttcacatgttttataaaagccagtaagatctggtacctgctttttactcatgcatagtttttctccctcatatttcatattttgccctccagttttactaaattttagtttgttccctgaaaatgactctggttcttgcttgcaggcctcagagcgcacttttctatcagccacagtactttcttctatgcccagccttccccttcccatcttttgcttggcacctaagcatttttcatgtctcaattggtcccctgtgcatcctttaggtttcactttctctggagaggcttatgaatagcccccaaatacaatgggtggacctcaactctatatccaaagaattttgtgcttctattttcatttcccatgaaaatatacaaaatacttcattaaaaaatataattctctctctctctctctctctctctctctatatatatatatatatatatgtaattacctgtattcttgtctcttatccccactagaccctaagccttgtaaggacagtctttgtctatcttattttccctttgtcttagtctgttcatgctgctgtgacaaaatatctgaagactgggtaacttttaaagagcagacattgattttctcatagctccagaggctggaagtgcaggaccaaagtgctggcaggtttggttgtctgctgagggctattctctgttttcaaagtggcaccttgatgttgcatcctctggagggaaggaaatctgtgtccccacatggagaaaggcagaagggaaagggagctggactcagcattaaagctcttttataaagaccttagccccattcacaagggaggagagctcatggcttaattgcttcttaaaggccccacgacttaatattaatactatcacattggccattaagtttcaacacctgaattttgtaggggacacattgaaatcatagcaccattgtatcctcagcatttaagcatagtggaggtacatgttagttgatgattgttgaatgaatcaattgatgattttcttttttatggttaaactaatgtggtatatactagactcatattccaacacaaacattcataaagattaaaatataaaaatattagattgtagaaatatgatataaatttgaataacatttttagaacaaattttcaacaagaactatgctttatactgtgctacacacttagcttttttagattttatttttatcttttttacccaggctggagtgcagaggcgcaatttcagctcactgcaacctccacttcccgggctcaagcgattctcccacctcagcctcccatgtagctgggaccataagcataacactacacctggctaattttttgtatttttgatggaaatgggtttttgccgtgttgcccaggctgatcttgaactcctgagctcaaacaatccacccaattcagcttcccaaagtgctgggattataggcatgagccactgcgcacagcccacaattaagcttttcaaagctttttgcgtactagtcttgtagaaattatttaacagctctgatttattgataatatcaaggtgtattgtaaggttaattctttattcttaatattgagataatgacctatgctcttaagtttgtatttaacttaaagagtaatctctgaaccagagtgttagctcttaacaattcataaatggtcactaaattaaccattttttttttttttgagacggagtctcgctctgtcatcaggctggagtgcagtggtacaatctcggctcactgcaacctccacctcccgggttcaagagattatcctacctcaggctgccagtagctgagactacaggcacacaccaccacgcctagctaatttttttcatatttttagtagagacggggtttcaccctgttggccaggatggtctcgatctaacctcgtgatctacctgccttggccccacaaagtgctgggattacaggcgtgagccattgcacctggccaacactttttttcaaatataactttaattaaatattggtggtgtgctaatggtttttaataaagtgttaattgaattgtgcttctcatcacaaaatatttgtaaacttcaaaggttcttatgaaactcatagtaactttaagaagaaagaagtaaaagcagaaaaactgataaattacttaatattatttcctgttacatgcattttctggttcttgtttttaataattagatacatattatggctttaatgcattagaactattaatcaggtatctcaaggtgatcacgcctgtgtcttgctagtcatgcactgcccacaagtgctcaataatatttactaactttaccaggttaactacaaatgtgggaaatagttaactcattcattttaattggttataaataatcttattttactttgttatctcaatatctttacttgacgcttactctgcacatttattaattgaatactctattaaagagaaagttattgtacagtgcagagttggatttgcagacaggagttcaactacttattaattcatttaaaccttctgaaatgcattttctcatgtgtaaaatgatttcaaagtgcaatgaaaaaagactgtctcaaggagatactgtttactcaccaacttatcaaatagaataacataatttaaagcattctaaaaccaaagaactctagacgtactaggtattattaccaaaatttgtatttcttttctacatatcacaatgttcaacacagaattaggggtaaaagcagaaaattggagagaacaccatataaataataaaggaactgggtgctgtggctcacacctataatcccagcactttggtaggcagaagtgggaggattattgagcccaggagtttgagaccagcctgggcaacatagaaagactctgcctttacaaaaaaaacacgaatgaatttgctgggcatggtggtatatgcatgttgtcctagctacttggacagctgaggtgggaagatggcttgagcctaggaggtcgaagcctcagggagccatggttttaccactgcactccagtccagcctcggcaacagggcaaagccctgtctcaaaagaaaaaaagaaaaagaagaaatgttcaaataaatgatgttacacccaaaatatgtgataatatgtgattcaatttacctttaaataccgaaaatatttcatgaaattaaaaacactatcataacaattgaggagtatcaattatatatgagtacatctggatgcctacattgttcctcaggttttgtgcatgaaggacagctcatatatgagattatattgctattatattgctacataccagccagctaaatgcaatcccccaaggacaggagctaaagtataacggagaatatccaaattttaaggaagtctttaaatgcatgccagtgtgtaagggaacttatctttctgtaagtgaatgctgttttacttttcttagcccagtagctaacagatttgacttctcatcatacctcgtttttaagggagatatctgagaagtaaaatgtaatgctgtttatgctactgatctttttagcacccaggagagtaaggagggcagcaccttcaagttagtgaagatgagaagagagccaactcttaatgaaatattttcttgaatctggcagtaacacgaaggatctaaaaactgataaacacttcggttacatcaaggacttttatattcccttctttattatgccagatgtgagctgccaacttaactaattaccatgttctcagtgggaagtttgctgtaatgcattttttgctcaaaaatatgttaaacataaaattcatttttttttcatttggggtcttcattttccaaaaagggaaataatatataaagctttgaaaagaaaactacatagtagcatttacataggaacgtttcttgataaaatacagatatacgacccaggaacaagcctggcaaaaaatttttcctgagggttttcaagttagaaaacccagtagtagaataaaattatccaaagacacatgttttggcaaacggtaacttacttctcttttatattctgttagaaaatattcagttgcttttgttggtatttaatattttgagaatatctaaatataataaaaagatccgctttcttcatttgcaaatgagaatgtaaagttcattattttgaccagcagtttttgctatttgtgattaaattcctataagaacttgtttgatatgagattgtgctcttctcaaataactctttaattttaattttacacctttgcaagtgtcagaatgatttgaatatgagagaaaagataaaggacacacagaataactgtgtgtaaatgatgtgcctttattattgttaaatactaaatagtaactattgtttaaagaaaattagtagtctttgaattcacaaattggagacctatttacacttcatttgataataattgctagcataagaaagacattatgttcaatacatatcaatatacataattaagaaggaaatgatttatattcaaggtcatgaacatcatacatcttagatttcataataaagaccaccagtaacacagcattttactagacacaggaagttattttgcgttacactaaaatttaaatattcaaatttatttcctaatattttaccaattggcatccataatgtagacagttcaagttgttattaaatgcacacatgcagttaaatataaataaggtataaacaacaaaaatctccatctactatgtcaggatgttaaacctttcttatggaggaaaaaaaagtgttttgctacactttgagctactcatctggaaaatcaggcttatccattaggcccatggatcaccattgaattactcatctgaatgtagccaaaaactcatactgggaaaacagtttaagaagctaattaaactgatagaaagaaaactttaattttaaagaaatatagaaagcagatgattatttataatttcaattaaacttcctaggctcatatatgaagaataaagtattaaacaaggagaacaagaccaatgcaaatatgaattgtggacatcaggtcttaggatatatatactaaaatacctaggcttattcagtcaaaaaaatgtaacagttgacccttggacagtgtggagtggccgaacgcttgtgcagtcaaaaatccacagataacttttggctccacaaaaactttaactacttacagcctattgttgactggaagacttactgataacataaacaattgattaacatatattttgtatgttatatatattatatactgtatactgtattttcacaataaagtaagctagagaaaagaaaatattatgaaaataataaggaagagaaatatatttattcattacgtggaagtggatcatcataaaggttttcttgtggtttataggctgaggaagaggaagaagaggagggtttggtcttgctgtctcaggggtggcagagacatataagtggacttgctcaattcaaacttacactgttcaaggaacaactgtatatctatatgtgtatatatatatatatatggacatataaatgtatatacatttaagaatttcagtgaattaatcagaagagactcccttctttattagcaaacataaataaaaatagatacaggtaccaacattcaataacaacttgtttttttgatatataatttatttatatctacttattgaaaagtatgcaatatatgctctgtttattttctttcttctctcactatattaattgtatcccttcccacccccttgaaataatctagatttataacttccagtgtttcatagagatatactaaaagttttatgagattattctggagttaccatctgtaattttcaaaagtaaactaaaattgctcagcggataatacctgtattccatttggaatatcattatttgtgcatagttgcttattaatcattatcttggaatcagaataattgatcgatacagcaaagatttttgtaaatatcagcagtctttggagaatggagagttaggaaatttgaagattccaaataagtcatattaacagatgattatgttcctactaataattgtattactagtagaacaaattggcctcattcatctttatttttgttagctgtttaggagcattagactggtgggtacacttttgtctttactagtactaactagcaaaaggctgttttcaatctttttaaataaatatctattttagtgaatactgtaggtatatatatcatcagaagcaactactttgcaataaataccactactgactttgtagacattttcttaaggcattgtacctcagtttgaacaatagaatttcatttaatacaaaatgtttatcattatttcccttcttggaaggacagtctagcaaactctgaaggtgtttctcagtaaggacttctacgaatgtggcaagattgttaacatgatatcacttggcaaagtttctcatattacatgtggacattttaaacgtatttagtaccatagccttaatgtgtttttattgtataaacaagttgtattttgattcagatatacttagtttttaaaaagtagatgttgaaatacttttagtttggtaaatatttcttttcaagaataattccaattgtgatcctcttccatattacaatggtaatatagggtttatttgctgctaggtaacagataaaattgctgttaggtaacaaataaaatatgcaactaagaaggtttgtaacttctgttttatttctatcactggtatgtgcttgaattaatgaaaagcgtctgagactactgattatttcaggaaaaaatttgccagcaattcagagtagttgctactacatggtagcagtgtgtttctttctctagcatagctgggttgcaattaaaaagaaaacagacatttggaaatattctttataaaaacaattattcttgaaacttgaatttcagtgaacacattataaactaaataaaattaacatatagaaataattgtaaaaacattttatgtttcaaaatcattgtaaaaatgttttctcttttaaatatgaggtttactctttaattcttcaaaaattccagtaaatcgcctcacttttggtctcatctgcttgctacctaacctatattggttcattggtcctttcagtgatacttgtttttgtattctagactatagataagtccatagacttctgtcatctttccctctagctaatgacagcagcactatcatcataaatattataggagcttctggtaactgagtacctactgcatacctggaactgtgataggtgtttcaaagataatcagtatctttgtctgaaaggtaggtagtattacccttgtataacttaaattgcagaagaattggctaaataaaataaatgatgaaaatagctgtaagacaagaaatgtgggaatgagtatattttttagggaagggggacacctgccttttaggtacaatgattgtttttaagtgagctaagcatgaacagatttcaggttttcaagagaatctgaatctgtgaattatgatgtgaaatagccttagagttgagatggccaattgaattatctttctaactacatggtgggtgaagcaaaaacaaatgtagacaaggtctgctgtaagcaattttataggctacttggtgtcacacaggtactaagtgataaagcaggatcccagcccaggtctgccagggtccattgcactccttttcctctaatccacactgctttgtgagctacaggcctgtataaatgccactatctgatttgtatattctatttctaggcagttgaacattttgaggcaaaatcatgaaattaaattgagtgttgtccaaatttagctgccccccttttattaattgctccctactttttttataggttctaattcctgagatagtaaatggcacataggaaatttcttaggagtaatttggggatcaccatctgtggtgtagaaggggaaaaggcaggattaagcagagggagaagttgagctgcaaagcacatccaacaaaggccttcagcagaccccatggggagctctaggacaacccaaggtaaggtgggggacttggcctttatacacttgcattgagatttgatgaaatctggctgccttgaggagaggaagtcccttcggctgactctgaaaagggctgagaggcaggacatagtggctcacacctgtagtcccagcactttgggaggccaaggtgggaggattgcttgagcccaggagtttgaggccagcctgggcaatatggcaaaaccctgtttctacataaaatacaaaagaaatagccggccattgtagtcccagctactcgggagactgaggcaggagaatggcgtgaacctgggaggcggagcttgcagtgcgccgagatcgcgccactgcactccagcctgggagacagaccgagactccgtctcaaaaaaaaaaaaaaaaaaaaaaaaaatagccgggcatagtagtgcatacctgtagtcctacctacttaggaggctgaggtgggagaattactttagtccaggcagttcccccagcctgggtgaaagagcaagaacctttctcaaaaaaaaaaaggaaaaactacaacaacaacaacaaaaacaaaaggactgacagctgaagcttttctagcagcagcactctctttcacagttacgataatagcctgcaataacttatcctggcataaaaagaatttgcatatcatataattggtgattttcttgaccttcattctcaaacagaggctagttatgttttatatcttctgtgggagagaggagaggaaatcagaggggaaataataggctatcctctttcggaaaaccaagcggccaagggggtatcccttggtgcacttttagagaatatccaaatattctctaagcccaaagctctaaacatcctagatcagattaaggaaatgtagaaccaaaaatcagaaatttctggaactgtagccactcttttgaaagtgccaggcagacacaggactcagaattgtcctgtcaatactcagtctggactgtataattttaccggttggctccaaaatgcccagtccagaaagggataaaccttgatgggctgcctgcaaaatgtattaatgtttttatattgttttccaggaatttttattcatgttttactacccattataaagacaatgtggttggtcttcatcagtgtcatgttcaggggcccttaatagcactttgttgggattttaatctgttaattaaattaataattaaaaattactcatctattattcatactccttattatattaagtgcctttctcatataatgttaagttgtttaacacctttactttgagcaacattaataataatattctaaattgttggctactttttcaaaatacctgatactcttttcatggagtagttttttaaaaatagcttgtttagataaagactgaaaatgttgctaatctggtttaattctggatgtttgaaattatttccagttgtttaaaaagctttatgaaaaataaaacaaagcttccctcaaatcatctggcaggtgactttacaagtaaccaggaattggtcagttttcaatatcatttaatcataatacgttaattgagttattgctaatatattctcacagggtatttgttctaatttactaccttatcacactgctataaaaatagcagaagatgtgttccgaaagccactgccatggacgttcataagataatacacagttaatctgttatgcctcaccttcatagatctgtccagaaacagaaagcacctctcattttccattgatccttttctatctcctgcctcaacaccaccaaatatttttattccacacaactctgtggccttccaaaattattaatttaagagattctaaccaagactctgtccaagaatgaaatagcttatttatggatccattcattggtttatggatccagggtgccctggagaacaccacaaatcttcgtgacatcccaagtgttaactttaatgtttatatctttaatttagctgaaagatgtgtaaaatctcatatagtcaaatagctccctcttgactgaacatataaaattgggattaaagcatgctgttccaatagatatcaatcataacttatgctcaataatttatttttgaatctacattttaagatcgcacaatgttaaggagcaattgatttttttctcccatgcggcttatttgtggccaaatcctagttgtacagagattgccttgaatatccagacttcctctgggcttccctgttatatgcaatagtgtaaccattaaaataaggtcagtaagtaacctcttggcatcacaaatagcagcaggacagtagtaagtatatgtctgtctctacatatagtattttcctatttatccagctcattacataactatttttactttattatttcaaaattggaaaatgatataactaataataatcaccatacataggaagggatttgactgtaaagataaatttaggccgggagtggtagctcacacctgtaatcccagcactttgggaggctgaagcgggaaggatcacctgaggtcaggagtttgagaccagcctggccaacatggtgaaaccccgtctctactaaatataccaaatgttagccgggcatagtggcgagtgcctgtaataccagctactcaggaggctgagacaggagaatctcttgaacctgggaggcagaagttgcagtgagcccagattatgccattgcactccagcctgggcaacaagagtgaaactccatctcaaaaaaaaaaaaaaaaaaaagataaattcaaagtcacactgtgtttcacatgtagcatactgtgtactctccagtgtttctgcaaaagccgttcttcagcatgttagtcattagtagactctgacacattctatatttgtcactcatcaggttagtttaatatccactctttccaataaacgtctgattctgaatattccatatgtagagcagattaaaaataaaagggaaaacacatagtgaatcatgttttaatgttcttaactccattaaaaatgcattatatgcttcacctacttgcaaaaaaatgagtgaaattgaaataagacacagatacattttattttttatttatttatttatttgtgacagagtctcactctgtcacccaggctggagtgcagtggggcagtctcagctcacggcagccttgacttcccagaatcaaacgattcttctgccccagcctcccaagtagctgggactacaggtgtgtgccaccacacccagctaatttttgtatttttagtagagataaggtttcaccatgttccccacgctcgtctcaaactcttggactcaagcagtcctcctgccttggcttcccaaagtgctaggattataggcttgagccatcatgcccagcctccctttttttttttaaaaaaaaaaaaaaagacctaaagatatcttttaaagtttgaatggatattgataaatttactccaaatctgaggcaaagataatttcttataatatttaaagtatacttgtatttagcttagtattataaaactaatattgaatttcatgcccttctgaatttctgtgaaaatttaccatttctaaaaattattcataacccttggcattttataattttatttcattattttattttatttttaatttcatttaacaaatttttatttatttttttgagacgaagtcttgctctgtagccaggctggagtgcagtggcacgatatcggctcactgcaacctccgcctcccgggttgaagcaattttcctgccccagcctcccaagtagctgggattacaggtgcccgccaccatgcccagctaatttttgtatttttaatagagacagggtttcaccatgttagccaggatggtctcgatctcttgaccttgtgatttgcccgcctcaggctcccaaagtgctgggattacagttgtgcaccattgcgccctgccccaaattttatatcttttgaccaacgtcttctcccccatccctccaaccactcctgcccttgataaccaccatttccctttctacttttatgtcagcaatttttttctatcagtgagattatgtggtatttatctttctgtgcctgactcatttcatttaacttagtgtcttccaggttcatctatgctgtcctacatgacaggatttcattcttttttgagggtagttactattttattgtgtatatatattacattttctttattcattcatgtattgatggacacttagattgattccacgtctggctgttttgattactgctacagtaaacgtgtgatgcaaatatctgttcaacatattggtttcattttctttggaattatacccagtagagaaattgctggatcatgtgctagtttcatttttaattttttgaggagattccatactgttttctataatggctatactaagttacattcctaccaacagtgtgctagcgttgccttttctctacatctttaccaactccttttagcctttgccattttggtaacagccattctgacaagagtgagggatatctcattgtggttttgatttgcctttccctgatgattaatggtgttgagcattttctcacatacctattgatttgtatgtcctcttttgagaaatatctaatcatgtattttacctgtgtttttattttgtaatttattttttattaattatttatactcatttatttatttaagacaagatcttgctctgttgtccaggctggagtgcagttgtgtaatcacagcttattgtgatttcatagagatgggggtctcactatgttgctcaggctggtcttgaactctgggcctcaagtgatcctccgccttgccctcctaaagtgctagggttgcaggcatgagccaccacacccagtccattgtttaaaattgagttatttgtcttattattgagttgtttgagttttgcatatattctggatattaaccatttatcagatatatagtttacaactattttcttccattctgtatcctgtctctttgctcttttgattgtttcctttactgggcagaagttttgtcatttgattaattccatttgtctatttttgctttaattgcctgtgctttttgaggtcatatccaaagagccattgcccactctaatgtcttggagctttccctctattttttcttccagtagttttatggcttcaggtcttatatttaaatatttaattcattttgtttttttttttaatatggtgtgagataagagtctaattcattcttcttcatgtggatacccaattttcccaaaactattcattgaagacactgttctttccctcttgagtattctggctcctttgttgaaaatcagtttgctctaaatgtgtggatgtgttttggggctccctattctgttccattggactatgtgtcttttaatgccagtgccacactctttcgtaacttactatagctttttagaatgttttgaagccaggtagtataatgtctctaacctcattctttttgctcaagattgctttggtgatttggggttttctgtgctcctatacaaagttcagattttttttttttttctgtgaagattgtcattggtatattgataggtattgtgttaaatctgtaggttactttgggtagtgtggatgctttaataatattaatattaatgctttcaattcatgaacatgtgagatcttttcatttatgtcttcaattttttttcattaatattttaaattttaagtgtacagatattttacctctttggttaattttactcctgagtatttttttgtaggtattataaatgagattgttttcttattttcagatattttgctgttagtgcataaaaatagtactgatttttgtatgttgattttgtatcctgaaacttaatgaacttttttattattaatagttctaaccatattgagtaatgtctttagagttttctacatatataattatgttttctgcacacagagagaacttaacttctttctttccaatttagatgatttttatttccttctcttgcttacttgatctggctagagtttccagtactatattgaatggaagtagcgcaccaggcatcctgccttgttctaatgtcagtggaaaagtctttagctgttccctgttaattatgttagctgtgcgtttgtcatatatgatttttattatgttgaggtacattccttccgtacctaacttgttgagagtttttatggtgaaaatattttgaattttatcaaatgctttttctgcacttattgaaatgattgtgtggtttttgtctgtcattctgttaatatgatgtgtcatatttatttatttacatatgttgaactatcctttcatcactaggatgaatccctcttgattttttttttttttttgagacagtcttgctctatcacccagggtggagtgcagaagcgcaatcttggctcactgcagcctctgcctcccgggttcaagtgattctcctgcctcatccctagtagctgggactacaggcacatgccaccacggccagctaatttttgtatttttttttttttttttagtggaccatgttagtcaagttggtctcaaactcctgacctcaaatgatccacctgcctcgacctcccaaagtgctgggattacaggcatcagccaccacaccaagccacaaatgatctttttaatgtgctgttaaatttagtttgctagtattttctttaggatttttgcatctctgtccatcagagatattggtctgtagttttattaatagtgtctttgcctggctttggtattagagtgagactggctttttattataggtttggaaatattctttcctcttctgttttttggatgagtttaagaagaattggtatttaattattctttaaatgtttaatatgattaagcagttagtatcttgatctcctctgtaaattaaaaaaaaaaagtagctaagccatcagttcctgggcttttctgtgatgggatagttttcatcactgatttgatctccttactagttactgtatcttactgtatgcatcaagggctttattcatttcttccaggttattcattttgttggtgtagaattgttcacaattacctttttttttttttttttaagacggagtctcgctctgtcgcccaggctggagtgcagtggcgcaatctcggctcactgcaaggtccgcctccagggttcacgccattctcctgcctcagcctcccgaatagctgggactacagacgcccgccaccacgcccagctaattttgtgtatttttagtagagacggggtttcaccgtgttagccaggatgttctcaatctcctgacctcgtgatccgcccatctcggcctcccaaagtgctgggattacaggcatgagccacagcgcccggccaccttttattctttgtattttacttgtatcaattgtaacgtctcctttcatttatttgagtcttctgtcttttctgttagcttagctaaaggtttattggttttgcttacttaaaaaaaaaaacaaaaacaaaaacaaaaaaacctcttggtttcctttaattttttctattggctttctactttccatttcattagtttctgcttagatatttattattttcctttttctactaactttgggcttagtcttttcttgtttttctagtatcctgattttcaacattttgtgatctttctcattttttgatgtcggtgtttcttctataaacttccccttttgaactgctgttgctgtttcccataggttttgatatgttatgtttccattttcttttgtctctggattttttttttttttttgacggagcccaggctggagcgcagtggcgccatctcggctcactgcaacctccgccttccaggttcaagcgattctcctgcctcagccttccgagtagctgggtttacagacatgcaccactacgctttcctaattttgtattcttagtagagacggggtttctccatgttggtcaggctggtctcaaactcccgacctcaggtgatctgcctgcctcggcctcccaaagtgctgggatgacaggcatgagccattgcacccagccagaaattttttttttaatgattttttttttttttttgacaaggtcttactctgtcacccaggctctagggcagtggtatgatcacagctcactgcagcctcagccttcatgggcataggtgatcctcccacctcagcctcccaaagagctgggactgcaggcacacaccaccatgtgtagctaatttttgtattttatatagagacagagttttactatgctgcctaagcttgtcttgaactcctgggctcaagtgatctgcccgcttcagcctcccaaagtgctggaatcataggcatgagccattattccccccaacctgatgaaatttttaattttacttttaatttcttcattgatccattggttgttcatgagcatgttgtttaatttccatgtatttgtgaattttttgaagtttcttccgttatttctaattttataccgtgtcatcagaaaatatatttgatacaatttcaatcttattaaagttgttaaaatttgttttgtggcctaacatgatctgtcctggagaatgttccaggtgcagttgagaataatatgtattcttcagctgttaattagatttagttgatctagattatattttaagtcggatgtttccttattggttttctgtctggatgatctgtttattgctgaaagtgggctgttgaagtctattactatttctgtattgtagtccatctctcccttcaaatctgttaacattcgctttatatgtttaattgctatgctgttgggtgcatatatataattcttatattctcttgctgaattgacccctttatcatgatataatgatgttcttgtctctttttacactttttgacacattgtgtattttatctgatttaagtttggttatttctactctcttttggtttccactgcaggaatatattttttcactcattcacttaaagcccatgtgtgtctctacaagtaaagtgagtctctttaggcagcatatagatggctcttgtactttaatccattcagccactcagtcttttgattagaaaatttaatccatttacattctagataattattgataggtaagtacaaactaccaccattttgtccattttgttaggtttttttagttgtttcatagatcttttgcttttttacttcctctcttgcttttttttttttttttcctttttgagacagtctcactctgtcgcccaggctgcaatgcagtggcaccgtgccgtgtcggctcactgcaacctctgtctcctgggatcaagcaattctcctgcctcagcctccaaagtagctgggattacaggcgcccaccaccacgctcggctaatttttatatttgtagtagagacaggatttcaccatgttggtcaggctgatctccaactcctgacctcaggtgatcccaaagtgctgggattacaggcatgagccaccatgcctggcctcttgctttcttttttgtggctgattttatgtagttgtatgttttacttttttgctttttattttttgtgtatctactataggattttgctttgtagttaacatgaggcttacaaaaacatataactggttatgtaaagctgataacaatataactttatttcaaaaacaatacaaaataagaaaaaaaaaacataactctggttgctcatggataagcagaacccagaacagactggtgcaagagagaagggaacccagctccacatttgtggcctgaagctctggactgattggcaaaaattttaaagctgacaatactggaagagaacctttgatcaaaaacactagaaattgatagagacgtgatacagacaccatgatcaaaaagagaggaagctcggatgtctgctcaaagtagttgggcaacaggactggcccctggactcaaaacagacataaggaagtgatgagtgaaggaaccttgggcaccacatgcccactgtggacctctgagatcctagctacaggagttcttatgacctccatagacctttaaactggcaggaagagctgcccaaagaacagacagaggcacaatttgtacctatgtggagccagaaggttttgctgcattgcgttgtttcagcaaaacgttaccatagatgtccatctctcaaggctctccatcttgtgctgagtggctacagctcctgctgtctgctggtccaggagagagcagggccaccactgctgcaggactgaggtgcatctgatccatccacccccttgcctgttgacctcttccaagaccacctgcctggctgctcccacaggagagtgcctacagcacagattccaccgcccccatctgagtgctttgctgttggcttggaggcagtttgcccctcagaatagccagtgcaataactgaggggccagtggacaaacccacgggtatggtcccagttcctcaggactggaaagcacttctgagggatatagaactgagatctatggcctgagcatgaacaaggacgatgacctcccctctccccagctctaagaatacagaggactgtgtcatggctttgtgtgccagtatgggagctgggcatccctcccttcataagaccagcccaggaaggagatgtcatgataaatgtcttcttccttgggagtcctgtggtctagaatgtctggaatgactctgcgatctaggcttggaagaagcctagttggtcaggcctgctcccatggcagagattggagggagatccattgggttgggggactgcaagttgaactggcctcactgcattggctgggctgaaaaccctgggctgtgggcactacactagttacaaacccatggtgccactaccctgcctaaggatgctctgcccttgaacccactgcatcaccagaccacctgcagacataccatgcaatctgctttgactccggcaagcacaggggactgatggtcccctgggagttgcatgcctcctggtgacctccttcaacatggactatccctaagagagggggtgaatgcagcctactaaaatcttcctttaggacaaaggaaatgggtgcagcaccagcagttaaaggggacaacaccaaggtctaggaatggacatggaaagggagtcatcttttgcctccggtctccacactggagcactgctgcagacccactgaaatactgaaggtatgagcatggcagagtaagagcctactgagccttacccttaaatgccatctactggactgacacttgaattataccaccaaacaaaaatatattgtgtttacgcccaaggcctgtaaaacccaccacaggaacctgtctacagcaaaggaacccttacagagtcttggccctctgaaaaaaaacatacaagcagctaacaaacatatgaaaaaatgctcaacatcactaatcagagaaatgcaaatcaaaaccacaatgagataccatctcacaccagtcagaatggctattattaaaaagtaaaaaataacagaagttggccaatctgcagagaaaagggaatgcttataactgttggtggggatgtaaattagtccagtccccgtggaaaacagtttggagatttctcaaagaactaaaaatagaacaaccattcaacccagctatctcattactgggtatatacccaaaggaaaataaattgttctaccaaaaagacaccttcactcatatgtttattgcaacactattcacaatagtaaagggatggaagcaacctagatgcccatcagtggtggatttgataaagaacatgtggcacagatacaccatggaaagctgtgcagccataaaaaagaatgaaatcacgtcaatcatgttccatgtaacaacatggatgtggctggaggtcattgtcattatcctaagaagattaatgcagaaacagaaaaccaaataccacatattcttatgtataagtgggacttaaaccttaggaacacatggacataaagatgggacaatagacaacagagactccaaaatgagggagggaggaacgggggcaagtgctgaaaaactaacttttgggtcctattttcactgtcttggtgacaggatcaatagaagcctgaatcttggtttcatgtaatatacccttataacaaactggtacatgtaccacctgaatttaaaattaaaataaataacacaaaaaatgcagttttcttccactagtctcatcatattttgaattttgatgttaccatttgcatattttatattgcacatctcttaaattattgtaactattatttttaatggttttgtgttttatatcttatatttaagatataaataacttatgcagcactattagagtattagttaatctgaatttgtgtacttacttgtaccagtattttatactttctgaatattttcatattactcattggcattttctttcatcttgaataattacctttagcagtttttgtaagacaggtctcatggtgatgaagtcactcagcttttgtttgtacttcatttctgaagtacagacttgcttagtacagcattcttggtattcagggtatttttccttctaggctttgaatatgtcatctcagtatctcttggcttgtaaggtttcagctaagaagtgtgctgcttgtagtattggaactcccttatatgttgtctcttttatctttctgctttcagaatactctctttgtctttgatatttgacaatttgggcagtcttattttggctaaatctgcttggagaacatttaacttcttgtacctggatctttacatctttattcaggtttggaaattacctactactatcttgttaaagaaattttctatcctattatgtttctcttctttttctttaacacctatgacatgaaagtttgtttagatattcttctttaaatctcataagttttttcatttcttttcattttttctcctctgcatttgtttaaataacatatctttgagcgcacgttattattattattattattatcttgttggatcaattctgctcttgatgctttctactgcatttttttcatttattgtagttttcttctctgggatttctgtttggttttttaaaagtatatgttcattaaatttctcattccgttcacatgtttttcttattttactggattgtttctctggatcctcttgaagtcctctgagctttcttaaaacagtttgaattttgtcaggcagtttatacatcctcatttatttaggtttagccattgataccatattttgtctgtttggtaatgtcttgtttttctaattattcttcatccttgtgattgagcattgatgtctgctcatttgaagaagtaagacctattccagtcctcatggactggctttgtctgggaaagccctgaggtatatgtggcactagggtgcattagaaacctgggacaattgtggtcagcacagcactgccagaaccctggggactacaacagcaggtgtgactcctggggtggactgcaaactcagtgcgcctgtagtgggcatggcattgccagatgctcagggaagctgtggccaatatggcacatgcaggtgactggggcttgctacagcaggcacagtgctgggatgtgcctgaagcacagtgcagctgcatccagtgcaatgctgccagaagccgtggcctgttacagcaggcatctttctggggcagggcagaagcttggttcagttgcagctgggtcaggtctgatgactcagttcatggatactgtcctggaatatgggactatagggatatccctagtgctgggttttattgtggtaggcccagtggtagagtccacggcaaaatcttgtgcttgcttcccttcatttccacaaagtggatattatctctctctatgctgcactgtcttgtgttggggaatgggtaacatggatgatgtaaaacagtcttttctaatttcttcaatgagtgttttcttattattttcctacaaccacatactttgatctctaagttggtttctgttgctcttgtgaatgtagttttcttgggtgtatagttactcaaattggtatttctgcagagagaaagttgctggagggtcctacttcacccctccccctcatatttttaattttaaaagatattccttcatatgtattttgctattgtattttttaaagtccatattgttcatttatttacagtagccaattgacaaataaagcacctgcttctatgtgagcaccaaaaatattttagatccatcaattcatagtttataaaacactaaatttcatgtcatttttgcttgtttcccaaatttcttagaaattacctaattaaaaatctttctttataagtatcttcttttttgctgacattctgtgtacgacacagtatgttatactatggagtgaatgaaggatattgttttttttttaattaaaaaaatacattttacctgagcaaaatcttatagaatttgatggtttctctctttgcctcagcactgatatattttaaaacaaattggttagtttttcttatgaaatagtatttcttgtttttttttaaatgaaccttgcagttatttagcttgtttacattggcattataaatattatttaatgtagtgccatatagcttgtagaaacacattaattttttttttttttttttttttttttttgagacggagtctcgctctgtcgcacaggctggactgcggactgcagtggcgcaatctcggctcactgcaagctccgcttcccgggttcacgccattctcctgcctcagcctcccaagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcctggcccgaaacacattaatttttaaactaaatttgtagggtgttatcagcattgtgaggaccggaataacatctgctttcttccctactgtgtaccagaactcagcacaattctcggtgcataaaaggcactcagtaaatatcttcaaattataaataataataataatttaaataaaatagaatatcataatgacattttggtgttttttttgtgttatattaaccaaatcatttccagcaaacgacagctacataaataaaactttaatataataatttctccctccaaacatcacaaacttttaatgtctgatgaatgtttttctcccttatcatgcaggaatctacagggaggagccgaaagtatttaatagagacttgtgagaaatttgctcatttagaatttcaagttcttgttttttactattttctctcaaattgttatctactgcctttaagtttttgtctctttatacaccactccctggttcatcactttctccttattccttttgcttttgttcactcgctttttaaatttcatccacgattcaatttagtcatcagttgtcagtgatgtcctcgatgacttagttaattttatgttgctataacaaaattctgcagactgagtaatttataatgaatggaaatttatttgacttaaatttctgaaggctgtgaagtccaagagcatgtcacagggacctggtaggggctttgattctgtgtcattccatagtggaaggtggaaaggcataagagtgtgagggcgagagtaagagatagaaaggaagggaggctaaactcatgcttcatgaggatgcttctcttgagatgacaaacccagtcccttcctcaaaatggggacagaaccctcctgacctcatcacttcttaaaggtcccacttctcacactgttgcattggggattaaatttccaacacaggaacttgagagtacacatttaaaccatagcaccagtcatgctgttagcatgtggaattacatcactgtaataaatacctgaaccaaactttaaatgtaccgtcaatgttacacaagcctctatgtatcatcatttttctctcttttgctttatagaataaaacaaatatttactttcctcaaatttttttttctatttctggttttactcttaattctattcttgtgtgtttgtaaatgccttcattctactttcacatttaataaatgttttggcagaaaatatttttcttaagaattttgaaatctttgttactgtcaagaagcctgataacattctgattccctttcctttgtttatacacttctgtcttcactctcattctctggaggctctgctgtgagtatatttgctttaagcatatctggattttttttcagtgtattggacattagggtaagcccttttactctggaaatgcagttttcatatctccgaaattttgttgtattgtttctcagatatgttccctctctgttttcccttttctttgtttctagttcttggggttgtcttcgttttgcttactagattgatagtttgttttgttcatgactatatttcatttgtttgctttttttctactttctaagagatttgattgacttttcaatatttactaatggctttttaaaaacagattttattttttatattagatttaggttcacagcaaaattgaaagatggtacaaaaatttcccataagcacctctgttcccacctaccacagactctcccactaccaacatctggcaccagaatgactcattttttaactgataaacttacgttgacacatcattgtcacccaaagtacatagtttacattacagttcattcatgttcattctatgggttttgataaatgcataatacatgtatctaccattgtactaacacacagagtaatttcacttcaactatgaatcttctttgttctacttatttatccctccctccactcaccccctaacaaccactgatgctttttcttttccatagtttcgctttttccagaatatcatataattggcattctacagtttgtagccttttcagtttacctctttcgcttcataatatgtatttaagtctcctccatgtatttacattctttggtagctcatttctacttagcactgaatacaattttattgtctagatatactacagttgatttatcaattcacctacgagaattaggttgctttgttgcttccaagtttggcaattataaataacgtttctataaatacctgtgtgaaggtttttgcatgaacctaggttttcaactttggggtggtaaatactaagtagtgcaattgctagatcatatagtaagtaagagtagatttagtttagtaagaaactgacaaactatcttccaaaatggctgtaccattttgcattcccactagcaatgaatgggagttcctattgttccatatcctaaccagcatgttgtgttattaatgttctgcattttggctattttagtaagtacctagtggtatctcattttaatttgtagtttcttaatgacatatggtgttgagcatctttttatatgcttatttcttgtctgtatatctttttgttgacgtatctgtttaggtctttttcccagttttacattaggttaaaaatggggttacttttcttctcttctgctagaagtaggaggcgatttttttccaatatttactctgagaacttggtagagttcctaaggtaaaactcataaaaatgtgaagaacctcttatgagtgagtgtccctggattttttaactctcataattgtccacactgattacctaagaatttgtcagttttagttgagggattttttgttttgctttttgccacagtagtagttcctacagaggtttctgctggtggatttctccttcaataagttgttactccctaattttgtatgtctatctctccactttttagggcattggtttgccctttgacctaacttcgctgatagttctaaaaagagttgtttatttttttagtttgttcagcttttaaattgttggtaggatgaagtgatgacttctaaactttttacatgctggcctggaatccaaaagttccaatattacttattttttaaaatttttgtatcatatttttaagagttcctctgaacccccaaatgctaatagatggagatcattgtctgagttaacaatatttctgtagggaataattatttattttgacaaataatttttattttatttcatgccggtgcagcagagatttcatgatgtttatggcatataatgatctaccagttgctctatttaatgttattacttttaataactaaagatattaatatttattgccttgtgaagcttcatattttcaaaacattttaatatttaatccgattgggaagtactgtgatacagtagaaactgaactgatttagagtatgtcaaacgtgggttagactcgtgctgctatttacagatgacagtatctaagactaaataccctttcatacaacttgggaataaaataaaatgattactttgaggatttttaagaagtaaaagtatgtgtagattattatattagctttatacttcttctgtaataaattaccactgatttaatgggttaaaacaatgcaaatttattttctttttcttttataggtcagaattttaacatgggtttaaactgggccaaaatcaagaagtcagcaagaccacttttctttctgcaagctttaggggacaacttattccttacctttttgagcttgtagaggccacctatattccttgactcatggcccctttctgccatctcgaaagccagcaaaaccaggctgagtttttgtcatatcatggcactctgaccctaccttttgcctattctctaagaattttttcagagttaccacaaagaatacttttaagagttataattctcttagagaataggcaaaaaataggttcaaagtgatatatttaaggactcatgtgattacattggacctctccaatatccagaatattctcccatctcaacttcagctgattgccaacgttaattgtatctgcaatcttaattcccttttgctatgtggcagcatatttacgagttccaagtattaggacatggccatatttgggggggccattgttctgcctgtaaaagtatctaggaaaatcctgatatagactatcaataaatggatacttgctattcattcaataaaatatttattaagtaattaattttatagattgtatctacttcagaggaaccttgaggtagacatgacaggtactactctagctttccatctatttcatctattttaaagcattggtactaatgatacaagaatgcaaatcataatctacatatttttagtgcttataaagtatataaatattatgttgtctattaaaaaaagcttgactttttttaatcaataaaataaataatatcctagctacttaaaatgatttatatttttaaattataaaactaagaaaaaagggtaatacttgtttttaatatcaggtcacacagaagaatatttttttcgcatgctatattacaggtgtgtcattgttcaaatcatctttttttgtacagaatctgaaatactccaactaatattttcaagggctttgtttgattgtgtataatgcaggtctagcagctctactaggattcttgtaatcaacacagtcattttgaacaatttgaggtgacgactttactaagtgttctctaatctgactttgttttccctatgggagcaattattctacaaaatgacaaagcagcaagggcaaaaatctagctaccaatgacataaaatcactgctttatttcagagttgggattcttgatctcattaatggcctggaattgcatgacaagcttttccatttagacaattaacatattaatccacttcatgtagtatccatctgcttatatataatttttcagaaatattttccatacctccttgcactcatggactgtagctattttcaaaagcaatataatcactagatggtgtaaaacactaatataaagtacctgggggcaattactggccttcagaaatgaaaaattacagtcaaatcattttataaatctttgaaactcagatattgaggaatagtattggggtaattcattttcccactcagttaattccgtggttggccttttgtgcagtttgacaaatcaagacttcttgtggagactggagagtaatttcattcatagctgagaaggatttttttttaaagatggctaaagtcatttatagttctataaactgaattattatgtagctattctcttatcttttttggcagtctggagcaaaatccatacttaatagtaagtgaaaataaaaaaggagaaaaaagaaaaaggccacatcttagcggttcttagaaaaactaattattgttttttagcaaatgaaatcaactttgctttgccttacctagatttcctgatgaatgataaacaggagaggctgagctatattacttttcaaaatacatgcatagggatatatataaatatacacacatatataattatgccagtgaatattgtaaatgatattatctgtggaattaacaaattatttccaaagctgaaataccacaggtcaatgccaggttctcctccttactaattatgtgacttcaggaaagtcattttgcctttctataccttgatttcctcatgtataaaatgcaaagtgttggcaaccagagaaacttacctcactcttagtgttcagggtttttatggggagtcatgtacttaagtatgcagcgtctgtgtgactgacctcagctactctgctgctttgaactcccctaccctcaagagcaaaaataagcattcactgtaaatcatattgttagtgtaaactatctgatcaaaccagtattgtggcttaaggcctcagacctatagaaatactcttaccaggcagaatattccaagggctcagagctcatttcctaggagctggcccagggccagtgctgcagacagccttttcctgggaatatgcagggtctgagcaactttggtctgttgagttaacctttatgttgcaaattatatctcaaaatagtcaagaacaaaagcataaatatttgttacaaactctttacatttcttgttcttctatgataacactattgtagcctctgtcagtgaaaggagccaaagaatatttctttaatttgataaagcatttcatttaaattaagagttaagatttaaaacaggatactttgcttaacagaatccatggggaaattgagttttgattaattgtgtgttttattttaaaagggttaactagaaagacctttttacttatacttcctcattgaaaataattccaaaatattttagttattttcttacctgaaaaactgcttgaatttctaatgcaataaattgaataatatttttcatccagaaattttaattcaaatggcaacaaataagaaacaaagatgggttaataaatatatagtaggataaatattttaatctataatactaaattatagattgtaatatctcaaaattaccccattagcaattattacaatactatatgtgaatgaatcagcactaacatccaaaaacagtgattgaagaaatccctttaaacaatttagctatgagcacatgtaaaagatgaattataatatttcatgcaagaaaaaaagacttttagtagaccagtttaataatttatttttcttcaggacattcagtaggaagatagaatgatgaaatgatcactgtgagacggaaaggaaggaagacttggttaagatctgtttgattacgttctacttaatgcaagtttatacatagttaaggggtatgtgtgtgtgtttgtgtgtgtatctgtgtgaaatatatatattgcacagttcttattaattaattatttaattagcacctaaattgtcaagaattattttgggggaaatccctttaatggaaataacttaggttttgaaaacaaaaaatatgggttctatgtctgcctcctgctctccgtgtgactctgatcaaagtgtttacctccatttgacaaagtattttgtaccctcagtttactcatctgtattttgagtttttgcatggggactattttgttctttgaaagagaacttgttgtaaatgaagatggatttagacaaaaaaatagcttcatatcagtacagagccttgatttttagaggaaaggaatgactttttttttttgtgattttttcacaagagtggtagcaacgtaccatgtgtagattactttgataggaccaagcaggatagatattatcaaaggaggaccaattgatgaatttcattagctgagtgatttttttcttattgttttagtgtataggaatcccatttctgcatttcttggtgggacaagaattgataaaacatgggttacatctgaataatattactactgacctcagctgttgctttcagctctcccacccccaagagcaaaaataagcactctctgtaaatcatattgttagcgtaaactatctgatcaaacttgtattgtggctcaaggcagaatatttcgaggattcagagctcattccctagtagctggcaaagggccagttctgaagacaggcttttcctgggaatgtgcagggtttgagtaactcaggtctgttgaatgaacctttatgttgcaaattatatctcaaaatagtcaagaacaaaggcatagatattagttaggaactctttaaatttctttacctactattatattaataacactttagtgttaaaacatgggtgacatgtagtattgctactccacatgattagtacaaagcaaattaaataatgactataaaagcactttataaacccttaaatgctaaatacatgttaaaataatcattgtttatcaatcagttaacaccaatatacagtcaaacacaggttcttaagaagaacttttttatcattatgtgtgaggtgaactcctttgacagggttttctctcattctgttctcttagctatggaccacttgatcagtaagtaattcaaatgcaataatctgtaggagacatggatatttaaagtaacccttttcaggtatccctatgttgatgattaccttcacactttaaaacatcgagagtgaagtagaaaattgatccaattacctgactaattcatgcttgagaaaaaatatagttttttgtttggcctatgaaaaattgactaatattataaatacactacttttaatttgcaaaattacttgtattgatatactgatctgtaatctgaagaagaatcattactaataccatttttcagttcttaaatacattcagtttgttatgtctgtgttgaatttatttttcactggggttaatatttcttgttttcttttattttacctcaaattaaccacacctactacaccaccttctactcaatggttttgtgagtccgttaattatattacattatttcacattttaaaaatttgtggatatgttttttgttttttaagacggagtctcgctctgtcgcccaggctggagtgcaatagcactatctaggctcactgcaaactccgcctccctggttcaagctattctcatgtctcagcctcctcagtagctgggattagggtgcccgccactacgcctggctaatttttgtatttttagtagagatggggtttcaccatgttggtcaggttggcctcgaactcctgacctcaggtgatccacccgcttcagcctcccaaagtgctggggttacaggcatgagccaccgcgcctggctggatatgttttttaaattgaggtatacttctgtgaattctgtataagaattcactttagaaatacatttttatagatattaaaaaaaggaaaaatatgctttctgccaaacatgctaaaatgttaacctatatcttggtgacgaccgaaactttaatttttttgcagggaagtatccttagtattgatttgcagccaagcttgtctctatctcaaaggtcacaattttcaaacgagaatacctttttatgtggtgtttcagcacatctatttttagtttcagctaaaaacaagaggttaaaaatcaaccatggatgaaaatattcaaggaaaaaaactgatttttttttcaaatatgaaaggagagtcttgtaaatgtcaaatacaattattttagggataaaatgtaattcatgttatctttgaaatatgcagcaatttaattttaattggaatatattatttttcttattaatgtccaataatataaaaggtacaatttaaaagaaaaaagttgtatcaagattataattgtgcatattaattcaaatgtcacggtggtatgcagaactctaagctgagcaccaagatctccattccctggtgtacataccctatgtaattccctaggactgtgaaataggatggctttcactctctgcagctgggttatgttataaagctacagggattatgcatgtttaattaatgtctcaaatcattgatctcaacataaggagattatctagttttgcttgatctactcataaaagcctgtaagtctgggcctagaggtcagacaaagataaagtcagagattccaagcatgaagatttgatgtagctttgctagcttgaagaagagaaaccacacggcaaagaatgaaggtggcttctagttgctaagagccagcaaggaaaagagaacctcagttacaggaacttcaaggaagcgtaactctgacagcaacagaaaaagcttgggggtgaatttctctttagaaactccagaagagaagcccatccagattctttgatttgggccttgtgatactttgagtagagagcccaaccactgtatgccagacttctgattacaaaattgttagctaaaaatttgggtattgttttaaagcactaacttgtgataatttgttttgcagtgatagaagactaatacgcttcctataaatttagccaggaaaatatgccatgtaacacagtgcttactagcacacttttaatatagaaactaaatataatccaattaattggaagtatagctcaaataatatatcagactatgaagtacgtatttaaccatgttttagttcaatttttaaatttaaactctcaagcagattataaacagatttgacaaaatcttttttttaaaaaaagcacaatgatttaatggaattttttgatattaaaaacttttggtctttgaaagacaccattaagaaaactaaaatgaaagccacataatgaaagaagatattcacaatacatttatcttgcaatgggcttgtatcccgagagtgctcaaagaatgcttataatttaataagaaatcaaacaattcaattgagaatgaacaaaggaattgagcagacccttaaccaaaaatgatatctgattgaccaataaacacatgaaagatactttacaacatttgtcatcaaggatataaaaattaaagccacaatgaaatattactatgaagccattaaaatagttaatgttgaaaaaactggtaatagttaagtgctggtgagaatgtgaaacaggtatcctggctggcgaaaacgtaaaatggtactaacaacttggaaaactattggagttctcaaaatttatatatttttgacaaaatcctttatgtacagtaaaactcccatgattcattccacatgatagttaaatcttgattaaactataacctgcattggtgtaaaaaataataatgaaagtgacaataacaggaaaggcttttaagatctgtttgtttctttaattgcttgcatgaaaacaaatgattcaatatactctaaaatgctttcttattcttataaacctagctaattaatattatatgaagagttacctttactttgcctataactagaatttgtgaaagtatctttaaatatacattattaatatagaattttgttactaggttgaatgacttttttttcatttaatgctggctgatgaagcataaacatgttccaaaaaagtaacatacgggtgtgtgactaaaaatgttaatgacaaagtactgatttctcagccctgatatttctatactgatatccatcccagtagcatgttaattcccactgaaattctgattattgatactactgataaaaataattatcctctatgtacggtctcttatgtgtcagacactgtgctatgtgacattatcgcatttgtatctcatagtaacatcaagaaatttattttctattattatcctaacttacaactgaaaaataggtgaaattcattaataatgatgtctacttagatgtcccagaagtatctgaaatgtaattatctagaacaggggtccccaatccctgatatcagtctgtggactgttaggaaccgggctgcacagcaggaggtgagtggtgggtgagcgagcattactgcctgagctccacctcctgtcagattagcgctggcattagattcatgagagcacgaattctattgtgtgctgcacatgcgagggacctaggttgcgtgctccttgtgagactccattatacccccccaccccagtttttttccaatttgtccgtggaaaaattgtcttcacaaaactgacccctggtgccaaaagattggggactgcggatttagaagataagtgttgctaaaaaataagtttaacacagatctattataatttgctaaaatataactgtcaaagagttgaaaacatgaccctcataaatataaatgaaccaagtcagtgattttattcaactaattaattaatgcgagaatcagaagatgccaaaactggttcaaaggattattaaaagtactgagattaatatagtcagtcagagaacattaagaataatttactaatagatgcataattgcttaatatcctacagggctatgaactataacatttgagattgttgcctctagcagctagaaataaatcatatctatactggacaacatttctttagattactttaaataaaaatcattttcattgcttttataaaagaatcaattgcattattataagtgcaagttaatttcacaagttgtttatgagtaaattttatagaataaggaagttttccagaaaccttatcagcaatgctgatatgatgctgtagtaggcagaataatggcctttcaaagatgtctcttctctaactgtgaatatgttaccatccatggcaaaagagattttgcagatgcgattaatttaaagatcttcagatagggtgattatcccggattaccttcgtgggcctaccataatcacagggttccttaaaagtgaaacggggggaggcagaagaaaagttaaggccagagtgctgtaatgtgataaggactcaatcaccattatactggctttgcaaatggatcaaggtcatgagccaagaaatgtgcggagcatcgagaagttcaaaaaggcaaggaaatggataatctcaaaaagaaaaatagtcttgcaggcaccttgattttagaccagtgagacctctgtcagacttctgctctacagaactgtaagataatatatatgtgttattttaaaccactaaatttgtagaactctattatagcaaccataggaaattaataaaaatgcctggccggatgcagtgatcacgcctgtaattccagcactttgggaggccgaggtgggcagatcacgaggtcaagagatcgagtccaatcaggtcaacctggtgaaaccccatctctactaaaaatacaaaaattagccaggcatggtggcaggtgcctgtagtcccagctacttgggaggctgaagcaggagaatcgcttgaacccgggaggtggaggttgatacagtacatgattattaataatttgttgactggatgaattatttagggttcaataaatgtaactcgtttaggacatatagttaataaactggatcctagattaagcctctgtgcctgtccctacaacctgtacttttaccacttaagttgctttatttcttgtgtagtcaaaaataatatcctttaaatcatttccttagattattttgcctagattctccacattcattctgataaggaaatgatttatagttgataatgtttattatttagttttaataaactggaaaaaatcaatttcaggcatatgttaaagatattgcaggttcagttccagaccaccataatcaagtgaatatcacagtaaaataaatgtcatacaaattgtttgggtttcccagttcttataaaagttatgcttatactataccacagtctattaaatgtgcgatagcattatgtctaaaaaagtccatactttaattaaatataccttattgcttaaaaatgctaacagtcatccaaatcattatcttttggctattggagggcctgatctcgatgttgctggccactgactaatcagcgtggtggccactgaagcttgggtagctgtaccagtttcttaacacaagcatcaagtttccaccctgattcactcacaagagatttttctgtattatgttatcatttgatagcatttaaccgacacttgaacttctttcaaaattggagtcagtcctcttaaaccctgctcctgctttatcaattgtttaggtaatattctaaattctttgttgtcatttcaacaatgttcactgcatctttacatggagtagatttaatctcaagaaaacattttccttcttcatttataagaagcaacttctcaagcattcaaattttgttatgagtttgcagcaattcagttacttctttaggctccacttctaattctagccctcttaatatttctacaacacctgcagttatttgcttcccttaagtgttgaaattttcaaagcccctcaccttccttctgcagcttcctgacctctttcatccttcacagaatctcatcttgaattgtagctcccctaattcccatatgttgtgggagggacccagtgggagataatggaatcatggggtcggtttcccccatactgttctcatagtagtgaataagtctcaagagctgatggttttataagaggtttccccttttgcttggctctcatttctgtcttgcctgccgctatgtaagccatgccttttagcttccaccatgatggtgagctctcccaagccacatggaactgtgagtccattcaacctctttttctttataaattacccagtctcaggtatgtctttatcagcagcatgagaatggactcataaaactggtatgcaaataagcagactctacatcatagtattccagtgtagttgaactattattataatggagtccctatccataaaattgattacaatctaatatggatttgtgcaataaggcaaatataccagtaactaaaatacagggaaagtatgctacagatgaattaatttatacaaatatatgagtcaaagggagaaattattcaattaggtaaaggaggaaagcatttattaaaattagagagggtgtctgggtgagagccaagtctgaaggatttttttgggtaatggtttctttactctattttctatcacatgttgaaaattttaacacattgctgtcatcagaaggtgtttataatttttttgtttatagggtttataatttttttgttttttaatttatagatttatttgattaaaaaagagtttcatgtaccagagatgggttattgaaaataggcattgtttaaaatatgataaatattttatttgaaaacttggatttttatgatttacaaaaatctggagaaaaaacagggcaaaaataacagaaaatgaacatatatttaaattccccaaatattcaaatatatcattatattatgatgaagacttacatattactattttgtaatatgacaaagatctattcttacatttattatgataaaatgttgctataatatgagttcattatatgaagctctgacatgttcctctcattcttcatctaatatctaataatgactacctgcaaggagaaataatcactcaagttgtttacttttgcagaaggtgcagtctctttcagagaattctaaaaaaaaatcacattctatttaaactagaaactttctattaaaataagtgaaatgtagttaacaaaggatatttatttttatgtattttgttagttactattttccttattttgaaaaacttcagatcactggaatatctacattacaaagtggccagattgtatggtgtctgtaatctcattaccttgtggtaaaaacacttaattttaggctggacacaatggctcatgcctgtaatcccaatattttgggaggctgaggttggtggatcaccttaggtcaggagttccagacaagcctggccaacctggagaaaccctgtctctaccaaaattataaaaattagccaggcatggtggcacatgcctgtagtcccagctactggagaggctgaggcaagagagttgcttgaaaccaggagaaagaggttgcactgggccaagatcatgccactgcactccagtctgggagcctgggtgacagagtgagactctgtctcaaaaataaagaagattggccaggtacggtgtctcatgcctgtaatcccagcactttgggaggccaaggtgggcagatcacctgaggtcaggagttcaagaccagcctcaccaacatggtgaaaccccattgctactaaaagtacaaaaattagctgggtgtggtggcgtgcacctgtaatctcagctactcgggaggctgaagcaggagaatcacttgaactcaggaggcagaggttgcaaagagccgagatcgcgctattgcacaccatcctgggcaaaaagagtgaaacttggtctcaaaaaaaaaaaaagatcagatggctgtagatgtgtggtgttatttctgaggcctctgttctgttccataagcctatatgtctgttttggtaccagtaccatgctgttttggttactgtagccttgtagtatagtttgaagtcgcgtagcatgatgcctccagctttgttccttttgcttagaattgtcttggttatatgggctccattttggttccaaatgaaatttaaagtagttttttctagttctttgaataaagtcaatggtagcttgctgggaatagcattgagtctataaattactttgggcagtatggccattttcatgatattggttcttcctatccatcagcgtggaactattttccatttgtttgtgtcctctcttatttctttgaacaatagtttgtagttctccttgaagaggtccttcacgtcccttgtaagttgtattcctaggtattttattctctttgtagcaattgtgaatgggagttcactcatgatttggctctctgcttgtctaatattggtgtataggaatgcttgtgatttttgtacattgctgttgtagcctgaaactttgctgaagcttaaggagtatttgggctgagaaaatggggttttctaaatatccaatcatgtcatctgcaaacagagaaaatttgacttcctctcttcctatttgaatacaatttccttcgtttgcctgattgccttggccagaacttctaatactatgttgaataggggtggtgacagagggcatccttgttttgtgctgactttcaaggagaatatgaacagacacttctcaaaagaagacattgatgcggccagcaaacatatgaaaaaaagctcaccatcactggtcattagagaaatgcatatcaaaacaacaatgagataccatctcatgccagttagaatggcaatcattaaaagttaagaaacaacagatgctggcgaggctgtggagaaatagaagcacttttactctattgatgggagtctaaattagttcaaccattgtggaagatggtgtagcgattcctcaaggatctagaatcagaaataccatttgactccgcaatcccattactgggtatacacccaaagggttataaatcattctactataaagacacatgaacgtgtatgtttattggaacactattaacaatatcaaagacttggaaccaacccaaatccccatcagtgatagaccggataaagaaaatgtggcacatatacaccacggaatgccacgctgccataaaaaagaatgagttcatgtcctttgcatggacatggatgaagctggacaccatcatcctcagcacattaacacaggaagaggaaaccaaacaccacatgttctcactcataagtgggagttgaacaatgagaacacatgggcacagggagggaaacattacacacgggggtctgtcgcaggatgggagcaaggggacggagagtgttaggacaaatacctaatgcacgcagggcttaaaacctagatgacctgttgataggtgcaggaaaccaccatggcacatgtatggctgcataaaaaacctgcacgttctgcacatatatcccagtatttaaagtaagataaaactatatataaaaataaaaaaagaaaaagaaaacactgatttttaactgacagattatgtccccctaattgcaggcattagaataatttaccattgtgataatgcttgaaagttggattatattacagacctgtaagacggcattagactttgagtcaaaagtattcattcattttttttgtgtatttttgtgttaaattaacagctttaaaaatgtttatagggatacatagtaaaatagctatatgttcatgtgtgaggattggataagcatgtgaaatactccacagaatttgtgctcaattttgggacttcacctgccttgctatgaataaagtatgtattcttaggatacataaacttgtatattattttaatcttaatatttctaatcatctcttacgcacagcctacttctttctctataactgatggtgattaattgcctaattacttgccccatatgcttctcattattttgtgttgtattagctttcttttttttcatctattgaattagagtaggggaatttaaagttcccagacagtacgttatggttctttgtatcctctgaagtccctaatacagcactctctccatactgggctatgtgatacatttggaaaagcatgaggtttgaagttcagacttcaaattctggctgtatgtgttaactcagtacacttgagaaaatctcactcttgttaaactcttctataacatcaggctggtgtggtaagatcagtagcagtctatgagaatcaagtgagaaccatttgcacaaaataattgtataaattccagatagctataatatatactgtagaattcttcattagataaaatgatcatactaaagagtataataacttaaaaaatatagacagctattattaatgcttgcaaaaattactatttcaatggaacttactttggatttattcatttttttaatcacatcataggaaaactaaacagattctaactcatttagttgttccaatttaactttaaaaggaaatagaaaaagcaaaggagcaaacaaaaaaaatcctgtgattctaatgccaccagttaaatcatagtgttactggtggagggggtacaggttcttgacgtcttgaacaaagaattagatgaaaatgcacaaagcacggaaagaatgaagcaacaaaagcagagactaattgaaaatgaaagcacactccacagtgtgggagcaggcccgaggatagagactcaagagccctgttacagaatttttgggggtttaaatatcctctagagatttccactggtaactttgtgtatgccctatgtaaatgaagaggatatttcctgtcataactgaagtgtttccatttgatttagttctaggaagtccttaggtttccagcctccaggttctattctcctgcctcgatagaggctctttaaattcacgaaaatcattagcccttttgcactgtatatattattgttgtatattttccctgggtgttatattcatattgccttcctttacacccgaattctgcttggatgcgtctcctctgtgttcttaaaacaagacaggtaattcctattatgttgcatattataatttcttcttattgtactttccttaactttttattctacaggactaagagctctgtgagtgaagggaccatgtctaccttgcacactaatatattcaaaatgactaattatgttcagctcatagtaggatctcagtaaatattggtcaattatataactgcagatgtacagcataattaaatatatatgcaggcccattgtaaagtggttttattttagaagcaggaaaatctttacaatccaaatttaaatttaacctttggaagttatgctatggggatgtggctattggcattcactaggcaaattcacctaggattctttttttccccagaaaaggaaaaaaaaaacaagctcaaaccaacttaagaaaaagatgttttattttctcttttaactgataagtaaaggatactatgtggtttaaatgaagtaatcatggctcagactcccatctccccacgtgttctctcaggttctcaagtaggctttcttcacttagcactgtgtcttgccttaaggccaaactttgcttcttgccactcataatttagtaagaaacatggctttctcccccatgatatgtatataaatatgtagggaagaatttaactagccctgtgtgattctagtgcccatatcttgaccaattgctgtacccaacataagtatggacagggttaatatgcttagatacctttctaccactatagtaaacagtctcacagaactcaatagattggggaagcagtgattttggatggaaggcatgagaaacaggtaaaaagcatttcttcactatattatgtctctttaggttttgcctttatgtggcaaagaaatagaaaagtctccactaaacgtttcatttagaccatccttgtgaacaacatgtagagttctaccagcagaatagtaaattgtgaactctttcatttaagaaatatatcaaagaattgaggtgctttttagccccaaacattgaaaatacatgagacaagtgaccatgtcagagttaaaacttggttttagataggtactagctaacaaccacaacacctagtattagatgcttggaaagcaacaaaaactctttcctcagggaagcattgaggatttagatgaattcagtgttatttataaagtgcttattatatgttctttttattttaatatcataagtaatatatttttatactttaagtgactaattatttgatttcatcgatctattaacaagtgttttgagttacttatcagagaattcatcataaaacacatacattaaacatctattttactactataaattcttaaacttgatttcatccagtagttcttatcatgtaatttcgaatgcaatgtaatgtagtcagaaacgtgtagaatatcttcatttaaatttgtcaggcatcacatgaagttaaaactcatagtggtctataagaaaaagcaaagaaaatactgttgcctcaaacagttattttaacagctgagatttttatattgaaataaactaataagaacgtttagtgtttgaaaattatggtaggcacttgaaatatttatatgttaatagttaaatcactcaggcaaaattgaacatatttataaaaaatttattctaaacatatggaaggaattctggattaaccttcataatatatttgaaatacgatatgttggaaattaactgggcttagcttgtattcctagtttgggctctgagacacgattgaaataattaatttcaacaaagaatatagaaagtatgaacatgtgttggctttcaaaatgtgaacaacgtggtgaaattattagatccttgggtggttctggtcttaattcatagcttaaaatattatgtagtgagagacttatatgctttagttttttagtatcaataacgcccttgaaacctttctttgtactcctcaaccagacctaggtgttttctccttaaactgaaacattcattttcacaaaaaataaaataaaataataaagaatagtcaagaacttgacattattttttgattagacttgttgggcagaacatatcttttatagaatggtatgttgtaattgatttaatatggaaagagagaaaaacctcttatataaagacaggtgctttgcaaatttcagtgttcatacaaataacctggagagtttgataaagtactaactgattcttggattccacttccagaggtcctgattcagtaagtggtgcctgagtgcttgcatttctattatattctcagatgatgctgatgctaatggtctgtggagcacattttgaatatcgcttaggtagaactactttggaaacaaaactatttcctcctttaaaaattaaactacaagaattaaaagaacgcacactaaaaacatgtgttaaactaaaaacaaattgtaaaaaatttaaatgaaaatattaaaatcaagtcaaattatttatgatcatttatgttaattatataatagaaaaattctcatttattcaattaaagttatttaatgctttttcatggtctgttcatatctgattttcattatggtgaagtaaaaataaaggatataggtgttaaatatactgatttaaagtataggacatgtactaacaatgatataattttttaaatttggcatttaagcttatttctatattgactatatatagctataaaacacatccctgtcatgagtcaacttgatttttttctaggacaatttaaagtatcagttcaataaactagcttaggtacatagtttactgctttggaacttcaaagtgacagtcaggtacaatcaatatgaggaaataaaagaaggattcaattctcttgttactgataagttcaagaatatctctgtaaaagtaattgctaaaccagatatttttttaccaaaaaaaagacaaacttaaaagcccaaataataatttatatgtaatttaaatgattaaaatcagtcataagttctttccaaaggaaataacaatttcagaaaagaccatgatttttaaaaatttcaagtgtactgtaataatacaatctatgatgaatgacagactgaaatagtgaatcatggagcttggatattatcaagaaaagacaataaaaaataagtaatttcttatggacatttaaaaacttacagctaaagagttttcagtgtttttatgactttttaaaaattattctcagtcatgattagttagtgctaattcaatctattaagttacaatttcaaaaaggcattttataaaatgtaacgtatatttctacagaaatttaaattctatcttctgatggtttgcttatcaagtaagcccatggactttgtaaaattgaaatcaaggtttacatcactctgaataagctggaaaaataccgtaacctgcagtaggaaaatcaaagatgaatgaatcaaatacttattctgcttaattcatgcctctgatcattttaaacttaactaattggtattatgagttcccaactgaacatgtgttattatataactgcattcagtatgtattttgtcttattagaggttacatattgctttttatttacatagctttattaagatgtgattggcatacaataaactgcatgtttttaaaatatactatttaagttttgacatatagacccatgaaaccattaccaagattgagatagtgatcgtaacacctcccataattttctttaattttttttaaaaaatacatttgactgtgtatatttgaggtttacaacatgttatgagatacatatagatagtaaaatggttacaatagtgaatcaaattacagtatctgtcatctggtatacttatgtttttgtaacaagaacagttaaaatcttatttaacgaaaattcctaacacaaaacaatgttatcaactatagccctcatgttgtacattagatatctaggcttgttaattttatatcttttgacctaaatctcctcattttctccctgccccacctgccatggtagccactttttaattctctgtctctatagggttgaccttcacttttttagattccacatataaatgcaatattattctttctgtgtctggtttatttcacttaacgtaatgtctttccagtccatccatgttgtgtcaaatggcaggatctgattttttttttaaacgctgagtaatattttgttgtatatatatcacattttctttctccatttgtctgttgatcgacacttaggttgtttccatatcttgacaattgtgaatgacactgcaataaacatgacagtgtagctatctttagggagtggtgatttcatatcttttgagtctattcccagaggaaagattgctgaatcatacgctagttctatttttaatttacataggacctttgttctgtttttcctaatggctgcaccaatttatttttttattattatttctttattttttattttttaaatatactttaagttttagggtacatgtgcacaacgtgcaggtttgttacgtatgtatacatgtgccatgttggtgtgctgcacccattaacttgtcatttaacattaggtatatctcctcatgctgcaccaatttaaattcccaccaacagcatgctatagtttccttttctccacaccttcaacaatatttgttatctcttacctttttgataatagccatcctaacatgtgtgaggtaatgcttcacagtggttatttgtatttgcctgatgattactgatgtagagcactttattatatatttgttggccatttttatgtcttcttcagagaaatgtgtattcaggtcctttgtccattttttaattggatttttaaaatttttctgctgttgaattttaagagacactccaattcaggagattgggggtggagtggatcatagaggggtggtgtggtgggacactgggttggctcaggtgtctacctcactgggcctaggttcaagtagtcaggggacagggtagacattagaatggggagatgagcctctgaggcaccttgttcccagagtagggagctatagcttggctagggaatgttgcagtatcatgtgtgagagcatggtgcaatgatggcaaaacctccgggatgaaggaatgcagtggctactggccattagaacataatgcactctagcagtggctctgggttcagaacgtgatagtgcagtggcagcttgggtcatggggttcagggcacaatgtgggctccttctctagagtagtacagccatgtgaatcccaggcaattccctaagctgtgctcaggaactgtaaagactgcaggatcctccagtagcaaaaattgcaggtatccgtggtggttgatatggtttgactgtgtgtccccacccaaatctcatctcaggtggtgatcctacatgttgagggatagacctggtgggaggtgactggatcatggggtggtttttcccattatgttttgttgatagtgagggagttctcacgagagctgatggttttaaaagtgtttggcaatccccttttcattatttttctctctcctctcgccatgtaagacgtgccttgcttccccttcaccttctgctatgattgtaagtttcctgaggcctctccagccatgtgtaactgtgactcaataaaaactcttttctttataaattacccagtcttaggtagtatctccatagcagtgttaaaatggactaatacagtggtgatgagggccactgagggtctcttacttgcctttctctatctggagaagccccttgtgatccagacttggggatgggatggcagaggcaatgtgttttcttctcttcttatgtgaccatcctgagtttctgtgctccacagggtttacctcactcctttgctgcactctggcactcctctttagttactcaggtcaaaatgcagctgcttattcattagtttggttcctgattgttggagagtgataagtgttaggcacacctctagtcagccatcttgctgatttctgtctcagaattttcttgtgccctttgtaaatcttctttcatccctcctgctgtggctccacacagccactgcttagttttctgtcactaaacactaattagcatttcttagaactttatataaatggaaacatatgtagtttttgttgtctggcacttttcacttaacataattattttgatgttcttatgtactgcagtgtgtatcagtaggctatttattctaattgtggagtagtattctattgtatagataacacacactgtatccattgacctgctaatggatatttggattgtttacagtttgaggttactgaaaataaggcttctatgaacatgagtgtaaatagggacgtaggtatttatttctcttgagtaaatacttaggactgaaatgatatggtcaggacaggtttaaatatttaggagacttccaaactgttttcaaacaggttgtagtatttcacatttctaccaggagcatatgagatttcctacccaaaacttggtacagtcagactttttagttttagccttttagatttgtgtgtagtcatttttctttgtggttttaatttgcatttccctattgttgagcatctttttctgagcttatttgctatctgtatatcttctttaatgaagtatcttttcatatctttttcctatttgaaaaatatgtgttaattgagattttagaactctctctatattttggatacatgtcaattattagatatatgctgtgaaagattttcttccagactctggctaatcattttattctctgaatggtgtcttgaaattaagtagcactagtccttcaaatctatgattttttttcaaagacatctagctactttatgtcctttaaattttttttaaattttagaatcaattgatcaatgtctctcaaaaatcctgctaggattttgattgaaatacatgtaattatagatgaatttgagaaaaatttttatcttggcaatatttagtcttagtgtccatgaacataatatatctgtttaggtctttatataagcaatattttttagttttctttcatatttctgtcagatttctatgtattttgtatttttgattttattgttagtgatattattttatttcaaatctatttttttcattgctaatgtattgaatacaatggagttttgaatattgatcttgtacaaactcgttaaataacttattagttctagtaatttcagattttctaacacaatcatgtcatttgcaaataaatacagttttatttctttctttctgaactagattatttttatgttttattcttgccttatttcataggctagagtcttcagtacaatgttgagcagcagtggaaacagcagacatccctgtttttttctttaatcttcaggtgaagcatttagtctttcactattaagtatgctgttagctctgtgtatgtatgtgtgtgtgtgtgtgtttaatatatatttagatatcctttatcaggttgtaaatttcctttctgtttctattttgttgaaagtttttatcaggaatgaatattggaaaaaaaggcaagtacattttcttcacttttctctccctcccctccgtgcctctttcccaactaaaagtttatcaatttgattaatcctctctgagaggcaaccaaatgaagccaaaagttacatttactttctttacttgtatgctattttatttagttccattctcatctatgctatttctcacattaggtttcatttgctctttttgtttacaggttcttcagctgaaagctggatggcttttttttttttgagaccttattttttatttatctctaatatgggtgtttagtgctccaactttctccctaagtattgctttcacagcatccaacaaattgtatatgctgtatattattttaatttggtataaaatactttttatgttctacttttatttttatttgacccttgaattattttataatgttattttttcccagcagttggagattattcagggatttttctatcactaatctttattttaattttatttggtcagagaacctactttgtatgacttgaattcttttaaatgtagtaagatttgttttttggtcctgaatatgatctctcagtaaatggtctctgtgaactttagaggaatgtattgaactgtttttggatggagtggtctataaatttctggtaggtgttgttctagtcttctacattcttatagaatttatgtctacttgttcaaccagcattgtgaggtagttttggaagctctgactataatggggcattttcagtctatcagttttgcttcatgtattttgaagctctgttattagctgcaaagcacatttaagatttttctgttcctttgaactaacaaccccctttttcaatatggaataaatttctttatacctggtaatattccttgaatgtattttggctattattaatataacctcctctttttatgtagttaatgtttgtattatatatcacctttcattattttatttttaatctatgactttatatttgcatttctctataggcaatatatagttaggtctttcggcttgatcagatttgacaaatgagacattgtgccttcaagatgggctgtctcattcacccaatatccatcttagtatatttattaattttaatgtgtgcatggtattctgttatattatcaactggccaagtagtttctaagcaacaagcaactgccaggctacatttccacattttcatggatttgaccaataaagaataagcccaagtggatttagacagtttattacccatgacaaagcaaacaatatgatcttcatgttcacatttctacccctgcttaccctccgcaagtctcatggggacaatatagaagagtgcaggtgaatactatgcacataggattatttatcactgagaaggaacaagtgtaatcttataaggagactgataacaaaccttcccaacctttgctacacaggggaatttctcctttattaccccgatcaggaaacaaatctgtcctctctcctagaggtagacactacctttgttattccgaagtgcttctagggaggagagagagactttagccttagtaccatggaaagtaagcagatctgttccttgacctggagaagctttgacaaagctgtcaatgccctttcttcagaggttgtgtagaaatgtcagacttacagggaattttctcccaacatatttagaagtatcggttacttctttcagaaaaaatgaagctactcagtattttaaggaaaagtttagtagaagaaaatagaagcgtatgcagtggctggaggagtagggctagcaaatgttaggcccattatttgctatcaggttatctggacgtgcagacagagccaggtaagctgatgctgcagatctgtactgctggtggcataaaagtgtttaattatcaggaggatgcctgaaagctattgggaaaactccaggtcttcagcctgctgtctgccaatgcccttgtgcctgtcctcagccctgccagagaataatggcttttcttactcttccacatcccaaatctcattcaagtgatatttattggcacaatctagtggcattctggaatttgggtaggatacctctcaagctcttcccttgtattttaggaaagtatatagatgaaggagagtgatgttgaaattgaaaacaatctgtggaagcctttattaatgtaattctaacatcttttctcttaccacaatactttagtaaataaccttgtacatctcccttttggcacatgtgggaggatttccactggatagatgcctagaaacgtaatggctcacagtgcgtgcctatcatacattttgatagatgataccaaattactctccaaaagcagttgctttccagggagtaactgtaggagaagggaggagaaaaaccctgtttgtagatgatttagaagcacaagttagtactcaagtctccttcatggacactgactcagtgcctttgggtggtgactctgtgaggcaatgggagggaagaagaaagtgcaatgaccccacgataccttattataagacctaacatctagcatcaatctttgaaccatcgagaaagaaagaagaaatacaggattgaatgtcttgtctcaggtcttatgccagcagcttgtacatggattttccaatttaattgtcaatgtaagtctatgaaatatattattctccccatctttcctggtgaactattgaggggtagatgccaagtagcttgttagagatcatgcatttaacaaatggtagggataagattcaaaaccagctgggaaaaattacaaaatctgtattttttttctatatctcacagaaatcttcccttcttggtaaacatccttgagcctcctattattcttttatggctagtttactgtcttcaaggctgcccatgtgtaccggagagaatacagactctggagatgtaaagacttgaatttgaattaaaggttgagtcccatgttcaccatttattatctgtgttacttttgagcaattcaattcagctctttaaatttagtctcaacatctataaaactgctataatgaaacatgcttggcaagtttgttgtgagcattagagataatatatgcaatgtgcttagcatattgttacagcattaattatgtatacttatgtatacattgcaggcgagctgcccgcttccgggatccactaggcaaagccagctgggctcctgagtcaggtggggtcttggagaacttttatgtctagctaaaggtttgtaaatgcaccaatcagcacttcgtgtctagctcaaggtttgtaaatgcgccaatcagtgctgtgtgtctagctcatctagtggggacttggagaacttttatgtctagctggaggattgtaaatgcaccagtcagcactgtgtgtccagctcaaggtttgtaaacacaccaatcagcaccctgtcaaaatgggccaatcagctctctgtaaagtgggccaatcagctctctgtaaaatggaccaatcagcaggatgtggatggggtcagataagggaataaaagcaggctgccccagccagcagcggcaactgagtgagctccgcttccacgtgtgggaggtttgttctttggctgttggcagtaaatgttgctgctgctgactctttgggtttgagccgcctttatgagctgtaatgttcaccatgatggtctgcagcttctctcttgaagccagctagaccacgaaccccccagaaggaagaaactcccgatacgttggaacattagaagtaacaaactccggacatagcatctttaagaacggtaacagtcaccacgagggtctgcagcttcattcttgaagtcagccagaccaagaaaccaccaattgtggacacatcgggattggcacatgttgaatgctgtgagactagatgccaaagtatgcatgtgttgtgaattatgtttacaagatgttataaatatgggccgataaagttgatatttataattccttaaagtcacgtattaaatctgatatattttatctcttcacaagtcaaaataaacttagaaagttttgagaaacaaaaatatagactagaatattatatgcatgtaagactgtacaaatccagtctaaaatgtaattaatgtatcattgtttcctccttgggaaaattatccagtagtactccaacattatgtctttttctgtctagtcctaatgcagaggagacaggaaatcagaaacagcttaaaacccttggtgatgtactagtgacagttgaattagaataaaatatgtgtcttttgactgcttgctaaaaatgtaaatgattttttataattttttttgacttcttagtgccagtgtgtttacattgaccaaatattttggtgaaagttttgtatattttttttcaaaatgttaagacaataaaaatatttgagttcaacaatgtattcttagaaatatatttctagttttatagtgcttaagtttattagaatatgacaataacatatgccaaatcaatgcttaaattgatactttttataattttcttgatcttgagaagtcttaaaaagaggtactatatttttcattataatatataaagatacctattgattataatttcatttggcttaggaatttccctttgaaagaaagtatcattttggatgaatgtagaatgtatttaaaaattttaaacaccgaagagataagtttatacacttggactctgttattaataagttatggccattatctcttccttgccatggggagagtcctagttgttattatactgtcatgtgtcacttaaagatgcagatacagtctgaaaaatatgtcattaggctgtttcatcattgtgcaaacagagtgtacttacacaaacctagatgatatagactactacacacctacattataacgcagttgtaatacaatggtaaaatatttgtgtacctaaacatccctagacatagaaaagataatgcattgtgccaagacattaatgttagctatgacatcacgaggcagctcgtttataatcttatgggatcattgttgtatatgcggtccattattgaccaaaatgtcattacatggtacagtcccacacttgacgtgatatagagttcatatgtcactttttcattgttactgattttgatcaaccaagttttaaatatgtactgtgaaaaatttattttcacctttattttgaagtactgtgcatcatttcatagcaaatctatggcatggatatgcaggaaaaagtggataaaattatattttgacaacttcctaaattattatgtctctcagagataataatgatcagtggtatatatactgttctactctgagatagcccaggggcatcccaaactatgagggtttctgtgacactcatacagataaactaggtccataatgtataaatattaatgttggcattcacactgaggctgggcttttgcatttccacaccaaatagttatcttttaaaaacataacattacagatacattttggcctgaaggtattttcataagttccctatttatatgttgttgatgaaattaaggattccagtaaatcataataatcattgctagtggaggagaacacagtaagattaattccaattttgtggggaagaaatattttacatatggttttagttatgtatttagttatggatgactctgatgttctgaaaatgtattgcattttaaccaaaagcgtcagaatataatacattagttagtacctcagtatttgaaaggcagtgaaaaccgttggctgtttttagacatttgtgtatattttgatatatatgtcaatatttaatagaataaatcttatgtgttaaaatgttctcattcctgaacacactaaatataaaaactttaaggaaggagcatttattagtttgctaaggctgccataccaaattatcacaaactgggtggcttaaaccaatagaaatttattgtctcacagttttagaggctataagtctcatatcaagatattgacagagctggttccttctgagggctgcctctcccctagttcttgtggttttctggcaatctttggctttccttggctcatagaagcatcaccctgatttccgccttaattttcacatggtgttctccctgtgttttgtgtttatccaaattttccctttctgtaataccagttatgttcgaataggggcccatcgttctctgtgttgaccttatcttaactgattacatctgcaatgactcttttcccaaataaggtcacattctgaagttttaggagctaggacttcaaaatataaattttggggagacacaattcaacccatacagagggtaatggatacttataactaccttcttaaacatggatcttgaaattcaacttgccttttcccttcctctcaactaaattttttttcaaaacctgaatttgaaagaaagactccacttaaccgtttttaaattttaaggcagaaataacacataagcatactggagtaaaagtgtgtattctatatcctgtgtgcactccacaactatatttagtaatgttgactcctcacatttcctaagttcttttaaaactgtacaaaatatttatttttacattgctttctgaaagctgatatgttatttagggatcttaataaataagaacaaggctagattaattcaaagaaatttaaggtatttagattaaggtttacactttctgtggataaggagtttgagcagggattagttgggtcctctattagggtcccacaaggctacagtagtggtgttggccaggccacggtgttatctgaggttcgtcacccaaactcatgtgatcattgacagaattcatttcctggtatctgcagaactcatggaggcttcaatttcaagctcaaaaggaccatacctttctgatgctttaccttctcctaaagggtcctctgattggggactgggtcagaataagttatttctaaaagattattaactcaaagacaaccaattatcaagctaagcacacgatatcccattaaattcacagtttctgtccacagctcaaagggaggagaatatacaaggcatatacaccagggagtggaatcttagaggccctcttagaattctgcctcttatagtaacaaatatatacattatcattaagaggtagataactaatagatactattaataaaaatgattcatgcataatgtaaaattacacaaatattaatgtttccattaaactcctaatatgtataatattctgatctagaaaataatatattctcacttcttattttgcctttccaatttatttcttcttattttatttcatttgattcctgattgtcctgcttctgtagaaaggtttcaaatgtggccattctatgtagtctattgtttagaatttttaatctgttttataataaagaaaataccttgctttttaggcttatttctctatacataaatcttcaccttatgattttgttgattttttctctatgggattctctccccatttcagctcatttgttctgatagcatcatattaaaatgcagttcttgcatcaaatagtaccgcctccaagatagaatcctggattcctgtagttatctataataactgtattttagtatgtttactgcaattgaccataatagaagtgtgattaattttattcatatttttatatatttatacttagacgtttgtttccattgcatcccttactagataataaaaatgttgtgaatagaaatcagacatagtgtgatcatgtcattttcttcaggcttagtaagagttaaattgtttcacttttcactgtagttgatattaattggtttatatatttgttttgtgagttaacgcatataattaggccaagttaaaaggaatcatatgtcagttgtattcatatttaaatatgctgtgaaattttctagcctgtcagaaaaagattataccagtattactatatcaataatacacaaaaaagtctatatagttttccttttgatagaacaaaacttattctgaaagaataaataaaatgttcaatctaaagatattatcccaaccttcaaacttcagtgggaatacatgacacaactattttagaaggaaaactatagagcattgtatcagtatgtggtatcttatatgccttatagcacacaaatgttacccaattgagatattcattaggcattagatacctgtctctaaatctagctatcatagagatgtttcgcatggagggacactcagaaaacatttatgaataagagtagattcggctactgaatttagataaatgcaacccagttggatgtgtactttagtaatcagtggcatattagagtcattgaccttaaaatactgaactcatgttttaaattattttactccttacttgggtgacataggattcatattgattactgtaatttggattacagaagaaaaagtgctatttattcacatagaatatcaattttaaaatgtgaggccaggcgcggtggctcatgcctgtaatcccagcactttgggaggccaaggccggtggatcacgaggtcaggagatttgagaccatcctggctaacacggtgaaaccccgtctccactaaaaatacaaaaaattagccgggcgtggtggcgggcacctgtagtcccagctactcgggaggctgaggcaggagaatggtgtgaacccaggaggcggagcttgcagtgagccaagattgcgccactgcactccagactgggcgacagaacaagactccatctcaaataaataaataaataaataaataaataaataaataaataaataaataaaatgtgatttcagtaagctgtaattacaaaagatcgcaaggaatctgccattctgagtcaaaaattttactgcccttctcgagtcatgcccaatcttcttgtcttaaacatgtgagaagaatatttgtgaacaactatcagctactacttcatggtgattgcttaaacgtattcatacacgtataaatagatacatatgatataaatattttagctctttttgctttctaaggctgacatctgacagtgaggccattgatcttcagttgctagaaaagaaaaattttaggctagtctaccacttgagtgatttgcttttaaaactatgagaatacatagaagtcaaatcaataattaagcagtacaacaataaacttcatgttagtattatgatgaacatcatatttttatgtgaaaagctacacacataacaatgaaggcaaatattatcaaatttattaatatgcattgaatagcgctagagtgtacagaaggcagatcgacctttatctcattacattaatgagatgagaaaaatttgaaactcagaagattgccatcagttgatattctttttttgttgttgtttctttgagaccaagttttgctcttgttgcccaggctggagtgcaatagcgtgatcttggctcactgcaacctccccttccaggttcaagcaattctcctgcctcagcctcctgagtagctgggtttacaggcgcccgccaccatgcctggctaattttcttttcttttcttttttttttttttttttttgtagagatagagttttaccatgttgatcaggctggtctcgaactcctgacctcaggtgatccactcgcctcagcctcccaaattgctggaattacaggcgtgagccaccgcgcccagcccagttcatattcttaacaagcaaatgaaaaaagctgtcaaatgacaaaattactgaaaaaaatgaagctctgttgcctttatttaatgattgggctatttggttgcaaacactttattctactctctttcttgtgatatatgactgctaacatgtaaattcagtagatctttttagtatgtgaaccagaggttgaaggcacagtgctttagtcctttgaagccttgatatccttataagatcagttggatttattcaaatctcagttggttgctttgagagaataaaatgatcccaggggtagaagatatccatttgctaatgtctaggctacctggtatttaaaaactgaaacacatttttttttttctaaaatgtaagttcttatatgattggtatattttatttttgtgtgtattaattaataagccaaacctcttaaggatatttctataataccatttcatatgaagaaagttatttcctgttcattcactaaatacatatatggatgaacaggatataatatataattatatatattatatatttaaaataatactttaatatatgtagaaacaggctttatatatattatatatttaaaattatatatacagcttatttctgttatcctcaaaataaaaccactcacgtggcatgaaaaggagtcttaatatcttaaagggagatatacttggcctcttaaatatgattagcacatttattatagaaactttctcacagatatcagatactcaaatttttcctgactttttacactctttcttaatatatctcttttatttaccttattttcactttgattttcttttaaatgatagctgtagacatgccaataacaaatattttaattgcgtgttcaataaaatgtaatttaaaattgctgagtttatttacaaataaaataccttaagacttaaaacaacaacaaaaaaataaactatttagttccacatgaagtttttgtttatctcaaggtaaaattttagtttatagaaaagttttagagagaaactattgggaacattggtggaatactaaaaagatcattattattttttaatggtggaaagcataatctaaatttcttgttgataattcagtaggacagggtatttggagaacggggtatatttcatcacttaaaagacaagataatcacagaaagcagccatcagttttagcctttctcatgaacaaagacagaaaatgagtaaacattaatgtgttggaactaccaatgaaaagaaacttaggcagtataagataaacttattagatttatgacatatgcaactccatttttaaagcagagaaattccacattaaaacaaaattcttataattttctgttgcttccctccaagccacttcattctccctagtgtaaaaaggtcagtcttagaatagcttatgtatttttgcttccaaatgcaacagaaacttgtagacagaatatatggctccctatatagtagtatttgagaaaccaaataccataaaaaggctatcttttgcagacataatccccttaatgtttgtgtgtggagttattccttttggataatacgtactctgttaaaataaaatgttataccagtctcttatcagacaccagcatattagctggattaattacctaagaagggtcagagtggtgagggccagggcatagcattggtgtattttgacagggaagttaaaaaaagtcactggcctctgacttagaattaaatgaaatacagcaacccaataatgaattctgagtatccagggaacaataatactctaaagcaaactcagagatcacaaaggggcatgacaggaatacacccaacggtacacaggcactggaagaaccttgtactacatttatactttagtcttaggtgtgcccaaaagtataacatacagttctttgatacaagtcccagaaacctacttttgctcacttcatgaaaaaaagaaaaaaaactggttattggaaggatatgaagaggcacacagaaatgaaaagctaaacagcactcaagtcaggcaaaagatgggaatcttagagaactgagatagaagcagggctagcctcataattgaagggtccagtgcaaaatgaaaatgtagtactacttgttcagaaatcactgaaaatttcaagatggtgacagaagaatatattaccaaatgtagtatcctttcaagaggtgggcatctcacaagttcatgaatctgaccatgggtggcaggaattaatggataagctccatagtataaatcagctactatggttttctgtcttcgtcctttgttgctactaaagattcacacttctgggaaccataatctagggatttagaatggtgaattctttccagaaggttttcagtttactttgcctaaattcatcagaagaatcactatctatggcagctatagccacaggggaagagagcatgggaccctgtttagcaagactgcatgcaatcatggagaagagtaaggagtttctcgaaggaacataaaggaactgttaacaaaggacgtgatttcttcctgtgcaggaaaaaacaaacagacattcacatggaaataaaaaaataaaaatcctttcttacactcctgtgaccagcttctaagaagttggctctaagaacatgaatagtttatttaacagtgctcctgtaacatctccattggatcacagatactcaggtttaaatactggcatatctcattttattgcaccttgctttacacagtgcttcccacatactacattttttacaaattgaaggtttttggtaatcgtctgtcaagcaagtccatcggtgctagttttccaacaacctgtgctcactgtgtctctgtgccacaatttggtattcacacaagatttcaaactttttcattattatattagttatggtgatctatgatcagcaatctttgatgttactattgtaattgttttgaggtgccatggactgtgcccatatagaaatcaaactcagtggataaatgtgtgtgttctgactggctattcccctatatctctccctgtcctcaggcctccctattccctaagacacaacaatattgaaattagatcaattctacaatgccctgtagatgttcaagtgaagagtcacatttctctaaatttacgtgaaaagctgtaaatgattaagcttggtgagcaaaacatgtcaaaagctaggcatcttttgacaaacagccacgttgtggatgcaaaggaaaagttcttgaaagatattaaaagtgctacttcagtgagcacaggaattataagaaaataaaacagccttgttgctgatatggagaaagttttagtggtctggataaatcaaatcagtcattacagtcccttatgccaaagcctaatccagagaaaagccctaactctctttgattttatgaaggctgagagaggtgaaaaagctgctgaagaaaagctggaaactagcaggggttggttcatgagatttaaggagagaagctatctccataaaataaaagtgtaaggtaaagcagcaagcactaatgtagaagcacagaaagttatccagaaaatctcactgagaccattgatgaaggtggctacactggcaaacagattttcaaggtagacaaaacagacagaagatgccatctgggactttcatagctagagagaagtcaatgcctgacttcaaagcttccaaggacaggctgactctcttgatagggactaaagcagctcttgactttaagttgaagccaagttttatttcccattctgaaaattgtagggcccttaagaattatgtctgtgctcaattaatgaagcaacgaagcatagatgacaacacatctgattacaacatggaacactgaatattttaagcccactgttgaaacctactgctcagaaaaaaacaagatttctttaaaaatattactggtcattgacaatgcacctggtcaaccaagcattctgatggagaggtatgaggagattaaagttgttttcatgccgtctaacagaacatccattctgtagctcatggatcgttgaggaattttgatgctcaagtcttcatatttaagaaatacacgttgtaaggctagagttgccagagagagtggttcttctgtttgatctgggtaaaatacattaaaaatcttctggaaagaaccattctagataccattaagaacatttgtaattcatgggaggaggacaaaatatcaacatcaacacaaatttggaagaagttgattccagccctcatggatgacttcaaggggttcaagactacaaagaccagtgtaggaagtaacttcagatgtggtggaaacaccaagagaactagaattagaagtggaccctgaatatgtaactgaattgctgtaatcccataacggttgcttcttgtagatgagcacagaaagtgttgttttttttttttctttttttgagatagattctactcttagtgaatatgctgtgaatattgttgaaattacaacaaaaaatttagaatattacctaaacttagtggataaagctggggcagggtttgagaggattgatacgaagtttgaaagaagtttaactctgggtaaaatgctaccaaatggaattgcatgctacagagaaatcttttgtgaaagggagtgactagatgcagcaaacttcattgttgccctatttcaggaaattgccacagccactccacccttcagcaaccaccaccctgatcagtcagcagtcataaatatggaggtaagacctctcactagcaaaagattaggactcattgaaagctcaggtgattgttagaattttttagcaataaattatttttaaattaaggcgtgtacattgttttttagacataatgctattgcacgcttaataaaatacagtatagtatacacaaacttttatatgtgctaggaaagcaaaaaaattgtgtgacttcctttattgaaatatttgcttattgcagtggcatggaacctaacccatgatatctctgaggtatgcctgtataccaaaattattaatttcaatgattctaggaaacttttttttaataaagtagtttttggttaaaatttccagtatgttacactcttctaacaaactgtcgaagaataagagaaaaaatgttttagactgggtgtagtggctcacacctgtaatcctagcactttgaaaggccaaggtgggaggatcacttgatgtcaggggagttcaagaccagcctggccaacagagtgaaactccatctctaccaaaaatataaaaaaattagtcgggtgtggtagcacacgcctctaatcccagatacttgggaggctgagtcaggagaattgcttgaacctgggaggcggaggttgcagtgagccaagaacaggccactgaactccagcctgggccacagagtgtggctctgtctcacacacacacacacacacacacacacacacacacacacacacacacacacacacaaataaaataaaataaaagggagagagagaaaaaatgttttaggttaaatacaaataaaagagcttataggaattactctgaggtgaaactagcttatatcctctaatcagtatgtattcatggcttttagagtttggcttaagaagcttatcgaggatttcgccaagtggctgtctctgaagggagtggaaatgttaggactcacactctggagccagactctgggtttaaagttctgttttgctgtgtgtatcctgttcagtctctacacctaggaaaatgttaatataagaattgattattaaaatatctctaaaggtgacataatttaaaatacaattattacacataaaacaatttattcttttcagaacagtttattcttttcagacatatgtttcatatgtatgaaacaatacatataaaacaacgtagtacgattatttggtggaggtatgtcttaggaatggaacttgattttattggggggaattatttttttttctgttatcctttctaaatgggcagttatctctgaagaggaaagagcaaaatggagcttttattctctcacctcttctttggttgtattaagaagagggctgagtttttattctcatctctgtttcaaagacaattcaatgttgataccaatctgtgtttctgctgcttgtgtaaaagaaaaaccatcctatgccaccagcaaccactgttatctggttttaaatgtcaagtatacttcagcatagaaataaagaaactgagataacagtcaaagaaaaatatattgaagcacaaagataagagtccaaccatcttagtgtctgtgtctttgagaaaggagttaggaaaagattcatcaacagaaacctaaaacattttgcagcttctaacttatctaaccttatgatttatagccatgtatcatgtttatacatatgattgtagtatttgtctatgttggtgctatactgatgaataatggaaagtaattcagctactttaaactgaatcgtttaaattagttcagcgatgacattctgtcttcatgttatcccttctgaggtctagcctgagattttcttactaatctcaaggatttttttgtttgttccttgcaacagatgttcatactttgacagttctattgtatataattatgtataaaccatattatgtttttcattccttatttgaaagtaatctagatgatttttgtgtgtgtggctgtgagtgggtatgtcaaggcattttggaatccttgacttggtgtaatatggaaaatctgtttctagttgaaattgaatacatatatcacaagtccttttgttacttttagaatggaatgtatgaaatctgattgggaagattaatgtaggttttattaatctttctcaaattgataaagttctgtcaccctaaagatttattcaaagttgtaatctcaaagtcataagcaccaagtctttacctttgaaaagtattggaagctttagtttcctagccactatggattatgccaatacttttaggtattacctttatgccaaattacaggacaacaattttctttttagaaacattattttctagactataattttttggctaacacttatagctcttagattgccacatcttgaatattataacacaaattatcagaagcaaatatacatacagtaatatttttaataatgtttttcataaatcatatctaaattcccattttgtgcattcttcaaatggctataaaaattttgcatactagctcttaaagcaataatattaggttctaactattttatgtgataatgaaataggctcgattttattttagtagtttggtcctgtaagattaatcaaatttattacatgatatggatgtgaagtaagcaaggcactggtatttttgtggctcattattctgatattaaagggaagggaagaaggtaggtaacaagtggcatttaaaataaatgtattttcataataaatgatgattctcatcttattctgttacactgcaagtataaaactcttattgttgataagaagttcataataagtaaatcactttagacctggagtttgtgacttaaaaaaagcctttatttcaaaaagcaaaaataaaatgaataatgaattatcttatatatttcttccactaaacatatttcaaatgaaatatagtatgtaagttaaaaagccaaaaatacttaacccataactgtaagatctacattataggtaactacaaaataaaaatactcattatctataatatatttataaaatgttgttttcaaccaaatgttaaatagaatatttaatatagtaaaaattatttccctttttagaggtttttcatctttataaatgtatttgacagtaaatatagtaaaaactacaatggaactgaacttctagcaaattttgaaagctcttcagtatcatcgtgaaataattattcctcagatgagattttgttaaactcattactcttcttctgtaatttaaaatttcccaaataaaattactcttccatatagtggtgaatgagagggtgggaaaatattcctgatccccgcaagagaaaaatgtgcagtttggaaaatgtataaaataaaagtgttccaacacagcagatgatttatgttgtttatatgatgaattgcatgaagggctaaggagaaataattttagattaaaaaaaatttgtttgatacctcttagacataggaagacccgccaacctgtgatattttgtaagttacgaacaacttctataaatattagggggcagtaaataagagtttgatttatttccatctatatgaaatgtctttgatgattttgtgctctcaactttctgtcagttttagtgctctgggaaagaaacccaatgtattattacttcaataatagcatgattacaggcatacaatacctccaattaaataattaattagaaaatgagaaatatgtatgtgtgtgtaaacagatttggtgtgtatctttatgtgtatagaatttttaaacaataatttggattttttttgttcaacctgattgtactttcatctctacattcattaattctgattcttttcataagtgaaatgctccttaacctggatctcaagtcacatgtgaatatgaaagtagaaaatgggagagaaaaatactcatgacattaatggcatggagaaaaggtactgaacatacacagtcacgtcaaccttctctttttaagactaagccagaacttgcggagtttgtatgatcagttttatgctcataggatactttctctaaaattttggacaaagttaaaaataagcaccaaaataggtgtaaaaataaaattaataaaattttggacaaggaaactaattttagtgaatagtgggagtcgttactatttaatctaattccctaagactgtaacttaataatatttcactattctagcttcagtgaaaatagaatagataaatacaagtgtatttaaaaatgtaaccctattaagagatgatacaatatggtaaaagaacactggactagaagtcaggaaaccagaatttcacagtctctgtgtgacagttagaaaattaatttaggcttgagctttcctatatattaaatggagatattatacatgatggactattattctttttctatactaaatttgattagtctatttatatgagtattacatagaattgtgcaaggttttgtggatacattgatgaacaagaaacacaagtactgtccctgttacctccttgaatcatcgtagtttcaaatatagaaataaatagttacacagttaattatgatatttcacccttacttctagatttaatgtctttcttactggaatatatcctttagccattatcccagttagaatgccttccccttcaagtaaaagacaaacctaacacaaagattattaaacagtaaaaacaaaaaacccaaaaacataatcttgtctaacaagaagaggtagggaatccccaagttggttagttacaagaaacaatgacctcttttcttttctttctttcttttattttttttaaacggagtctcacacactctgttgcccaggctggagtgcagtggcgcgatctcagctcactgcaacctccacctcctgggttcaagccattctcctgcctcagcctcctgagtatctgacattatggtcgtgcatcaacactgctggctaattttgtatttttatttttagtagggagggggtttcaccatgttgtccaggctggtcttgaacgtctgacctcaagtgatctgcccacctcggcctccgaaactgtcaagagtacaggtgtgagccaccctgcccggccaccagtgttttttacagctgactctcctctcttttgtgggatacaccaatcattccaggcaatatatcaagacaaaacaacatccaaaggaaaatagctataatttttctgtgttttttttcttttttgccagggaggaaatgttttcctgaagccctcctacctcactctttgtcttatttatctgagtcataggagaaccagcctttaaacaaattaagaagttttgtttttgaaagaagcaggaaggaggtataaaatgaatagtgggtaggcagccaacaatgtctgcacataatatttttttcctttcagaaatgttatcaattggtttccaagtttctgggttttttttttttcatctttataatgtccttttctctgctgagacttgccatttgtttttttgttattaccatttttaatagaccttgaacatatttataatgctgattaaaattcttgtcagctaatttcaatatatgggtcatctcatttttagtgtctgtctgtaaattgtttttctgcttctttgcatgcctacttattggaatatttgacacacatgaatggatgacatgtttttcagagtctgtattttattgtcttcctttagagaaagtatagaattattccagcaggtagttaatttactagtaggatcaagtgaatttttgagcctttttaaagtttggaactctatgtctatcagcactacgagtctcctttgtctgtggcagatcttctcctttatctgcataggcgtaaaaattgctgcagcctctgtttttagaaacctcatgcaagttcaataccctgacactaccacagtggcaatttgtataattatttctattttgctttctttcatatggcacctggaagttcatctggcttttccttttgtactgtaatatgttttaaaataaatgtggttgtaagttatttagcatttctttgtatttggaacatgaggtggagtgtagatcagctcattcaaatgtgttcttagaggtcccctcaaattagttttttaaaatgcatctgtgataagcattaaaaatgaagtcttaccatataaaagaggtacctgtgtattttttaagagtggggtactagctgcagaggtttctctggcgacctgatgtttgtttgtttgttttagttatactttaagttctagggtacatgtgcacaacgtgcaggtttgttacatatgtatacatgtgccatgttggtgtgctgcacccattaactccttatttacattaggtatatctcctaatactatcccttcccctgccccaacccctcgacaggccccggtgcgtgatgttccctttcctgtgtccaagtgttctcattattcaattcccacctatgagtgagaacatgcggtgtttgtttttttgtccttgcgatagtttgctgaaaatgatggtttccagcttcatccatgtcactacaaaggacatgaactgtcctttgtatggctgcatagtattccatggtgtatatgtgccacattttcttaatccagtctatcgttgatggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgtccctatttctccacatcctctccagcacctgttgtttcctgactttttaatgatcaccattctaactggtgtgagatggtattttgctgatgttttataagggaagatctgaagatgggtaaaggattttttttttttttttttttttgagacggagcctccctctttcgcccaggccagagtgcagtggcgcaatctcggcttactgcaagcttcgccccccaggttcacgccattctcctgcctcagcctccagagtagctgggactacaggcacccgccaccactcccggctaattattttttttttgtatttttagtagagacagggtttcagcgtgttaacctggatggtctcgatctcctgacctcatgatcccccaacctcggcctcccaaagtgctgggattacaggcgtgagccactgtgcccggccaggatggcaggattttttttttatggagatagaacatcatatgcaaaggccctgaggcaggatggaacttggcacatttcagcgcctgaatgaaggccaatgtgtttggaactcaaagagcaaagaggcagctgttaagagatgaggttttgtgagagagacagtttctagaccatgaaacaaccttgttggctatgttaagatatttgaattctatcttgcttttccccatatcacaggtagtggtgaaataacttgtcacatgtagatttttatctaaatgtaaattttatctaaatgtactgttaagttcttataaccactacacttactatagagggaaatgctgattgcatctcttctggaaatacgatgaaacattcagttacagaataatttgagatacaagtgttttcctaaaataacactctcagacagacaatatatttggaaaggaaaaatgaaaaatataagttattcataatcaacagcctttttgtaggtaggtccttaaacagatagtttctgttaggttctgggaatgctagttcattaatatagatttatgtcattgtgctggtcttagaattattcaagctaggattaaactcaccgtaaataacctgaacctttttaaaatgaagttgaaacaacagtaagtatcctaagctaaggtttttaaaagttattattttctgcagctctacttaatgaagctttggaaggcagttgtgtgcatatgcttatttattatgccaggtaaataggggttacttacttttctgttctttggaaatttggttcagaaatcacagttacattataaagtgtaaatcattgagatgcttttggccatagacattccctataatgaaagatgtcattgcactaaataaggaaaggttcctatgacagataatgggatcaatgctatgcaactgacatgatcttgtattttgatagtcatttgggccattttattaagaagttttcaaatgatttgaagagcacttgtgggcagaggaaattctaactacccaatgatactacttagttatagctaagtgagaaaaaaaatcataaaaatattcttactttctctctcaggtaaggaaaacctttcagtttccctgtagtttgtgtcaagatatatgttttcccattaaacttgtctgccatactgacgagagaattacagcagaacttttgaactagtttgataagaaattcctttcacacaaaggatcccagggagaaaagtgcaaagccagttcaccatcgtagtttaacttaaatgtgttaagtatcagttgaaagtctcaaatcctctactcattcgaaaatccacttaatataacatttatgggatttgctattaatcttatccaaaacctgtgttattttggtacttatggacttagaaaagtctgtatgtctcaaactttaaatgttactaaatcttaaattataaaaacttggttagcactcataagcaacgaggcatgtgtaaatattactaacaatttcactgaagattcatgaagttgacacagagaggatgaactgtatataaatgtgttcagcggagattacattgtctttgttttttgtttggagtagttatggtgattaatgaaccactgtatccagcttcagtatcatactctttctttttttgccaagttaaaggactatctttggtgatataaagcacatttgttcaatttcttgaaactataataattcagagttggcagacagagttatatatccccaagtgaacgaattgtattatccagtgaaccctgctaaatgcaagaacagaagagcacctgaatctttttctcccctcaccagccttaatatgttgtctgtgctagaggaaaatatggcttcgtattagagatttttcttcattttcttgtcaaccacaaggataattttaggtgaatttacccagagacacttgggtatttttctgcccaataatggctattgatcaaaacattaatattcaatacattgaacaactgtaaaccatgggcaccaaccaatcagaaagacaatggcaatcagcataaaacaggatggctgtgccggcctttgcagctgagtggcaaccccatttaacagatctttcactaactgtttcaacctaattaagaatggttttgattaccatagccttgtagcagatctattttttcatgtagagataaaatgttttgagataaattgatttgtttctcatatgtgaaagaatattagttttttttggtatcaactactaaaaagttaataattgtggtgaacctcttaaagtcagtgacagaatcctattaatctctgcaacttcagccatcactgctctgctggacacaatgtggatgttttcaataattttggaaaaaaatgccatcatcttttccttttgggattaaaaatatattcaaattattgaagtatgaaaaaatgactaattttattttcaaaatgcatttctgtacatggctcatcttagctatttgaaaatggcaaagatattcaaatttgtgaatgttaaattataatctccagagcctcagtaaattccctgaaatacagtgttagaacttcacacgaatatgattcctgaaagttgtgtcagtcctcatgggtgtttagatccatgactgaccaaataattttaaagagccagcacgctaactaacaggaattatagaaatataatttaaattttattgtaattgtggcaggaaacttagagccatggacaggagccccgcaattcataacaattcacaatacagaaaaatttttctgtatgagttgtatgcgtcgatgattacaacaaattgtgttttatttattcacccattattgtatttatctattcaatttcaattatacaactatttactgagtcagcctaatatatgccaaatagcaggcaagttcacaacttaaaaatgatacacttcaaaaattcgattataactaaagtactactctaatttaatatatacctaccgtgacttctaatttttatacttgattttattcttattggtcttagagaaaatagccatagaaagcattaacactaaacggaaggctttaagaatgactgtatagttcgttgcaattagacataatataattaaattgaatcaatcgtatcagataaaatatacactttaaagtgaaaatgttaatgattcttagtataactgtaagtatactgttttgttcatttgcatgcttgttttccacacaaaatgcagcactgttgtggtttagagctaagtatgtattgccagcattcaaacctcagcaatgtcttttgttagctgtgtgaccatcagcaagttacttaacctctcttgactcaaatcaccccactgggaaatggatattataatagtactaaccttaaagaattgttgtgagaattaaatgatttaacacctataaggacattacatgactgcctgaggttcaataagaactatataaatattagctattattatatgcatgcacattatgtagttagtagggggcaaaatcctaggttatttcattttacatccatttctcactaactctttaactccaagaaaagttacttatctgtactttatttcatctacctcttgaagttgttcaaagtttgaatgaattaacacacatggagtggttagcacagtacttggccaatagtcaaccctcaaaaaatgttagccataattttttattccttatttcattatagatataaaatggaggtagtaattattatcttatcccttcacaggacaattgaaccactgaacatatctgtgaagataagtaaacagttgaatattattcaaaaatgtgtttactaattatctagtaatttataaattcagttattctgtttgtgaataatgagatgtgaataaaattaattaaaatatattttcttatctgtattattgcctgaccttggtggcaagcgccagagcatctgtttgttttttctctatttaggttgctaaagtatcttgtcatataattcagaaaattatatgatataaaaatatattatgtaagaaaataatataattcagaaatatatgtatagtattgaaattaagcagaagccctaaactgtttttataaatattctgaagtatgttacaatattaattatcattattggataggtcttttggttttaaaaatggaaacaatttttttaatggaaagattatatcctaaaacagtaattttcattgaatcttaccactaaatgtatatttgaaccatttcataatttctactggaatgtgtgaaaattttaaaaaactactatcatgaggatggaagcagtggtgcacgcctgtaatcccagcactttgagaggccaaggcaggcggatcacgaggtcaggagattgagaccatcctggctaacatagtgaaaccccatctctactaagaatacaagatcacgccactgcactccagcctgggggacagagtgagactccatctcaaaaaataaataaataaataaactaatatcatgaaatgaggacacaagaaatactttctaggatactagaaacattgattaacaacttgggaaatactgctctaagcatgctgcactgtaatttttgttctttttttttttcttgttaggaatctttccctgaaattaacaaaggacgttgatcaagaagccaggtgttcccacatcagccgaatgcccaacagtccatctgcggattggcctctacaaggtgtggaagaaaacggaggcatagattctctgccattcagactgatgttacaggactgcacggcagtcaagacgttattattaaagatgaagagagttcttcaagaggtaatggtttcctctaagattaatgtccttcagtgctggtagacaatgaagtctgcagacgtggttagaccctgctctgtcagtaattaactacatgacattgggcaggggtcaggtttcctcttggagcttagctattttcatatgtcaaatgagtgttttgaagttctggtttataaggtactctttagccttaaaattgtaagagtttacgaaatacttaaaaaagaataaattgatcccaagcatccccctatttgtcaggtaaggagaaatgagtatcagctatatagttatggttacatgctattataaagctattgagaaatctattaaatgtatttcacatcaatgatactgggtctttgtttatatgataccataaaagtagtttatttagtcatttttgttccaataatcagaattcagtaaaattgaattacagtaaaattcaatctgaaggtctgaatgattttgcctaaggaatgtagttgccctccccacagcttgggcctagttactgaaacagtgagctagtcaggaaaatgcataatgagattcttttacccttgtgcccagaaatcagccattctttaggactcaagtttgctttggtttgatttttataattacaacagttgttttatttgagggatttctatacaaagtatacccgtgattattattacttcatagacatgtgaagtgagagttagaaattttaaattatttttctcaagtaagtgtaatttcagggcaacagcctgaaatttgtgtctttgtattacatcctattatatttaagtagatttatctttattgattggagatattaataaagaattgagaaaaatattattatttagaattaatggtccctatgttataatgattgctaatatttgctttttgaacactttgataataatgctagcagctaccactggaggctagaattgaatcaggaagaaaaaaggcagtataaaagaaatgaatgccatagactattggggcttccagtaatgtgttctcatcagctgttataaactgtattagtctgttcttacactgctaataaagacatacctgaggctaggtaatttataaaggaaagagatttagttgactcacagttccatatggctggggaggcctgacaatcacagcagaaggcgatgaaggagcaaagtcacgtcttacacggcggcaggcaagagagcttgtgcagggaaactcttatttatgaaaccatcagatctcatgagacttattcactaccatgagaactgtatgtggggaactgcccccatgattcagttatctccacctgcctcccccacccttgacacatagggattattatgattaaagctgagatttgggtggggacacagccaaaccatatcataaacaaaagctggaagataccttctctgtgtcccatacaggttatatctctagggcagcctttgtttctggatattctggatcctataatgtgttgtgctgtagcggtatgcttatacttgattactcttagaatttcagaaattatatgagctggcagttcagcaaaggcatcaaaataaattatatgaacttaaatcaattactttcaaaaagggtaatcagtattcaaaatgtgttttctatttgttttactattatctacacttgtgagattatttacatcttttagaatcacatggtggaagtactatataattctgactgtacagatttccaacatgtagattcatttatgtcattttggtagcttgaaatcagccatgtgggagtatttatgcctcagaaattggcaaacactgcaaattagggcctcttatttttggcaagcctgttgttaaatattgactagcacattactatgtgtataactgtatgattctatactgacaacataaatatttgcctgcaaatgaatagataagtttgaatttcttccacctttggcttaacatgcaacctgatcctctttgaacaagacaaacttagtaacagctgttatattagaagatactagtctcaactattcagctttttacctctgtttggtctgaattttaataacaaatcagttaaagcaaaagataagtagaaagagctgacagaaggtgtcaagaggctttcttagagtacttaattttataattttaaaatattcagtgatattcactataaagtcaatattcagaatatatttagatggtttctatactgccacctggttttctttattaaggggtattcgaagaagctgaagagaattgattttttaaagctgatgtagagtgaacaatacttaatatatgtttgtgcagcccattcagtgagcagagggtctttattatcaacagggaaaagcaatagtattatatgattagcatagacaacagttctactaagaagatattcataatagaggcctctaaagaaaattgttttttgaaatgttccctaagccaggaagttttaaacttccattcccatttcattactaaattggagtttaatatcaatattcatttagattaacaatatattttaatataaaaaattcattcctattttgagctgatttttatgatgcacaatcgttcaatctttgttcacagattattattattattattattattattattattattattatttgagatggagtctcgctctgtcacccaggctggagtgcagtggcgcgatctcagctcactgcaagctccgcctcccgggttcacgccattctcctgcctcagcctcccgagtagctgggacaacaggcacctgccaccatgcccggctaattttatgtatttttagtagagacggggtttcactgcgttggccaggatggtcttgatctcatgacctcgtgatccgcccgcctaggcctcccaaagtgctgggactacaggcatgagccgccgcacctggccaagttcacagattattttttaatggcaggaggtacctatttgattttaaggtaaaataattacttaatttttacatgtcatattagaatatgcttttatttgagatttttggtttgttacatgagtattgcatttgtatattttttctcattgatctctttgaaacctatgacttagtggaaatgcaatgcattcatgatatttttacacttttgctaataaaggtacacctttcttgtgagcaaatcaagttatcctttgttgtttttgagggaacatcttctacaaatagcatttgaaaatatccagagatagtaatagtgagatcacagaaaatttttggcttaatctgtttaagattgctctagggttgtggttaatgactagcggctagaaggatgcctcgacagagtgttaatagatgactttcctaaagtttctagaactgtttcagggttgtggagtaataaaaataattccttggaaagttctacacagcaggctaaataaatatacaggtcgagcatccctaatctgaaaatccaaaatccaaaatgctccaaaatttaaagctttttgagcactgacgtgacaccacaagtggaaaattccacatataagtactttaaaccacttgttttatacataaaattattaaaaatattgtataaaattacctttgggctatgtctataaagtatatatgaaacataaatgactttcatgtttagagttgggtcccgttcccaagacatctcataaggtatatgcaaatattctaaagtctgaaaaaattcaaaaaacacttctggtcccaagccttttagagaaggggtactcgacctgtactctatctttcaagtactcttatctatatagtccatattacttatggcattttaatgaatataagcattaacgctgagatctacttgtaatattttaaagctacctataaaatttacttctttctaaatttttttgtgaggtatcacatgtttaatattattttgcaatttttattactggctaaacaaccttagattgctattaaaatgttaaatcccattagctcattccagatttttttaaaagttattttgtcattaactgtaattgcattacttattattctacctactttgggtttaataaaaattttcatcaagtaattcatttggcacttagtaattcttccattttgtgccatcaccataacaacataaatcatattaatctaatccaggtttggggattatatatgttatgctattttataatatataatatatactttcaataaaatataattttgaaagtgaatacacctgcaaaagtgaatctaacattgtgtttgtatctgaatcatcttgggtaggaaccagagatggagatgagtaatgggtaggcattgctctaaatattctgcttcagtaaacctgtctttggcccaagcatgtgaatggtgaggactttctcagtgtctcttccaagtatactggaaaagcactgggttaggatattgtgttttagactgttggtattaaacatcctgaaaccttcctctacttaggagattcttgctcctgaatacttttcagatctgcttatatgcatctcttcttccaactgctcctacatcaatgatggtccattttactgaagttacttcacaactggtcttacttctagtcttcccacctatcaaatcaatttactcattgctgtcaggctaaaatgattatgtgatcaagtcagtccctgtatatctttaaatgtttcctaattgcccttacaagttcttctacaggttgtataacagtctatatttcctctatcattggagcacttatgtctcctcattttaattgctaatcttccttttcccagtgatattctaagatgcaggaaaatgatcttgtgaacttgtaccttgttatatcttctcaacctggaaggtatttgctgcttaataagtgtttattaataaataaatgaaaggaaatggatttcattctgtttccaggctaccattaaaataactgttggcagaaaacaaatgataaacttgagtgcttgatggaatgaggatcaaagtaagtatgtagtaaatttctcctctttaaaagaagtgtacaatatgtttttttctcagaatatgaaataaagacacatcacaaaaattactagatttaatttaatcaagacccatttgtatgcccaagtctatcaatggtagatataatttcctgaagctttttcagatctttctatgcagtagatggctatggtattccttaactgtatttttaaaattatctgctaaatcttccagattagaagaaaggcctagaggtttagagactggttatttccatatgtactcactcttttcacacagagaaaattttgttttcactgaacatcattgcaatttcagaggaaaaggataactataaatcattataaaaccacaaatcagttaatctaataaacataaaattattggtataaagccattattacttcttatttgtttggctgagcttaccgttttcctagtgatggtctgtcgacctcctagattttaattttgaggtgagctaagaattaataatctgaatggagtatcacactccaaattctgtcatccttttttaaagatcagtttctttttattaaaatgcacattcatattcccagcaacttcaaatttcaactcctttatttttagaaaaatgaccgatgttgggcctttagaaattctattgttgtcactttattctctagtattagtgggaaaagacatgactgtagtaagggaagagaactctatcatttttttcttctttttcttaaatttttaaaaaattttatgatctataaaagaaaatgtttaatatctacagaggtgggttttgttttaatgcttccttttagtttgctctattctctttatcaaacaaatatattttgatataataagctgtatctattctaacaaaatagccagataagtaaaaatcaaggaactacttatttgaaaatttatataatttacaggcccatatagttgatgcaaatattggggctgtgaaacatttgcaaaagacccgccattgattaaagagctggaatctatttttctttttcttttctctactacctaatagttcaaacattaatttcattttacctaaaaggaataataatttaagactttcaaggataatattcaatgcaaaatttttggttttttttcagcgtaatttgcaattacattataaaatttacagtgttttctacttcatcatttgtcactgtttggtgggaatttttaaagagtttatttttactgcatttcagtaattgattcaaagggcattaataaggattttataactaaatgacattttcctatcagcacatcttgagatggaaagaaaagtctatagggtaggaacttcagcaatggataattagagaaggaaatggccacagtggagagtcataaagtaaagaaatatccaaatcaagcaattaccatggaaatatagacagcagtctaataatcagaattctctttatacttatcatttgaaaataacaaaattacaagtttttgctaccttctttatgtttatttatttatttttgctggtccagaaatatgtttaaggaaaattagaaaaacaagtttcatgaaaacatcaaatggcagaaagttagagtgactatactagtatcagagtagatctaaatatatgacatttcaccacagtcagaaagccatacttcataatggtaaaagtcagttctttaggaagacacagcaatcaaacatgtggatggcttgtttcaccaatacacaatgcaaaaactgacagaactaagtgaagaaataaacaaattaacaatcacagttgaagaatttaaaacatttctttctgtaattgataaagcaactaaatgaaaaaatcagaaaatttctagaagacttgaacaatattatcaatatttttaacccaattgacatttatagaatactacaattaataaaataattatatattattttcaaatgcgagtggaacatcgtcaagacacactatatactgggtcacacaataagtcccattaaatttaaaaggtagacatctatggggtacattttttgagaaaaatggaatgaaactaggaatcaaaaataataaaataactataaaagcatcaaatatttggaaattaaattacaaacttctatataacccacagacgaatttagaaagctgaaaggaaatttttaaatgtttccaatgagatgatgataataatatcacaaatcaaaattttctggatatagttaaaactataattacagggaaatttgtgactttaaatgtttatattcaaataaagagtgcgataattcgtaacctttaactttcttccttgaaatgttggttaatggatacaaaaaaacagttgaatagaaaaaagttctagtattaaatagtacaattgggaaattatagtttataataatttgttatatttcaaaatagctagaagatttgtaatgttcccaacacaaagaaaagatacatgtttgaggtgatgtatatagcaattaccctgatttaatcactccacattgtatacacacattcagagatcacatgcacccaaaaatatgtgcaactatgaaatatcaataaaaaaggtagctaataaaagaagggcaaattaaatccaaacgaagcatgtagaaagacataataaagaacaaaactctataaaattaaaaacaaataataagcccaaattgattctttgaaaaagttcaaaaaaaggctgataaaaaaagattatagaaaaattaagaaacataaatactagtgccagcaatgaatctagggaggaataatcactacaaatcctgcagacatcaacatgataataagacatggttacaaagaacattatggcaaaaaattaacataaatgacaaaaacaatttttttgaaaaatacagctttccaaagtgacataagaaattgcaaatctgaatagcctaacttgtactaaattaatgtattttattatttaaaaaagaaatacatatgacagatattatgtaaaaattttcaggaaatagagacacattatgcttctcatcttgttttatgtggccaacatatgcctattaaaaaaaattggcaaaaatccttataggaaaaaggaaattacagaatttttttataaatatagatgcaaaagtcacttaaaaattagtaaatacgtgtagcaatatgtaaataatgacctatttgctttcattccagtttttttagcatccaaaaaccaagcaatacaatttactatattaaaatattaaaaagagaaaagcacaagactgtattaatagatgaaaaaagtacctttgaaaaattgaaaaccaatttatggctcaaataaaaatataaacctcagtttactggtagtacaagggaacttctatagctaatattcatacttgatggtaaaacactgaaacttctcctcctaatattatcagcaaggtaagaatatccactcaccacgtttgctgtacgtgtgctagaggtcctagctaggaatgaggcaagaaaaagtgtaacaggcataaatatttgaaagaaaaggtaaaactgcatgtatgagcagatatgtttgtttatacagataacctaagaaatctacaaaaaagttaataataaaatgacagaattagcagtaaatttaatagcattgaagaatataaagttgtcataaaattatatattgctgtgtagcaaatcagctgtaaaatctagtagactaaatcaatatttgttatttcaaagtttctatggttaggagtttgagagtagttacctatgggttatggctgaaggcgtctcattagtttgcactcaggatgtcaacaatggctgtagtcatgaattcttggctaaacttgaagatctactgcctagttcactcacttgctgtggcaggaggactcagttcttcactgctggtgctcaagaggcctcagttccttaccatgtagccttttcgctggtcaacatggcagttggcttccccctgactacacaatctgagagagagaagacaaaatgcacaatgtcttttgtaacctagtctcagaagtaatataccatcacttttgtcaaatttattggtcacaaagatcaaacttgatttagcatggaagaacaatatgtaaagtatgaataccaggaggtagggaacattgtggtccattttggaggctgtctaccagtcaatggtgtattcctctcatatgcaaagtacactcagcccctcccaaggccattcaaagtatcattcaattacagcatcaattcaaagtgcagaatctcaaaatctaaagtgtgtatagccgtagatgaggtttaaacacagcaactcaagtatagttttccattttaacctgtaaactaatacacatgttagtagttttttggttaggattcaaggcctactaaaaattcttgctctttgttctgccctctatgttctttgttctaacctctgggcaattctttcttataaaggtagcacatgttttgcagcagaatagtttcttcatccttatttgtagttgtagacattggtatccaaaggcccttttcattttactctttgtcccttaaagaccaaacttggaaagtgtttctgtgaatataactctcttaaattccttttggggttgcctgtgaaccttattcgggaatcacttccttagacaaaatacgtacccacaaatcgcttcaagataagccctactctaacttgaaataggtgcgggataactcctttaagcttttgaaattttaattgtttgactgtgaagttcgatgggccataccttaaaaccttaaacaaaaggcatcttctgtgtgagtgaactaggtactctgcagcaccacattttatcttttaggacagctctacattgattaaataaattttaagataataattttttttaatctcaaatcatgtggttgttgcacaggtttccatgtttatcaaaactcatcaaattacacattttggatggcaacacatgaaatatcattacacaactgttaagtgccagtgtcagtgctcccatttgtggagtttttagttttcccttgtgagacctgtaaaacaacaatgaccatttatcatacagactaacttagtattgtcagttcttataaattattacaagttattttccctcattgttagaataacataggttaaaaaaatttacaaggtaacatagtcttcatatacacatatggatcccattgtatactccctggagaaacctctggtttagataatgacatctcttagactgatagatttttagtaacagtattctgcctacataaataaggcctggttatgctgctgtacaacttggtcttgaaaatagatgaggagaggaggaaagtataattccatgactcttgctttgtaaacaaccctaattttcaacagtcctcttggagagattagagaaggtggagaaaaagtctttcctaaccccaaccccatttcactcacaaaattccactggaggaagtatattgcagtggtaaagattacagttgttttgaatcgtagagatctaggtgtgaatctcacttctgccattgtatagctactgtaagttgattaatgttttcttaagtttctgtttcatcatatgtaatattaataactacctcataggattatttggacaattaagcaataaaatgtgtacagaacatcacagtgtgagtttggggtaggcactcatgaacatgagccactgcagtgatcttacttgtgtgataattgccaactatgtcaagccacgtgtgaaatatttgagatttcttaaacacttaaaaatataacaattaaaaaagcatatatatattctttatatatatatacacatatatatcagtaaatgcttcttaatagcataatgtgttgtattcattgaatcaatatcaatcaatattgaatcaatatcaataaaattatcaataatttttaataaaattaaaataatttaccaataatttttaataaaagccatactatctaaaactaaaactagaaggattattgccatttatgcttttctggacatactcaattatggcagcacatttgacttgacaccactccacaaaagtactacaacatgtcaattgaatttcctgtttagagtcaacatatactgtggttgttccaggtgagaactcagggtgacagaccagaatgaaagaaattgagatagaagggaagagatgtgtagtgtttttttgaagtcttgtcaatagtacctgcttgtgaactggaatagagtggtgacagatagagaaaaatcaagcattactctgaaagttgtcacttgagttacaggcagattatattgccattttatgagccttggaagactagaagaggagtaacctgtgcaagacagaaggaaacaagagttctattttgatcaggtgaaggttgaaattcttatttcaacatgcaaatgtatgtgtcaagcagaaatttgaattaatgtgtctgtacatccagcaagatcatggctagaaatgtagattgattattcatgatcatatagattctatttaaagttatggaagagagaatttgtatttaaaaccagattaggatgtgccaatatttaatgattggaaaatcaagagaaagagtgtccagggagctaggaagaacactaagagcatagtgtctttcaaaaagccaagagaaaatattgcttcaagaaggtcagcttggggaggtgctgaaaagtaagtaggataagaaaagataagcaatcgatttggcaatcctttgaagttaattccaaaagcatagtaataagctttaggaatttcaatatataaaacaacctattctaagtgttaacttggatagtcaaagcctagaatagaaataaccatttccatctagttctcagttgttaaattgtttgttaattcctttatggcattggtctatgaatgtgaaagacatgaaaattaataatagatgtcctgagttttaaaaatagcttttaaagtaagacatgtcttagttttggaaggaaactatagattttattaggttaatcaagaatgataaacaaaaattcattttatagagtattctccatgttgaggtatcatttttcttttaaaaagtattatttatattacttaatgttattacttaatactgcagaataaatctagcatagtgatcacaggatacagttatgatatgattaggctttacgtccccacccaaatctcatcttgaattgtaatctccattatccccataatccccagatgtcaagggagagaccatgtggaggtaattgaatcatggggatgatttctcccatgctgttcttgtgatagtgagtgagttctcaggagacgtgatagtttaataagggactttttcccctttcgctctgcacttctccttcctgccaccttgtgaagaaggtgccttgcttccctttcatcttccaccatgactgtaagttttctgaggcctccccagccatgctgaattatgagtcaaacatctttcttttttaaattacccagtcctgggcagttctttatagcagtatgaaaacagactaatgcaaggtactagaacaaactgctcagatttgaatttcagctctcacaattactaggtgcatatgattttgggcagggtgcctaatctctccgtggaaatctggtctcttccaaaagtgtaatggtgcatgttcaaaactactagataattttaagttttccctggtgtttttattacattactctcccaatgaggtataatatattaatctaaaatatattttatgttaattgtattcttatgcccacaaaaaatattttgagtacaaaaatcaagtcacaggtaaatcctcatacagaatatggagttaaaaatatgcaaacttaaataatatgttgttaagtaatagatatgtatatagtaagaccataagaaaaaagatttaaagagtaagaagatgctaaacaccgtattcagggtaagattatctgttagaggtagtgggggaaggcatgtgcagttacgaaggggcacacagaggtctttctaggtattattatttacaatatattttcttacattttttcaaaataattatgtatacatgttttcttatgtatgtgaaatcttatattaaaaaactcactttccaagtgtatgtaatccgagtggttccctgtacagcaacattactccccacaaccctttttcttgtgtatccctatgcctgtaaaaatggcagaaatattttgcctactcctatgctgtcaatgtatcttctgatatttatatgatgtcaaaatgcaagtggagcaggatcaaggtgaacaaatgtatacccatatgccagagatttcttttctggtatgtgtacttatattatctgctagtcatgcataatatttgattgcttataagaaaacgaactgcaacccacagttttaacaataatgccaccttcattgtacctaactggtgtggtaatctatttgtgttattatcatattcaataattaatcaaataaccactaatgtggttttattatgcatgtctaactttcagttttcttcatgaatccagcattaatgtttcacttgtaaaacaactcacatacttttgtgtgattcgatgggctaaatccgacattaagaatttcaagctgcaacataacaggtatacagcagacggcaccctgcagaatctccaaggaatacttgagtcgtcagcgcttctgatgggttttggaaaaagacagtgagcagagaatcacttaagcaaagtggaaaagccgtaattgtgttcctctgagacacatttttactgaaattatgttttgtttttgtttgaaaatcagaatcaaaggcatatttaactacagttaaaatagctgtttttaatgagtgattctatcaaatatgatgttacaactttagataacataatgcaatttcttaaaagtagtatgaatctaataatattcacatgtttacagatgagcaaaagtgtttcagaatctagtgactcgtttagctggaatgcacttattccttaactgtatcattttaaccttgataaaattgaaaacttgtggaaattgatggactttattttagtttagatttaccagtagatagacatttactatttcaaatattgtcattttaaatatgttattttctggagaggcacagtggctcatgcctgtaatcccagcacttcagatagcctaggcaggaggattgcttgagctcaggagttcgagacaagcctgggcaacatagagatctcatctttactaaaaataaaattgttaggtggatgtagaggcacacacttgtagtctcagctacgcctgtagtcccagctactctggaggctgacatgggaggatggcttgagcccaggagtttgaggctgcaataaggtgtgattgtgccattgcaccccagcctgggcaacaaagcaagaccctgtctcaaaaataaatacatacatacatacatgcattattttctgttttttttttttttaaagtaaaagtgctcaagatatatagaggactagctattgataaaatagaaatgagtcaatttatatttaagataaatacgtgtgaacataagtagacccatttgttttgttctctttgattaaatggacttttgagcagactatgaagagtggagtgtttaaaaaaaataatgatttctcatgaaatattcacttcacttctcttgaaaacatgaatattgttttgttatgcatgatctacattaggagtcagcaaactttttctgtcaaggctagttagtaaatattttaggtttttctgactgtatattttctgtatttcaactcctcaactaagttgtagtgtgaaagcagctacattaaatgaatgaatgtgtgttgctagttcccataacactttgtttaaggaaacaggcagctgtccagattcaggatttgtcctgggcctgtcatcctatactacttcagagagaggagattaaactgtcatgggaggcattgggtccgtgacattggagcattagttttaggagcaagaatatacagtctaaatcttattccattactagttaaatgttcttaggcaggttgtttaaattctttgcctcagtaggttggggataacagtcacatatcacttaggtttgtagagaatattaaatgtgttaatatacttcaaatgcatggaacagtgttggacacatagcaaatgctcaatacgtattagatattattttatgattttcacaaagtctgagggccactagtgaaacaaagaaactggatttgccattagacaagcctgaattcaaatcttagatctacaaaaatttaagaatgtaatttaattcagttttgtttaatttctttagcagtcataggtttctttgggtgtaataaggggattaaaaaaatcatataaatgttgttgtaaaggttagatttcatttgtgtctggcaatggaaggatctaaataaatgttacttctctttcccccttaaaaagttttttttaattttagtattaattctaaatttgttgcccaggttggttttgattgctggcttgatagtacatttatgattatagttttctctagaactggtccttgattttagtatcctatttctttcatgtgccagagctgaagtttgggccttgagcctcacgtttgttgcagagattcttttgctagttcacaggatttctaaacacaggtttaatatcccttatccaaaacacttaggatcagaagtgtttcagatttcagagtttttggattttggaatatttgcgtatatgtaatgagatatcttgggaatgggacacaagtctaaacacaaaattcatttgtgtttcatatacatcctaagcacacaacctaacgataattttatacaatatttttaatagttttgttcatgaagtaaacttgtgttatgtgttcatgtgtggaatttttcacttgtggcaccatgttggcactcaaaaagttgtagattttagagaatttttgatttttggattagggttgctcaatctgtattttttttatttaatttaatttaattttacattccaggatatatgtgcagaacattcaggtttgttacatagataaacgtgtgccatggtggtttactgcatctatagacccatcacctaggtattaagctccacgtgcattggctatttatcctgatgctctccctccccaacccccaacaggccccagtgcgtgttgttcccctccctctgtccatgtgttctcattattcagctcccacttataagcgagaagacgtagtgtttgattttctgtgcctgcataagtttgctgaggataatggcttccagctccatctatgtcccttcaaaggacatgatcttggccaggtgcggtggctcacacctataatcccagcactttgggaggccgaggcaggcagatcacctgtggtcaggagttcaagaccagcctgaccaatatgatgaaaccccatctccaccgagagtacaaaaattagctggatgtcgtggcacacacctgtaatcccagatactcgggaggctaagacaagagaatcacttgaacccaggaggtggaggttgcagtgagccgagatcatgccgttgcactccagcctgggcaacaagagtaaaactccgtctaaaaaaaaaaaaaaagaaaaaaagacacgatctcattcttttgcggcatagtattccattcaacctgtacttcttatccacctttctaagtctctgatcaagttacattgtttcatagcaaattttggataggatatcagtgaattataagcatgtccaaatagatacctacgtttacctaggttttaaaatctttccaaaattttgttttgtttttaagaaatattcaaaaatgttcgatgaaacagagatgtgttgtaagtgcttttcttgcaaggaattctgtgttatagtaatgatattcgtagcttctatttgaagccaaacaattttaattcatctatatcttcttctaaacaatttcctttatatctatacttatagtcttcaaggtgacattttatctagatatgtagggatttactgtttacaacttaaaacattattttaattgcgtattctcagatggaacaatcctaatttgctgttgtttaaattgtattatttatttcctattcagggctttggaaaggctcacaatcatcatatttttgtttaacttaactcttggtttatggttttgacacatggtcataaaaacatgctttgataaggtgtgatctaatttagtacctactgaaattctatgtcccaatatgcccttactgctttttaaacctaaggctgttttgaaccaaaagccaattttctaatactggaaggctcatttgctccacattattgagaaacatatctattttatttaagtactttagaaatatccttgctagggctgtgtcaaatttaaataccaccggaaagataattgaaaacgctaaataatcttgaattgtttcttctgaatatttctctttacttggttaacatccaagactatgtatcttactgacaaattgtttaatatctgtcaaagttatatttcttttttctagaaaccctcagaagaggaaacaatttttttttggtaatgaattgtggtaaaagagcagtaaatattgccatggatacatataattctctggaccacaggccaaaaaactgctggcgttgattttggggaaaaaaatcagcagataacatctaaatctctgtgcatatagcaaaaataggaattttgggggaaaaataatcatactatatagtaatttgtgtttggatttgagaatattataatagtagagaatgaaagtgataccaggatgcctgaagtgtgtgtatgtgtgtgtgcaggaacatacatgagtgcaagtacacaagtgcctatatgttcattgggtttgagtgtgtgtatttgtatacactggggtttaggaggtagagttggaagggatcttaaaaatagacctaaaaaacaaacaccttaaatgcatagatgacatctattgcttcctctctgtcaggttaaatttgacctcattgaaatttctacccaaccttgcaaaaaaataccaggatgcataaaccaggaagtatgtctgcattcaaacattgcttctgagccatttcttggtatccttattgtcaggtctatcctgcttttcttcactatgttaactgaacttactatttctgtctacttttaggctctgactttgacctttcctgtgtgtgaatttaatttctccctcttagcagtaaagcaatgcatagattacttttaatgacccaccctttcctttcatttgcattagccctatgatattctatatcttcttactttcctagggtagtagaagtcttggcttgttttgccagacagagcaaaagtgtcctgggatccacctaaatctcgtaaaatatttccttacacagaacgcaaaattgcttagtactctctacaaataccctcatccccccaccccaacacacatccttttcattttaaatgatagcccaggataaatggtgtgtttccatcagtgcttcagattgccatgttctttcagctcattatgcgcccacccaaattgaatttctgtccctagcatgataagcaagcatttaggtttaattgagaattctccttatcttattataatgagaatttttaacaccaccatttctgtaaccattatggtagtttaactgctgttttctgattatcaacttttgtgagacttttaccatgtgcagagtgagccagtttggccactgccacaagcgctgtggtattgttcctttataatttttgagagtaagacatggacagagtaaattgtgtttaaggaggggtttttgttgttgttgttgtttctcaggtagacacatatgagcacgttaaccgcttttacagggctttctagatttcaaaaagctattggtcaatttagcaaatgttagtattttcaaacttcttagaaatgttctttatactctgccatgaaaattaaaacataaaactagaaatttgaaagatcatagcttttctccccaaaagcatgctatgtatttgtaaggtaagtaaaatgagtgaaataggatgaatattcagtgattttaaaaattgtgaaaaataaaaactatttttgacaattaaaaaaatagtagtgtactctccactttatacaaaatatatactttaaaataacattgattgtagagtcgggtgtaggagaacaaaaagcaaattccaaaaatagtttattttacatttgtttatgataagtttaaatggacttaagtcatttgtcctaagagtttaggaagtgaagaaatttcaagatagtaagaaatccagatgaaaatgaaactaatcaatccataagtaataacaattggtatttggcttatacgttatgtgaaaaacagcaacaacaaaaaatattcatgcctgtgcttaacatctcagtggggagaaataggcagaggaaaacatgtttaaaataagataatttatacgatattttaattgtgcctccatttcttaagggaactttttttcattcactatctgcttgagctttatgtttaccttttaggttcaatattagagtattaggtgcaattattttataggctccttaccgtagttatagaattcagtttagacatagactcacagttttttgttcagtttatcaacaaattttcattgtatgtcagtctctgagtctacaaaaaggaaagacaaaatgagaggaataaaggaaaaaaagaagaaagaaagagagagagaaagaaaggaaagaaagaaagaaagaaagaaagaaagaaagaaagaaagaaagaaagaaagaaagagagttgccctcaagaaagaagtatacaagttcctggtattcaaaaaattaagtcatacttaaagcctgaaatttctgtggttgtagggcatactataagagagagtttctaagaaaaccagttgttatggaatgaattgtatgtccccaaaattaatatgttaaagccctaaccaccaatgtgactgtatttggagataaggcctttaactaaggttaaatgaggttataagagtagggccctaattcaatatgattgttgtctttataagaagacaaagaaacagtaaaagccaagtgaggacagagagagaatgcaccatctgcaagccaagaagagaagctgtaggagaaaccaaacttgctgacatcttgatcttggacttctagctccaggactttgaaaaaataaatttctgttcttttagccacccaatctgtggtattttgttatggcagccctagaaaagtaatataccagtcaatatcccaaatacagtagaaagaacaaagccaagattagattttatatggggaaccttaggactttgtgtgttgtactaatatagggaagacaaccaagagagtaacacggtcttataatattagtgacagagcagaagttagctgctgcttcttacacattcatctatgtgcatggcgataaggcttgacagctttgcactgataagaaaacaggggcaatgctccttgaatggtttcactattaaaatggccaagaggttaagtgaattttaagaaatttttcatacagaagcatgttgtgaaaataacaatcctgtccagaaattaatttgtgggttaatatgcaggacatattagaataaagtttattgggagaaatgaagatcaactttgattcaggtttgaaatagtaagaatatggagtgtggcagtggcaatgggaagctaagaagagagaggctgaagattatataaaaattggaaatgaagagattaattactattataaacagtatgcttgtgccctctcaatattcacatgttgaaagactaaccttcaatgtgactatgcttagagacagggcttgtgaggatgtaataaaggttaaatgaggtcacaatcgtggggccctgaatcagtagggtgggtgcacttagaggaagagacaccaaagttttctgtctctaccatgtgaggacacagtgagaaggcagctatttgcaagccaggaagagagccatcaccaagaactgaatctgccagccccttcatcttggatttcccagcctccaaaactgtgagaaatatattatctgttgtttaagccatcagtttatagtattttgttatagcagcccaaacatattaagacaaagtggttgggtactttgaaactaatattttaactaaagcactctgagctttagaaatcatatttataataactataatacatttccaaagaaagtataatttagtgaaaataaagggtcaaggggctgggtgtggtggctcacacctgtaatcccaggcctttgggaggcagaggtgggtggatcacgaggtcgggagtttgagaccagcctggccaaaatggcgaaaccccatctctgctaaacaaaaattagcctgtaatcccagcactttgggaggccaagacgggcagatcatgaggtcaggagtttaagaccagcttggccaacatagtgaaaccccgtgtctactaaaaacacaaaaaaattagccgggcatggtggcaggcacctgtaatcccagctactcgggaggctgaggcaggagagttgcttgaacctgggagggagaggttgcagtgagccgaggttgcaccactgcactccagcctgggcgactgagcaagactccgtctcaaaaacaaacaaacaaacaaacaaacagaaagaaaagaaagggtcaagaaagtgaaaacgaggaagaatctttttgagcaaaaaggaagaaggttgccatgttttctgtaaaataagaataatgaaaaaaaagaaagcttgtgggattcaattgcaaaggaagttcttaattaaggaaaggaacatgttaagatagtaacaggatagtttggacaccagacttgtaaagactttggataaaacttatgatgaaaaaaggaatgtgatgaatagaaacaagtcattctgaaacaacctgcttgtgcaataaaagaaagggagataatcagtgaatgaaagggaataccatatcaggtccaacctcttcaacagctaatatctactctttaatatgttaccccactttacactcagcatgcttataaatagtgcttcttggtatcaattttgcctttccctaaatacctacatattttttacaccatcattttactgaataccaataattaaaacccaggctctactttaacacagttttatgctaagccaatgtgtcactaagtccttttctttctgtaaaatcttttcttcctacctcaacttttcttctccatttctataaccaatgctctagtctaaaattgctttaaatatgtgaaatcttgtaatagtctcataactaagaagcagtattgcaaaatgtttaagaacataaactatgaagtcgaactaacttgggatagaatcttgtctctgacgtttgcatactaagtgcctttggggaagttatttaatgtcttcaattctgtttcttcatttgtagaataaagacttgaataatagtagatgagaaaggctaattactacagatagagagaaagagaaattttctcctttctcttcattaatccactcatatctatttcatcatgttattttctcaaaaaattttagcagatttctatttcatggaaaataaagccaaattcattctttattctactataaagatacatgcacacgtatgtttattgtggcactattcacaatagcaaagacttggaaccagcccaaatgtccatcagtgatagactagataaagaaaatgtggcacatatacactatggaatactatgcagccataaaaaagggtaagttcatgtcctttgccagggatatggatgaagctggaaaccatcattctcagcaaactaacacaggaacagaaaaccaaacaccacacgttctcactcataagtaggagttgaacaatgagaacacatggacacagggatgggaacatcacacaccggggtctgtcaggtggtgggggataggggagggatagcattaggagaaatagctaatgtaggtgacaggtcgatgggtgcaacaaaccaccatggcacgtgtatacctacgtaacaaaactgcacgttctctgcatgcatcccagaacttaaagtataattaaaaaaaaaaaagtttgtaaagcaaataacttggaagacagagatagcgttccccctctaggacagagagcaaatttgaaagctaatgtctccttccaagacaagttttggcaggtttgctagcaacacatttaaaagattgttgttcctaagcttgagattatttagctgtggcacaaacacaatgtgtgtatcccttccacctggattgcttcatatagtgtccattaaacttgggggatgagaaatagcatggacaactggagtcaatggaaaaattaagttcatgctacctgctatatcctgaataataaatttcctgtatatttaacccagaaagtctcaagtgttctgctagcatttatgaaactggggcatactaattgatttatatttattgagtaaaatatcagacccctcacagttattttcaaatttaatatgcaaaattttttcctgtagcaatttaatttataagtaaattttaaaattgtaggtgtataaacaaatttacttcctaaatatttaaatgtaataaaaacacttaggaatataatttttgtatttcaggatgattaaacatgcagtaaaataatgaagtcacatgttgctactggaatcaaaagttcctagtttttgtgatgtcttttataataatgttgtatatgattgtagaaataatactaaaatactacattatcagattttcagcacttttcttctgaaaataatgggctgttacttttgagtcagagaatcagtggtctgtttgcatgtgttggagctgagaaactgatatcccaaaatatggcattttgacatgctgaactgaagaagccttagggtgtctctgactatctttcccaaaggaaaagatctagacccaataaggagaacaatattctttttcttctcttccctgttatcttattatctattgcaaaaaagaagaccaagatgagatcatacctcagtggacctttttatgagtataataacttacaagcataatgacaaggaccatttaaattccaaagaaaactatttacaagttaatctctattccccattcaatcatttttgctagcaattatttattgcccttcaacagaattcctcttcccctttttcccataacctgtcttactagaagaatccaaggccccattgtttctctgtatcctcaaaattaagtttctgtaactcattgggaaggtttggtcttcattctgaaggcttccgtgtatgcatgttaaataaatttgtctgctgttcctcctattaattaatatgcctcatgcctgtgatttttcagaaaacttttagggggccaagcctatggctcccacaaatgcatttcaagtcgtttaactgccatctttcttaccagacaacctacttgtctttataaaatagatttatttggtaataagagttcctatttaaaaaaaaaacttgctttgaatttccagctgtcagagctgtgtaattttatgtgtgcttgtttttatttgagagattatatcctcttaaaaggaaaacaagtaacagagtaatgaagataaaataatctcatttttataaaaagtgtattttatatgtttgcatatttgtatatgagaaacactgcgcagtggtatcatgtgttacctaagaaagaatagaggagtagagggaaatagttgactttccttcatatatctgtgccaatgttattttttcttttggttttgtgctagaaatacaaattgaaaaaaaaattttaatgaaacgtaagtattgaagaaccaatgagataaattaattaaaattatgatagacaccatgatagagtcagtatttatattaataatattttaatacaacagggtgtacattcgtaagtgtgaataacattttgaaatatcttattttttaacataatttttatatttccagtaaattcagccaccaccatacctatttcctattttatataacttgaggcaccttgatgcttcatttttcacaaattgtttccttattgagtgatatgcttttatatttatttaaaactatgcacgtctacaaaaacgcattagttaatttaaatcttgaaaggttgtaggatcatgtatttgtccattttcacactgctataaagaactacctgagactgggtaatttatgaagaaaagatatttaattgactcagttccacagacttaacaggaagcatgactgggaggcctcaggaaacttacaatcatggtagaaggcaaagaggaagcaagaaccttctttacatggtggcaggagagagagagcaaagtgggaagtgctacatacttttaaaccatcagatctcatgagaattcactcattatcacaggaacagcaagggggaaatttgcccccatgatccagtcacctcccaccacgcccctccttcaattcaacatgagatttgggtggggacataaatccagaccatatcagatcccttatgttttgtttctgttatagtataaaattgaaatccgattatgtgaattcgttgggatgctttatttaacaacacttaattatttttcaagggctaatattaagattttgttatccaatggaataacatatactttataatttttcatcagctgtattacaaaaaaaggaatccttattactttaatttacttgacacttgaatttgtattttcttccttttatactttatatttcattttacatactaaattctaattcttatagttttaattttttcttatatatgcaacatatttttgaataaatgttaaacatacattttaaattaacccattttccattctaaatgtacattgctcatttctctcttctgttacatagcattgcgattttttaaaaatctgctcatatcttctctttcatagaagctagcttccatgacaaagttttcccattcatttattcattcattcaaaaccacttatttagccctttattgtacgcctaaccctctctcagtttcttgggctatattatttatatctctgtaagtgaaagaataacacacaacttaaacttctttggaggcctattgccccacagtagtataagtataagaatgagtgtgatgtttttgccagaaaagaagtatagaagagatgctggctatataataaatttttattttataggtggggttagaaaggaggaaaagaaataagattgaggttgattattgtcatcagaaattttaatttcagtaaagaaaacagtgcagttatttataatgaaatattatcaaaatattattttgcatatttaaatttagattattctagcaattgtttatattttgaaatgacttacatttcatgcatactgttctgtacctatagatggcattaatatcactatattaaaaaagtatacttgatatttggcctggtggtttttgacagtgtaattataggaattttagttatttgtttctcatgtcaaatctagcagattcaataaaaaatacaatgattctctgtttatctgagttatatataatcataataaagttttataataggatccctcatatcagctgctctctttaaattatcctcctggtttgatgaagtaaaagatagatttttattaaaaaatttctgtagcacattttgtggtgtgttttgtgagatgacagtaacagtctagtgttttcatggcttttgatagttatttattgcatggtaaaagagaactttgggaagttttaaattatcttttctttcagattgaaacaaaacactattttctaacctgttatctctcatttccacctatgaaggcaacactttctggctctcttactcactggctcttgctctctttctctctcttacatttggagtcaaaactctgagaatgagtaagatctttttgatacagatctggtctgacctagatctttccttatagttttcaatttattgttttcacatgtcctagtttgggtagtattgagaggatccctaaaattttgatggatgcaaaaatatagctttagtaaacatgtatgtgtgcatttactcagaatttaaatgaaaatggagaatagaaaggattaaatactcgggtccaaatagagatattgttaatcttatattatctgacaaacttaaacaatttttaaaatagtatgccctaaattcatgaaaatcaaaggtataggagagtaaaaatcctcagaatacgtgtggcaagatattctaagaggctttgcacagttataatattcttggctttttcttttactaacatgctgcttctccaagtagagaataatttaatttctttcattctcttctacccttacattgttttgatcacctcttcacttcatctttcagagaaagaaaaagatattcatttgtttgacaggttgacattaaaaatctctttttaaaagtttttaaaaattgttgttaacaattaatatttttgaaacccattggacagtctaaatgctctcaataaaagatctttatttccatgttttctcctttgtgtcctgcaagtttctgaggaaggtgtgttaaaaccttcgaatatgactatgaatttttctatttatctattatgactatgaatttttctatttatctcttttattctgtcaattttttaatatatcttgaaaatatattattggatgtattagcccttttataattatgattttttatttttaataaatattctggtgttaatcctacatagtctaatattagtattgcttgtgctagtttctgttggttagtatttgtgcgatatctattttccattcttttatttttgtttttctgcatttgctcatttttatatgtctctagtgacagcatatagttggcttttatggtaaaattcagatttaaaaatcctttttatcttttaattggagtctggatcatatttgtatttaatgtaactactgatatatttgaatttaaatgtatgtttttaattttgttttctatttgtccctcttgttctatgttcctttttgtatctccttgaaataattattttctaattattctatttcctcttattactttgttagttatgcaatttaaataaactattcttttagtggttatgatagagatatcaatgtatatctttgacctggagaaagcctaatttaaatgaacacatgtaattttctgtgtaatgttaggacattaaaatactttatttatctctcatttacatcttcagttatgtatttaattcaacagatatgtgatcatatgcatcatgacctcaatatttattaagatttacctaaatatatgccattttatttgaactttatacatttctacatacagtcatctatctgggattattgtcttaatttctgaagaacttccttaatatttattttagtatgggtgtgctgatgatgaattccctctctctctgtctccctttcattcttttttccttaaaaagccacctatatcagtttcatcttaaaacatattttaactaaataaaaaaatctgtttgcagttatttttattttcaatgctttcattttctggctttattcaaaagagattttgttttttggaagctgatgtgtcttttctctggcgtcttttaacctttttctttggctttttgtagtttgagctacctttacatagaattttatttgtttgctgtttatgttatttacatctgtggctagtttttaaacaatctgatccagtatcttttcaaatgttgcttctgcatagttcttctgttttttacttctgggactccaattgcatatattttgatgttacaccgtataccgtgtcattaagctttttcctgtatttttgttgttttttgtttccatgtttcaatcagagaattttatctgaccttcattatgcttcactaattttctcttcatctgtattaaatgcactgttaaagccatctaataagatttaaatttcaattatcatatgttttagtccatttgattttacatcacagttttcaattctctgctgaaatttttcatcttgtcatgtaatttcttgaacacattaattacaattatgttaagactatgttataactctatatgtggagccagtcacagtggctcacacctgtaatcccagcactttgggaggcccaggagggtggattgcttgaggccagaagttcaagaccaaccttgccaacatggcaaaccccatctctactaaaattacaaaagttagctgggcatggtggtgcatacttgtaatctcagctatgtcaggagactgaggcatgagaattgcttgaacccaggaggcggaggttgcaatgagctgaggtcataccacggcactccagcttgggtgacagagtgagactctgtctcgaaaataaaaacaacaaacaacaaaaaaactctctatgtagatctcctttggttctgtttatattttctggctttttcctttttatttatgtatttatttgattccatctccttgtacacctgataatgtttaattaaataataggagtaatttgaggctctaacattattaactttctgcagaaaggatttacttttgcaggcaattaagttctaaacattacatcttaatccaatcaggaattaaagtgattccaagatggacgtcagtcattgggaacctagtgggattaccaatggaaagaaaaccaggagtttccccaggaactcctctccctgggagacctgaattccaatgtcttcttctcaactcagttacactagtgacggccctgcttaagacctgtcattctcaaccactgctttctgctcaacttctcagattttgctgtcaatttgacaaatgaccccaaggataaaagtgacaccaaatgttacatttgcctttgtgggtttccccctgaaatcatgacgttttaggtctttgacttttcagagtaaaccatacttatgcatgtaattctctattactcccctctaggaataacttaaaaagatatagtaactcagattacagctgtgcgtgtaaagaatcaataaacatttaaatatattcacaatggatgttttctttatgaagaatgtaatttagtatgggaccattgaatttgcttttccaaagcatttcacaaactaaatatcttagaatatgtggtgacatctgtagttatatagtttaagtaacttgaaaccaaatagccatattaaagagatctcagtgtatgtactgtatacacacacatgtgatattttcttcccgttttcttgcctctctaggtagttttagaaataacaaaaagtggtgtgtgcagttcatccttgtaaatttgattttcacaacaaccaatgatatgagagggctttttttttttttttgagaactgcccttaataatgaagatctactcctaaattaatgttacaatgggactcgttgactcacatcagttttctaaattgattccaaggtaaaaatttctgggagatcattctcttgattctgctaccctctgaagaaagcaacaaataattaggcaattaacaagttgctttcatgcttgccctagtgttttgttaagagctccagttctggataggctctttgaatatgaattatacttctagcacctagcagtttggtaacccagaaaaagtgacttttccctcttagtggataagaattgtacttcataaatttagaggatttaatgagaaataaatgtaaagagcagattagtcatccccccaaaattgtattattattttttcatcatcatgatcatcattacaaccaccaccaacatcaccactgctaccatacttccaaaccatgtattgtgggctccaaaagttattattataacatttttatcattgtgactatgagtctgatttcaatagctagctatatttttaaccaacattgcataatgaatattacctagatagccttcttttcttagtaattgcatttccattatcactctatatagcatttaaacttttaaaaagctgcctgtgtttttataagttaaatatataatattaactatttagttgtgctatcctgaagagttaaaaagtatttgcttgggattctgactggtgtaagatatcccattgtggctttaatttacatttatctcatgaatgatgaacattttttcatatgctagattgccacatgtatgttttcttttgaaaaatgcttatttgtgtcatttgcacactttttagtgaggttttttgttgttgttgagttctttgagttccttagtcttcaaaagtaaaaaaaaaaaaccttaaatagatgttaatgaagattcagaaaaaggggaacacttatacactgttggtggaaatgttcagttagtacaatctctataggaaacagtatggcaatttctcaaagaaataagtatataactaccatttgatctaaccatttcacactgggtatctacccaaaggaaaagaaatcattatatcaaaaagatacctgcactcacatctttatcacagcactattcactatagtaaagatatgaaatcaacctaagtgtccatcgtcgatggacaaatgtgtaaagaaaatgatatctatgcatcatggaatactacatagccataaaaagaaggaaatcatgtattttgcagcaacatggatggaactagaagccattatccttaatgaaacaacttagtaacagaaagtcaaatactgcatcttaaaatttttgggaatattaatgaaaatgtgtcataacatttcaaattgatatatgatattcttcaagttatgtcttatctaatatttatatagccatataattcataaaagctgtgtaagccataaaatcatatatgccaattttgttggttctgttaaacaggaaaataagggcaacattattatgttttgatttaaatttgcaggatttatgataagaaaaattattgtttgttattgctaacctttttctaaaatagatattaaatacattttaaaatagagtcacaaagctttgaaccaaagtagaaatggtggaggaaccttgtactttacagatgggctgccagctaattgcaccttttgcgtaatggctatatatttgatggatttcgcaatcttagaatgcttccaatttttatttgcaaagtagcatattaataattgccttgcaattttgagatgaagagtaaataatataaatttttataagacacttggcacatagtgctcaataaaggtaaaaggtgttattgttgctatagtttcctggaataaataactgctgtacagtgtttctcatggtgcttgcaataaaggaagcaacattcgcttggttgtctggattctgaaatactgcatctctgaaattcattcatattatgcaaatagtgtgataaacatttttattcctctattcctgcctttctcaaactccaaattataacttacctacagaatcccctgtattgaggttggtttttaactgtgcttttaatttattctgtagtttttaaaactgctttagtatttacaatagttggcagtcatgaaggtagtaaattatgacctttattcgttatcataagaaccccagtttgaacagagattgcacatgactttattgtccttctgtgcttcaggagtgtgcagttgcttttctgaaactccaagggagaatttgtgagtgtatttatatatatgctactagaaaagtaattgaagaatagaatagaagaagcaatgtaaaggcttcttagaaaacattaaactagtagagattattcagcctgaagaatagaaggctgaagcgcaatatgcagcgaaatgtttaactatagtgtgagatgatttatgttaactataaaggagaacctccctgggctgaatgatagttattagaccatggtacagattagagaaagagtttatggaataactccaaaatttcctaaaatatcagagtgtcctacttaaatcgtatgctattggtcttactgaaaactataaaaatgcagagattttatacactgtttttgttctttaaaaaaacccagtgtttagtaacatgaaattaaagaaataatggaacacaattccacaagtatcagaaaatgtgctaccttgttgagtaaattgaaaaaggcaggcattacttccattctgcttaagaaaaaaaaaaaatttattttaggtctgctgtgtgatagttgacaagcagtaaggactggcttgtttgtcctataccactctttgtttctttctttcttttttttttttttttgagacttagtctcactctttcacccaggctggagtgcagcagcacagtcttggctcattgcaacctccgcctcccaggttcacgtgattctcctgcctcagcctcccaagtagctgggactacaggcgctcgccaccatgcccagctaattttttgtatttttagtacaaatgggtttcaccgtgttagccagggtggtctccatctcctgacctcgtgatccgcccacctggggctcccaaagtgctgggattacaggcctgagccaccatgcctggccgtcctatactactcttttatgggaaaaagtagctcaactgggtgtgaaaacattaatgttctgatatagggtctgctacttatactatattatatggaataatatactatattatatggaataagtcattttaattttctgcatctttttttactcactatgctaattgatctctaaaattttcaaattataatgttctgtgagtaaataaaataatgaaaagtaaatgttttttagtctcatatactaaggcacatttaatgcacctcccagtctttaacatgcattctgattggattatttattcatttggggaaatcttatacattgtacaatatcttaactaaatttgatttgcattttcatgtagctaggatatgtaatttaggaaacaatataaattataaataattaaaacctatttttgataaagagggtgttaatgtaagctagtgatcctagtaagttttttcattacgctcttgtcttttgtttctggtactctacaaatttcaagtcatacattaaagtgggatctctgtatctgattcaggtcctgctatgtcataatccaatgatgtctcttaaatcatattttctttccttggcagttttattattatcactgcttagaaatactgaggcaacaaaatcatatttctaatatcttaaaggatggaatattatttcataaagtgagattacctaattgcttgttatgtttttgttctctataatgagagaggaaattaagataatcaccttgagttgattttctgatttttatcaggaagataaaataacttccctgtgctttttcatatgcaatattttgatagtaaaataatggtttactgtttgaaacctagaggaaagagaaaagaaaataataataaattgtgttaatccacacttggaaattttctataccttgtaaacatttatttcttacaattttctattaaagtagatattaacatcttcacttttttgatgaaaaaactgagattcaatcaggtttattagtttgtctaagaacccagtcaacaagtgaaacctggatgcctgctcagttccaaagctcggagtgtttctagtacaccagatattctggctacacacaagaaacaaatgggaaccttaaaaataccaatgaattcaatgttcaagatcaattgagaaccactaaagtatatcgtttatgttcttgagacaaggtcttgcttgctttgtcacccagctagaatgcagtggcacaatcatagctcactgcaagcttaaaccctgggttcaagcaatactgtgggcctcccaaagtgctgggattacaggtgcgactaccacacccagcctatactttattattcttcacaattttttcaaatatttattttacaatattttagtgaaaaataagtcaaatctaaaacatatgtttgccagttatgttatttcccattgcaatattgtagatgaacagatggttagctattagttccatctgtatgaccaaaatagagagtaattgtgtgttattgttacttataggttcacttgtcaaggatgagtgtttccaattctacaaataaaaattgtattattttctagttgtatgaaagtgaagctaatgcttaagaatgtaagttacctgtttgctactaccatttaaaagataaaaattggtttttcagtttggagatacttttaaaaaaatctctatttagttaataagaaattctatacaaaaaaaatctctacttagtttacaagatattttatacaaataactgttttggcacattcatgtatgagaccggcttttaagagtcaaaggattaatttgaaatattgatggtatgagtatgatagaaatttcataatagaaatattacaaaatggataaaatgttttctatgtgcttcgttatttactaatacattgacttctcatttcattacacatttccagctagatggcaagcaattcaaaatgggacttaatgtaatgatataattttgtgatttgtgtgtctcctttaaactttcaatcatagattaaattttaatttgttaatgtgttctcacaggataaacaaggcacaaattcctactatatactaacggaaaagggagttttttttgtcaaaagcattaaagcaatttgttaatagaattcatcagcattgtatttttctaccttaacatactaccttgtggttcacattaatagttataataattataaaataatttcataaatttagatacttgggtaattgacaaatatctatttacaaagctggtttagaaatagaaactaattggccaggcacggtagctcacgcctgtaatcccagcactttgtgaggccaaggcgggtggatcacctgaggtcaggagttccagaccagcctgaccaacatggagaaaccccatctctactaaaaacacaaaattagcctggaatggtggcacatgcctgtaatcccagtgactcgggaggctgaggcaggagaattgcttgaagccaggaggcagagattgtggtgagccgagatcacaccattgcactccagcctgggcaataagaatgaaactctgtctcaaataattaagaaaataaataaatgaaaccaaaataaatttttggcgtaaagtagacgcttttattgaattttagttctgtggaaaagtagatgtttgcgaagattactatattaaacatttaatcctgaaaaattcaagtccttgtttagtgaacttatttttccattacttttggctttctattacattattatccagtacaattttagtgagtatctagtaagtttaaggattatattaggtggtaggatatagtatatctatagtaggggtccttgctataacagaagagcagggaagaaaaacattaaacaaatacttataagtgttgtatgtcatgtattttctgcgctttgtgacatatggctgtaatttcgaggtagggagaggttctaaggactgaaacatatgctgagatttttttttcttttttttttttgagacggagtcttgctgtcgcccaggctggagtgcagtggcgtgatctcggctcactgcaggctccgcccccagagttcacgccattctcctgcctcagcctcctgagtagctgggactacaggcacccgccacctcgcccggctaattttttgtatttttagtagagatgaggtttcactgtgttagccaggatggtctcgatctcctgacctcgtgatccacccgcctcggcctcccaaagtgctgggattacaggtataagccagcgcctccggccatatgctgagatttgaggggtaaaggaagtatatttccagctgagggaaatgctaatctgaaggcactgaggcaagagtttacaaagcagtggggtattagtttgttattgctgctgtaacaaattaccacaaacccagaaactgaaaataacacaaacttattatctcacagttaaatagatctgaagtttagatgtgggaggtttctctggtgcaaatctcaaagggcagtcttcaaggtgttggcagtttgggctcttatgtggaccttctgacagtgggaggtgtgggaaaagggactctgtttccatgctcattcaggttgttggcataattcatttccttgttgctgttggctgacttccccatttccttacaggcctggagcctctgtcatattcttaaggtcttctgcattccttgtcacatgcccccctcaatcttcaaaccggcagttgtgcatggagtctttttcacctatcatatctgcctgacatcccccctctgccacatcacttctgactctccttttcatacgttagatgcaaaaaaaactttgctcttcaaagtttatatgattatattaagtctacacaggggattctggataatctattttaaagttaactgattagtaatttgaattactaatttaaatcttgattactaagtcctttttgccatgttatgttacatagtcacaggcttgacaccatgggcataaattatggggctaaaattctgcctaccatggtggttgaattttactgcacatgaagaggtcagtgaactgagtggctaacttgctttttagcctgtatattttggcattaatcagccaaaaatggttgtggtgaagagataaactaaagtcaatgacatatctctagcaatacctaaaggttggcaattagtagacacaggatgagtagaggatgataccagcatgagcctcacagattgggggaatactgcaggctatggagtggtgataattaggaaaatgcaccagattgccctatcacgtgctgaagaaaaagctatcttcaactgacagaactcagtggaatcctggcactttggagagagccaattttcaccaagtcaaaaattgaactgagtagtcattcaaagagttcatactgttgagaagtttgttaaaaattttccaagagtaaagtagaaaattttgtgggggagaggaggaatcagggaaatgtatcaggagaaacaacacaaagaacattatgggcatgggagcgtcagacagagatggcagagagtggtgaaaggcaaagtgaattgagtatggatttacaaagaaaataataactctaataatctcttggaaatggatatatttctttcactagttatcaagaggtctgcaaagaaagtcaagttgttgaaaactgcatggtctttggaagagagtggtagagttaacaccgaatcgacttcaggttctgtgaagtctggagcatgtaaggtccaagtcagccatttgtttctgagagtcagtacaccatagtggttaggaatacagcctgtggcacaagggctcatgggttccaatcctgtccttctgactttgaacaattcatttaaactttctgtgcttcagattcctcagctgcacagtggaaataatgacattagtggccatttcattgtgtcattgtgaagattaaatgagtacatggctcattgttaagtgttagctactattattattattatactttaagttctgggatacatgtgcagaacattcaggtttgttacctaggtatacctgtgccatggcggtttgctgcacccatcaacccatcatatacattagacatttcttctaatgctatccctccccagccccccactccctgacaggccccggtgggtgatgttcccctccctgtgtccatgtgttctcattgttcaactcccacttacgagtgagagcatgaagtgtttggttttctgttcctgtgttagtttgctgagaatgatggtttccagcttcatccatgtccctgcaaagaacatgaacccatactctttcatggttgcatagtatcccatggtgtatatgtgccacgttttctttatccagtctatcattgatgggcatttaggttggttccaagtctttggtgttgtgaattattaataatattgtgttagctattattattaatggtcattgctatgattttttacctacttaccaaagatttcaatattacactctatgcaagacaaataaacagtttttagactgaaaatctatgctaaacttaataattttgtgtatgtcatttggttcaataatgctacttaagaaacacagtattaacctcatagagttaggtattattgcttgtgtgtgatggtggagctgtgtcaaaatagttgttgggaaaataggttatggtttaagtgattttggtagatctaaagatgccaatcctggtaatgtaaacttgcctgttggattactttttctttaataaaaacagccataatcttctagaagcagtgttcttgagaaatgtatctgtcgctaaaaacagaggaggtcaaatgatttttctaggtatagtagtcacagtaaatatctactgtcacatgtagggaagcagcagaaatatactgtggcttctgttattggaaaactgtctgtatcttttctagctgtctcctccaagcatccttcaatggggaattaaccttgtacaattaaatttgcagcagagtaaaaactttttaagaaaaagagccatcttttaaaatattagcctgttgccatttagttcaaattacgcgattgataattcaaaaccacttacatgctcatttttatgctatgtgaattgaatgtcataaaattcatttattatgaacaaaatattcaaaatgcatcagagtattatatgctgagctttgataagagaaaaaagaatgatttgacaaggatatgaaaaatcatataccaggtatatgaggttaaatgtattttcaaatgcttcttgattacaatagttaaatattccttgagagattttactatatgaatttatttcagatttcaagtagtcatttggaaattgttattttgggaattttttagatcaactttttctaatcacaactagaaaattaatactatcactttggcataatttgattgggactgctggttatttaaaacaattgatgtgtataagaaacttttaaaattattttaggaaatgtaaaaaagtatttgatttagtttctgcctccaggtactaatacagtaaggggatgaatcatgtacacatataattattgcacaaggtataatataataagggccataagagaaatgcaaagcaaatgaagtccaagaagagagagattaccagaagcttggcaatcaaaactctgttttcatatttcagatagacaatggaaatattaagtggaaaagtagggtatggaatatataatatagtgaactccaataatgaatattttagaaacacacagatacaaatagaaaatattggaaggaaatgactaaaggtataatgagtggtcatctccttctttctcttctgcttcttttgaatttctcaaattttctacaataattgcatttttctcttaaaataaaaacttattaaaatatatggtctcatattaatctaaaatctagagctatgagacaagagaagaaaatgaggaaatttctaagaatatgttcaagtgtaaattttaaaacctgtttataggaaagaagacaaacaccatagtaggtctataaggatggttggactgctttaatactctatagaatccctcctgtagtttatagagagtctctgtaaagaaagttatctatttgctattttaaagtaaacattatttagagaatatataccacattatgcttgataagtttggttatgttataacttggtagaggaaggtatcgtttaggggagggaataaaagcaactaacaattgagtcgaacttttgataagttttaggagtcgttgactaaaggttggtgtgaatgaatcatgtcaccttcatttgagttctctcttcaacctttttagtagaagaaaaaaatgtgaaggagaggaaatatgcttgtagatataagttatattaagtattaatactcatgcacttacatgcttttaatataagttcaatgagaaaaaagagctctaaaatatttgtcaaactttttttaaatgaggatctttgcttattgttgcagattaataatatggcttttttgaaggatatttgccaaaatgtctaaaatgcttttagattggattatcttagagcatgtaaacaaatacagtgatacagtaatagggctatgagaaaaatcattcatgaatgaacctattccacaattatgatctctagcttgcacatgataacattttcatgtcatgtcttaatttaagaagattctcattgtttatgcaaaagcagctagtagagttcttttaatgagatggaatctattaaagtctcgaattgaatactaaagatgccaagtttaagaaaatgttcacattattgcttactgttctttgtgaattttctcactcatacgttgtatctcaggttgggatccctagaagcagacgttgagacaggatttcagttgcccatatttattgacggtattttctcaagataaagggagtgagggaagtgagaaagttcaggggaattcactaaagcaagaaggtggttttcactgcagtctagattcagccatatctcatggggataagaaggagcatgacttttaccatataattgtccccaccttgaggcaaaggggctggcattttgtacctccatgtattctttatcgatgttggaaaagcaggttagcaatctgttaggggaaagaacttctggtaggcaaagggaaattctccaaagaagggggcaactatgaactatcagcagccaacactcacagcagctggatcaaataaagagagtgtggccagaacacttaaactgttcagtagatattattggttaatcaagaccatagacatatttaatttaatttcacaatgttcaatcattaaactgtcactgagtacctgttagctactgaaaagtaatagtgaactattattaatatatttaaaaaaaatacatgccctcctcctttatccaggaagaggtcaaaatctctgggggcaagagtcaagtataccaatacagtcataccttagagatactgagaatttggttccagatgccacagcaaagcaaatatcttaataaagtgagttacacacaatgtttggtttcccagtacatgtaaaaattatgtttatagtatgctgcagcctattaagtctgttataaaattatgtctaagaaaccatgtacatatcttaattaaaaatactttattgctaaagagttctaatggtcacctgagcctaaacagagtcataatctttttactgatggagagtcttgccttgatgttgatggctgctgataagggtgatggctactgaaggttgcgatggctgtgacaatttcttaaaataggataatgaagtgtgccacattaattgactcttccattcataaaagatttctctgtagcacgtgatgctgtttggtagcattttacccagagtagaactttgaaaattagagtccatcctctcaaactctgctgctgctttatcaactaagtttatgtcatattccaaaacttttcttgtcctttcaacagtgttcacagcatcttcagcagaagtagatttcctcccaaggaaacactttttctgctcatctgtaagaagcaactcctcatctattcaagttttatcatgatattacagaaattcagtcacatctaattctggttcttttgttatatttccatcacatctgctgttacttcctctcctgaagtctttgaagtcttgaacctttcaaagtcatttatgagggttggaatccaaactcctgttaatgttgatattttgacttcctcccatgaattaagaatgttcttagtggcatctaaaatgctgaatcctttccagaaggtttttaatttattttgcctagattcatcagaggaatcactatctatgagagctatggccttaggaaatgtatttttaaaataataactcttgaaaatcaaaattccttcttgatccatgggctgcagaagatatgttgtattagaagacataaaaacaacattaatctgcttgtccatctccatcagagagtcttagataactagatgcattgttcaacacgtagtaatattttgaaaggaatcttattttctaaggagtaggtctcaacagtgggcttaaagaatattcagtgagccatgtcattaaacagatatgttgttatccatgctttgttgtttcattaattgagcatgggcagagtagatttagcataattcttaaggaccctagaactttaagaagggtaaatgagcattggcttcaacttaaaatcctcagctgtgttagcctccaagagagtcagcctgtccttggaagctttgaagccagcccttgacttctcctccagaaaatctgttatttagcatagccacctttatcaattatcttagctagatcttctggataacttgctgcagcatcttcatcaacacttactgcttcacctttcacttttatgttatggcttctttccttaaacatcatgaatcaacctttgctagcttccagtttttcttctgcagtttcctcacttcttttagccttcatagaattgaagagattaagggccttgttgtggattaggccttggtttaagggaatgttatggctggtttgatcttctattgagatcacaactttttctgcaccagcaataaggctgtttcactttcttattatttatgcattcactagagtagtacttttaatttccttcaggaatgttttctttgctttcacaacttggctattttgtgcaagagacctagcttttggcttgtctcagttttagacatgacttcctcactgagctaaatcatttgtagcatttaatttagggtgagagaaattgtaactcttcctttcacttgaacacttagacgccattgtagcatgattaattggcataatttaaatattgttgtgtttcaggaaatagggagatccaacgagatggtcagagactagagaatgaccaatcagtggaggaatcagacacacacaatatttatcaattaagtttgccattttatgtggctgtggtgtgtggtacaccaaaaaaattacagtagtaaagtaacatcaaagatcactgaccacgtatcatcgtaacagatataataataattttaaaactttgaaatattatgagaattaccaaaatgtgacacagaaacacaaaagtgagcataagttattggaaaaatggccccaatagatttgctggaaacagggttgccacaaaccttcaatttgtaaaaagcacaataaagtgatgcaaataaaatgaggtacaattgtatttatgtacaatgagttatgtactaaaacaatattcaatattcaactattatggaacagagaaaggctcaactattagtgccattatttatatatatcttaaggtatgctatttgagcttgaaaattatgtttaaacttaaacttttaagtgtcccttctctgggaaattcacctgtatagaatatcttacttctatggaatgctgtataaactttgtgtactcacatacctgtgcatataaagcacatcccatttgttgggcggccacttatccccaaacttaaaataagtaaaacataatgtggatcaatagtatttgaaaacaataaaataactcctgccagtcacaatgaagggcagaaaatactgtgccagttgaggcacatggatccttctgctaggtaaatataattaaaaacaaaatactctcccaacctagaaatcctctccacaaaggtagcaggtaaagaacacatctgtattattgagtaagagttaaaccagaatgtggtgaacatcataggcaaatctcttcactaaaagattgcaaaaacagcaactttgctcttttatgtagtcaagcagatacaacccattatacatacgtttttaagatacataacatctagtcctcaaataaaaaggacttagtaccacttgtcaggcatagttcattataaatttagccagtaattggggtgaccatctatgttaactaattggtgttatccagaggagaaacaaacttcttatatccttatgacagaaggcagtttttgagttaggtcctaccttcccacagaagctgggagatatggatgctaactctcttgatgttgacatttcaaggagatgatgtgcaagcccttaagacattcctaggtcataagactgacaaaaggcctatttagctttgtaaaggatttatatatgttttaaaggaggagaaagtacttagtattacaagctttctaagaaaatggagaggagggaaatctgtttttttcaatagagagaattatgcttcatattttaaatttttctttgtccttgcactacttatgatgggattctttaggccccagaggaatcatttactcttatttctgacccagttatatagtttgaaatcccacagcagattgtaccttatctgagagcaggcatcttattggagacagagatgctgactctagcatgatgaagggacagttgtcaagtctgacactgagagaagcgacaatacttacaaaaagcagatggagaagtgtaaaagaggggaggagagagagtaggatgaaatggacagtcattcggcttttctaatgggaagaaacaatcctgccacttaggtgactcctgacggcattgttttattaccaaacaaaaattaaaattgacctttaaaaatatatatacatatatatttatgttcactaaaaaattatttaatacattcaatccacagatagtctctaggttgtttgaggtcacattcctgttatgtttaaggatcttcactgatgccctttgacaatgtctctttcaggcttctctcctttttttatagcatgtaagaaaatgtgcacattttctgcacatgagtggtactggtttttataagtattacaggaggggaacacattgttgagttcattggtgatttcacccccaagaaacaaagaccctcctgacccaggaggaaagtagagcagttgcattttataatgaaaatattattgtgtcacattattatgactatttttcagtgggtgattcagtaaatgcagcatatgcttagtaaatatggatgcacagtgtctgaaaccagactgccagggttcaaatcacagcatggccatttactatcatcattgtgaccttgaacaagttacctcatcctttctcatttcattttcgtcattgatgaatagtgattattaatagtgctttacctcataagactgtgacgaggataaaaggagttttcagagagacagaaaaagtgaaagagaagatctgtcaaaatagtcaataaatatcaactattatttataaacaattacttacagttgcaaggcttatttcaatctagaaataatatgtgctttaagagaaaatgcatgtttttttaatcacatgtagagagtgtgctttgtaaggatgcaagaaaaaaatattctatattactatatgtctagtaaatgtgtattgtacagctagttatagctgagtttattttgtggattcacaaaatattagtttgaaatcaaattggtattttttgtattttaagtatgttgaactcaattttatgatttctaatgttagtgtatatcttatgggtagaccaatttttttttgcctgtactgacatattttgatgttgatgtatttgaaaactttgttaacacacatgatctaaaatttatatagtatgtgtgtttttatcttttttttttttttttttttttttggcttgggttggtggtttttttttttttttttttatgtgtttttttttttttttttttttttttttttttattatactctaagttttagggtacatgtgcacattgtgcaggttagttacatatgtatacatgtgccatgcttgtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcaatttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgacttcttaatgattgccattctaaccggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttgtcttttgttgccattgcttttggtgttttggacatgaagtgcttgcccacgcctatgtcctgaatggtaatgcctaggttttcttctagggtttttatggttttaggtttaacatttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgtttttgtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttatttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtcgattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtgactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttgtcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatttcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtggtgcgccgtttcttaagccggtctgaaaagcgcaatattcgggtgggagtgacccgattttccaggtgcgtccgtcacccctttctttgactcgaaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctccctcgtgtttttatcttataccatgtggtaacacatgtttatttgtggactgatttaagaattgataattatacagtcttcacagaactcagaaaaatggtaaatttttacattcatattgggtgtttaccaccttgggaaatataacaaaaggaagaaatatctaatgtttttgattttctagtattgccgtaagaaaacaaaaataattctctacttgtccactatttctggtcccagactgaaagaaaaaaaaataacttttttttttatgtttctatattttgctaaactacaagtgcttgctgttgagcaagtgtgaagcaagctttctcctaccacttttgatgtcctaaattatgtctttactctgatttggcaaacatggtgtaggtaaatcatcttggagagttcttcctagaatgagtttacaaacaaatccactttatacttataaattataataattccgcttatattgattcatcatgaattgtgctcataccctattaaaaaaaaagaaaaaaaaagacactcattagacttaaaatttattagtggcttaattagatccttttcagatcatttttaaaattttgtgtaaaatgataagaaggcactttttaccagatatagtatatcatggcctggtgaatgctttccttttccccatgtcttaatattttatagatttatttctccaaaggacctgtattagttaagttcaggtggattatgtcaataacatattaacacaaaatctcagtggtttcatataacaaaagtttacttaccttttatttttttttctaaaatatcaattatggagccagggctctgttccgtaaagtcattcagggtctcataactccactaaccaaggataatgggaaaacaatctttcctgtgccttgacagaaaaaagaagtgcttcttgttgtgcactaataatatctaccaagatccatgtggctcttttgtccttgaacatatataatagtttgtgtaaattctcagaatttggtgaatacatgggtgttactgtataaactcagatttattaatcactaaatagctctaaatttgtaaataaatttaattcttaaattttaaaagaattttaattaatgtttttacattgacagaaaaagataatctttctcaggttatttttggacatgaaatggcaataaatgactgcattgcctactggcaatgggtgaaaaacatgattgaaagcctaaagaacaagtgccatttttatcctgtgaacagccatgcaaccaaactgcagcaagcaacatactgatatttctgaagagtctcctggaaatttgccaggaagaaaagatgagagattaagaagcagagtacgaagatgaaataattatttattctatttattaaatgtaaaaactttccctttaagttgcaataagaaataaaataagctacttgagaaagaagaatcttactgtattgactttagacatagagagaatcttaaagtgcttctatgaaaaaatacactcatatctaagatatgtagaaagaaattatgcccctttctcttctagtcattgtaaatatcctgtcttaaagagctcaagctattttgctactaacagcaatcatattactcttaagttaatccatcttatataccctctataaatcataatctagttaaatacatagcaaaaatggtgaattggctctccttaacctgagtcattttaagttgtacttttaaaaaatcttaccaattgctaaaaagcttaattatgaaaagaacttgcaaaagaaattaatgactttgtaaaacgaaaatggctttaaaatagacaagctctaattaaattgatttggacccaacatctttttattcaacaaacatatgtatttaaaacaattttctgctgtaatgattaattataattttatttttaaactgacaaaaagaaaatagcatacctatttaaatcaagaaaaggtagtttttctttaaaatggagatttttagttttgctaaatttaaaaaaaaagataatgtctcaagtagtaaactaatgagggattgtatgtctgacaatagtctaaaattgtcttttgagccatgtttccttgactgaaagaggaatggaacaaaataattatcttttttttcaatcttctcctctaacatatttctaagccttcagaggttaatagcaattatacaaaagatgccttcccatggcttcaagcctgtcatgttttgttttgtttgtactctagagaatgctctgaggttgattgagttgtgttttgaattaacggcctcacatcacctttcaaaatttgaaacattcttatgacattgtcaaaattagaaaagttgttatcatagttacagttttatgcaataacagattgtgtctattttgtttcactttattttgggatatactaatttgcttcaaaaaattgtatctaggaaataatgagcaatagaatcagagagaattaggtttgaaatataagttttatttaacttctttgagatgtaattatcttatttctaaaatgagattataaatatccatatcttctgaggatcaaatggcataactagtatagtgtctgccatattatatccaattaaaaaataacatgctattcattatttttgtccttactgtttaagccttgtgtttaagtttatgagtacttagaaggaatttttaaatgcctatgatttatttacactttatgctttaaattatgcttgtgaattatttatagaatttttctacaaatactgagccaggaagcatataacattttaatggaaacatagaaagcaataaaaaggttagagttattcattaatataattagttgtataagagtaataagcatatggttgttgatatggtttggctgtgtccccacctaaatctcaccttgaattcccacctgttgtgggaaggacctggtgggggataattgaatcatgggggcagatatttcccacactgttctcgtgatagtgagtaagtttcacaagatcgatggttattataagcggtggggcgggggtggactcttgcacaagctgtctctttgccaggtgccatccatgttaggcgtgacttgctcctccttgccttccgccatgattgtgaggcctttccagccacatggaactgtaagtccattaatccctttttcctgtataaattacccagtctcgggtatgtctttatcagcagtgtgaaaatggactaaatatttgaaatttggacacaattccactcactaataatctactatatagcataggatgttttgatctgcaagtcacagaaaacctcaacttctagggtagtcctgagttagaatgagcttcaggcatataacaatctgtggctagtcatatcatctagaactcaggctctttccaatattctgccttctgtttgctggtgatcacatcaacttcaggctagaacaagatggcagcagtgtttccaagcaacacttccagactcagccatatcaaagaaaaagaggaactgccactctgttttcttcttggaatcaaggaaattttcctgtgaccctggtagatttttcagaattatccaattcctacaaaatatactagaaagcaaaaattattactaatttaaggatgtaatggatattattagagtgccaatcaaagacaccatataggtcacacttttaggtacccagcatataaacacacattctttccacccataggcatttaaaaaatgtccatgctcactaaatacacattctccagaatgggaaaacacagacatatgtaagaccctcagctcaagtttagggtctctgtgttcggtgaagtcctttccatcaatttagacagtaactgtttattgtctggtgaagaagtgtttcactctctgcccaacttttggtaattggaaaacaggaaagacaacttacatgaacactcttactcaaaacattggaaaatcaaaccgcgatactgatttatagcacattttctattttgctggaaacgtgaatacttttggtttgatagtcaactaaatcccttattctgcaaatctgacagttgtatttgatgaaagctgagatggtaacaactttcttgcccatatcgaaattcagggaatggggatgtggaaaaatgcctcactttgagattgcacatttttaacaggccccttcctattgagtgggtttggtgagctggtttaattatttaattggtttaattatgggatcttactcttggtgaggcttacagttaccttgatattgtagttcccttaagaatttatttggcttctagctcactggagttcagctccacggactggtaacctaggcagagagcttatccagcaagttatttattctgggaagtctagttttagccacaggcctcagagcttcatccacccctctctctcgaccctgtcatcattatcatttaatgacctctgccatgaacggaatcaaaagaatagcctgaagtcagaagacacatatattatgtgttccttctaactgcatttttaaaacaagattgtctcctttactagatgaataatgcctaactggaggtgtttgctagaaatctggggttgtaggatttctttttactttaatcaaatattctgcccagtatccattatcccatctctgcttgctttatctatggcttgagtagaaaatttggcttttccagtcccccaaatttccaaattattgaactttaaagcaatttagattatagcccaaaacctcttcaggcagaattgtattttattctttctctgccttctgatagatcagctttagcctaagcataactctttcttgaaatacctaactgaaagctgcaagaagtagccaaaacaccaatgttctgaaaattttctgtcagtttcccaaatgggcaagcatttagccaagtgcttcagaaccacacacgaaaaagggtaattaaccactaagatttgaagaatagagcaaattgtctttatccttgctttatctcctctcctctgccaatttagtgttttaaagtctgttacttgtggcagcatatttccggtgacatattcggcatcaggatgcttctgtcaacaagtaacagaagacattaactaaaccaccttacaaaacaatggaaattataccatttaactaatgtagtgggggtccccaagtgccatgcatgaaggttcagccccactgtaattttcttacctatcgtctttctctaggactggtagcaaaataccttcagctccttaagataagatatttacaatgactagaagaaaaagagaaataatttatttccaggtatcttagaacaagtatatttttcacagaagcacttcagaattattctctcaatgtctaaagtcacttatgtaaaattctttttttcaagtagcttactttattttttattgcaactcaaagagaaagctttttacatttaatagatagaacaaataatactttatcttcttactctgcatctcatttgctcatcttttgtttctggaaaattttcaggagacccttcagaaatagcatgttgcttgctgaggtttggttgcatggctatttacaggaaaaaaaaatagacacttgttctttaggatttcaaccattttttttttcacccaatgaaaattgctgggtcatctgtgacagcctcttttggaaacctgcagttgtcctcagctggggtgagaagttcatattctcccaggcctgccttgagataaagtaaagcactacactttagaagtgcttccttttcatcctaaccaggagtttgaattaggaatagaaacattcctggagcccttcgtctctgccagagtggagagtggcccccttgggagccctccttccttccacccacaacctcagacagcattcaaaccatacaacagccaccccaaacgagctaggtagactgaaaggaaggaagagaaggaaggactaatataaaatgccttagaacatatacttcataattgatgggtcaccaacaagaagtgattacttcacactgcagggaaatacttttctggaaaacaagagacaaaaataattttcggatacctgcgcgctgactctgatctaactctgtagcctgtcctcatcccagtcacctttgttaaggtgtctttgttgagcctgagttctgtacagaaaccagaaaagctcgatattcataaacatttctttaaatgcagaaacatagaatgttaatgtgcatttttctgagatggtgttataagtccaagtatcaaaaagcagtagcaaatattagtttgtgttttcaactctggagtctacctaggccacgtgttaaggacatctgtatacttcattagggaatgagaagccaggaacaattaccttagaatttttgcatctgctgtcactgtcaatacccatttcatacccttatgcattctgtatcctttgctaaataatttctgaatcttaaagtgtgtgtgtgcacgtgcatgtgtgtgtgcatgcatgtatgcatggtgttttcctgaaaactcataaaacacaaaacactgtacactaaatttctgtaaaacaatttaataatatataccaccttatgttacaaatattcttttaaataatttttctacctaggctactctttaaatggttgtcactatattatatacttgttaccatatcaaaactcagtactctaattaatatatactgaattttaaaattgcagtaaattttatcttctcagtgtagtaaaaagacccactaatttttcaagtaaataatcttgttaattccttgctggatgatgttttatgatggtggttatgtgtctcctgtgagcctgttcccacattcaaattattttatgtatatactgagacaaataaaaaatataataaacacacttaactgatacatctgtggaatttttaaatactttaagtgaaatacctactttgtacaagaaaaggttataatattaccatttgaaaaatcaatggtgctttcagattccgaggcatctcagtataaatacatattattatttttactcaaatgcatatctgaaaatattttcatactgtcatgctagaaaagcactaaaattgcttgagaagatagctgatatacatatatctgggctaagaaagcaaacttgagtacaagtgtttgagttaaaacagtcttatgcatactaaatggactctggcaacatcacacatttacctaagcatttagagatggcagttcttcttaatttgttcttaattctgttttcagagtattgtgatattttaatctttggaatgctgatgatttatgagttcaaacttgaagacattttctctgtcagtcttttagtattcaaatcaatgcagggaacacagaattagatctggagaggggaagcaggattcatcctctctggggataactaagcaaattatttggaactctggatgctcttgggcattcagtaggtcaaagtctaagtcctcaaagtaaacagtgatgggtcaaattgctgagagctccatgtgtgtaaaaaacaattctttatagtgcccaacatatctggttagaatatattaattggtggttaaaaatagaatatttattttaaaacagctcgttgatatagataaaattgaactaagatttctaatatttaatgtaaatattattcacttatcattcatgcagcacttgctctatgccagggacaggctttggttcagtgatctcaaaaataattagtagtgttacccaaattcaagcagtggcgtagattggatactccaattagtggaccctgatcttaagatttagatgtaagtgacttattaagtaagtgctcccaggaagatgtgataagggagtggagaaaacaggaaatgaacgacaaagaaccaggccaatggagagaattcagtggaagtttcagacatagcctgattctgtgggaagctctggagggtaaattacaggtcagaggttgtcctgaccctagacaaagaagtaaggcttttatactcctgttagccaggatgggaggcagtgaggttttggatgtgtggttagtgctgtctaggcacgtccagcaactcctgcaggggagaggacatcagtatgcagggcattcctctgaagggtgagttctaaaggtgtaagcctttcaaagcaaacaagaataaacttgggccaggtatgcacagagctggccaaattgtggtagtcactgctggtgctccacacaagaatatgcaatgttaatcataggaatatgtttggggcaccagaagtgagtcctgtcagaaattcatgttctggaaggggtgctaagccttaaaaatatgagtgtgatacgtgcaataatatattgatattgaaggcacaatactcagaaagggggttggataactccctggatggtaagcatgggaggtcaaagaacacttgagtagaaaaatgaagagacattttaaatgctaatctgcttgctaccataaactaagtattaaaagtgtatgtctggtttgattatcattttttctttaagggagaattaatatttcactcaccgcttagagaaaggtttctcttactcagtgtcttgtgtttgcttttcaagtcctacattgtcccactgaaagaattaattattgtcctgtaaaacctattaaaattctgtcttaggaaaacctattgtcctgcatgtcaaatatttctacagttttataagttccttttggcttctgcttctcctagcctaatttcctcatcttttcttccaaagtgtatttctcttacccggtcaatgagaccatattctttcctcatgcataagtggtactcccataatcattccatcctcttccagcagcaaggagccaccttattgcctccttaattttttttatgtctctctttaagttagtatgtgtgatttaattccctagaatgaccatttgggattgaattcctgactacctgataaaattacatcacatagaccatgaacccagaatacaaagttgtatgcttttatctgggcctttctatgttctatttcaagacatctgactcaaacaatgaagtgagacatctaatttcatttctgctgcttactcaatgtcacttttaacaatatattaacctctccaagtcttaattccccaatttagaaaagataggtaatagttcatgtgtaagatggttgctgtgagagttataaatgctcagtgcagtgtctgagacatgataggtctttagtagatgacaacaactattaataagaacaataaaaataataatatagtggccttacctcaagtttattaataaggtagaaacacaactcttttaattttactattaaatctttacagagggtttatacatacaaacatacataaaacctctaagttttacttaaagatatacctgtctctgatagatacatatggattctagagtttaaatagtcttgattattttattcctaaagctaacacagcttagaccagtatttctcaaaccaccttaaaaaaactcatatatatgtgtgtatcccataatcccatacatatgtgtatgtataaactcatatatatgtatatcccataatcacatatatacacacatgtattatatatcacatgtatataaacgtgtgtatatattacatgtgtacatatcacacgtataatacatgtgtacatatcacatgtgtgtatatcacatgtataatgcatgtgaatatatcacatgtgtatatatcacatgtatatatgtgtatgtatatatatcacatgtatatatacacacatgcatatgtacgtgtgtatctatgtgtatatatatacacacatatatgttattttattttacattcaggagtacatatgcaggtttgttatataggtaaattgcatgtcacaggggtttggcatacggattatttcatcacccaggtaataaacatagtactcgatcagtagttttcaatcctcacccccattctaccttccaccctcacataggttcccgtgtctgttgttcccttctttgtgtccatatgtactcaatagaaacacttatattaagtgacatgttaatgtatgttctggaagaacacaccaaaaaataactaaattaaattttttaaaattttgcaattaaatattcttttacaattcaatgtgtgtatatatatatatatatatatatatatatatatatgataaataccagacacatttatagagctcttatgatcataaaatctcttatttatgaaggtatttctcattcacaaatctcattataaagttaaagataaattacttgaaatattaagcaagtatatttaacttcttttatttatagacagtttgtcccgttcaatagctggtctgtgttatgtgacttaatttataattttatatggctttgtcatgtcattaaatgcttttattaaatatgaaaagaaaaatgctgctcatttctaacttcaaataaatttttggcatctgctttaatccaagagcccgtttcacctcatggtttcctgattgtgttccattgttgcattataattagaaaaattatacatgggcaactaaatttaaacaccttggattaaaagggaaaaattaagaagagattgtgttataggcataatgacggcagtaacattaagggacacttgaccgaaaggcaataattcaagctacagtactagcattcaataagatgttggttaaatacagtaccttgttaattttgacgtatgaattctacttcatgaacgaccattttattaaccatttcaattagctaacataattagaataattcaataccatgaacacattaatcaaaataggttcttcaataaacatgtctagactttaatacgtcaaccataaattacaatattattttattttagtcctctaacaccaaagggccatattaaataaaagagtatcaaattaaacttaaaagatgtattttattttgctcatttatcattcagatataatagatgggcttttggctttcaaaattatccttcacgtttttctcattttaaatgcatgtccttttttctttataaagatgtttgtctctttatttgtggaaagagctaaagaaactattactataccagaaagacacacacagttccacaatgtcagagtcagggttaaaactcagtaaagtgtcacttgtgcggatgaggttaagggtaaggatggactcactaaatcttactctattcagagtggctgagtcttcaaattctctcttcaggtaactaaattttattgcatgcttgttaagtggcagttattgttctaatagaaggccttttacgtatatgtacttaatcttcactaaaatctcatgagatagaaactctaaaactttaaaattattatttccattaacagatgtgaaattattatttccattaacagatgtgaaaattgtttatagtaatggtttaaaacaattcttaccacaaattcacattttcttttactcttcccagctacaagttagagttggattatctacattacgaagagaggaaagtgattgtaaaactagactttatttcattcagcaaaggaaattcattggcagggtgagactagtcgagtgagtatttcattgaggtggttaagaaaagaaaaaggtgtgaacaaatgataaaaggtggaataagcttgatgaccttggaaaggtgtcctattgattgttcaggtgacaaatcaggtcatgtattatgtggtagtcacagattatataatttggttcttgtcaattctgtaaataattcattgtgtaacctatgaaaaactctccaagcctcagtttcttataaaataagatatagatatggctttaaatttttttcaattctctaatttttgttatatctgaagttaggctatcaaagataaaccacagccaatcactttcttaagtgtctaatgcatattttgcacaatgctatgaggaggaaaagaagaaagagagaaagaaagaagaaagagaaagaaagaagaaagaggaggagagagagaggggaaagaagaagtggggaggaaaaatcatattcttcagtttataatttagttgtcagaacaagagcaaacacatgtttaaaattttgtgaacaattccttcatggcaacaaaaaagacatggtgattttaaaatttatatttgttctaatagtcttaaccaggataaatgaccagaaagagagtaatggctattgcagtatgtaaagaagactagagtaggagttggaagatttggaacaaatcccaattttgttgtatcatccttatttagtgaaaatgttaataattattaagcatctgtcatgaattaggtaccttgctaactaactactttatatattttaataatccacaattgtagtgtgccagagttggagccttcaagttttagtgattaattgaaaagcacaacttatttcttcttgtgctatggactttttaatgagtcctcatattcagaaagccgtagaagtcaagtgggtagttacttaatgttggctaggcagttgatttactgagtctgcaatagatgctaactttccctggttgattgggagaaaaagtcaatggaaagtaacaaagaaagcttcattacatttctttgctattcatacaagctttcagtgctagtgaatgttttgtgcaattgctcaaagtattatattatttgggagcatggaaaatgttttcgtgtttacttgttgttttcctcaagaaaatttccagagctaggtataactcacaaaatcttttttcagtcttataaagaatgagaacacttgttaaatgtgccaacctccctttagcagaaacagctccattaagccagtatatttggcactttctcaatgcacgatgtgtgtgtggggtgtgtgtgtgtgtgtgtgtgtgtgtgtgttttagtttatgaaaccaatttaaatgctgcattcctaaaaagctggctatgatcctcaattttacagagaagaaaagacgttttgaaatcgtttaatataccaccaaatctgaatgccaatgagctacaatttaccagtaacatacattctttattaatattaccttcttttgctttcagaaggcatgtagggagaaggccataattagaatatatgtatatatatttatttatatttatatatatatgtatatatatttgccaatctagaatttctaatctccatacactttggcaactattggggaactaaaagatgtatcatggaaaaacaaattaaaatgttaaattcaaggacacagtgctttgaataaaagcctcagataatgtgaacttgataagctcatcagatataaatgaaagatctggcataaatgatagatttcgtgacttgggggactaaagaagttttaaaatgcatctaatactaagcactcttttggagaattaatgtaaaaactaaatcattgacctgtagaaattaggtaataacacttactattattgcacattatcaatttatgagatgttacattgtagtcctaaacattgaggctgaaacaaatcttaaaagccctcattattactttactctttgggtagatattattactggaagtatcatagaatgtcagacctagaaaggagtaaggaatggaactaatcctcttatttacataggaggaacatgtaaaggcaatacagttgtgattgtctgaggtcatgtgatttttgtctgtgtacatgggacttttacttgctcctttaaaggaatctcaatagcttataaatgtcaaaaggaaaaaccaatcatctctttacattagcacattttatttcatttactgatattattaagccaaatatttatattttaataccctagtaatgatatttatattttttcaaggaatttttttacattgttgcataagattttcatcatactttatgagtgcaagcacttttactattatatgtgagtcttattaatgttaattatttagaaatagagatgacacaaagagctaggtaacaaaacaataaataaattcaacagtaaaacattttgaaatgcaaatattttaaataaaaatttttaatgaataaaagtatgcatgttcttgaaataaatacttttattaaaaactcatcggttacatttccaaaatataaatctgataccaactatcaattttagtttataggcagtgaacattaaagctggattaacatcatgctgattttgtttttcattttctttttaattgaaaataaagtgtgccaccagtcaaggtgaataatgtctatagatttttcacctgtgttttgtggctgaatttatttacacccacattaactgattagctcctgccatgcagttccatattcatcaattatttatgaaaatgcctcattgtatttgtcatatatgtatcagtttgaatgacaagatggctcttctaatatgctggtattttactatagttaaaataatgagaaactggtaatttttttttaatgccatgaagataaaggtgtttaagtcctgttaagcagaattaaccaaaataagagctttcccaggtaaacacttggttttgtattttacctaattatctaaattcaactgtatgacacgtcctaattgaataacgatggtaatttctgtgatagagatgaaaagcacataaacttgttctgaagttcgcttaccatcatagcatatagacacgtaaacaaataatttcgatatagcttgataatcattaaaacctaacacttcttatttagcactttgtgtgccaactctgtttttaatagtttttcctaatttactccttccaacaacctttaagagtgggttctattactctccatttcacagaggagaaaacagcagcacagaaagcatatataacttgcctaaggtcacataattagatacctgtggagctgatatttgaaatcaaacagcctgagactcagaacaaaacagcagagtgttcagttgtagcagagggatggtgctgaattacagctgggaaaaaaatgaataagaatgtgctagttaagggctgcacagtggtggaaggaaacagggcaggcatgagaggaaggatgagaacagatacagagcattctgggatgagataagagacttagtgagggcaaagagctatgagactgtggctgcgtgtaaggaactaagcaggttcttcttacctcagccatatttctcaaagtgagtctccagactgtctgaagaaataagtgcttggatacattttgaaaatacagattcctagactgtgatagacctactgagacagaatctctgcagtgaattcccaaatgagaattttaatagagcacgtcagattatttattatacatcaaaagtttcagaagcctgcgcaagattgtaaagttcaagatgagaagtgtcagaagatgcctttgacttgtcttctttctgattatgttatttcacataacataaaaaaccaatatttcaaaatacatactaaatgtaaacaaagattaaaagcacctgagtaaaataagcaatctaacagacaaaaataaaccattctttgtccagatccttacttcatttatcctgtaaggaaattatttaaaaaaaaacaattcttacctacttttattgagacactacatttcccccgcccacaatcatttcagttcactatttttgctatccgcataaacctttagtgagtctttcaaaagatatgaccaagtccaaccctcattcatttaacataatgattctgaatcctattggcaaatagtgacctgagatactttttaataaaaggcgtatgaaaggagaacaattgatttgcaggtatttttccctgtatctactatgcaaaagtcttttcaccctatactctcaggaatacatgtataagaagtgtaatatccatagggagcttgaaatccagaaaggatataagacaggcccacacacacaaaatgtaataaagttaaaccattgtaagagcttcaaagaggtgcagataatgcataggagttcagcaaaatgcaattattacttaactgttgaaatcattagggaagttttcatggaggattgggcatttgaacttggttgtaaatgatggatggacttgtgatattaaggttaccaaacaagagcattttcaaatgcttaggtggagagatcattatgaatgaaagctagaaagctttcatagtaattgtggttaaagggattcttggaaaacagattacagttttttatcttgagagggacttaagtaggggtgataagaattaaaagagaagttgttctcactctgaggatactgaatgcaagcctacagagtaaggaatgtagtcagtgctctgtgtgtgacattgaactcctttagcaaaggaggaaaatgaataaccaagtttcagagagaactgacatctaggtgtgaaaagaactagagaggagagagactgagttacaggaactcttaagataaaatcgagcagacaaggaatatgatgtttcaaatccaatctgtagtgcaatatagagatgggaacctgggaatgatagagttggcaaagcattccccatttacaaattgatcttttccatgcatttcgtcattctttctttctctagaaagtgaattgttaactttgtcaatttctatgatataaatgatccaactatggtcaattttaaactaccaatgtaatgtattgaacctgaatttgggacatgttggcaggaagttttcctctgttaactgaggtctgacttgttagaggcttgtgaattaaccgacaatagacaggttaataggaggaaagtttattacacatgaaaaactagccagtagtgaggaactagaggttacggtttgtaaaccaactcaacaagagttgattggataatttgactcatgcctgtaattccagcactttgggaggctgaagtgggaggatggcttgagactaggagtttgagaacagcctgggcaacatagtgggactccatctctacaaataaaaaaattaaccagggtggtggtgtgcacctgtagtcccagctactcaggagactgaggtgggaggatcgcttgagctcaagaggttgagggtgcagtgagccatgatcccaccactgcactccagccggggcgaaagactgagaccctatctcaaaacaacaacaataacaacatccaagaaggaaggaaagaaagggcagcttagacttcaatgcaaaagtgtggaaggtccttgctgggtaccttggctcatgtctgtaatcctagcacttcaggaagtcgaggcaggtgagtcacttgaggccaggagttcaagaccaggctggcgaacatggcaaaatcccgtctctactaaaaatataaaacattactccagcgtggtggtacacgcctgtaatcccagctactcagaaggtcggggcatgagaatctcttgaacctgggaggtgaaggttacagtgagtcaggatcaagcaatgttaatgggcagttgaatcaattgaatttatacttccctgtgctagggttagacttcccccaaacagaaagttctctcaagacaaggtccatggcagctatattgtgggggaggttctgcttaagtttagaaaatgtctctctgtcgttgctgactattcagaagttttcagtttaaagtaatttttgtaccactttggtaggctgttaatcccttcaggaaaaaatgtacaaagtacactcaaagagcactggcaaagcagcttctgccttctgctgtatgaatctgccataatctgtatgtttgtatccgttcaaaattcatacattgaaatctaatcatcaatgtgatgatggtaggatgtgggacctttgaggggtgattcagttatgaggttggagccctaataaattagattagtgcccttataaataaaccctacagagctgcttatttccttccaccatgtgagcgcatagctagcaggcaccgtctatgagccagaaaatgggcccttaccagatattgaatctgccagtgcaatctgcttatgtctcaatcttttttttttttaattatactttaagttctagggtacatgtgtacgacatgcaggtttgttacatatgtatacatgtgccatgttggtgtgctgcacccattaactcgtcatttacattaggtatatctcctaatgctatccctccccactcccctcaccccacaacaggccccggtgtgtaatgttccccttcctgtgtccaagtgttctcattgctcaattcccacctatgagtgagaacatgtggtgtgtttggttttttgtccttgtgacatttgctgagaatgatggtttccagcttcatccgtgtccctacaaaggacatgaactcatccttttttatggctgcatagtattccatggtatatatgtgccacattttcttaattcagtctatcattgatggacatttgggttggttccaagtctttgctattgtgaatagtgccgcaataaacatacgtgtgcatgtgtctttatagcagcatgatttataatcctttgggtatatacccagtaatggaatggctgggtcaaatggtgtttctagttctcgatccttgaggaattgccacactgtcttccacaatggttgaactagtttacagtcccaccaacagtgtaaaagtgttcctatttctccacatcctctccagcacctgttgtttcctgactttttaatgattgccattctaactggtgtgagatggtatctcactgtgattttgatttgcatttctctgatgaccagtgatgatgagcatttgttcatgtgtctgttggctgcataaatgtctgcttttgagacgtgactgttcatatccttgcccaatttttgatggggttgtttttttcttttaatttgtttgagttctttgtatattctggttattagccctttgtcagatgagtagactgcaaaaattttctcccattctgtaggttgcctgttcactctgatggtagtttcttttgctgtgcagaagctctttagtttagttagatcccatttgtcaattttggcttttgttgccattgcttttggtgttttagacatgaagtccttgcccatgcctatgtcctgaatggtattgcctaggttttcttctagggtttttatggttttaggtttaacattgaagtctttaatccatcttgaattaatttttgtagaaggtataaggaaatgatccagtttcaggtttctacatatggctagccagttttcccagcaccatttattaaacagggaatcctttccccatttcttgtttttgtcaggtttgtcaaagatcagatggttgtagatgtgtggtattatttctgagggctctgttctgttccattagtctggatctctgttgtggtatcagtaccatgttgttttgcttactgtagccttatagtatagtttgatatcaggtagcgtgatgcctccagctttgttcttttggcttaggattgtcttggcaatgtgggctctttttttggttccgtatgaactttaaattagttttttccaattctgtgaggaaagtcatttgtagcttgatggggatggcattgaatctataaattaccttgggcagtatggccattttcacgatattgattcttcctacccatgagcatggaatgttcttccgtttgtttatgtcctcttttacttcattgagaagtggtttgtagttttccttcacatcctttgtaagttggattcctaggtattttattctctttgaagcaattgtgaatgggagttcactcatgatttggctctctgtttgtctgttattggtgtgtaagaacgcttatgatttttgcacattgattttgtatcctgagactttgctgaagttgcttatcagcttaaggagattttgggttgagacgatggggttttctaaatatacaatcatgtcatctgtaaacagggacaatttgacttcttcttttcctaattgaatatgctttatttctttctcctgcttgattgccctggccagaacttccaacgctacattgaataggagcggtgagagagggcacacctgccttgtgccagttttcaaagggaatgcttccagtttttgcccattcagtatgatattggctgtgggtttgtcataaatagctcttattattttgagatatgtcccatcaatatctattttattgggagtttttagcatgaagggctgttgaattttgtcaaaggtcttttctgcatccattgagataatcgtggtttttgtctttggttctgtttatatgctggattacgtttattggttttcatatgtttaaccagccttgcatcccagggatgaagcccacttgatcatggtggataagctttttgatgtgctgctggattcagtttgccagtattttattgaggattttttcatcgatgttcatcagggatattggtctaaaattctctttttttgttttgtccctgccaggctttggtatcaggatgatgctggcctcagaaaatgagttagggaggattccctccttttctattgattggaatcatttcagaaggaatggtaccagctcctccttgtaccactgctagaattcggctgtgaatctgtctggtcccgtactttttttgattggtaggttattaattattgactcaatttcagagcctgttattagtctattaacggattcaacttattcctggtttagtcttgggagggtgtatgtgtccagtaatttatccatttcttctagattttctagttcatttgtgtagaggtgtttatagtattctctgatggtagtttgtatttctgtgggatcattggcaatatcacctttatcattttttattgcgtctatttgattcttctctcttttcttctttattagtcttgctagcagtctatcaattttgttgatcttttcaaaaaaccagctcctggattcattaattttttgaagggttttttatgcctctatcgccttcagttctgctctgatcttagttatttcttgccttctgctagcttttgaatgtgtttgctcttgcttctctagttgttttaattgtgatgttagggtgtcaattttagatctttcctgctttctcttatgggcatttagtgctataaatttccctctacacacagcttttagtgtgtcccacatattctattatgctgtgtctttgttctcattggtttcaaagaacaactttatttctgccttcatttcgttatgtacccagtagttgttcaggagcagattgttcagtttccatgtagttgagaagttttgagtgactttcttaatcctgagttctagttttattgcactgtgttctgagagacagtttgttataatttctgttcttttccatttgctgaggagtgctttacttccaactatgtggtcaattttggaataagtgcagtgtgtggctgagaataatgtatattctgttgatttggggtggagagttctgtagatgtctattaggtccgcttgatgtagagctgagttcaattcctggatatccttgttaactttctgtctcgttgatctgtctaatgttgacagtggggtgttaaagtctcccattattattgtgtgggagtctaagtctctttgtaggtctctaaggacttcctttatgaatctgggtgctcctgtattgggttcatatgtatttaggatagttagctcttcttgttgaattaatccctttaccattgtgtaatgtccttctttgtctcttttgatctttgttggtttaaagtctgttttatcagagactaggattgcaacccccacttttttttgttttccatttgcttggtagatattcctccatccctttattttgagtctatgtgtgtctctgcatgtgagatgggtctcctgaatacagcacactgatgggtctttactctttatccaatttgccattctgtgtctttcaattggagcatttagcccatttccatttaaggttagtattgttatgtgtgaatttgatcctgtctttatgatgttaggtgtttattttgctcatcagttgatgcagtttcttccaagcatcgatggtctttaccatttggcatgtttttgcagtggctggtaccggttgttcctttccatatttagtgcttccttcaggagctcttttagggcaggcctggtgatgacaaaatctctcagcatttgcttgtgtgtaaaggattttatttctccttcacttatgaagcttagtttggctggatatgaaattctgggttgaaaattcttttcttttagaatgttgaatattggcccctactctcttctggcatgtagagtttctgccgagatatcagctgttagtctgttgggcttccctttgtgggtaacccgacctttctctctggctgcccttaacattttttccttcatttcaactttggtgaatctgacaattatgtggcttgaagttgctcttctcgaggagtatctttgtggcgttctctgcatttcctgaatttgaatgttggcctgccttgctaggttggggaagttctcttggataatatcctgcagagtgttttccaagttggttccattctccccatcactttcaggtataccaatcagacctagatttggtcttttcacatagtcccatatttcttggaggctttgttcatttctttttgctctttattctttgaacttctcttctcacttcatttcattcatttgatctttaatcactgataccatttcttccagttgattgaattcgctactgaagcttgtgcatttgtcacgtagttctcatggcatggttttcagctccatcaggtcatataaggacttctctacactggttattcttgttagccattcatctaatcttttttcaaggtttttagcttcttttaatgggttcgaacttccttctgtagcttggagaagtttgatcatcttaagccttcttttctcaactcgtcaaagtcattctccatccagctttgttccactgctggtgaggagctgtgttcctttggagggagagaggtgctttgatttttagaattttcagcttttttgctctgttttttccccatctttgtggttttatctagctttggtctttgatgatcatgacataaagatggggttttggtgtggatgtccttgctgtttgttagttttccttctaacagtcaggaccctcagctgcaggtctgttggagtttgctggaagtccactccagaccctgtttgcctgggtatcagcaacagaggctgcagaacagcaaatattgctgaacagcaaatgttgctgtctgattgttcctgtggaagcttcatctcagagaggtacccggccatgtgagttgtcagtctccccctactgggggttgcctcccagttaggctattcgggggtcagggacccacttgaggaggcagtctgtccattctcagatctcaaattccatgctgggagaactactactctcttcaaaggtgtcagacagggacatttatgtctgcagaggtttctgctgccttttgtttggctatgcccggcccccagaggtggagtctacagaggcaggcaggcttccttgagctgtggtggtctccacccagtttgagcttcctggctgctttgtttacctactcaagcctcagcaatggtgggcgcccctcccccagtctcactgcctcctttgcagttggatctcaggctgctgtgctagcaatgagcgaggctccatggtcgtgggaccctccgagccaggctcagaatataatctcctggtgtgctgtttgctaagaccattggaaaatcacagtattagggtgggagtgacacaattttccaggtgccgtctgtcacagcttccctttgctaggaaagggaattccctgaccccttgcacttccggggtcaggcgatgccttgccctgcttcagcttacgcttgttggactgcacccactgtcctgcacccactgtctgacaagccccagtgagatgaacctggtacctcagttggaaatgcagaaatcgcccatcttctgggtcgctcatgttgggagctgtagactggagctgttcctattcagccatcttggaaccactccctatgtctcaatcttaaacttcccagcctccacaactgtgagaaataaatttccgttgtttaaaagttacctagtttatggtatcttgttgtaacaaccctaatggactaagactgaaaaccacctaaaaattgccctttcacatggtgaattaaattatttaaaaacaaacaaagtggcctggcatggtggctcacacctgtaatcccagcacttttggaggttaaggcgggaggatctcttaagccccaaagttgaagtctgcagtgagctgtgattgtgctgctgcactccagcctaggtgacagtgagaccctgtctctaaaaagtcaattaattaattaaaattaagattaaaacaaataaaaccacaacaaaagttaaagataatcttaatagcagagatttttgcaaaataggagagaggatgccttcagtaattaggattcagctgttagggctagagagattctggtgaatactacaggttttcttgagagcttgagagaatttggacaaggaaaaattacagaaaatgaagtaaaccgttgattatccccctaaagtttagaacatatgctatacagcaaaacaaaatttgcacattgtgtgtaaagttgaagtatattctttctgtttattctgctcattcccttatgtagtttttattgtaaattgattagcttgtcctgggtatgtttgccacaggatatgctaaaccatttgtcctttttgagagggtttgtgaaagaatgagtttgatgaagtcatgacttccaagtagcataagctcaatagtggatttttaaaagccatacccatcatgttatgaagcttagagaagaggcaggtgtccatcttattcctccttataatttcctaaccactgtcttttcctgctcccctcataatttttggcaggaagcccatgccatcagactgtatcacttgctacccctcttcattgtagtcttcatcccaaccccagcacactcttgtctattctttgaagattatagtcctcactcatgttcattatttccaatgttgcttctaaaatagtccatgtttagacacatagcttatctttgtctcaccttggattttagctccttgaactgttttttttttcaataatcttgttctcaatcctatctccgccagtgtagtcattcacagtgcacctctactgtgatgtccatttggaatttcaaacttaacttgaacaagctgaattactggactttacacttcaaatgtgtacatgtgtaccttttgccatcttccctatcccattaaattcctacagaatctgtttacccagacaacaccttggaaatcattctgccttctcttttctctcatagcccatatccaaactatgaggaaattctgtcatttctaccttaaaaaaaaaatatatatatatatatataatattcaaacagtttttactacttccactgctaaaaactttgtccaaacatccattatctctcaaactgttataatcactttggagtggtctttcagcttccacactcacccttctacagtgtctttgtaatggtgcatttgccatattttattcatcacaagtgcactgtgaaatccagcccacactcaaggatgacatgagagtgcaaatacaaggaggtagggatcatttgtgaacatgctagaagccacctacctcaggcagcacagctagttgtaacgagtaggcctcactctcagaatttaaagctggaagcatcctagcactctgtagcagatgcagaacacagctttcggtttacaagctgccaatattatcctacctactgaacttaaaaagccccagaatggaaagatactctttcctttcatttcagtgctctatcagccaaatctgtcaatgaaaaatggatctgtgtagttcaaggtcaaccagcagcagtttgcacctcctgaggctctgtgttttagctaaagctacctgtggtctttgtcttttctgatgttgttggacccagaggctttgctgagacacattcatctcacaagccatcatttcagtctcacaagactatataaaaatagcgtcatgcctgagggaaaagcctccataagcttcagacaaccttccaggttaaaccttcttatgatctgaggcttaatgttctcgctcagaccttagcagtaaaaagccaactgtacaactgctgagcagaacacacgttctctgcatgtgatcctgctagcaaaagaggaataagcagaaccaaaaacactgagttcattcaccccaaatttattagcaagaaaagtaatatttctttgctagggagaaaggctgggagtgtaacactagtagagcttctggtaccgggaatgaggaatgaggaataagtgttcctacccatcctcagaacttccaaatattttctttgttttataattttatgatgttttctttaatatgtaaaaaaatcaacatagtcacttaggtcagtctttgtctttattatttatttatgtttatgttcagagaagccctccttgttctattgtaactgaaaggtaatttttacttacattttcttcaagtggttcttgtgggctgatttatatttagtattttaatccagttatagtttactataatgcaatttaaggatctgattttttcccctaaaagttaacgaattggtaaatcacaacctattaaatatcctgatcaatttctctttgccagttgaagatatgatacatttagaaccctcaaactcctcaagtggtagtaaaaattaaggcattagctttggagggaaattgataatatatgtgaagctattcaattgtgtgcatagcctttaactgagactttataactctacaagtgcatttaaagaaatattcacatatctgtcttaagaatgtcatcacaacattatacagaaaaaatggaaatacaaaatatctaatgacaggattaatgaagttatttttatatgatggaaatttattcattccatataatgtaaacttaagaaaaatatttgatgtaagaaaaatcctgagaatatagctaggtgcaaagtttagatagaaattattatatacattaatgatgcattaatgattatattatgttttaaaatttttatctatttctcttcaacttttactttgagttcaggggtacatgtgcagggtgtgcaggtttgttataggtaaatgtgtgccatggtggtttgttgcacagagcatcccatcacctaggtattaagcccaggatccattagctattcttcctgatactctcttcccgctcaaaccccctccaacaggtcccagtgtgtgttgttttcccctatatgtccatgtgttctcatcatttaggtcccacttaaaagtgagaatatacagtatttggttttctgttccttcactagtttgctgaggataatggctttcaactccatccatgtccatgtaaagggcatgatcccgttcttttttatggctgcatagtatattatggtgtatatgtatcacattttctttattcagtctatcattgatgggcatttaggttgattccatgtctttgctattgtgaatagtgctgcagtgaacatatgcatgcatgtatctttataatagaatgatttatatttctttgggtatatacccagtaatgggattgctggttcaaattatatttctgcctctaggtctttgaggaattaccacattgtcttccacaatggtagaactaatttacacttccaccaacagtgtaaaaacattcctttttctctgcaaccttgccagcatctgttttttttttttttttgactttttaataaccattctgactggtgtgagatggtatctcatagtggttttgatttgcatttctctagtgatcagtgatgttgagcttttttgtttgtttgttggctgcatgtatgtcttcttttgagaagtgtctatgcaagtcctttgcctgctttttaatgggattgtttgttttcttcttgtaaatttgtttaagttccttctagactctggatattagacctttgtccctttgtcagatggatagattgcaaaaagtttctcccattctctaggttgtcacttcattctagtgatagttttttgttgttgttgttgttttttgttttgttttgttttttgctgtgcagcagttctttagtttaattacatctcattggtcaatttttgcttttgctgaaattgcttttggtatttttatcatgaaatctttgctcatgcctatgtcctgaatggtattgaccagattttcttctagagcttttatagttttgggttttatatgtaagtctttaattcctctggagttaatttttgtatatggtgtaaggaagaggtacagtttcaattttctgcatatggctagccagttctcccagcaccatttattaagtagggagtcctttccccattacttgtttttgtcagctttgttgaagatcagatagttgtacatgtgtgatcttatttttgagttctctcttctgcttcattggtctatgtgtctgttcttgtatcagtaccatgctgatttgattacttaagccttgtagtatgatttaaagtcaggtagcatgatgccttcagctttgttctttttgcttaggattgtcttggctatttatgctcttttttggttccattggaattataaactgtttttttcttgttctgcaaggaatgtcaacatggtttaatgggaatagcattgaatgtataaactacttttgggaagtatggtcattcagatgatactgattcttcttatccgtgagcatgaaaggtttatctatttctttgtgtcctctctgatttctttgagcagtgatttgtagttctccttgaagatatccttcacttcccttgttagctgtattcctaggaattttattctttttgtagcaattgtaaatgtgaattcattcatgatttggctccctgcttgcctgttgttagtatataggaatgctagtgatttttacacattgattttgtatcctgagactttgctgaaattgtgtattagcttaagaagctttagtgctgatatggttgggttttctagatatagtgtcatgttatctgtaagcaaagataatttgacttcctataatcctacttgaatatgctttatatctttctcttgcctgattgtcctggccagaacttccaatactgtgttgaataggagctgtgagagagggtatctttgtcttgtgccagttttcaagaggaatgcttccagcttttgcccatttagtatgatattggctgtggatttgtcatatgtggcttttattattttgaggtatgttcattcaatacttagtttattaagagtttttaaacatgaagagatgttgaattttattgaaggccttttctgcacctattgagataatcatgcggctttcacttttgttctgtttatgtgtcaaatgagaattactgatttgcttattttgaaccaaccatgcatcccagggatgcagccacttgatcatggtggataaacgttttgatgtcctgctggatttttttttttttgtcagtattttattgaggatctttgcattgatgtccatcaaggatactggcctgaagtttttttgttgttgtatctctgccaggtttggggatgatgctggcctcatagaatgaactagggagaagtagtcccttctttttaatttcttggtatagtttcaatagaaatggtaaaagcttttctttgtacctctggtagaattcagctgtgaatctgtctggtcatgggctttttttgtatttctgttgggtcagtggtaatatccccattgtttctgactgtggatatttgaatcttacttcttttctttattagtctagctagtggtctatctatgctattaatttttttcaaaaaagtagctcttggatttgttgatttttttgaagtgtttgtcacagtctgcttcagtgcagctctgattttggttatttcttgtcttccgctagttttgatatttatttgctcttggttctctagttcttttacttgtgatattaggtttttaacttgagatatttataactttttgatgtggacatttagggttacaaatttccttcttaacactgccttagctatgtcccagagattctggtatgttgtatccttgttctcattcatttcaaaggacttcttgatttcttccttaattttattatttacccgaaagtcattcaggagcaagtttctgaattttgatgtaattgtatagttttgagtgaatttcttagttttgatttctagtttgggctgtggttcaatagtttttttatgatttaaaatcttttgcatttgctgaggcgtgttttacttctaattttgtgatcaattttagagtatgtgtcatgtgacaatgagaagaatgtatacactgttgttttggggtggagagttctgtagatatccgtcaggtccacttaatccagagctgagttcaggtcctgaatatttttgttaattttctatctcggtgatctgcctaatattgttattggggcattaaagtctcccattattattgtgtgagagttgaagtctttttgtaggtctctaggaacttgctttatgaatctgggtgctcctgtattgagtgtatatatatttaggatagttagcacttcttgtcgaattgaactctttaccattatataatgtccttcgtctcttttttttttttttaatcattgttggtttaaattctgttttgtcagatagtaggattgcaacccctgcttttttcttttttccatttccttggtaaattttcctccatcccttaattttgagcctatgtttgtctttgcacatgagatggatcttttcaagaagcacaccgatgggtcttttttctttatctagcttgccattctgtgtcttttaattggggcatttagcccattgacattcaaggttaataccgttatgtgtgaatttgatcccgtcataatgatgctagctggttattttgcagacttgtttaggtggtagcttcttagtgtcactggtgtgtgtacttcagtgtgtttttgtagtggctggtaacagtttttcccttccctatcacgtgcttccttcaggagctcttgcaaggcaggcctggtagtgatgaattccctaagcatttgtttgtttgaaaatgatcttatttctctttcacttatgaaccttagtttggccagatataaaattctatgttggaaatttttttccttaaggatgctgaatattggcccccactctcttctggcttgtaggctttccactgagaggtccacttttagtctgatgggcttccctttctaggtgaactggcctttctctctggctgcccttaacctatttttttttatttcaatcttagagagtctgatggctatgtgtcttggggttaaacttcttgtgaagtatcttactggggttctctgcattttctgaatttgaatgttggcctgtcttgcttggttggggaagttcttctggatgatatcctggagtatgttttccagcttcattccattctccccatctttttcaggtgccccaatcagtcgtaggttcagtctctacataatcccatatttcttggaggttttgttcatttattttcattcttttttctttattcttgtcttcctgtcttatttcaaaaagatagtgttcaagctctgaaattctttcctatgcttgatctattctgctacctgtgattgaattgtgaagttcttgtgttgtgtttttcagctccatcagacatttctctctaagtccttctaagtctctttcagtcccagtatgagaacctggaaatttcagttgaaaacgttgaattcattcgccccttttcattcctctctgtgagtgccatggaccgcagctgcttctattcggccatcttggatcttttcctttcaaatctttaaatatctacttttaaatatctaaaaatatatattttatttgtgattgtctttgaatagttggaattttgttcctttttctatctatttattcgtttattcctttttctagtttgtacttttaatacttgcttgtctcccctaatgaacttaaggtaattggaggcaaagattttttcttattaagcacacattatagtatcttgttcattataggttctcaagactgtcagttaaatgtcgttaataaaactagaaaacaattctgactggttggacactgctgaacataccaagaatatttaataagataaatgaactgagggatatgaagattcaagtcatagaccaaaacataaagaggccttgccacaattggttcagatccccctacatagataaggggtcagagacagaatttctttccctgggaaaaattgtgggttaaaatagggactcagcctccaagtatctatatagcaccttgggggaatgctacaaggacttaaaggttcaaataaatatatgaactcctagaattttgacataaagttagaaactgcagttttctaaaatcgaagcaaacaagagcaagataaaaccaataagcttagttattgttgcagtaaccaataccactatcaataaaaataagctggttttaaaaatattactaataaaattaggtatttatcttctcaattacactgcagtgtatctggcatgaaatagttgtattttctatagtagatttttttgtaaataaatgagctagtatgaatggtagtcattgtggtgatgctctaacactgttcaaatgagaaagtgccctgattctgaatgatttatatttatttatatatttaccataacttgatgttagcatcttttgagaggatccagttattgcttcctacctttatatgaaacaaagaacctttaggtctgtagtgtggtttctgagtgattctgttcaccaaaagcaaagaactttataaatagattaccaataattcttatgctaagtttagtttccattattagttaatatgttggccagtatctgacaaagtacagttcattattcagttaattttgaatcatccccacaaaacctactcgtccctatgtgaattgatgtagtttaatttctgaaccttccaaactaaggaccaatttctgatttcttctgtgagattcactctgaagggatgagctgggttattgccttgccatagcctagtaatttgggttattctagggtttggtcacagctttgatttagctttcagttagtgactaaacactaaagcaagagattagtaattggaattgtatcacaagatcagagtagagctaagagcaaagctaagtcaacactgagacaatcatctcttgggatattatatctcccagctgtcttagattattgataccaggaggaaagaggatttaaaaagctgctttctgtcctctctgtgatttcaggagggtgaaccagagcttttgtttaccttcggatctgtactaaaagccttttcaagtagagaatatatggtgaggcagtgggaaaatactcactcttaagccttatgtggatgtgtatactggtagaatctctatgcaggacaattttgtaatattattcaaaattacatttgaatgtatctttcagcccagtaatttcacatctcaaaatatatcttataggtaaatttgcagaaaatataagattattcacttcagctctgtttgtaatgcaaaagagaatataacactagttaactacattataatatacccataaaatgtaatactatatagtattgatatacagtcataacaaatagtaggggaacccattatacataaatatatggtaaaacagcaagtttaataataatatatatattaccctatatgtataaaaataaataactgtatataaatatttgtgtatatttttctatttttaaccatataacatctgtagaaggttatataatacattgctaaaattggtggcctctggatggctggtcactagtggtaaaagaaagacattatttctggaaaaatatgttgtactttttgaattttggactatgtgaatatgttatccaaattaaaaatatgtacaaaaatttttaaaaagtagtaaatacttttatatccaggcatttttgtgataaagtcttatgatgttcccaattcaaaaatatataacctaagctccaaaaatgtagaaagtaataaactaacttgctattatataaatattgttaactttccagcctagaataaagtggtatcatggctgtctacttttgttagccaattctaaattttagattttataacttgaaacttctcaatcatagtgcttattcccatacagttatgtgctgtataattataatactgtatttttactataacttttctatgtttagatatggttggatacacaaataccattgtgtttcagttgcctacaatattcagtacagtaacatgctgtacagacttgtagcctgagagcaatacgctaaaccatattgcctagatgtgtagtagactaagctatctaggtttgtatacgtacactctgtaatgtttgcacagtgacaaaagcacctaacgatgcatttcttagaatttctcttcatcattaagcaacacatgtctatatgagacataatgcttacatattagacacactgttttgtgaaaattatttgtccatgtagagctggattatcaatataccaaagattcccttggaacttagtgtatttcttgccatttcctagattgactcagtgttggatttgctcctaaggatgttccatctacttggtgacttcagtcaattcagacagaaacacgttcttatgacctctggtgtgttagctgaatgagagcatctacttttcaaaattccaccacaattcccagatttgagctttgtttaaataatgcggcttctgtgccattttgtgactggcaggaaatgttgattaggccttgattatatgctcacatctattttaagggttttggaccagcagtattcaaagcaaatggattgaaagtttaggagaactcactccccaatggaaaaccagaatgttaacaagtgaaatgaactggatgctaggaaggcaaaaacagcagctataaactctaagaatatattataaagaaaaaagcttgcattttcacttggaggaaacaagaccagtaaaagatgtgaccggaatggaaaaggttgttgaaccagactaaagtacaaggggtagtccagatttagagattaaactcaatttcctatcgctcttgttttggtttactgctaaaacaacaaacactgaggcatggaatatgcaccacttagagaatgaagtagtggaatcagccttgttcctctgagaggagtgcctgtaattcagaagtcagcaccctggattggaggagtccaggcctcttggcttcttgccttttgcaggtataactagtgaaggacacacattagacactgaaaatctacccactaatatgtatgtgtgtttatatatatatatacacatatatatatatacacacatatatagtgtatatatatgtgtgtatatatatatatgtgtatatatatgagagatgtttttctgtgtcacaattaggtattctgtattccctttcttactaagttcttgggccaacagcaagcttaaccaggtcttaccaatgggaacaatcatggcaaaacttaaagtctaagagcagggaagtttaatgtgtactcaatactttttgaatggctgaataaatgactgaattttcacagaaagttgacacgtctaaaaaaagaaatatatttttaagaaaaataacccatttatactatagaaatcaaaattatcttatgtgctttatcagtgataacaccattattaaagcagcagtatactaaaccatgtgtatatattttctgtgtaattttacaactatgagaatacatcctaaaattagttaacacatttaaaagggggaaatttaattttattaggtctagaggatcattatagaatttaccctaatggcttaaaaaagttaaaatatttcacctacacttaaatctttttgtgtactcagaagatttcagcccaattgatcatgtttcacttcaagaaatccttataaataaactttaatcccataggacagatccattaattatgctttcaggggaggcataattaatggatctgtactatggaattatagcattcagtaaatattaataatgaaaactcattctaccaagcaccttaatagtacccaaacaaatagatcattttatatggctgaagctttccttcagcattcccatatggaacatgaaagtatgcaaaacaatttaacatcagcttttctgggagaacttaatagattaaagattctctgatggagagattttgcatctcaataaaatgatctgtcaaaatttactttgatgaaagttttaaaagctctgataaaaactcagaggctatgagtaaataactattatgtattataacaataaatagcctggttatattgctaatgaagaatttttaaaataaacttttaattggggaatagttttatatttacagaaaatatgcagagacagtacagacgagtcccataaactcctgagtttctcctactgttatcatccaacctcagcagagtacatttctcacaacttaaaaaaccatcattggtgcattactattaactcaactggtcaatgtatttggattttaacagttttccttaatgtcctttttgttattcccgagtcacattcaggatactttattacagggctcctcaacttcctggccacggaccactggtccgtggcctgttggaactgagccacactgcaggaggtgagcggagggcgagtgagctaagcttcagctgtgcttacagctgctccgcatcattgccattaccaactgagctccacctgcctttcagatcagctgcggcattagagacccttaggagcgctaaccctagtgtgaactgcgcatgcgaggtttgaatgctccttatgagattctaatgcctgatgctgtgtcacattctcccatccctcccaagatgggacatctagttgcaggaaaacaggatcagggctcctactgattccacattatggtgagttgtataattatttgattatatgttacaatgtagtaataatagaaataacgtgcacaataaatgtacttgaatcatccctaaatcatccccctcccactttgtggaaaaattgttttccatgaaaacggtccctcatgccaaaaaggttgaagaccattgctttattattgttgttcgccatgctttctcagtgaaagtttctcacacttttcttgttaagcactgattaggtttttgcagaacattcctcagtttagatttgtctgatatttttctcatgattagactgtggccattggtttgagggtagaagaccatagatgtgaaggatccctctcttcacattatacaacgttcatgctgtctacataatgctacccttgatcacttggttgaggtagtgtgtgctgggtttctccactgtaaagttacattttccttttttcatacattacactttggaagaaagtcattcagtgtagcctgagggtgggaatagggtgttaagtttcatctcttgaagagaactagctaaatgaattatttggaattcttctgaaaaaggatttgtctcgtctatttatttgttgatttggaatttttctgaaaaaaatgggtctcttctcccgatttatttgctcattcttttaatactttgagttatactctgtagtatgttttttatgttgttgttcgaattgttccagctttggcatttgggagttctttcgtgttgagttctttgttctttgtctctttggcatacccctgttcttttgttttttgagtacttccttgctttatggtaccacaggatgctccagaatcatcttgtgcctcttgtaaatttcttgtcccattctggacttggaattagccatttctcctaggagccctggtttgttttttagaaaaaaaaaattaaaaaaaaacacaagacctaggcactgggtgttagtaaggatattttatttaataaaattaccacattttccacagaatcagaagaaaaacataagacttatacaataaaatatttataatacttgtaaaagattctttcattttcatggattaaaaattaactccctaacttatgaatcagttaactgtatttcaaaaataaatttaaattttaaattttatattttgtttgtttgtttttgcatttgcaagatttaatagagtgaaaacggagctcccatacaaagggaggggatccaaagagggtaacctaaattttatattgttagatacacacggctgacttggaaattgtatatacagaacattgacagtactaagtgacaaatagtttgtgaatcaattgagagttcttcctttcttcatatcaaaatgaagaagataatactatgtttcccaatgctattaaaatgagtacatgtttgtatttatcaataataaatataatagtagcagttatgagaagatgtaacactcaaaatatcaactttattttctgattattaatagtgcctcttattcttcaatttctctgcttttttagtgacagaatattgagtgaggaatgaaatcgcttgtcaattaaggaaattgtcttctaaaaacaacagcaataaagaaatgaaagagttttttaataattaggcaagtagaaaggattctagagagcaatattcataaaaagaaggtgatattaaccagaatatttataatatgctcagtaaattcttgtctagattttattattgaacctaaggatgacacttaggagaaaaatgaaagagaacatagtctacattaaatagaaatagaaagggagaggtgaccaatttgtgcaaaataacattttaatggtaggtaaaatgttaggttcatattatttatctgtgctagtgtttgaaagaagcagtttgtctgttggacttacaaccaaaaaccaggttaagaacacttgttagaataggcttcttatgacaggaatgtctattgtgtctccaatggattaaaaaaaaattcatgagaattaaggagatttattctgttgagatatttgctgcttttagaaaatagctcttctatgttcccataggattcactttcacattattatgaaccaatcacttgtaaaatctctgaaatatatcaaaagcagatgaagccataattctgacagaacattttatgaagaaagttgtggattaacaaaaaccattagcttttaaaaacatcaaatgtaacttaagtattttatttagatattaaattgtatcagtattgctattgttgaatgaaagagtaaatggattaaaatatgaaatatggataagacttatcttcaaaaggtttacgatactatttgatctaaaagaataagcaaattggaatgatacctaaattacagatcactgaaaagcaaatgggaaaacaataggataaacatgaaaatatgtatttctcaacttgataactaagtacagtttatcagctgttgtcatacgagattgatttgtttttttaaaatatttatctcaatatttcctcagaacagtaaaattaaggtgtcacactttaagattgatttgaaaattatagctagaacacaattttctcttagaatgacattcaaagaatcagtgttacataatgtaaaatttggagtctgctttttactaccctttgatttatatgttaatttctggaaagttgtgggagacctcaatctttaaagtttaccatgaaccttgactttgcactcctcatgttcttataaaaattaaaccttcattggaaagactgtgatccaggcttttcaatttttacaaatgaatgtcatctatgtctcctaaatatatagtttttgagggtatgatactttaataagctatgcaggctgtccatactacaggtaaatatcgaataattcaactatgaacgaactgtgttctgtcacttgcttaaattcttgtgagaaatccaactttaagagatttagctcaagagtctttttttctgtgtttttcagcataaagcttcattcatgtcttacgttaacatcctgaggtaaattagttagcaataccagccttgtttctctattatgtcatataatcagagagcgagagtcagcaattcataatatttcctggattgatcaaataaatggcatagaactccggataaattttgaaattaaagtcaataactaactcacttcaattatctggtgcatgtattttcctacttcctttagtagattattgttcaatttttacctaatttccttctttagatatttttactcaatgcactgccttatatcaatttccaaaataggtgtggtatgtgttaaattaacattatgctgaatatcttggttcctgtgtttatagttcttatccttggtttctggactagggagtcataagtagtcccaacttaatggatatttaaaatatgtccagtttattgtacatttgaatacagtgaattgaaaataatccttgaatagaaagtctctaagaataagtagcggttgtagcacctatgctttgaatgcgttcttttgttgaaacttaagtgagtcaaacttgcctacttatatccttatctcacttgaggtgaattcattctttggttttaatcttcactgcaaaatttctgtgtgtttgcacatatatttagaaaccaagctgaaaatgtaggtatatattcttttcaatgttttcttttgttttatttgcatatgggagaatccctctgagagactgtgttaagaatataataaaatgacttctgttgctacctactattagtatatttttcttgcttttagaaaagtaaattaatgatgaacttctaactgatatatctttcttaggctaatctctcattaaagacgttttaattgattttatttttaaaagactagataaacagccattagcaacattccaggcattctcttacatttgtgtaaatcttttatccttaaatttttgtttagcagaataaaagaaaggtaaaatgtcaggggctatgaatttaggaatttaaaaaatttaatattttttcagtttgtaattgtatattatggcagattggtttacataatgaaaaaaatggttgcaatgatttaaatctttatagaagaaaaactgtaatacacgtttgaaaatcagtctgaaatacattgaaatagcaacataatgaattattacagatacagtttaatttaaaaaaggtaaaatataaattaagcaatgatgataataaataccaccctaacacaaaaaatggccattatatttgataaaatgcacttaaaatatacatggagagtgataatttgactaatttcccagataatcatttctgtataaggaatgatttattatataattatgattaaatctacgttaaatctgattttttacattcatattttacttattatttgtttattttaatgatttatttatttttctaaattatgaatagtcaaaatgactacaaaacaatcctaattaaattcaatttcactgtccttgcagagtgcagacatgagtccagcaagcagtaccacgtcacttcctgttagtcctcttactgaagagccagtgcctttcaaggtaaaaaacaaacaagaaagcattatttataaaaatattaggatagttaataaatagtttaaaatagtttatgtgtagatggtgaagtgaactgctttaatcttcaagggtctgatttcaaatcttaaaatcgtttttttgtgtgttccattgtcattctattgctaactaaaggtaaaggtttgaatgataattaatactttatgggacaattgtttgtcttacatgtaaatggtggagttttattgtaataggttgattcacatgaattagaggttttaaatattttgtttatagtaattatattaatataagtcataggggaaaaaggaaacattcagccctcatctagtggttaaattttcattagcaatgctaggttaccaataattaatgatgtaatccttttaaaataagagtcaaaatcaagagttgaaatatggaatcattccaccaaacatattgtatttaataaatattggagtaaatatgcaaataagtatgtggtatgactggtggcatttttttcactttgggaagctatatacataacaaatacgaagtcttgttttgccacttaagattagatgtttctatttaagccaaagcttgtagatcaactattttatgtttgtactggggtatttagatattattaggattattataaataaaaacaattcttaagagcctgaggaaaaaaacttaaaacgttgggatgatgtacttaagtgcactgatttcagtatagtttggtttaaagacgtgcacattttaagattatcacttttatgactgcaatattttaacatacaattattatgagagttttttatttttcatataaggaatgtatcttattcaattttatattgcttatacctagtacagttgctggcatggattttcatatattcaatattgctgtcttgttgaaatgataattatagaaggctatgaattcaaatgagagtatttagttttctaattatggacacttttttgcttaatgagagtcaaatatttgttagaaggccctttctatacctgctaattgttaaatactgaatgatattctgattacattatttattgaaacattttctttattattatacagataaatgagaaaataatactaatgctacaaagtttgatgttaccgttttatggtatatggaacaaatttactgaagaagcatatctttaacaagattttaattgaattctcaaaacttcgccagaaaccattttttctttttaatattttgacaatgattacagtctttgaaaattaatgtattttttaacagaggttaaaaaaggttagacatatttcagaatctgctgacataaagctaatataaatataattagtttctctaactggttctgagagatcaatagttttggggtaaatgtaaatggttctataagaaattaaaactttcaagtgcttataatatttagtattgtcttttgatggccaacatagttatagtgacttttaatttactccttttgtgaaaggaatattgcctatatcttttcaaaatatttaatcacctataaaattatcccactagtgtttataagtatctaaacttaaaaatcaaaattatgaaataaaactttatctgcttctttcatttttagcttataaattgtcattgtgtaaatgagtaatataatacttaatgttacataaacacaaaatatacagaactattttgaacagaatcttaacagtataaagcattgtaattccaaggatatgttgagaattatataacaaatagaagacatttaagttttcttataaccacattctgaaaaagtctaatattataattcagatgtataaaactttgattaaaattatgatatctgaatagctaggtaactagaaaataaaaggttgtctttttcacctattccccatgaatgtgacatgatatttcatgttagtattagattaatcctcttaacctcttagcttacttttctaagatacagtgatttcagcactcaaccccatcacaatccaccctaacattagaagagcaaagcttcttctaatattggtgggtgattgagggatttgattttcctttttcttctgggaagtaattagattactagaagaaatgtatttactccactttcttagtcagttttggaagcactcagaacagttggaggaagataccttgttttggctggtatgtttatcaaggtgcatacttttttttaagcattacctttagaatgacattcagattaagttgaattcaaccacatcatttgaaataaagacaaatggtaaattatttttataaaaaataaatacaaatactttcccactaatacccatgcctttattcttgaatgttagataagaaattggctattgttaggaatgtaccatagtaagatatattaaattaagtatggaaaaaaagatggcatcctagggactatcccaaggtaggttaaactttagagatacatgaatttaaaatggcagttcagtcttgtttgggatcaaatgtttattttttccaatatggcagcatttttcaactttgttagtattggagcccattctttcaattaattaaaaacgatctgccctgaaagatagtctaagccccacatacatactcacttctctattcccccacactatggttcagttcctgctaatctcaaatttactgtttaaaaaccattgctagagtggtttgattggtgtagctagcctttcaaaactgaggacatttcacacaaaaattcatccaactttgtcttaaacaattgaaaaatctggaaactttgtggatctcgttgtaagtagaactacttgataagagatgagaaggctttctccatctagacagggtacataaactccaggtcaccacagtcatcaccattcctactatattcatgccaggtgatgaatgcatttgactgtattctttcatagaagatagtgtataattcacaatcttccacatatactacacataataaactccagatttcctgggcagcctcttgatactgaggagtttctaggatgcttggttcaaaaagtttcttttataagaactgtcagattcttttacctttataaactattgttatgggcatctatttggaaacaaaaggcaaatgtataacctctagtttttgttgttttttaatagaatattcagcattatatcaactgtacacacatatggtctgacacatgccactgcatcattatagaagagccaaaggataaccaattttgcataggtaggaacaaaatgttatcaaacatcaacaacagaatcataaaagttcaagatcattaaagtgaaacattgctctgataaaagacagtggattgcttagccattaagttttttatagttttctgaggactaaacctgaacaaaattgatgttgttaattttaatgtgctcattctatccttttctatcttttccctctggcattctccctgatttcttgcaaacatctaatcacttcctatctcatctgcctgacatctccctttgttagccttggtaaaatgctccacactgaagatggcttcaagccactacatttcactgttctttagtaggatgaccctttcaatgttttgtacatatgcagttattagcagcctcagtccattcctggaactaacactcttgaagctaaagctggctcgttgctcctgaccctccataaaagtacaatttatcatgagccatgttctttttgctagtaatgttcatcagttttaaaatttatttgtacttcaatgaagcatgatggctacattttagtctcttttcctacttaagtaatattttttgattagatatgttaggaaatcatattatcctactgtactgtattatatttatcctgtgataaattcagcaggaaaaaaaaacttctattctattgttctttgaacttctgaagacttttgtagcttcaaaagtacacaaaggcattgaggaataccctccattcaccaatccttgatcaaaatttaaaacaaacctaattcattgcatttcttggcccattgactactgcttccctgggatgtttgcattcctggaatgcctagagggattgtcacagtacctggaatgcacaatggcaccaccctctccaaggtatggccacattcccaaggaactgacagtgtggcatttggttctttcctaggtctcttcttcttatgaaatccaaggttctctgacttcttttcctcatccctagttatttctctttagtctaaagaaactccaagcttctctcagagatgtttcttctctccttaaatcagccagggcactgataaaacaatatcaagaataagaacaagaaaaaactctttgatgtactttttaggaatagaattgtgtctgaagattcttctgccgtgacatgaacttaactttaatatgcacagagccactttgcttaagcaggggatagaagggaggaagtagataaataaattgtttcaaaaaatttttttgtaggctgggtgtagtggctcacccctctaattccagcactttgggaagctgaggcaggaggttcgcttgagctcaggaatttgagcccaaccttagcaatatagggagaccccctccctattatttaaaaacatatattctaccatgaaatactggtatgttaagcaataaaaatgatgcttaactttacgtgaccatagagcctggattcaggaattagtaatgtgtagtaacacacagtttgctccctattgtataaaatgaagtgtgtagaaaaaaagatgcagtaaatatagaattatcaatcttcaactctggggatggatcacactattttaagaaaaattttctgtagtttctataatgaccacttatttctatttttaaaacaatgtttatttttaataaagcagaaaagagaattgggggcattagaagcaatgcagtctaattaggaggctgtctgggaggatcaaaccccagttttgccactctctagctatgtgagaccttgagccagttattttgtgtccaaatatcttatttataaaatgacaacagcaactacttcttcattaggttcttataaggttaaacaagttaataaatgaaaagtgtctacaatagcacatagtaacccatatgtaactgttgattattatttttatagatgcaagatctccaagttcaatgcaagaaagtcttataaatactgtagggcagaaattttgccactgaactcctactactttattttcaaatatgaaagaaatatattttaaacataaattatttactttgatgaagattcaagtttaacatttattcctacaagtcatgctatttattttatacgcttgagtattcagttgagctcatatatcagattcctcttatgaaaaatgattaatggaaatgtttattaattttgagaaggagtaaatataatgaatttgtcttgagggaaaactggtaaatataatgaaacactacttggaaaaaatacataatagtttctgtaacaataagaacatatatatattggccgggcgcagtggctcacgcctgtaatcccagcactttgggaggctgaggcggttggatcacaaggtcaggggatcgagaccattctggctaacagggtgaaatcccgtctctactaaaaatacaaaaaaattagcctggcgtggttgtgggctcctgtagtcccagctactggggaggctgaggcaggagaatggcgtgaacccaggaggtggagcttgcagtgagcggagatagcaccactgcactccagcctgggctacagaccgagactccatctcaaaaaataaataaaaataaaataaaataaaataacaaaagaacatatagtatctttttatcaggcatacaccatagcaactttttcttttgttatccaaaccaccacagtaacgtaacctggtaacctcctaaaagcataccttccagtgaaggaatattatttaaccactttagaatactggggaaacacccattgtgaacaaagtgctgctgctgttttacttgtttatatattataacatcaacatagtgagtagtttcgatttatttcatctaaatatatcattatgtaaaagaatacatttggaaactctgaaagacagaagccaaattgtggcatgaccttcacaacatcatctgttgtgtatcctgcatagactcatttttgtgtgtgtatgagagagtttttattgttccttttcatttattgaatgtaatggtctctcttagtattagaaatcgcttttttaatgtatccctggaagagcccattatggtatatttctgcatttctggtcattttttactaagccatctatgcattcaaggatttgttgatgaatcaatttgtcaagtacctaccatgttcttagtaatattctaaggcattggtatgtcgatgtcaacaacacgaactaaatccctgcattaatggtgtttgggttcttgggagaagaaatagacaaccagcaaataaatatataaaatgtcaggtagggtgataaatgttatgatgaaaagtaaagcgcaatatgaaggatagaaagtggcactggagtgtgttggtgtttcaaaaaggatggctaaggaagaccactttgattatggaacattttagtagagaccataatgaagaaagggagaaagccactcatgtttttatgggaagaaacctgagaataacaactgcaaaagcaagagaatactcggtcttatcaggaatggcaaaacattgtgtttggagtagaatgaatgatgagacaagtaatacaagtttaggtcacagagaaatcttatcataaaaggtctagtatgtcatgataaagacttaagatcttatttcacatatgatgaaaagccattagagtgtttgttgaaaaaaagaatgacataatcagactattgttaaactattgctttggtttctgtgtagatataggcattactgagtcaaggctcctatagttgaaagattatgatggcttaaactggagtggtaaaagttgaggggataacaattgattgaatattgagtacattttgaatgtggggtcagcaggatttgttaatatattgtatgtagaatatcctaaaagaacaaaatcaaagatagtttctgatactaattttttaatgttttcctatttttaccctttaggtaactttctgatgttacaaatagatagcatgatacggagattagtaaaatcttatttgtttggttggcttaattgtgttagtagtgaggcagtaattgtgaaatggcagacgatgttggttttgcaggggataatattcaatcctacaagtaatactaatttctggtaatatattttatctgccagataactgaaagcacataggtaaaactaaacataatttgtggtggatgctgataaatcaataattatggtttagaaatatgattcattaatacataggtgaagaaataagcaggtaaaaataaaattctttgagggatagctgatgaattttgaatataaaccatacaataggtatatatttgaggaaccaatgtattttataaaaatcattttaaataaacatggcatcattgtggttctctaatgggaataaattttaagagggttctattatttatactatgtatatttaaagcaattatttttgattgatgtaatacaaaatgatagtttcactcatataattccaagtaataaaccatctcaaaacctgtcagtctaaaataataatttattattgatgtttatgattctgtaggtcgactagactcatctgggcagttcttgtgtgaggttttaaagtgggtacagtcagactgaggttgagaatggggtcatctgaaggctcaggtgaggtagactcccaggataattcctttattcacaagtctggtgttgcactgaaaacactgtacctattgggatttctctctctctctctctctctctctctctctctcactgctctattctacttctgcctccctctttctctcctcagcctctccatggactagcttgagctttctcacaacatgctggttttggataattagacttgttatatgatagttggcttcccctagggtgaatgttccacaggaaaagaaagggaaacatgtcagtctaattaggactagaccagaaatacacagcttcacctccacattgttctattgatttagcagttccagagtgtgtcgacagtccctaagactacccctacattcagagatttgtaagaagacacagaattcaacagagatcacactcgcctctaccagcaatgtgaacagaggacatgtatgtgatatttctgcccagtaaaggccagtagcaactcagcaccaaaggattttactgggggcttatcatgtaggaaccctgtacctagtgtatatccatattctaaactcccagaagaaatcaggtatttaacataaacattattgtacaaatattgtttgtacaaactacttagggacagtgagccaatcttatcatttatggaaatctttatatgtatgtaggactctggttaccagtcagtcaagttcttagataccaaccagtggctaatcttgcaagtgggcctttctaagcactatatattaatttgttctctatctccatcagtttaattattgtaatatttagctcccataaataagaacatgtgtaattttcttactttccttggcatatttcacttaccataatgacttccagctccatccctgttgttacaaatgatagcatctaattcttttttatggctgaatagtgttcattgtgtatatgtatcacattttcttaatccattcatctgttgatagtcacttggattatttgcaaatcttgactgctacgaatagtgctacagtaaacatgggagtgcagatatctcttcaatacactaatttcccttcttttgggaatatatctagcagtgggattgctggatcaaatggtacatctatttttagtttcgtgaggaacctccaagttgtactgcatagtaattgtacaaatttacattcccaccaacattgtatgaaggttcccttctcttcacatcctccaaagcatttgttattttgcctgccttttggataaacatcattttaacaaggatgagatgatatctctttgtagttttgatttgcatttctctgatgattagtgatgttgagcaccttttgatatatgtgtttcccatttgtatatattctttagataaatgtctattcagatgttttggccatttttaaattgcattgttaattttttgtcctatagagttgtttgagctccttatatattcttatgttaatcccttgttcagtgggtggttttcaaacattttctcccgttctgtgagtttctcttcactttattgtttcctttgttgtgcaaaagctttttaacttgatatgatcccatctatccaattttgctttggttgactgtggtttagggatattaagaaatccttgtctactccatggtcctggagagtttccctagtgttttcttttagtaatttgatagttacgtcttatatttaagtctctaatccattttgacttgatattttgtatatgatcagagataggggtctagtttcattcttctgcatatggatatctaggttttctggcatcatttattaaagagattttcctttccccgatgcatgtctaggcacttttgtcaaaaatgagttttctgtatatgtatagatttgtttctgggttctctattctgtcccattggtctgtgtgtctgtttttatgctagtaccctgctgtcttgtgtactatagctctgtaatatgatttcaagtcaggtaatgtgattcctccaattttgttctttttgctcaggatagctttggctattctgggtcttttgtgattccaaatttataaattttaggattgtttttaatatttttgtgaaaaacgtcaatttaatctatagattgctatttttatttttatttttattaatttaatttaattaattaatttatttattttgagatggaatctcgctttgtcgcccaggctggagtgaagtggtgcaatctccggtcactgcaagctctgcctcctgggttcttgccattctcctgcctctgcctctcaagtagctgggactacaggctcccaccaccacgcccggctaattttttgtatttttagtagagacggggtttcactgcgttagccaggatggtctcgatctcctgacctcgtgatctgcccgccttggcctccctaatctgtagatttctttggatagtatggacattttaacaatattgattcttccaatttatgaatctagaatatcttttcatttttgtatcctcttcaatttattttatcagtgttttatggttttcattgtagagagctttcatttatttggttaactcctaggtatttatttttgtttatagctattgtaaattggattactttcttgatattgcaattttcacaattttcaaatagattccgttgggatatagaaatgttaatgatttttgtatgttgatattgtatcctgcaactttactgaatttgtttttcaattctaataatttttttggtggagtctttaggtttttccacatataaggtcatatgacctgcaaacaagtataatgtggtttcttcctttccagtttggatggcttttatttctttcccttttctgattgctctagctaggacttccagcactatattgaataacagtggtgaaagggcatccttgttttgttccaaatcttagacgaaagactttcagattttccccatttagcataagctgtgggtctgtcatatatggcttatatggcttttattgttttgaggtatgtttcttctatactcagttttttagggtttttatcatgaaagagtgtggaattttatcaaatgctttttcagcatctattaaaataattatatgtttattgcccttcattctgttgacatggcatgtcatattaattgatttttgtatgttaaaccaggcttgtatctgtagaatgaattctacctggtcatgacgaatgatctttttaatgggttgttgaatgcagtttgctagtgtgttgttgagtatatttgcatcaatgttcatgagggatattgtcctgtagttttctgttttggatgggtctttgtttagttttggtatcaaggtaatattggcctcatagaatgactttggaagtattttctcctcttccacttttcagaatagcttgaggaggattgatactagttcttcaaatgtttgctaaaattcagcagtgaagccactgggtcctgggcttttctttgcttggagatgttttattacagcttcaacttcattacttattattggtctgttcagattttacatttcttcatggttcagtcttgatagattttatgtgtctcaaaatttatccatttcttctacattttctaatttattggcacatagttgctcatggtaactttaaatttatgtagtatcagttataatgtctcctttttcatctctgattttattggtatgggctttctctctgttttcttagtctggctaaaggtttattgatctgtattatttattttactaattttggttttgattgttcttttctagttctttaaaatgcattgttaggttgtttatttgaagtgtttctacttttttgaaataggtgcttataactataaatttccctcttagaaatgctttcactatagctcataggtttgggtatgttgtgttttcatgttcattggtttcaagcaatttttaaatttttttcttattttaatcattgagccactgatcactcagaagcatattgtttaattccatgaatttgtacagtttccaaaattcattgtgttgttgatttttcattttattctattgtggtcaaagaagataattgatataatctcatttaaacaaaattgtaagacttgttctgtggcctaacatatggtctatccttgagagttattcatgtgctgaggagaataatgtgtattctgaagcctttggatgaaaaatgttctgtaaatatctgttaggtccatttggcctgttgtccagattaagtccaatgtttctttgttgattttctgtctggatgatctgtccaatgctgaatgtggggtgttgaagtccccaagtattattgtattggagtcaatctctctctttagctctaataatatttactttataaatctgggtgctcttgtgttgggtgtgtatatatttacaatattgtatcctcttgctgaattgacctctttatcattatataatgaccttctttgtgtctttctatattttttgtcttgaaatctaccttttctgatataagtatagctagtcctgctcttgtttccatttgcaaggaatatctttttccatccctttattttcagtctatatttgtttttacaggtgaaatgtgtttcttgtaggaaacagattattaggtcattttttttatccattcagccactctatgactttcaattggagagtttatttcatttacattcaatgatattattaataagtaaggacttactcctacttactcctattttgttttctggttgttttttccttctttcctcccttgctattttcttttgtgtgaaggtaattttctctggtggtatgttctgatttcttgctttttatttttctttatctgctgtgggttttttgatatgaggttatcatgagatttgcaagtaacaacttataacccatttttttaaaaaataggtttaaaatgcaatgacaacatggattgcatgaacaaacaaacaagtacagagaaaactattaaaaaccctacactttaacttcatcctccaactttttaactttttactgtttgcatttatatcttatactaactatgtcttgaaaagttgttctagctattatttttgttacattcatcttttagtttttctacccaagttatgagtttatgtaccatagttacggtgttataatattctgtggttttctgtgtacttactattgccagtgagttttgtaacttcaagtgatttcttattgctcattaacatccttttctttcagattgaagaattctctttctttagcatttcttgtaggacaggtttggtgttaacaaaatccctcgtcttttgtttgactgagaacatctttatttctcctttatatatgaggatatctttgctggataaactattctaggatataggttttattccttcagcactctaaatatgtaatgccattatttcctggcctgtaaggtttccactgaaaaggctgctgccatatgaataggagctccattgtatgttgttcctttcttcttgctgctttttaggatcctttctttatccttgtccttttttagtttaattattaaatgtcttgagatagtcttctttgggttaaacctgcttggtgttctataaattttaggtacttaaatatttatatctttgtctaggtttgggaagtactatgttattgtccataccttaatttgtctctctacttcttctttaaggccaataatgcttagatttgccccatttagactattttctagattttgtaggtgtgcttcattctttttactttttatctcccctgactatgtattttcaaatagcctgtcttcaggcttattacttttttattctccttgatcagttcttctgagactctgatctgttcttcagtatttcaattgtatttttcagctctagaatttctgcttgattctttttaattatttccatctatttgttaaatttatgtgataggttctgattcctttccctttgttatcttgaatttcattgagtttccacaaaataactattttgaattctctgtttgaaagatcacatatctctgtttctcttcagcattggccactggagccatatttagtttctttggtgaggtcatgttttcctagatggtcttgatgcttgtggatattcatcagggtctggtgtctgggtattgaagagttaggtatttattgtagtctttgcagtctgggcttgtttttgaacccatccttcttaggaaggctttccaggtattcaaagggactttggtgctgtgatctaagtctttggtcactgcagccatatctgcattagaggacaccccaagctgagtaatgctgtcatcttgcagactcataggggtactgccttggttcttggctagggtcaggcgaatttttttttgctttaccatacagagattcttgttgttttctcttactttcccccaaacatagtctctcccactattttgggttgtcaagagctggggaagtgtgatacaagcacccctgttgccacctcactgggaccaagttgcattcaacccaaagccaacacagcactgtgtcttcccaaggcccactgtgacctcccaaggcccactatgaccaatgcctggctatcacctgtgttcactcaagaccaaaggctctacaatcagcatttggtgaatccagccaggcttgttttcttcccttcacggcactgagtttctctctccctgtagccaacactaccccaggcctagggtgagcaatgcctggctgctgtcgatgttcactcaaggccctgtgctctttcatcagcttatggtgaatgctcttgtcctgagtctctcctttcagagaagtgggctcctgtctggcccagggcaggtccagaaatgccatccaggagccagtgcctggaattcaggaccccaggagcttgtttgttgctcttccccactatggtggaactggtacaagcttcagtaaaaagtcccattttttccttcctctcttcttctaagcaggagactctacccatagccaccacagctgtgaatgtgctgggtcacacctgaagccagcatagctctgagtctcactcaaggcaagtggcaagtactgcctgcctgctactgctcattatttagagcccaagggctgtttagtcagcaggttatgcatcctgccaggactgggtccttccctttagggcagtgggttccctttggcccatggtatatctggagttgtcatccaggagctaggacctgaaaggggggcctcaggtctctgcctgttgccctattctattgtggctgttccaatacccaagttggaagacaaactcctctttactttccccctcctctccttaagcagagagaagtctctcccagagctgcaagctgtgctacctggagttgggggaggggtgatgcagaaactcccttggctgccccagcttgtgtctcattgggtcatgtgcatcttagcttcatgggctccaagtttagcaccaggacttgcccaggaattgcagtccttgtgggctagactgcatttcaagtttatttagtacccccaagctctttagcctgtggtagtggggcttactggaattcaggttccaattgctgggatgagtaattcacctctggctagggctaatctgaatgttccctccatgtcaccaactgagctctgccctgagtcactttccactgtgaccaggcagcactgtgttccaatgctaagttccacaattagtgcactgtacctccttgaagcacacagattctctctccacggcaggtggctgactactgctaggaataggggaagggtggtgtaggtaattcaaaactgtctttcttatcctcttcagtgcctctttactcgatatgatgttaaaaccaggtactgtaattacttacatgagttttggttcctatgaaggtgcttttttgtgtggacagttgttcaatttgttgttcctggttggggggaatgatttctggaggcttctattcagccatattgctccgccttcgtcactatatccctcaatgctattttaatttccgttaagtttggaaatttccattaaatgtcaccatatttaaattaacttcaaagaattatgttttttaaaagtattttacaaaataatggataaaaacactaaaagtaaattctaaattgagatatcaactaccaaacaagactttatatatatgtttatatattattatttggtgtcaatatttttttctcttggttcagtcaagataaatttagaataaatagtatacctattatttgactattgcagacagcattactgatggatgatgaatgctcacatagtaagaaaaatgagaattatatcctggtaagacaaataaaattatttttacataaattaaagtcaaaatgaattttgcttaatttgtgttaaaagatatgcaatatctcttagacatagtagacctctgggaaaaatatttcaagaggaaaacattagcaaatactttcatgttgtctattagcatcatattgctgttcaaattattctcacacactgtccaaatcatttcagaaaggttggtacaagataaagaacttgtcaacattaatacatactaaaaataatggcatacctcttcttccttctacagttcacacattcattttctgtcttaaatttaaatttcaattagtttttcattttttccaggttggtgtcttggatttctcctgttttggggttctttaagtagtactgatagaaaattttctttgtaaaatggcttattttaccatgccttcagatattgggtcatagtctgttttgcttactttaatcaaaggattcatttaagaaattttgtggacaccattttctgagcatctattaaaatattatcttggactattgaatttaaggtttcactttgtgtatcactgagttaaacagggccctggaaatctgaaggatatatacatttggattgctttccttaattggccaaagtgaggattctgtaggataagcttgaatactgcggtagagttcaggtacagaacatgggaagagttctgaattaatttgtatgtaaaggataggtgttgaactactgctagcaaaattttatagccaataaagggcttaattataaggaaggaaaaaaatatttatatgtttcttcaaacaaaaagaattttaagaaactgagtcattataacctcaatcttggtttgagaatccacttcagagtagattggcatcactgaaacattttttctgtcaaaagatgccagggcagttttatttgaaaacagttgaaaccaacatgtattcagttggatggtgttctgttcctgaacacctgttgctctcaataatttgaaaaaccttggtgtgagataatagcagaggtaacaatcacaccatcattcttgtgcacaccaatattaaggttttaaaatacgtgatatatacatcagatactgaatctggctgggaattcacactgttatatttttgatataatatcattatcaatgataatttaagcaactgatctcatgtatagcacttcagtgtttatttcttacttagtattatcatttcatataaactccattatactcatttttattgttttttacataatttcaaatattacttcacagtttacctataagtgtgaacacgttttttaaaataagaagttagtaacccaggtgaaattcaaagactatgatttactactaatgtgctcatttgagatagaccgtgaatatgagaagctatcatatatggattcagcatgagttcagtttatctggcaatagttccatctgttgtattttgaaattgcctactgtattagttcattctcacactgctttaaagaactacctgagactgagtaatttataaaggaaataggtttaattgactcatagttccatagaccatacaggaggcatgcctagataggcctcaggaaacttaaaatcatggcataagggtgaaggggaagcaagtatgtcttcaaatggcagaaggagagggagacagagagagagagagagagaaaagggggaagtgctacacacttccgagcaaccagattttgagagaactctgtcacgagaacagcagatggaagtctgtccccatgattgaatcactctcccaccaggctccttctccagcactggcaattacaattcaacatgagatttgggtggggaaacagagccaaaccatatcatctacttaaataaccattgaattttagaggttgaatcatatcaatatgcatgctatagactgaagatttatgttctctgaaaattcaccttgagatttttacctccaatgtgacaatattaggaagtcgagcctattactatgattaggtcctcagtataaagcccttatgaatgttattagtgcccttataaaacaggtctcagaaaatgctctcatcccttccaacatgtgagcactcagagggaagattgctgtctgtgaaccagaaagccctcactagcccctgaatctgctgacaccttgattttggacttcccagcctctagaattgaaaaaaataactttcaattgtttagaagccacccagttaatggtaccatgttgtatcaaataaaatgtaataaggaattaaatgcaattaattttgccatgcatgaaattctttggaaatgactgttttccttggtgactctatagtgctaaaataatattagacttaagtgttttataatgatattgggcttatgttgttattttttgtttcgtaaaatgtgtaattcaactactgtttttattgtaccatgtggatgcattaagtagccatgctgacagatgcaataaaatgagtaaaataaacaaatattttgatttttttaagatataaatttagcctttttttcactgcagttttcataccacacataagtaatttggcagatattctattatttattgttatttccttaggaaaaattggcatgttgatggcacaaattaaaatttggataataattaggagtaaataagataattcaatttggtcttgcctacaataaagatattctcaatagcttaggaatataatgaataccactttaaaatgcattccaaaagaaagaaggaaaggtacaatgtgttttagcagaaacttacttgtgtccctttggttagtggctgatacatagcacagaaattagaaggtaaacaattgccagatgaaaggattaaattataactaatagcaaaaattttgaagatagatataatttgaatattctgagaaactgttgatgtcagattctcagctaaggaaattatctgctttgaagctcttcagttatattattagcagtcggtttatgtctttgtacatgaacacgtcttctttttctcacatagtttattttactttagtaaatctgatgggaagccttatgtcagaatatgtaacaaacattgattcttgtaggctaaacttattttattaaaattatgttgcatatgcttcttattaagaataaaggtttatttagactagttaggacctgcttaacaagaaagacttcggcagccacctttaagcctgaagctttaaaaatgctgagcaaaattgtcaaagcataattaagggtaggggaattaagttcacttttctcccctaagtgtctttgccagagacagaaacttcaacaatagagctaagtggaaaaatggagccatgtcagttaccacaccatgctaaagactgattagtcataatttttggtaataatgcccacaggaataaacctgacaatggtgtactctcttgttagcattagcccttttttgtccccatttttcttgctctttcccatgggcctggtcacttagtgatattagttttaaaagtttcatttctcaccatttctgctactttcttgaatgtggtgagtcatgcagaacaattaacaagcattaattgaggttctcttatgcataagattttatgtaaaggtactgggggctgggaatattttcttatgactatggaaagctatgggaatagtgacactggttgtatttgcacacggcctggaaaagtgcaaagtattgggagttgaggagagacaaatgtcctgaaatctcagctgaaagagcagaggccttgtgctagaccctgagggtacagaaactatacgtattcggttatgtgttgcctgtatgatgaggaaaaacttagactccattttacaggaagtaaggtaccggaagtggtcaaaaattgagcaagtaataaaatgcaaaatgaagaatattttctacttcttgagtttgaattccacagaatgagttttggactttatttgaaatttgtcaattgctagaatatcaagaggcactgatcaaataaaaattattttaaaaatgaatacttcttatataatacactattgttggatacctatatctgcatatgctctaactaggatgaaaattacctatattcatattaaaataatagactttacagatgatctagaccaggggtccacaaccatcaggccacagaccaataggaaccagtcacaaagcaggagatgaccgatgggcaagcaggcattaccacctgagctctgcctccagtcagatcagtggagacattagattctcatatgagtgcaaaccctattgtgaactgcacgtacaagggatctaggttgtgtgatcctatgagaatctaacctaatgcctagtgatctgaggtggaatagtttcatcctgaaacaagtcccctatccatggaaaaattgtcttccatgaaaccaattgttggtgccaaaaaggttggactagtgatctagactatcgtaaatatgtactaaaaattcatacattttatatatattatatatatatatgtactgctatatcttaaaaagttatagtttattagtttcatattgctgctgtaacaaatgaccacaaactcggtggcttaaaacagcacacatttagtatcttaacaactctggaagtcagaagtcagcaatgggtctcatggaaagaaaatcaatatgatggcctggtcgagttctttctgaaggctataagggacagtttgtttacttaccttttgaacttctagaagctgcctgcattactgggctttgtagaccccgtctatcttcaaaaccagcaatggcctatctcaagtcttcctcatgctgcatctctctgattctgagtcatcttctgtctcccatttttgacatttaaggaactttgtgattcactgggtccacccagatagtccaggaaaattctattacaaggttggctgattagtcaccttaatttcatctgattctttcattcccctttgccatggatatctgtcgaatggggcgggaagcgttattctgcctgtcacagtcagtaatatcacacaagtaagatcaggattttatttcttaccaagtaacttttgttctgtccataaatattgagctgcttgtgtaagtatttgcaatgcacattacttttccccctcagtggttgattgttatattaatacagagaaaggaatttccattgtgctgaattacacaagctatttcttttatctttttttttttttttttttttttttttttgagacggagtcttgctctgccacccaggctggagtgcggtggcgtgatctcggctcactgcaagctccgcctcctgggctcacgccattctcctgcctcaggctcccgagtagctgggactacaggcgcccgccaccacacccagctaaattttttttaattttttttttctttagtagagacggggtttcaccgtgttagccaggatggccttgatctcctgacctcgtgatctgcccgcctcggcctcccaaagtgctggggttacaggcgtgagccaccacgcccggcctcttttatctttggtatatgtttccaactcctatgcctagaaaacttgtactttccatttagtgcccaattcaatgccatctcctctacaagaattcctccctgaagcctcaaagtagtttaatcaaacttctaatatggaaccataaaattatattgtaattatgtttatttacaatttcttccaatagatgcaaatgttcttaaaggcagatatattttatattctttatattccctatttcagttcctagtatagaaccagtacatagtatactgttaatagatgaatgagtaaattgttaaatgaattaatgatgaaaaaaattcacttaagacctctcatttcctctcaaatattttatcctatcttacagtagtgatttaataaaatatccatttaataaaattagccattgggaacttaaataatacaacaaatcctatcaagctatacacataatatcagcctaccaagttttctataacttatcctcttttttctctaccagtgtcagcatagctcagcctatcctaggtccgaattcattttgagactctaacttggtgtagggaattcagtgtcagattgtctttttctttgtcaggatcttgtcctccattctaaaaacctggctgctgccttagctggtatttatctgataatcagtgtctgagataactgcatttctgttaactgcctatttgggtttataaatattatctttttcaagatcttccataaccaagcactgaaagttttaggtactgaaaactgtctgtttgcttagattattcattcttaatacaccagactattgtcttactttacagataaggaatttgaagcttagaatagttaagtatcctgactgcaggttgcaatgctggtaaatgaccaaaatggcatttcaactcaggtcctaaaaattctgaagacttgttttaactactgtactctactgttttaactactgtactattttattttaagcattattctgactatccatttgcttgatataactgaggagtggtaaagatcaaagtagaggaagaggcagaggtagagagaagagaaaaggagggtaagggaggagatgggagacagaaaataaaaaaagaaaagaaaagagagaaaaactatgagaaaacatcccactattaggttgggcatgtattgagatcataatcctaacaaggttatgcatttcttttattaacaaacttaataatttcgagccatctttgcagttctagaatgaaagttacctgaaataatggtcagttttcctagatgcaggcaaaataatttgacttagtttaaacagaaaggattttattatagaatatttgatagcttacaaaatttcttggaggtcagcaaatcaaaatttcttggaaagtcagcaaactatagcaacaaaataccagacaagatttctgcctggaggggataaactgcggagctaggctgagagcagagaaaaaaaaagagaggtggaggggaagggatggggttatggaattttcagtgtttagtatgcagagtttaatttaatctacctgttttcagtaggatattctctttctcggttttgcctgatgtttcttcaatttggagcttatctaattttcttttttttttctttttttaaattttattattatactttaagttttagggtacatatgcacgatgtgcaggttagttacatatgtatacatgtgacatgctggtgcgctgcacccagtaactcatcatctagcattaggtatatctcccagtgctatccctcccccctccccccactccacaacagtccccagagtgtgatgttccccttcctgtgtccatgtgttctcattgttcaattcccacctatgagtgagaatatgccatgtttggttttttgttcttgcagtagtttactgagaatgatgatttccaatttcatccatgtacctacaaagacatgaactcatcatttttttatggctgcatagtattccatggtgtatatgtgccacattttcttcttttttttttattatactttaagttttagggtacatgtgcacattgtgcaggttagttacatatgtatacatgtgccatgctggtgcgctgcacccactaactcgtcatctagcattaggtatatctcccgatgctatccctcccccctccccccaccccacaatagtccccagagtgtgatattccccttcctgtgtccatgtgatctcattgttcaattcccacctatgagtgagaatatgcggtgttgggttttttgttcttgcaatagtttactgagaatgatgatttccagtttcatccatgtccctacaaaggacatgaactcatcattttttatggctgcatagtattccatggcgtatatgtgccacattttcttaatccagtctatcattgttggacatttgggttggttccaagtctttgctattgtgaataatgccacaataaacatacgtgtgcatgtgtctttatagcagcacgatttatagtcctttgggtatatacccagtaatgggatggctgagtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatgtgcatttctctgatggccagtgatgatgagcattttttcatgtgttttttggctgcataaatgtcttcttttgagaagtgtctgttcatgtcctttgcccacttttttatggggttgtttgtttttttcttgtaaatttgtttaagttaattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccgttgcttttggtgttttagacatgaagtccttgcgcatgcctatgtcctgaatggtaatgcctaggttttcttctagggtttttatggttttaggtctaacgtttaagtctttaatccatcttgaattgatttttgtataaggtgtaaggaagggatccagtttcagctttctacatgtggctagccagttttcccagcaccatttattaaataggaaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtctgaagtcaggtagcgtgatgcctctagctttgttcttttggcttaggattgacttggctatgcgggctcttttttggttccatatgaactttaaagtagttttttccaattctgtgaacaaagtcattggtagcttgatggggatgacattgaatctgtaaattaccttgggcagtatggccattttcacgatattgattcttcctaccccacattttgttaatccagtctatcattgttggacatttgggttggttccaagtctttgctattgtgaatagtgccacagtaaacatacgtgtgcatgtgtctttatagcagcatgatttacagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctcgacatcctctccagcacctgttgtttcctgactttttaatgattgccattctaactggtgtgagatgatatctcattgtggtgttgatttgtatttctctgatggccagtgatggtgagcattttttcatgtgttttttggctgcataaatgtcttcttttgagaagtgtctgttcatgtccttcgcccactttttgatggggttgtttgtttttttcttgtaaatttggttgagttcgttgtagattctggatattagccctttgtcagatgagtaggttgcgaaaattttctcccattttgtgggttgcctgttcgctctgatggtagtttcttttgctgtgcagaagctctttagtttaattagatcccatttgtctttctgtagagaataaactcctagtctgctagggacggaaggagaagttgcttgggtgcatggagtacttttagctaaccctctagttgccagccccatctttactcccactttgttaggtgcacagcttttctaaggtcccagagtaaatgtggggttgtttgagggcaaggaggtacactgctggctcaggtttcagatttcttgagactatttgctttccagtgtatgcgtttattttttcttcagctgctgccagctctcaaagtgctcaaattttacagtgaacttatcttaaaatgctcctctctttatactttctgccgatatagagatatttagtattaatgttcatttttaaagaattttgaagaacaattctatgccaaaaccaagctgaatactgtacacatgatcataaaacatagtaaacagtatacattcaattttatatgaatattggtaaatggtgtctgtatctttgtagaaaggaccaaattgcagttagcattatgaattttcatttaactttttaattttcttgttacatagacactagtcattaagtgtttaagaagagatctgattaaataaattggaattatcttttctttgaaatatatcttaattaaaccctgtctattatgaaaatatcagacctttattagtaatcatttctatattatgctgaaaataactttttttaactctgcttaatttatttcatgaaaagatttaacgaaaggttcagtgaagttttgcaaaaattggtgcataaactcagatatgtaaagattcacatattctaaaattttctccttcagccaaatataaactacacatataaaaaagtaagacattgccataagccccatggtttaataacattgctccacagtcttatgagtttgttttaaagctttagtcaaaaaatacaggatgagatttgttaatatacacaaaatttagcttttcaatgtgttcatgttgagtaattaggttatgtgctacataaattaatacatttttatgtggtaaaaacagcgtaagtggtaacagctgcctctaaagtatctttgttcttattcagatttaaattacctgttgatttgagtaagtaattataattttgtcctaacactgtgtaacatatggtgtttacattcttctcaagagctccttgagggaaaaaaagtacacagaaacatcaatataaatagtgatttaagaaaccaatgaaaaatatttacaaagattaattgtagttaataggatgttaaatagttgttaaagcatttgaatttgtcttattggattattgacttatgatattattttctattgtttgcttggtgttgacgttgttacataacatattcattttgagaaatctgttttccaaatggaagtttattcttttattatcatagaattcattttaagctatgtgttcctttttcttaacaacaaagcattattttacatctgtgtttatattttagacttagcatataagatattgataacctagcagactttttaaaaattaaaaagtataggatataagatttgttttaaaaccttttaagttataagtctattaaaatttctaatatatttaggtataattttagaatggaccatgttccaaatatttgctcaaaaaattatttgtttagaatgttgtccctgctaagccacaaagtgcccttgaacatgtggtttatctaaaaggtagctatattacaagctttaatttattgagcacttccaatgcgctagacacattttaatttgttttacatatgcttttctgaggaaaactttacagcgactccatgagttaagctaggcattttcaacctcatttcctatgaggagaaacagactcaaatactttaatacctctgatatgcctccaataaatggcagaaccaaaatgatttcaaaactcatgcctgtaagtactatgctatgctacttctctaatagaatatatatagttcttttacaattgcagggaacctttctgtttgtgtggaataattcattacatattttgccttggcatataagaaacactgtattttgaattcacaggaggggagtctttctaggttacttccaagggcttaggtaatttgggcctgagtcatgtaataacctacatttgaatcagctatgtaggtaatatttacaattttattattacaaattttggtgctctaattttcagtttgtcattttccaaatagtgggggcagttttcttcctgggaggtgaaagcgttcgagtttgatctggagtgatgtgaaccaatgtgtaaatttgtatttcccttcatctcacatcttccccctacagcctcttctccagatatactcatttcctgggtgatttcatgccatctattgacagatgcctttcaattatttatctccatctcaggtttctctaagtttcagattcatatattcaattgcctactcagtatttccacatggatggctaccaggaatctccaaattgataaaaaccattcaaaacatttgattctcatcccataatacctactttgctattttaagtttatttctatccaagtctccaaatcccttttccaatctcaataaatattttcatttaccatttcatcatataaaaatgaaaaataattttttcctcaattataagttcttagttggaccaaaaggcagattaacaagagaaacatagtgtattaacatgtgcactgcacatgatgtgagagaaacctcaacaaagcagtggcttagaacttctggcttatatagcatcttcaacaaagaacagtaaatttatagagaaattacagaacagaggaaagaggttttagttttaggagaaaactaatggtgtaaggatcctttgtagattcccctgttgcctctctaagctgataagcatcagaattgtctctggtgaaggagaatgcatatcctgcctttaggcagaaacaaacagaaggtatggagagctttcccctcatttgcttctcctttaatgtccttcaggtaaaaataaattttatgtcaaagaggcaattttggggtgacattttggtttccttcagttgctcaagccaaaaataagagagagagaggaaaaagaatagaaattcatacttgatttttcatactctttctcacacccattctgtgagcaattctgtgagctctgtgttgagaatatataaatatattccaaatctgtctgtttcttccacgtacactattatcagtatcatttctcacctagactactgcagtggtttctttgttcccactcttgtctcccctgtaattccatttcccacatgggagccagagtgatcttttaaaaaaataaattggattgtgtcattcccttgcttaaaacactccagtgccttcatatcaaacgcaagattaaagtgaaactgctttctaaggccttacatgttctaccccatggcagcttttccaatctcatctctgatttatcttgcaagtcttttctagatctggcaatgctggccttcatgttgttcctcaaacatagtaagttctctccttcatcaggatagtcatactaatgttttcttccgtctgtatcatcctgtcttcacattaccatatagctcattctatcactgtatttaagaatttgaaatcatatcagctaatcaaaggagacttccctaactgcccttctaaaatagctgccatattcaggttcattttctgttttgtttttcttcatggcacttattatttttcatagcacaaaccccttgtgacctgacattacattgtatgcatgtgtttaaaatcagttttgctcagtaaaatggaagcttagcatgggcagggacttattcatcaatgtatctttagctcatgcagcaatgactggcacagaaaacctgtttaataaatatttttgctaaaaaaattatttcatgttgtattttattttaacatatacgtttatgtatatataatctactaatttacctgagtgtgtatgtgtgagcatatatatctatgcagagaggtggggatttattaggagtatattaataaaaatgaaaatatgctattctgtgatgatactcagttatctggtcaaaacatcctttggttggtaatggatttattctgatctagtccctgtcttcatccagtttacacaggttgcatataattagccagacaattttgtgtcattcaagatacaacctggttcagaaaaaagaatcttgaattgtaccttaatgcaacccattacagtgaggttacagtgtcactcacctcggaaacagtgtcctcttgtatatacccatttcttcccttaactacatcaaatcttttttctgacttgaacattttgctagcatttttagtactttgttttagtagaaatagcattcagctgcaaaaataagacaaagaaaacaaaaacagaaaataacagtatcttaaaccctattgaatttaatcttacacataaaacttggtctgaaggtaggcagtctggagagcatagggctgctcctggaagttgtctgggaccctgagtcctattaacattctgctcccctttcctcatctccagcttctgaattaaagaccccattataatctaatacagctattggagttcctgccatcacatcagtgttccagatagtagttgggaggaaatggggaaggagaaaaaaaccatacttgctagctgagttagcttcatataaggagctactctggaaaccccacataacacgtttgcttatgtcacactggccaaacttcactgcaaataagcctagaaaatatagtgtgttaattggatactttgctactccaaataacatcaggatggtataactgaggaacaagagggggtgcatattgataaacaagtaagagtcagtgccagatatatgtgttttttgtggaacttattctactgttgctatagttattggcataagtttattttcccatatttccattacagctcccactctcatacatcacattattctcatctctctgtacctgccatcccatctagcagtgtcttttaaccaatagttagtcagtaaatacttgctaaatttggatttaaatgactcaaacccattagcttgtttcattagcactttattctggcagatgataaaatgctgaagaagccttgtctcttgtgtcctctgcacttctacagatattttaaaaacaagaaaaatgaacgtattctgcttaatactgtatttttagataacaaatggacaaattgcatacttaactttgaatgaaaacccaattgagttatcagtggatttgaaagagaagtattatcaatgcaaaacactgtatactgtgatttgtattaaataaacaaaaacttgaaacttctgaaggaatttgtgaatgaaaggacattagttaccttatgaagttaagcacagggaaatatctaatgatccttgctccttcagctaaattatatgcaataaggaatttacacttctaaagtatatttcctgttttactcaaaacatgttttcattttacctaaaaacctagcttttaaaatgcataagaaggccagccacagtcgctcaggcctgtaatcccagcactttgggaggccaagagggggtggatcagttgaagtcagaagtttgagaccagcctggtgaacatggtgaaaccttttctgtactaaaaatataaaacgctagccaggcgtggtggcaggcacctgtaatcccagcttctcaggaggctgaagcaggagaattgcttgaatccgggagacagagattgcagtgagctgagatcgttctactgcactccagcctgggtgacagagcgagactctgtctcaaaaaaacaaattaataagtaaaataaagcatgtaagaaaacatttaatagaaaattgtttactctctttccaaattctaaatatcatctctatggtttgtataactttgtagtaagtttcataaacataactttcctctccatattcaactcttaatgcaaaaataatacaaacaacttttcaacatttttaggaatgtttcttgaggaatcattcctaaaaatcaaaatagcctatttaagtttttaaattgaagttagccagtaagaaagtctttcttcggtgtcttagtttctaagctcactatagatttgtgttttatgacaatatataatatgtctgattattactgacagccttgtgtcatatgccaaatagcctctaattttaattttgatatatttgtgacacacacctatcaattctcttacaattttttagaagacttggcaagatataaaaattatattcctagttcttgttatgacaaattgtgaattaccaggagacaagaaccgtatacatatactttactgcatcttctaaaatatctagctaagtgccttgcatattttagatttttattaagtacttattgaacaaagtatttcttaagtttcatgaagtacttcttgaaagtatagcagaatgttaggttaaaataatgagataaggaacacagaggaggcttatgtgtactttattccactgatatgaatatattaaactaaaaataaatttatgaaaacttagatttaacctagattagaactttaattaatttggaagtaacttttctttgctccctcatcataaaaaattattttcctttatataagaacatttatcatggtttctttttatttgtctcacttttgaaatggaattggataagagattcgcaaatgacaaagttagaacaaattcagtttagagatcttcattggcttttgtttatgattctggaatgaggcaaaaccccattctataaaatagagtaggtgttccaattagctgagaaaaggagtttggttgtatagacagcaaagggaaagcagaaacagaaaccaaaaagcagattggctgtttcaaagttactgtccttttaaaggttaaagcagatggaactcccgtatcattcaggttaaaactggcttgcttgggatttggctattatatctctcaatcttctgatttataaggtcagataaacaacttaatttcaggttggtgtcatggaactttagcatgagtgacttcattttggtttggtctattgggccttgtacaggagcttagtccaaagcaatggcctcctataaagtttatttaacaaggtaatgagaccctggttctacgtagtgctccagaatcatgggcacttaatccattcaaccaaggaagcagacaagtgccagaaatggctgaagagtccacatcaagttcctaatcagggagctagctgcaaggtagaatccaggaacaaacaagagactagctgctggtgcttcaaactcagttttaacagtagggaagtaagccaaggagcacatcaaagagactgtggagtttttttcttttaaatctcaatatttacttttacatttaaatgtgatttaatggatgatgtaaaaatgtaaagtaggcaaagctcaaagtggggactgaagacaaccagctgtacaatagtccttgtttccttttctttttttttttttttttcttttgagatggagtttcactcttgttgcccaggctggagtgcaatggtgcaatctttgctcaactcaacctccacctcccaagttcaagcgattctcctgcctcagcctcccgagtagctgggattttaggcatgcgccaccacacctggctaactttgtatttttagtagagactgggtttctccacgttggccaggctgggctcgaaccctgaccccaggtgatccgcctgcgtcggcctcccaaagtgctgggattacaggtgtgtagtccttgtttcttacatcaagaaccagaccctatgctcctattaagaagaaaataactgaattatatttttgtattaaaaataatagagatgtgaaattaatgtgtgtcttttatctttgatattgctaatgggggaaataacagtaatttaaaacagtttttttgaataaaaaacttaagacatatatttggggaaaaataaaatgtttatgattcaatatatataaatatccaaatacataaatacatgataggtgatcatttctttgggaaaaaaagacaagcagattaaatttcttaaatataattcagatagcagttttgaaatttactgttcatctcatacttaattttattatttctgaaataagaaattagtgttactatgatgccaaatcaggtgttatttttaagtgttttttccaacatgcactcaatgatgttatataattatgttcagatcaacagatatatacccagtccctctaaccataggctattgtgtgtgattctgcaaagaatgataaaatgagaaagatatagctactgttcttgaggatattaaaatatagtatgttgaatagaaaaataacacaaaaatagtgtagtaggatggttaaaatagcaaactgacagaagtttgtatatctcatggtgatggctaaaggggataatctgtctaaggggagaagggatttaataatatttcatgctattgtatttgaatttttcccattctgttatgttcttttagtaacaccctatacactccttccagtctgttttctctaaacctcccttttgtcttcttactggaacatcttgcacctccttctaagccatccatatgacctttagtcatcctaaattcgaagatccattattaaattctcttagccgtatttctagacaccaacgcttcctcccaagtagtagatatctttcttttatgttaatcctctgtaaccctccaaataagctcaattatgacacagcattggaatgatttcttatgtgtttctctaatagactgtaattaatctgaaggcaagaatgacgttttatttatctctgaatctgatttttcaataaatctcaccaaatggagaggataactagaaaattgagttctttaaagatattgggaataggacaaaatgctacctcagtaaaagtgacttaattttataaataaaacgggattaagaaggagatgaaatagtctcagaagcaaaatagtcagaaccagaattgtgctggtaaacatttaatagtaaatctttgcaaaggaaacaaacaaacaaaatgatttgtagactttgtaaatttctatgttgttattgttgcaccatggccaatttcaagctaccaagtcgtgtctctgaacttggagttgggaaaagatgagcccaatcagctcttgtaagctagtgcaaggcaactccagtgaagaactcacgaagaactagaaaattgtttgtcccttgtagtatcccactgtggttttcacgatctgatactgaaatatgtatacacaaaattgatttaattctttctgataatttctttcgtcttcaccacatatataccacagagatgtactttttaaaaatgaccaaatcaagagcaaaattattaatttcaaaaaatttacaaaatgttagaatttgacttacagaaaattgtatacatatagttaaaacagctgtataaaactacttaatatgaatattttctttaaaattattacattttaatattgtaaaatattataaatgaagtataaatatttcactaagaagctttatggatttctttaggaattttttagtttcactatgaagaaaatataccaagttaaaacagtcttgtaagcaataattattgcctatttaaaataagaaatgaaggatatataatgaatatattagtaaataaagtaatatgtgccatttcgggttgaaaagtaactgtgaattcaaccagtaaattatttttaaaatactgtcaagttctgttcatgtattatatgaatgctgactgtacataattttattcttttttaatgtttgaattaatgacactattaatatcttacagttaacatctagcagaagcagatatgagctaatttgtattttcctgtcatataaaatctgaagtcttcttcagtaatgttaattttatcttgtcattttagatcttttacagcacttaatatcataattgtaaaaatattgttccttattaatatttgaacaaataacaaaaagtaaatccaataatactatttataatttattaggacatagaacaatcattttgaataagctgttattaattagtttatgataataatactagtaaaaaatttcagactttcaatgtatgaaaaatactcagtttaaacaaatagaaatgttctatatcattaaggaaccaaatagtctagtgattaaaaatacaggttttagaaatagatctaagttgaatctatgctctgtttcttgttatgggactacaggtaagttttttaatttatgtaatctctcacttatgagttagtttgatgctgaggttacaaaaacaaatacggccaacaaagtctctgtatgcatgaagctttctgttttttggcatatacagggagcaaacaaatactcatagtgtggtaatagagaagtaatagagaactgcaggaataaagagtaagttatacttaatctattctcagaatcagaaagccctcctgagaaaagtggtatttaagctgagacttgaaggaaaaataaaaattagctggataaatgtgaatatttgaaatgacaataccaaataaatttacagggctctctaaaattaaattaaaatgccacatataaatcccttaacagtcactgatagatgctgaataaacggtagatgatgctgtcgttactaactatggtttgattctctattagactccctaccctcacacttgtatggtactttttggatttatttatgatagaaatagtctaattgtgctcacactgactgcaaaagtactaaaaacacaatgagaccaacaatattatcttatttatctttgtgtcttcatctgatcacactgcttggaatttaaacaggtgttctttaagtcttccttagcaaataaatacatgaatgaatagggaaaatacagcttttaaccattaatacagaagtaaagttttgtgactagatgaagtattgttcagtaaataaaatacaggtttgctcccacttgtcctagtcatttggcctccgagttataggatggatatgtataaattcgattatttattcaactatccatatgccagtgtcggcaatatattaatttcaaatggtaacacagcaatgcactgatttagtctgttggatctgagtaagtgtaatttttaggagttcatatctataaacattaccccaaattgggattgaattggaaaataatctgacacaaagcttccctaaaggcagtgctttgggttaggcgttcattaaataactgaatttaaatggtgaatggactctttttccttctggatcgttgtaagaatagcagatttgagatgaagtgaatttcaaagtgttgcaaatggccaaagtgagaagagatggctcacaccaagagcatcagctgatttctgtagccatttcttaaggaggctgacaaattaacttgagaataatcaagaaaggtcaaattatgatcatctgattattttaaaaggttaaggaaatataaaaacatataaagaaagtaatttcagaaactaccaacatatgaaaagctttaacattttagaagactgatatgatttggctgtgtccctacccaaatgttgtcttgaattgtagttcccataatccacacatgtcgtgggaaggacccgacaggaggtaattgaatcataggggtggttacctccatgctgttcttgtgatagtaagtgagttctcatgagactgatggttttataaggggcttttctcccttctatttgacacttctccttgctgctgccatgtgaagaagtacgtgtttgcttcccctttcaccatgatcataagttttctgaggcttcccagccctgctgaattgtgagtcaattaaacctgtttataaattactcagtcttgggtatgtctttatcagcagcatgaggacaaactaatacagagacaaacttaagttatatgtgttacttgttggttctccttagttgaatcactatttttgcacatccaggactgccttctctctgtcttcttagtatcatctcttgcactaccaaccaaaacagttctctacagcgtagccatagttatcacttacaaataaaactttgattatgcatcacctctgtaaactgtttatggcttctaataatagcacttagataaaagccccaaatcctttttgttatttcacacaaaaataaccataccaatttttgtttgatatgaaaaaatacatgtagtgggctgaaaatggttctcccaaattatcatgccttaatccgggagcctgtgtatgttaccttacttgaaaaagggattctttgcagatgtgaccaaattaaatatcttgagatggggagattatcccagtgtatgtgggtgggtcctaaatgcaaccacaagtaagagagagacagagagagatttgacagaggcagcagaagaggagacagtgtgacaatggaagcagagattgagtgatgcagtgaggagccaaggaatatgagcagtgatcagaacctcaaggaggcaagaaacagactgctgtaaatggtcaaagtgagaagagatggcttacaccaagagaagacattaaagcagcagctgatttctgtcatcatttcttgtactaccaaccaaaacaactctctatagtgagaattgtcataattttccttgtgaatttgcatattttcataatacaagctagggaacccactaccagagaaaggggcttagttccacctattgagtaccttaaatcatggaggactcatgggtggagagaggtcaagcagtagactactaatcttacacagcctggaagatttgggaggagagccatttgtccctggtgcttcctgcagattccactatttttaggagccagtgaagcaaacagatgcactgaaaaacaatattaaaattgtttcaatgttctttcaattgaattttaactccaagtactcatcctttagtgatggtaggaagtataacttcagttatttgtgagttatctcaaccacagagttttgtcagtgtcttgatattttacaaacaatgtatccattggaaagtcccatcgagatgttggtaatcagttcacagagcacatcaaccatttaagtcccatggctctgcccgtttatgtcccacagttctgcccatttcatgccgtgctagagatgtaagcactttgggaagaactagaaactcctctgcctaggatctagctcattaagtcaagagtgaacaaggtagctcttcctcactgagtctttgccctctccccagatgatgccaggaacaagcactaggtctccttcattcattgaaccaatacacttcttctcctatctactttaggaatttttcctcatttcctggtcatccatttctcaaatgttttcttataactttccggtgtcctctgcattagcttttaaaatgtttatgattttataaagagcttctaatttcacattgattatttcaattaaacctaattccttgcttaaaatgagaggaaagaaggaaaacatatcaggaaaaacagatatttcaacagttcactaagttatattgactcaccaggttgtgttctcctgtaatgtgtttctcctaccacttcatcctctttttctgaacacccaatatacttctagaacttgtgccaagtcttcccttcgaggtagattgtaaaaatcaatgagagcaagcttgcacttaacacatgattatttaataaaaaaaagagaagtacttcaggagatgataccaccaaacagaatgtgttttatttgtttgtttttaacagaattagttttgactgatagagtataagtagaactataatccatgaagccattcatctgctatacagaaaaatcaatgcttggtctttaaatataaacatcgtcttcaataataagactgaatttatggaatgcacaaataatactgattaatttttcttaggtgttttatacctacagagacatcaattgtcacccaataatggtggtttttggagtataggctgcatggatcataatggcaaaccttatttaaacagaaagaagagcagaatatcagtcataatgttttctctgtaagaactgaaaaattgaagtaaatatatgaatcttaaaatatcaattgtaatattggcttttgcaactcaggcaattataagatataggacattttaaagactaatgaagaaaattgtatttaatttattctaagttttaaaaactttatttttctcaactagagaattagttgaaagctcccaacccatgatttcctaaaaaagtcacatctaacttagatattggtagcagttcatgctctttttaccgctggcttgtgtcccttccaaacactttaatggtattttactgttaaacaatatatatttctcaccacttgaaaaactaattcaaaataatatttctttattctatgaggtctctcactattgtcattctccttttgtggcctatgctcatttcttttccccaatgaaaagtagagaaaaaaaatcatgacaaccttgtgtgtctgcaagtctctgtaaaatgcctccatccaagtttccttccaatcaggaacataattcttagcaaataggtcgctaactcacttaattaactctctgctatgtccttagaggagtttctattatcaaacttgaattggaataacatttaacaagctgtacaaggcctttgggaaacctgtttttcacaaaaatggcttcttaaatgggctttgatctccttaaaggattctgaattactgcataaaatcctaatgcacttattaacgatgcatatatatgcagattttaaacagagtgaaagataaatttcttttctgcctccttggggagcatcctaatatggattttctttaaacatttcttgacctattgaacatttgataaacaggtattttacccaaagctccctccagatctttgacaattaagaaataacataaaaacctatttaggattgcatcgtactcttctctgttagtatttgggatagagatttgaaggagagtgatcctgttttccatttttcgtctcatataattttttttaatgcttactctttgtcagtcactccactatagacagggttgcaaagtcaattaagctatggtttctttgtttcaggaaactgcagactagtgaaaagtggagcagaagagaaaaaaataaacaaagaaaatatacaatgataggccagactgatacattgataaggcttataatagatttttacctagatacaagagtcagacatctaatttagaccaagagaggataatattgtgagttgaattttgcagaatgagtcatatgttactgaataggagaaggctatcctgagcagaaagatggatatatggaggtaagcatgacctgtttgagaatttttaagaaatttatgactgtcagctgtatgggttcctctgagggttggtggttgacaccaaagaggttagcaggaacattaaaggcattgtaggaaaaaaaagggaaaatgtgtgtgtgtgtatgtgtctgtgtgtgtgtctgtaattaagtaacctagagaggaaattttagagcataaatttttagaaatttggggacttgtcatatgccaaaatctagacaaagcaatcagtgcctatcaaccagcctacttatatttgaacatagcagatgagtcttcctagtgcagatgaaaatattttctatgtgtgaaaataacttcctgaaagttgtgtccacataatttcccaagttcatatataacgttctttatgcagaaattttatttacaactgaattcttgaggatcacgcctactaagtaacaccaggtgcaactaaataaagagaagtaaaatatctgaatgctcacccagaaagcgatcaatctatttcattttaatatattatttatatttagtgaatatacaaagaatatgtcacaaatcattggccaggcctggtgaatgtggacctatagtctcaactactcaggaggctgaggcaggagaattgccagagcccagaagttccaggctgcagtgagctatgatcatgccactgctgggtgacaaagcaagaacctgtttctaaaaaataaaaaaatatatatataagcaaaattaccttgtcattatgtgatgccatctggtattgaaattgaattttattcacacacataatttaatacagttttttaaaaatttctggattccttctctatattcacacattttggcaataactcatacatattttctctccattgatacagaagtagggacactgtaaagatataaaacatatatgacatctaagaacccttaatatttgttcactagagctcatacgagatgtgatctatactctgtagtttggagagctaaagcaattcataactactttagcactcagttcaatttaagatgaattgcctgtcttatgtgaatgtactactgagcaagctgaatgtcacttatctgatgaaagaacagtgcccagctatctcacatacaccctgtgtatcattcaaacttggaaacatttatatcatagtcattatcttaaaatcacagtgtttgccaacaaagccttccggcttgattccatagaaggacatttaaaaaaagatatggcataacagattcattgtcctgcttgtatgtgtttctaagtttgttcttttttttaggtaaaataaagaatttagcagtagtgcaaccattcacagttctaaaagaagcaagtgcaaatgtagagcaattttttttttcatgaaaggcagcataatgtgactgcacttacactttggatttgcaatttcactgatgatctaaataatgccattggtttaaacagttagttgctctactttgaaaattacctttgacctttttctcactagatatcaattgaattccaggttgcacatactgaactaaacgaggtaattgctctggccttgtgaacttaaaaggcaacttctttgtgaatgtatttgttggtatcattaactggatctaagaaaatataatttttataaagttagatcattcatatctaagttgccttttattcatgtggcttagtaaaagttaattgtactttcaaagtaccaaggcaaataaacagggtaatttttttttaaagggtctcgttctcgctctgtcacccaggctggagtgcagtggtgctatctcagtttgctccatctccagggctcaagaaattctcccacgtcagcctcctgagtagctggaactacaggtgtgtgccaccatgcctggcttatttttgtatttttttgccatgttgcccaggctggtgtcgaacttctgggctcaagagatccacacacctgggcctcccaaagtgttgggagtataggcatgggccaccatgcctgaccaaacaaggaagttctaataggtgtctgtggtaggctctaagattgccccagtgattctcccttctcagtgttcatgatcttgtataattcctcccctgttgacttgctccacatgaatagaatatggaagaaataagttgtcactttcatgattagtttacaaacaactgtggcatttgtcttgggtgctctaactcaccctcccttggttcactcactttgggagaagccagtactgtgtcataaggtcaccctgtggagaggtccaaatgactacttggaaacaggttttctgaagcctgccaacgaccttgtgagtaagtagatgcaatctttgagtcaagctttgggatgattatacacctagccaggagttagaatccaacatcatgagatactgagctggaggcaccaacataagctaggcctaatttctgacccacagaaactgtgaaataattgaaacttattccatgctgctgagttttgtgataatttgttaaataacaacagatacctatatagatttttattctgagtgtaggatgctgctgtaataagtctaaaatatgaaggtaactttggatctggtcagcagatttcaaggagaatgttagtgaaagtggaaagtgccttgacggagctattgttacatgtctcatagttttcaataaggctgtaggttaggactttcagaagatttaaataaatggtattggaaactggaggaaagataatccttgttatatagtatcagaaagtttaacaacaacattgattaaagtaaggcagaaaatagaaaatgtgcctaaaagactggacgatttgcctaaggagatgtcttagcaaagagttgaaggtgctgtctcgttttctctagcagtacatctatagagtggggagataaattaaaggaaggattgttaaccaaagaggagccagtacttgtgatggctttgaaaattctcagcctctctagaaatcaaataatgctaaatttaagaaatggcttcaatcaaagatcaaattcagagtacttccaggaaaatgtagtccaaaaatgaaagtgagggtatacataaaatcttttgtcaagacctcagaaagattaaagctggtgactcagaaagcccttaaagagattaagagcataccctctgtgtcctctgaaacattattatagcttctagaaagtttaaagacattattgctcatccatagaagtaggagctcaagatagagaagggcttatctcaagagatttttgaatgtggcttttgtcaaatgatataaaccccaagaaacttcacaggagacccatgaagttcttaagttatagatgcagaaacattttcagcttgaacaaagtggggaacagagacagtttagaattagaagaaaccgtttgggctctcagaattatgctgatagggagtagactgagagagctgctcaactgaatgatgactcagagggcagaaccagaccccagcagttaaagccaagagccatggagaattatacaaagtcttttgaccttattaagtaacttccagtaattgcataattggacttcagaattgttataggccagtggcttttttgtacctgccattcccccctttctgaacagaaatgtttaaagcagttaccctctatctgtatcattattatctgttgtgtatttgggaaaccagtatctaccagttttcagacgaagagggattatattcaaggatatgtatttatggaactagacctgaagtgtctacaccatggctgaacctgattcagatgacaagattatttaatttgagtaggtactacagtagtatcaaacttttgacgttggtggaagtgggtgagtatattttacatgtaaaaggaatgttaactggatgttaattagaggccaatacgcagagtatagtgatcctcaattatccctaccacctggtattcaggccctcatataatccccattttttgagtgaaggctatgtttattagcttctaacaaatatgatacaacggaactgatggaaagctactgctgagactaggttttgaagaggctgtggggcccatttgtgaggctctggctcactctcccttggatcccttgtcctgggaatgcttccatgtcatgaggaacccaacagtgagaccttcatgagtgaatttagaaaatgatccatcagttccagtggatctgtagctgagaagaccatagccctggcctacagcatgattacaaccagaagagacctttagttacaagacccagctaagccatacccaaattcctgactcacagaaactgtgtgagatgataaatacttgttccatttaatgttctatgcagccatagataactaatacagcactcaataaatgtttgctaccaaatattatgcgaatggaaggttaaactgtaaataaagtgagaaaaattagggcatataaatattaacattttgagactgggacatgggtcatccaagtcaatatttcaataataacatatagaaaataatgagttattgaacaagattttaagtatcttaatattgtgttcaaatgttaggggaaaatcccagagcaagtaacatctcttatgttaactattatttccttgctatcctttagtgtattcagtggttaccatgtattatgccatcattgtattcctttttctttctgtcattctatttccctctactgactttttttatgccaaatctctttcactagcactctctctcactacaatgcttcattatttctttgtctttcatgagattttgttttctgtctcacacatgtacacacaaaagcacaaccacatgcaaataactaaaatcattgagttacttatatagtaaaaattataggagccaaataaaatttcttgctcaatagtttactaagtctgaatagaacaaatcattttaacaataatgcaaaggaaatctatcacctaagttggaagaaaaaacagttgtgatttttaatttgtttcacaagaaaaaaattactagaggtgagtagttttttaatcattcaggaactcatgattatcctccaagtacagaatatctgtttgcatgggattgcttttgctatcataaatatagctatggaatttaatgcattgttggctattcacccttttatatagctatgattttaaagtgcctacactctgcgaatatttacataaattatcataattaaccttctgtggcttttatctttataatgaaatatcccttcattcgaaataaaatatgaaatattatttttcatttctaatgatactttgcttataaaatatattattctaagattgttagtttgatttattggatttattcgataattatctttttttagacaatattattgagggaccactttttaaaattcagaaatagatgttcttaaaatgtattgacccatttatatcaccttatagatttatacttgaattggtagatataaatatctactatttgtacatcccactatttcttttcttttagctagaaaggtataacgttaaaacccttttaccaaataaaatgattttatttagaaaatgccgggcactaaaaaaaaaaaaaaaaagaaaagaaaaaaatgcatatttttgtagaaagtgagatactatttttattacaaacaactttaaaatattttatattgagccataatgcatgaggtggcttaatttgtaaattttcaattttgaagctatttcatagatcttgatattggcatgggaaattggctttctttttgaacctcagtggatactacttgtttttcttcttaaacacagctttgtgtggtgtatcctctggtttcctgttactatttctccaatattttgacttaaatttgtttcatgcagtaattcttaggtgtcattaccactggcacttggtaggagctaaaacatatagccagtataaattttgtctatatggatactcgagttttgatctttgtttaaatcccaggtgctgccagactaaaacaagaaattatgcaattctcctcatataaccagctttagttctatagtgacttttcaccctgagaaaatttgatctaaggcaagaaagccactaacatttgtgttattcaataaaaaaggaaataatttttcagaaagcatgtaagatatacataagatatcaaattataaacacactcccttatttcttagagaagttcctatcatattgttattcaaagataatgttttactgagatagggaataatatgattagagttttgtgtttgaatcaatatattatgacaatcatgtcataaatgtctgagagaaaatatatgacaaacttcaggttaattactatatattataaaaattgagaccagtttttgagaggtgatgagtgagagacataataaatttatactcattatttattgattactgttctatatattctaacagataaaatttctcacagaaaatgtcaggtataacttacagtcactactggaacaaaatgcaaatatttcagtgtcattcgaaaaactaacaaggaattataagtttcttataatatatcagtcaatcaccagactcctttcatacttggaaatgtttccatgcatgggcttaagttaatgtagaattcaaacatttgagttctgttgtagcagataaaatgaagcctcaaatcattctctaatctgaagtacatcctggcagaactactgtgacttgtctgttaaaattgatttcctcttaaagaaaaataggcttttcttattgtgtcaaaaaatgatattatctattatgtgtcttttcttgtgacaatccttaccttttatgtcccagaaggaaaaaatattgtttttcctcctaagtttttatatcctattttactctaatgaataatctgtgttgcacacgaaatgaaatatattccaaaaagagtaaagagcaatgtttaaaaatgagtgtagaggccaggcatgttggcttatgcctgtaatcctagcactttgggatgccaaggcgggcggatcacctgaggtcgggagttcgagaccagcctgaccaacgtggagaaaccccatgtctactaaaaatacaaaattagccaggcatggtggtgcatgcccttaatcctagctactcagggggctgaggaaggagaattgcttgaacccaggagatggaggttgcggttagccgagttcacgcctttgcacttcagcctgggaaacaagagcgaaactctgtctcaaaaatgaatatagaatgggcagacatttgtaatactactgattgcccttaccttaattcacatcatctctattgtttgactttataatgctttttgattggcagccttgaaagatgaatcgacacatcagaattttacaatgtaactttgaagactgctagggaaccttaggcaagcaacttcctttaggacactaaaaatgcttgatggggtttggaactgaggtgctttgtgttagctattattgttagtgatgatggttaggtttgtgattattttgtttaataagactactcaggaataaaaagctaccttcaaataccttcccacctcctctccagtattttttaagattagactttatccaccctaaattacatctatattgaatggaaaaccaggtgttggtattttctgcactagtggcttaatgatagtttattgaactgtaatgctttgtaattagaatatttctagtaaaaacaaaatgggagagcccagaaattgtagttcccatccaaaattacaataacattatttctgtaatagcagaagagaaattagaatgtcttgaggtaatagctcacatatttagaagaagaaatttaaatattgaaagaacatactcaaaaaaggagacgttagatcgggtattcagaaacttcagcatgctgtcaatagatataaaaatgcaatgacattcattttttgatcaatgaaatgagaattgtgctggctaaacactacataagatacgataaaataaaagttggtaagttataaatactgtaagtgccttgggagtgagatataagggcacatcatttttatttaatttctagttagtctatgagattgaactctcagtacttatttaaggccagaaatttaattacaaaataactataaggttacattttgatctcaggttaaaagaataatattagaagcattaaaaatatttttgtgttaatcagcgtttaggaaaacagcatggtaaattcctgtgaaattgatttatactttcttcatttacctctaatatgaaatatattttatgtttagatttgcttccttaggattgtgacttgatttttctctttgctcaaaattatctgtgggtgtattattctttggggatagtgatggttaagaaatgctatttgaagcctcacactattagaagagttagttactaacattttcatgataatataatgagtcatagaaaatttgcattgagatttattgaataaacttgacatatttaaactgtttgccataattatgagcctagtacctgtatgccacaacagtattttaaagtactgtactttgcaccttcttcactaagaattgatctgataaatccctttttgctagattgtgtcatgtccatctttttaataccttccttgttcattattaagtgctgttagccatactgtctaatgaaaggtacataatatcaactctgattactgctgtaatgttttccaggcatgcttggtgatgagcctggcatatgaaacaatttcctacagtaataaaactaattaaagtaggcagtcatccacacaacacttcctaatgaattataataagctcattaatctcatctgttcttattccaaaaagaccactaataggacctgtaggtaagagtacaatcctcagccttaaaaatggacagctatcatgaagtcagacttaaggatttaagttaaaaaattacaaattgctaatcaatgttgtaaatgaaatgtgtaacgtctaaactctgctcagattatttattgacaagatccttttctatttgagttctcctataattgatttaacaaaggaaaaaaatgattcattgtaacataatgactcttcaccacctcaaagattacaattgaattaaccctctcacatatcctcctatatagaccatataagaatcatgaattgagtacttgagatcaagtgataaaaatatagcctgttttctctccacagagggctggagtatcttcttaaaatgtcaaagtataataataattattcttttgttaactcttctacagctttgtgaggtgcctgatcaaacaatgtaactaattattattccattcaggtacagatagtttggtaacatagatgtattgttctagaaacagttttacagtaaaagagataaggttgtaaaatataaaacatggagagacgatttttgaactacaaatgtgaatagtaagaaaagatcactttaaggggaattttgttttatcttcattgtaagttgatgttttttaaatgcagcagtttctgttctaaagctgattactactgtgccacatgtatggacttctttccttagaagtgacttataaatatgtagatttcacaattaatgcagaataatgataatgggttaatcgtaaataggaaggtacatttttcacttatggaatgatcatgttcaaaattgttatccacatttataaatttttagctaatatttcatattctttgtggagtaagagattggatatttggcacagaggattttcttttgtaaaacagatatttaaaaatacgaccactttggtaggtagaggttttccttagcctatcactgaggaaaatgtctcccaatctagaatcaactatctagttgccatgtgtgtgaaggagagttggttctgtgctatgaacaattaggaggcctgactttggcaaagacttctccatcatctagttgtacggccttgagacagcagcttacacagcatgcaatgcatctgtctttataaaatgagggggttaggctagagcagtgtatccccaaatatggaaagtaccagatagtaaattttatgttttcaataattcttggatacaacagtaaaacaattgtactgtatgaggtaatgcaattcctcttttaaattccaattcaattctcctgaaatcaaggaggtaagttttgtgctgtaagtctgtaatacactggcaaatcttactttttgttttgacaaagcaggtagatcacctcatagttactaaaagacaagggagatgtgttgctgaacagaataattttgaatttaagtcttttggttaaaagaagaaaatttcttgaaagttatctcaaagataatagaagattacacaaaagtcttaagaaaatgttcacagctcaaactgaccttgttttgaacacaaatccttatttgagaaagtcttgctccaattagtagacttaattaatgtcacctattaaggtaagctagctatctattgaataaactttggtaatagactttaatgttaataggaaacatgacttatcatcataatatccaacatttgtttaatgcttaacaactaatgtttgttaaatgcttggaagtcaggtactcctaaattatttacatgtattaacacgttagtgttcaccatataggttaatgtttacaacaaccttattaaataagcactaatattttccccattttacaaatgaggaaactgaagtgccaagagatttgagcaatttgagaaaggtcaaacagctggtaaatgacaaagttttaaaaattctgtaagtacccaatactctatgcatttctctctcttattgtttcctatctcaccatccccagtaatccttagttaacttcatcctctccattctcaaccataagcttatatctttcaacattatattcgcagtatctggcacaagataggcactcagaaggtatttgttgaaattcgtatgaatgattaactaatcaatgaatctgtgctataaaacagacaaattaaaaatgcctctaagtgccgggagcggtggctcatgcctgtaatcccagcactttgggaggttgaggcgggtggatcacctgagggtcaagagttcgagaccagcccagccaacatggtgaaaccccatctctactaaaaatacaaaaatcagccaggcgtggtggtgggcgcctgtaatcccagctacttggggggctgaggcaggagaatcgcttgaacctgggagacagaggttgctgtaagctgaggtagtgccattgtactccagcctgggctacagagtgactccatctcaaaaaaaaaaaaaaaaaaaaaagcctgtaagcgtaacttattggactttaagacctcacacttagtacttcctattttcctccttgacttagttttcttctgatcatcaattattaatcatggataatttgaaaactgtgctttcatgaatactagaaaactgtgctttcatgtcagaatgtacaggttcaaatgaatatgccatcacttatctccatctatatacttaactgtgtgactttgaaaaatgtatttaactttctcagtttcagttttattatctgtacaatatagatattaatatctattgtatatagccagcaggattgttgtattaactactttaaacacattaaagtgtgtttaaaaccaccaagaattttcagcgtattgtacatgtgttatgaggcaatataacatcatattgaaatagctagaaattaaagccaaacagtccaactattgctgaagagttctgggagattaggtaaaatgtttacacatctaaagcattaatgtctcaatgcttaatcacaaaatacaagttcctaactcagggcaattttaagggctagatttgataatatgttcagagtgcctggcatacagttaaaaccaaataaatatttgttgatcttgtttgtcatagtgttccttttcaaaaaaaaaatgttttcttattcatttggtttaatatctggggaaataaaagactcaatactgaatacatttcctagactattttcctggagttctctcaaaaacataaccactatttttgcctgtaaccaaataactcagattatattatcttgaacactgtgctgcttaaagctatgattgcaagtagtagaaaatttaggactaacaaagctaatttgttgagtctgtattttacacatcagtggcaattggaagactatgataggaagaaaatttaaactctatccttgtattcacaactccctaaatagaaagaaatggaattcaagcattcaaaaaatttactggagaagattaatttgaaaatagaatgtgcatgagtgcatggatagatgtatctcttcttggatgactgcaagtaagccttgctatgaaaatatctaagaagcaaaatttattgtaaataagttttccattaaatggcagtatcttattgggaatgcatttcttaaaaaaaaaaaaacacaaaaagaaacccatacactaacatattttttaaaaaaatctatcattctgcaaaccaacacttcagagattacacatttttttctacatcttgccatgtgcttgtggagcaaacatttttttgcagtgaagcaaatgaactacatgtgggataccatgtttaaactagaaggcaccctgcatccctcaagattcccaattccttagagataagggatagagattgttggttgacttaaaaaaaaaactctttattaactctaacattaaaccatattgaattaatttactatgatttatttcaaaaccagatgtgttgataacttggtaaaaattgcttcagacagtatctgagcattttcccagagtactaaggagcaaatctataattcagggccactactatcatcctagttaaatatactttatctccttcttctaatcctagttggtattctcacttcctctcttccaaccttaactactcgtcttatttccctcaatggatcttcctttcagatttatgcaaatattatgtcatatccctgttaaaaaccctttactgcttcattcattctctgtattcttaagataaagtctaagaagcacaaatgatatgacttattttccagtatttcaagtgccattcaatccaattgtgctttgatatttcatctatactaaatatcttttatttctttgaaatttctgtgttctcttttacatattcaggtgttttcttcctctttttctgtggtaaaatcttactcatgcttcttatttcaaggtatacattacttcttcaaaaaagactgggctaggttttcctggaatctaataattatcttacataacgctcatcatactttaaaaaaaaaaaatctgcgtcttgtgcaatttgaatctgtccctagcaccattttatgtgctgctgcattctcagctctttcttttcccaatggttagcatttaacattcacttattcctaaatgctttactgaatgaaagttaaagtaatgtgtgttatgagttcaagctcacaccagacgttcctcatgggttatgcatgtatccttacaatttcagattctgtagcagtcaccttggtgatcccctccccacacagacattcttccttgacactgagcccacgagctgaaaaatacctgatatttttttgaagctacggcttagacatgtgacccaatcctggccaatggaccagaggaaaaaactggatgaaaagtatacttgtgaggagaaaatgtctttccccctattaaatacagttgactgagaacatgctttttggatctgtatttgccttccaacaactctgaagaatcaaatctgaaaaccaacgccaatcctgtgcagatgggtgaaaataaaatatatgatatgtgggcctttgatgatttaaattattctttaaataattcttgtgctgctgaattaaccgagcctggaaccacttacctctagtcaccttgttatataagataatacatataggttctatttcagccacttataagtaggtatctttttatttactgtcaaaagaaccctcactgatatagatgccctcaggacttgaccctccctgagttcctgttaggcagttaaggtaatcatctgttggattagggaagcctagcttatttacttctcagtgtggacaagtttggtctttaacttgtatgctcttgttttccaaaaaggagatagaccagaatcctaaaaaagtaagtctaaacattggtgtccttttacgcttcccatctaaattatctttaagaacatttaagtttcattgatgatccccaaaataattcaagcaaaatgctgagttggtagaatataaggactgttatttatttttattgtttttacagaccacataccctagggaattctgaaaacctgactaacatcaattgaagattggggttcaggaggcctagatgatccaccatgacttattcaaaagttgaagatgaaaggaaagaataaagactctttccatccagttctctagtctgaaaggaaaagaaataggcaaaggacagtaggcttttctatatcattatattcattcaaatgattctcttaaaataataatgaactaaggaggctctgtaagcaagacaaacggtcaggaggcctccttgctccaagaatactccctttttactttattaaaatggtttgtaaaggtaaactaaattgactaaagtatcaatatttccatatatgcgtgatcttttagagaccataaactgtcagtgtattaggctgttcttgcatggctataaagaaatacctgagactaggtgatttataagaaaaggggtataattggcccacagttctgcagactgtacaggaagcatagtagcatgtgcttctggggaggcctcaggaagcttccaatcgtggcggaaggcaaagggaagcaggcacattgcatggtgagaacagaaacaagaacaaggaagggtggctgggaggcgccacataattttaaattaccagatctcacaagaactcactatccggaagacagcacccagccatgagggatccaccctcatgattcaaacacctcccaccaagccccacctccagcactggggatcacaactcgacatgagatttgagcagagacaaatttccaaactatatcactcagaatctggaatagaaagagtatgcaccataacacttttattctctacagaaacagacactgtgctgagctcaaaaaatagtgattcatcaaatatgaatgtgcaaacctcttttgtactgtatctgtggaatcctggttactggggctttgagcccctgtcccataaaatctctgtaatactaacctaactcatggcatttctttaaaatcaaatttaatgaaatgatggacataaagcccatggaactgagtgtgtaatcttctcttatttgattagatgttaaacttgaaacacttttttttgataaaatatgaaatacataaatgagttaaattgttgtgactttccttataagattgaaaacaataaggtgtttttaatactttttttctgtgttctcttgaaagtagctttacatgtattaagcaatcctggctttagatattagggacaataaaaatatctgcaattttcccagttttatatagccattgtttgcaagtatgaaaacctgtcttttgttactgaaatattatcttttattttggcttttttgataacttttatgtttgccttgagcaagtcacttatcttttctatttgtgttttctatttcagtttatttatgaaagacagtaataatgattgtgatgtaccttacaaaaaaagataaaatcgtattgaagagactgttgaatatgaacgcagtgtattaaatgcccgatataggaacaaaaataaaatgaagaacatttctattataaagtattttcctaaatagatttagtactgtgaaaggcagtaaaattatttcctgataaacactttcttgagtattcaaggattaattgcccaggataagaaaaaatccagtcttgattatattgcatatttcctggtcggccttcactgaatagttaattagaataccaccaggaggcgtcttcttgggtcatagatggaatatatttgtgggcaaaaaatatttttccttaaggaatttgtagactaatctaaggaaataaaaatcaattttaacttcaaatttcagcctaattagaagacagtagatcactcacacattcattcattcattcaattaatatttattgaactccttctctgtgaaaattattggactagatgatttgagacgtacaatgacaaaatatgacttctatcctcagatcttatcgttaatagggaagtgaagaaatatatttaaaaaactctattaaggcttttttagtgggtgttgaaacaaaggcagggaaagcagttatgaatatttctaaccagatataaaggcagtggcaatgggaatttaaggaaatgaatgaattaaaataattttcggtgaaaaaggggattgtttgtcagctgcatatggaatgttgggagaaggtgagaagtcaaggacagggatttctttcttttctttctttcttttttttttttttttgagacagtctagctctgtcgcccgggctggagtgcagtggcgcaatcttggctcactgcaagctccacctcccgggttcacgccattctcctgcctcagccttccgagtagctgggactacaggtgccagccatcacgcctggctaatttttctgtttttagtagagatggggtttcaccgtgttagccaggatggtctcgatctcctgtgatcgagatcccccctcctcggcctcccgaagtgcgttttgagacggagtctcgctctgccgcgcaggctggagtgcagtggtgcaattttggctcactgcaacactgtaacctctgcctccctggttcaagtaattctcctgcctcagcctcccgaatagctaggattacgggcataggccaccatgcctggctaatttttctatttttagtagagatggggtttcaccatattggccaggctgggggatttctggtttcttctctaaaagctaaaaagcttggaaggcattactccttccaagcttatttattccttaaaataagaaaaatttgaacaaactgaaaatcaacaatatttcttgggctcatcagataaattaggacataaaactaactgctactcccaaatctagaaaggcaggcgattatagagaaaagcagctaagatccgtttaactgcagcagaagtcactgaaaccataaactggtagggacacttaaatggtaattccgatgaagatctgactgaatgctgagtgtggactagcttgagagtaagaaactcctggggatcacattcttagggaatcccgcacactttgatgactctcacctctagggatcccatcaggttcttacggtaaggaactaagaaaaagcaccttttgtctttgtcagggatggggaaaagtaaccatctgaaatatgcctagagaattctctatacataagcctcttccaaggagaaaacactttaccagtcaaatatttatctcaccaaggagaaagaattcttactgaattccaggcctctctaacctttctgtccacattacatagaagaaataaaactgtgatggttaattttataatatgtgccaatttaatacactaagaaagacacagcccagggatacaggcccacttaagaccagctgtaattgtaagattatagaatgttttccctccccaactttttaacaccacatcaacaggactccagtataataagtgaattatagctgagagagctggaaagcacatgctgcaacttacaaaaaaaaagaaaaaaaactcattaatacaagaatgagagtcaggaatagtagtcagaatcacagaatttttgttgctatttgttgtcattacatttatttattgaaaggtaaaatattaagccagtttaaagactgagataaataggagagagtaaataagctaaaagttactccaaattagaggactttccttatgtagtagcattctgagtgaagaagtgctcaaccttgcccatactgttcctcgtttcatatgcacgtgactagctgaataattcttgaaaaacctgtcttttccccatcatcctggataatggaaagtgttctctatatgaagacaatttatagcacactgtgattataataacaaatagcataccagttatcataaatgcatatgctgattttatatattttggtaatcattcctttattcaactgattttcaataacaatgtgttccaaaagtgaggttacaaggatgaaaatgatgtgttctaattcacatctctagttggttttgataagtctggagctgtggaatgagaaggagtgggaggggactataaatctttgaaatgcttcccagatgatttagaaaaaatttacttccacaccctactgaaaactacctatctagtttgttatgcatatacctcagtatccatatatttcactacatttgacccttgaacaacaagggagatagaggcaccaaccctcatgcagttgaaaatccatgtataacttttgatgcccctcaaccttaactactaacagtctactgttgactagaagtcttactgataacataaacatggttgattaacatgtattttgtttatgtattatatactgtattcttaaagtaagctagagaaaagaaaatgtttttaaggaaatcataagaaaaagaaaatatatactattcattaagtggaagtagattatcataagcatctttatcttcatcctcgtcacattgagtgggctgaggaggaacaggaagatgaagggttggccttgctttctcaggggtggaagaggcagaagaatattcacttataagtggatctacacagttcaaacctgtatattattatttttgagatggagtgcagtggcatgatctcagctcactgcaacctctgcctccagggctcaagggatcctcccacctcagcctcccaagtatatgggactgcagggatgtaccaccatgcccagctaatttttgtatttttttatggagatggggtttcaccatgttgtccaggctggtctggaactcctgggctcaagcaatccaccctccttcgcctcccaaattacaggcatgagccaccacgcccagcccaaacctgtatgtacattaagggtcaactgtatgtagttttcttgttattatgttataatcctgtgacttgactggctctctttttaagatgctagatgttgtgcagctggataaagttcaagtggcaatggaagaacaggaatcatatttacattgataatcaaagtgaatagaaaagtctattactttcaagataatataataccattaaagtgcaaatctctcaatgtgacaaattctgaaaaatacagtttctatgttcgagcaaaataatttgacaattattgacagaaataaggtaccatttacctttatgaaatgttagtttctaaataaatctcaatccaatgccaattaaaactatacgtttaatttgtatgttttaataagttgtcaatttttttttacaatgttaacattttagtagattttacagtaacatctttttgaactgtgactgtgttttttaatttaatgaacaaaatgagtattgcttttctacttgtaaagtgttattaatatccaaaggattaacaaatgccatttttttctgcaattgcttgttatttaggctttttcatcaacatttgttatgtagcaaatactcatatagtttgcattttgtggagctgagaggtacttatgtaaaattgtttccaaactttaccttctccctattctctaaaacaaatttctggcctggtcgacttcaattcttttactccgtagctacagtctgaatggggctgagggggattcttctttgtcagatactttctcaagggctttcataatgcagaatcaaaaggaaagctgggcagatagaaagacgatggctcctaagcaatgttctgtagggcacgtggaagcgcaactgaagtgattcaaggaaactgatagaggagaaaagggcaatattagaaactactgtggtgaactatgtgttctaataatgatgttcaagatatacaaatgaagatcttcagttgttgtgaattttcttttttggtctgaatattttctttggaacacagtaatactcagaaactataacatggttccaataggttatatgattactaaatatctcttaataaatattttatttcccagataatgtattttttctagtacttagagcctttaatactgtaatcattttactcaaagtttagaaattaaaaaaaattaaatcacacataaatctaaaactctagtaaaataattgtcataattttgcatattttcaggtttttcatttaaaattccatttacaaacaaagtgtattttccatttaccacatggacttttgtgtacagaaaatctctctgtttttcctctactctcataccacagcgatcaacaatgaagacatctgtgaccaaatgtgtctgtatggtgggagggttccccacacagagcagcagacaccagctgggtatcctctaatgcaattctgatgctatcttcctgaagatactgtcagatccaatagattgggggctcattccccaagagtcctcttcagacatcagttgcaagtctggccctctgaacatctgagtgaccagcttcaagctgaggtttctataaccccctttttgtgttggattaactttctggagtggctcacagaactcagggaatcactaacttaatttaccagtttattataaagaatattccaaaggatacagatgaagtgaccatagagtgaggtatgggggaagggacacagagcttccttgcccaccctgggcacgcctccttctaggaactctacaccttcattcagatatcctaaagctcttagaacttagttctcttggatttttatggaagcattccttcctccaggatatgaggtgggaccctctcaggggaaggacttaatacaattagaaaagcaggggaagattagagtcctgccccaagaaagaaaggagagagattctgtttcctgaggcctttccctgagatctaatgcacccattataacaaaagactgtagcaaaggccacggagttatgagccaggaactgtggatgaaaaccaatatatattcaatcataacactacaactttgtgactatttttttgaatgcataattttcagtgaaaacatttactatcattgaataacaattttttaatggttgtttacttaggttgctttcaacatttagacattacaatgctggttatctgtcatgtggcctctagttttcagtcttcaaagatgttttcttttaattaataaggcacagatggaatggagatcgagtatgtgtagcagggtatttattcaaattttttcccatgtctggaggtgatacttctcttacaacttgattatgtgtgaaaaggaatttgaacaattgtatgtctccatgaacttcatcatgtactgattagaggtcaaagtgaccttgaccttgatgagattgtctagacattttgaccggcattttgactggcattgtctagatattttgactagaaagtggtgacgcttcctaaatgtggttggtggctgctcaactctctacaagaagtagggtccaccacagtaagttttgcagtttatctgaatgattagatgagtatagtgtgaaggttaaactactgctacatacactgacttaagtaggcagctgcttatgaatcaagttgtgactaaaatatgcacagataagggtactttatttttataacttaaataaaaaacctattactattatattagaaatcctgataagcccatcaatttctaatattatcctatgttagaaataagaataagcacttggagagctttgaggtgaaagactaaggtagaaaatgatcatgggttatgtactctatttttttacatccattcttctttttcttttttcatttatcagttattgaaaaatcagatatcaactcaattacttatatatgatctataaagtgtagccattgaaaattatgggtgtgtctatgtattagtttcctaaggctgtcaaaaaaagtactacaaacaaactgagtggcttagacaatggaaatctattgtcacagttctagaggctagaattctgagatgaaggtgttggtaggaccaagcatcctttaaaggtgctagggaaggatctattctggacctcaagcctggtatctggtagtttcttggtttgtgatggcataactccaatcttcacatggtggttccctgtaggtgtcctttgtgtccaaatttcccctttttaataaggaaactagtcattgtaaaaaggctcacttccctccagtattttctctttttaactaatgatgtctgcaaagaccttatttccaaataatatatcctgacttaccaggagttgggacttcaacataggaattggacagggggccggggagaaacaattcaatcattaacaatcaattacatagttaaagttcattagaaaggcgatcctttatcattgactgactcactgtcaataaaagattagtttatttccttggtttacagatagttctctgcctagttatgtactgaatctcattctttcttaacacctgaaagattttcctcccccaggcattcctctttccctggtatttttaaatcactggatcattttcatcagtgtttaaacttgattaagcttttctatctaacacatacacacacacacacacacaccatctcaatcttgttaacaactattctgttcacaagtttattgaaagaagcttgccttctgataattatgtagttggtagctcactactttttactttcagtttatttctgaactctctgtaatctggactctgcttccaaaacaccatccagagcagctttgataatgtcaacagtgacttacttttttaataagcctggtgaaaactattcagtcttagtttatttcctctctgttatgtctaacataattgatctcactctccttcttaaatttgtttgctcccaaagctattgtgacaccctaatttattttttctcttttgtttgttttcatttttcttcacaatcacttttttgtttttcaactgtttattttctactacatgaatatcctagtgattctcaaatctccattttctgatcagatatttctcttttgagctcatactcacgtagccaatgtctactgatatggtttggctctgtccccacccaaatctcatcttgaattgtaactcccataattctcacttcccacatgtctttggaagaactcggtgggaggtaattgaatcatgggggcacatcttttcctgtgctgttcttgtaatagtgaataagtctcatgaaatctgacagttttaaaaaggggagttcacctgcactagctctttcttcttgcctgctgccattcatgtaagatgtgacttgctcctccttgccttctaccatgattatgaggcctccccagccatgtggaactgtaagcccattaaacttcttttacttcctagtcttgagtatgtctttatcagcagcgtgaaaatggactaatacacctactatatttcttcggctggattttataaggaacatttcaattgaactcattatatattttaccttaaaattccacctgaaattttatttgctctcaacaggagtgagcaatacttccattccactagtatacatgccaaaacataaagttattcttgactctcccttctcatttgcctctctctactccacccatatctgtagagtccatcttctaagtagctttcaaattcacctccataacccatcttagtttaaatcttaattatttctgtgtgaattattaaaataacctttttaacagtctttagccttggtcctatgcagccttttctttataatatcctcagcaaactactgcaggagtaatttatactgtacccagagtaaactgcataaatttaaatatgattataattttccatgattaaaatttattattgatataccatagccttctgaataaaacataatttattgttatggaataaatgactatgatttggtttcttttggtttctctttgccaaggtatacctctccacataagtatactaaaatacttgttccccaaactcttgcctccaggaattttaatgttcctacctttgcttagaaaatacttggctttcttttatcttttactaattccttctgaccattgggattctggatacattttttttccccccagaatgctttctctgactctactaccttggtctatgtgtttgttttcttttgctgtgaggcaaattactacaaactggaacttcccaacaagtttctcatctccatctgagaccacttcagcttgcacttcattgtccagatcactatcagcattttggtcaaagtcattcaacaagtctctaggaagtctcaaactttcccacatcctcctgtcttctgagccctccaagtctctaggaaattccaagctttcccacattttcctgtcttcttctgaggcctccaaactgttctgacctctgcctgttacccagttccaaagtcacttccacattttcaggtatcttaatagcagcaccccactctctgcagtatgaatgtactgtattagtctgctctcatgctgctatgaagaagtactcaagattgagtgatttataaagaaaagagatttaattgatccacagttctgcattgctgtggggggcttagggaacttacaggcatggcagaaagcacctcttcacagggcagcaggaaagagaatgagtgttgagcgaaggaggatgccccttataaaaccatgaaatctcatgaggacttactatcatgaggctaccatggggggaaactgtcccaatgattcaattacctcccactgggtctttcccatgacatgtggggattaagggaactacaattcaagatgagatttgggtagggacacagctaaaccacagcagtgggtaaaatgccatcaaaccacattgcatgctgcagagtaatcttttgtggaaagaagagtcaacaaatgtggtaaacttcattctcttactttaagaaattgccacagccaccccagccttcaataaccatcaccctgatcagtcaacagccatcaacattgaggcaagaccctccaccaacagaaagagtacaactctttgaaggttcagatgattattatttttaataacatatttttaaataaagatacacacttttagccgggtgcagtggctcatacctgtaatcccagcactttgggaggccaaggcgggcggatcacgaggtcaggagatcaagaccatcctggctaacacagtgaaaccccatctctactaaaaatacaaaaaattagccagctacttgggaggctgaggcaggagaatggcttgaacctgggagttggagcttgtagtgagccgagatcgcgccactgcactgcagcctgggctacacagcgagactgtctcaaaaaaaaaaaaaacacacacacacacacgtttataagatgtaatgctattgaacacttaataggctaaagtataggctaaatgtaagttttatatgcactgggaaacccaaaaattcatcaaaataaaacagtttattgtgatatttactttattgcagttgccttgaaccagtcccacagtatctcagaggtatgcccatatatagtattggtttatgttgtgtaactataatctgtagcttcagctaatgttcattgccttcttgcagttcagttttttgactttgcagaatccctgataccagtgtttaaggtgagtcatattatctgtaattcctgcacagcacaatgttgacatctctgcttttttttctcttggaaattttatattgatgctcgagtccatgaaacatttctgaagcgttacttatttttgtattcttcttcattgtcacaattcagcaccccataaaatagggtactatgtatattttaggatctgccagtattaggaaagtcttttctctctagtttttactctcctttgttatcatataaaacctgaagggctttactttctcttttttatctaaaaactgcatatgtattcccaagcactgcccaatgttattcacgctgtcctttccctgtgtctgaaatgtacagggccccagagatggctcagcttctttcttccaggaggatggcagaagggtgcctactacctatagcaaagcccttgtcagcactgtgtcctgtgagatttagcgattcttttgatgatgtgacagaatacatggacactcagacagataaaaggcagaactctttgttacttacagctcaaaggaaagaaggctgccctgtaggaccatgcaataggttgcacgtcggggcaggatagcagcaagctggagctgagggtggcagcttgtgccaggcaggcaaggtgggcaatgcctagttgaacagatttcctgtggctagactaatttagatacttccaagggctctggggaataggggctgtccctagttgcctggtacttggcctggtggatggagtaaaggggagtgctgatagggctggtacctggagtgtgagagcctgataagggaagtgtttggagtgcagatgtttcagctgataaagaaggggtaataactggactctggccaggcctcaaaactgggtcaaggcagcatttaaaaaataaaaacaaaacaaaacaaaaactgtgttacacacttctagaaggtaatggagatgtgtttgatgtctttgaataccttttttctaccaagaaagtaagttcatagtgatgttcaaacataatttcttactttttttttcttttttaaatttaactttcatttaagttcaaggatacatgtgcaggtttgttatgtaggtaaacttgtgtcatgggcatttatggtacagattattttgtcacccaggtattaagcctagtattcattagttatttttcctgatcctttccctcctcccaccctgcagcctccaataggccccagtgtgtgttgttccccactatgtgtccatgtgttcttatcatttagctcccacttataagtgagaacatgcagtatttggttttcttttccttttttgttgaggataatggcctccatccatgttactgcaaaggacgtaatcttattcttttctattgctgcatggtatttcatgatgtttatataccacattttttctatccagtctgccattgatggacatttaggttgattccacgtctttgccattgtgaatagtgctgcaatgaacatatgtgtgcatgtgtctttataatagatttatatttgtttgaatatatacccaggaatgggattgctgtgacaaatggtatttctgtttttaggtctttgaagaatcaccacagtgtcttccacaatggttgaactaatttacactcccaccaacagcgtataagcatttcgtgtcctctgcaactttgccagaagctgttattttttgacttcttaataacacataccattctgtgaggtggtgtctcattgtggttttgatttgcatttctctaatgatcagtgatgttgagcttttttgatatgattgtttgctgaatgtatgtcttctttttgagaagtgtctgctcatgtcctttgtacactttttaatggggttgtttttgtcttgtaagtttgttttagttccttacagatgctgggtattagacctttatcagatgcatagtttgcaaaaatattctctcattctgtaggttgtctgtttactctgttgatactttcttttactatgcagaaggtcttttgtttaattagatgccatttgtccatttttgcttttgttgtaattgcttttggtgttttcataatgaaatatttgcccatgcctatgtcctgaatggtattgcctaagttgtcttccatggcttttatagttttgagttttacatttaagtctttaatccatcttgagtagatttttgtatatgatgtaaggaagaggtccagcttcaatcttctgcatatagctatccagttatcccagcaccatttattgaataaggaatcctttcaccattgcttgtttttgtcagggttgttgaagatcatatatttgtagctgtgtggccttattactgggttctctgttttgttccattggtctaagtgtctgttttgtaccagtaccatgctgttttggttactgtagcctgtatcatagtttgaagttgggtagcttgatgcctccagctttgttctttttgcttacaattgcctttgatattcaggcgttcttttttttccttgttccatttgaattttaaaatagcattttctggttctgtgaagaatgtcagtggtagattaataggaatagcattgaatcagtaaattgctttgggcactatggctattttaatgatattaattattcctatctatgagcatggaatgttttcccatttgtttgtgtcatctgtgatttcttcgagaagtgttttgtagttctctttgtagaggtctttcacttcccttgttagctgtatttctaagtatatttttgtgtgtgtgtggcaactgtaaattggattgcattcctgatttggctctcagcttgacttttattggtgtatagaaatgttactgatttctggctgggtgcggtggctcacacctgtaatcccagcactttgggaggcagagggtgggctgatcacaaggtcaggagttcgagaccagcctggccaacatggtgaaaccccatctctactaaaaatacaacttagctaggcgtggttgcgggcacctgtaatcccaactactcgggagactgaggcagaagaatcacttgaaaccagaaagcagaggttgcagtgagccgagatcgtgccactgcactgcagcatgggcaacaagggcaaaactctgtctcaaaaaaaaaaaaaaaaaggaaacaaagaaatgttcgtgatttctgcacattgattttgcatcctgagactttgctgaagttgtttatcagcttaaggagcttttgggctgagattatggggttttctagatataggatcatgctttctgcaaacagggatagtttgacatcctatcttcctattcggatgtcctttatttctttctcttgcctgattatcctggccaggactttcaatactatgttgaataggagtggtgagagaaggcatccttgtcttttgctggtttttcaggagaatgcttccagcttttgcccattcagtgtagcgttggctgtgggtttgtcatagatggctcctattatttttaggtatgttccttcaatacctagtttatcaaaagtttttaacatgaaagagtgttgagttttattgaatgccttttctgcatctattgaaataattatgtgggttttgtctttagttctgtttatgtgatgaatcacatttatttatttgtgtatgttgaaccaaccttacatctcatggataaagcctacttgattatggtggataagcattttgatgtgctgctggatttgttttgccagtatttttttgagaatttgtgcatcaatgttcataaaaaatattggcctgaagttttttgttgttgtgtctctgccaggttttggtgtcaggatgatgctggcttcatagaatgagttagggaggagtctctccttctcagttatgtgggatagtttcaggaagaaacatactggctcttcctgtacatctagtggaattcagctgtgaatccatctggtcctgggcttttattgttttgaaggctatttgttattgattcaatttcagagcttattattcgtctgttcagggataccatttcttcccgtgctcagtattgggagggtgtatttgtccaggatttattcattttttctagattttctagtttatgttcatagaggtattaataatattttgatttttttttgtatttctgtggggtcagtggtaataccttctttgttgtttctgtttatttggatattatctcttttcttcattagtgtagctagtggtatatctattgtactaaatttaaaaaaaaaaaaaaaaacagctcttggatttgtggatcttttgaagggtttttcttgtccccatctccttcagctttgattttagttatttcttgtcttctgctagctttgtgatttgtttcctcttgattttctacttcttttagttgtgatgttaggttgttaacttgagatctttctaactttttgatgtgggcatttagtgctataattttccctcttaacaccaccttatctgtgtcccagggattctggtacattgtgtcttttttctcatttatttcaaagaactttctgatttcttcctgaattttattatttaccaaaaagtcattcaggagaaagtttttcaattttaatgtaattatatggttttgagttaatttcttagttttgactactaatttgattgtactgtggttcaagacattgttttttatgatttcagttcttttgcatttgctaaggagtgttttactgctactgattttgttatcaattttagagtatgtgccatgtgacaatgaaaagcatgtatattctgttcttttggggtggaaagttctgtagatgtctattagatccatttgatccagtgctgagttcgtgtcttgaagatctttgcttattttctgtcttggtgatctaatattgtcagtgggatgttaaagtctcccatgattattatgtgagagtcaaagtctctttgaaggtctccaataacttgatttatgaatctgggtactcctatgttgggtgcatatatatttaggttagctagatcttattgttgtattgaaccctttaccattatgtattgtccttgtcttttatttttatatttgttggtttaaagtctgttttggctgaaactaggattgcaaccctacttttatctgttttccatttgcttggtagatttttctgcatccctttattttgaacctacgtcattgcatgtgagattagtctcttgaagacagcataccaatgggtcttctgattccttatccagcttgccactcggtgccttttaactggggaatttagcccatttacattcaaggttaatatggatatttatggatttgattctgttatgatgttaactgtttattttgctacttgtttatgtggttgcttcatagtgtcactgatctgtaatttagtttatttttgtagtagctgctaatggtttttcctttctgtatttagtgcttccttcaggagctcttgtaaggcaagtctggtggtaacaaattccctcagcatttgcttgtctgagaaagatcttatttctcctcctcttatgaagcttagtttgacgaggtatgaaattctgggttggaattcttttctttaagaatattgaatataggccgccaatgtcttttggctcatagggtttctgctgagatgtctgctgttagcctgatgggcttccctttgtaggtgacttggcctttctctctagctccctttaacattttgttctttcatttcaaccttggagaatctgaagattatgtctgttggggatgatcttcttataaaatgtgttattgtggttctctgcattttatgaatttgaatgttggcctctctaggtaggttgctgaagttctcatggataatactctgatttatgttttccaagttggctctattctcctgatatttttcaggtacaccaaagagttgtaagtttggtctctttacgtaatgccgtatttctcagaggttttgtttgctcattttcattcttttttctctatatttgtctgactgccttatttcagaaagtcagtcctcaattcatgagattctttccttttcttggtatattctgctgttgatacttgtgattgcattatgaaattcctgtagtgtgtttttcaggtctatcatgttggttacattattttctatattggctattttgtctgtcagcacctgcattatttatcaggatttttagcttccttgtactggattttaatatactcttgtagctcagtgatcttcattcatatccatattctgaattctatttctgtcatttcagccatctcaccctggtttagaacctttgctggagaggtgatgcaatcatttggtggaaaaaaaggccttctggctttttgggttgacacagttcttgcactgattctatttcatctttgtgggcttatctaccttcagtgtttgatattgctgacatttgcatgggtttttaaaaattcttttatcctatttgatgaccttcagggtttgattgtgacattacgtggattcaactgactggctttgtttctggaagattttagggggtcactgcttagcccccaactcctggactatgtgctctcactctgggggcttgtattaagccctgactttgttctcttggctccttgatgttaggaacccactgcactgaggtggggggaggcagtgggtggtggcggaaggtgctttcagaccacaggtcacaacactctgatgggtggtgccagccaaagcattttttagtgcagtaacagtaggatcagtcctcgttctcacgtgctagcagcaacagtagtggcagctgcagcagagtgccagcaggtgccatggttcctgcctcccttcaggcattcaccacagtggtgaaggcaacacagcttggcggtgaggggggtctctgttggcaactgtgtgtatggtcacactggaggtgatgttggctcaggggtggggtgctggtaggcacaggtctgggtgtcttctctgtgtcccggaaggtggagtggtcactcagtacgagggaggatctgctgttcactgtgcagtattagcacaagggcagggtgctggcaggggagaggttggctggttctgtgcctgccaaggctctgtctgctctgcaatggcagttggcggagggtgggggacagacagtctgtgaggtaagcaaagaaaaatccatctgggcagacacacaccagccaagtgatgtgggaccctggggaagctacagtatggggagagagtgtgcaggctggtgtgtggccgtaggcgtcgtgccactggagctctctgcagctcaggcacaatccaccagtgcagaagctatgggctcccaagtaacccgagactgccctgcaagcagtcatggccagtctggggccccaggagaagccagaagactaaggggtgctcaggtcgcgcaggccccatatgatgggcaaaactgcctgacagagttcaggtccagcagttccccatgactaacgtctcctatgggagcaagtcaaaccaagggggtggctatccctggcaatattctgttacacatgctcccacataaaaacctctggactccacatcagctggcttgctgtccttaacacttctttaagcatctctccctgccaacacaagtgtctgtagtggtcaacggggctcctcctgccagtgattcagaggcccatggtgagagcagactgccccttgccagttcaactgacccattccctgggagccactgggggccaggaacaagtcctgttgcacgctggacccgtgcagagttccgagctttctcctgcttcagcccagcttctgtgtcttccttctgtccactcttggtgccttccctctgaaggcctgttaggagcatgccagtcatcttggtcccttggtggtgctgtttcccataatttcttaatttaggaggtttaggtagataaatagataaaatttcctttattcctatgtaaaacacaaaaagccagtaagcatgcttcataacagaaaggaacttttaatataatgttttaaaccattttttcttttcttcttcttatcattattattttttgtagagacgaggtcttaccatgttgcccaggctggtctcatactcttgggctcaggaaatcttccgccttgtcttcccaaaatgttgtgattacacacataagctctgtgactagctttttattttttatttttttcatgtgtagtttacattgtgggaggagacatgtaaacaatttcttaccttgcttaagaaatacaggtagaatatggcatttcctagctatctcctctgggaaacaaaaatgctggaatcaagagactctcacaacctcttaaatgcattactttctcctaaaatgtcttatcaagcaatgccagtgagacagtgtaagttatcgctttatcacttgttgactgtttctgttaagaagctcattgttgataagtttgtaaagcgacttatgtcttaaatatagttccaaatcgatttttaatgaaacccatgggttttaggagatcagaaaactaatttatgttgtgtagtaactcattctatgaccctgggaaatttggttctcattcttctacatgcaaaatactgtcattttaagatagctttagaaaagtaaataccaatgtttatttttaaattttaaattttatgaaagaattggatcaaacaaaaaaataaggaaagacttgagtagtgtttttataaagataggttgaaatgctctgttctcttactgtataatcgaaaaaaatcagtaagatgggctacattacattagaaaagttgtacaacctcattattttttattgttagttcaaaaaaatgaaacaaagaggacactaacaaattggaaatgacaagaacatagtctcatggaacttttttgacatcttaacaaatttatcattgtaagctcatgtttttaacttttccaaaaaatgtaggacttcagtgaattttgttgagaggctgatgaacactttcttggtattatgatatatgtttttcttttatttcatctttgctacaattactttctctgcttactttttatgtctgaaaccctacttattctagaaatgtaatatgttttcaataacaaattaagaaagattgtgatagtaaaacatagttttgtacaaaggagtgttttttaaatgataaagcctctgtacaaatgtaaggtggtattattattttttgaaagatttatatcggtaagaatttttaagatattctaagagtaccattcattgtcaaaaagattatgctgatatccaaacattcttcctcaattgcttgaaaatcttaggagatatgccactgtatcaagagacaatgctatttccttatttgactaatatgctaaaaaaatacatttctaacatactggctttgaacaactgttttctcttgaccatcccgtaaaagataaattattaataatttcaatactaaattaataaatgccatttactttgatcatggatatattttaaaattacattatagtttgtgttttatttgtaaacttcatcaacatttcatataaataccagagaaaatcagagtaaatataatgtctaagaatcatttgtttagttttatttcaaaactgtaaaaaagacttagaatatacaatctatgctattgtttggtaatatattttttagttctttagaatatatgtataattctaggctgggggcgttgtctcacgcctgtaatcccagcactttgggaggccaagcggggtggatcacgaggtcagtagttcaagatcaacctggccaatatggtgaaaccctgcctctactaaaaatacaaaaattagccaggcatggtggtgggtgcctgtagtctcagctacttgggaggctgaggcacgagaatcgcttgaacccgggaggcggagtttgcagtgagccaagatcatgccattccattccagcctgggcaacagagtgagactccatctaaaaaaaaaataaattaattacaaatatataaatataaatatatataatatatattatatgtaaatatatttatatgtatatataaaattctgtgggtaaactatgtgaattttacctctagtaaatgtagttgtataatcagtaaagatatcctaaaaatattatgcttttaaaatttttaaatagtatttcaatagtattcatttaatagtatttaaatagtactcatttaaaaagtacacttactgtaaatcaatggaatgttaatctcttaagtgagcatataaagatagatctacaatgaatttttagttaatgtttataaaaaaattttatagcatcaagtagtaattattaatgctgaaatgatatataaaatattttttaattgttttgcgctaactaataaagaaacaaaattgtggttttcttaaccttgttttcagtatttgagaagcagtgcctcccatggacctatttggatgagtatatacctccactgatttatttcactagctacccaggtgttgcagacagcatgctactttgaaactaagtcaacataagaattatatgaggtcacttatttaggtagagcagaatatattgtcaatgattacacatcgttgtgttttctcatctctgacctctgtccttggccatattccttttttctttcttctttttttttttcacttgttcataaaattctgtccttgtttgccctgataaagttgtctgttttctttgttttttaatcttttgaattttttgtttataagaataaggaaacagcttgtaaatcttacagtaaagccctccagagagaagaccagcagtctacaaatacaaagaaagtcatgatgactcaatgtcaaacttgatgtgtttgagaagccaaaaattatgttcataaatttactggaggaattattgggaggtttgtgagaattagaaattattatttgttttttatttgcattttttaatgtttttgtctttttttaaattatactttaagttctggggtacatgtgcagaacatgcagttttcttacacaggtatacatgtgccacagtggtttgctgcacccatcaacctgtcacgtactttaggtatttctctaatgttatccctcccttagtcccccaccccctgacaggccttgctgtgtgatgttcccctctctatgtccatgtgttctcattgttaaactcccactgattagtgagaacatgtggtgtttggttttctgtccttgtgatagtttgctgagaatgatggtttccagcttgttctatgtccctgcaaaggacatgaactcatccttttttatggctgcatagtattccatggtgtatatctgccacattttctttatccagtctgttattgatggacatttgggttggttccaagtctttgctattgtgaatagtgctgcaataaacatatgtgtgtgtgtgtctttatactagaatgatttataatcccttgggtatatatctggtaatgggattgctgggtcaaatggtatttctagtcctagatccttgaggaatcaccacactgtcttccacaatggttgaactaatttacactcccaccaacagtgtaaaagttttcctatttctccacatcttctccagcatctgttgttttctgacttcttaatgatcaccattctaactggcgtgagatggtgtctcattgtggttttgatttgcatttctctgatgaccagtgatgatgattattttttcttatgtctgttggctgcataaatgtcttcttttgagaaatgtctgttcatatcctttgcccactttttgatggggttgtttgtttttttcttgtaaatttgtttaagttttttgtagattctggttattactcctttgtcagatggatagactgcaaaaattttctcccattctgtaggctgcctgttcactctgatgatagcttcttttgctatgcagaagctctttagtttaattagatcccatttgtcagttttggctttttttgctgttgcttttggtgttttagacatgaagtctttgtccatgcctatgtcttgaatggtattgcccaagttttcttctagaatttttatggtcctaggttttacgtttaagtctttgatacatcttgagttgatttttgtataaggtgtaaggaagggggtccagtttcagttttctgcatacgtctagccagttttcccaacaacatttattaaatagggaatattttccctattgcttgtttgtgtcagatttgtcaaagatcagatggttgtagatgtgtggtgttatttctgaggcctctgttctgttccattggtctatgtgtctgttttggtaccagtaccatgctgttttggttactgtagcatttcagcataatattattgttcaaaataatttatggattttacttgcttttagtttttgacatttgatttctatttagttaatagtcttaaacaatgagataattccaaatacaggcaaaatgcattataaaatgtataagactggagtcaggaaactgaacctgggacaaactacccaaatttctgagtatgtggctgtaactttccggatttataaaatagaagtacaggaatgaaatcacttgtatgtaattttttatccgtatttcagattctttagtaggttatatcataagaacataaatattgctgatatacttgaaatgagctatttgaaaatcattgcaaatataatttaaatcacaaaaatcaaaaattaaatcacaaaatatttactttaaaaaatttactgtatgcatttttacacaactataatgacataatttacactaatctgaactataatagagtttgtctctatgtttagatgatcttgtaacaagttatttcaaaatttagtggcttaaaactataattttatttagttcacaattttctatgtcaagaacttgggaatgattcaactgggaagttctagccttgtgtttctcaggcagttagagtgagatgttagctgagactttagtcacctgaagactccaccagcctagatgtccaaggtagctcatactcacagtattcaacacccagcattcaacaccggttgatgttgggtgtcctttgggagctcagtgaagctgtcagtggaagcgccatgtggtttctgcttctcagcatggctactgggttctttctgcaaaggagtaacctcagaaggagcattataactgaccatgatggaaggcctttcctgatctaatcctgaaagtcatgcagagtcatcatattctattaatcattgcaagtcaataagactagccaagatgcaaggacaggaacattagactccacttttcaataggaatactagcaaagggtttatagctgtctttaatctaccacactgagttccatatttatggataattattgaattaagaaataatagaattgaattttagttcaaaaattaattacacttgaatgagaaagagaatgtcataattattaaattatatttttcctatcaatgaataatatgcatttttacaagcacagggtcaaattggttacattagcctacaggttaatggaataacttcattttgaataccaagaatattaaaatcctgttcattctacacatcaatatgatttctaactcaatagatcatccttaaaaatatgttctagaattttgcaaatacaatgagaattttgatgggttattgctatcaaccctcatttgagagtaagagttgtttaaaggctttcattttgcctgctagatagatattttaggttggtgcagaagcaattgcagtttttgttatatagtaatggcaaaagcctaaattacttttgcaccaagctaatatttatgtgaatgttgccactgtatatatacaactaaagacaaaatgctgggtagcaaaaattcatttgcaaagccattcatagagaagacttttataaattgtcttcttatggcatataataaatattttatatgtgttattccataaatgaatgtaaatgatatattagcatctatccagtttaatgtggtgagattgtgaactccttcagaaattttcctgggaataaaatctgagaattttttaaatgagcataattttggaaaactgagtttctttgcagttcctagtagccacaatatagggaaatgttccattttaaactatttaattaacaaaatgttaattaatacaaaaatactgttgttaattgttcaacaaaaacaactgtagtagatataggccaaatctcagatcccatctcaataaaggactcactgaccagcttccaggagtgtggctagcccactacagcattagctttttcaagggtcagcctcagctctccagatgaagttcaagctcatcactgggtgatctgaagcaaaggctgagatctagctattcatgaggcactccccaaccaatgagtgaacaagggagtagtacaagagccaacccacttttgctcaacagggggatttctgtaacaggaaatcttagctatgagcccctcatttggctcatagagaatttgttagtaggaatcaaggtttgactgtcccctactcaatcctgaatcctcttcttttttttttttcttcacatttcctttcctttcccttccttaataaactttatgtatccttaactccatttgattcctggagaaccaacttgtgacattttattttatgaataaaattaacttttcttaagtgacatattatgcaagactttggtaatataagtagtaatacaatagagtttttgtcgtaaggtggttatagtttggtgtcatcatcaacctccacagaaatttccatgggactaaagaagttaagtaactagcacagaactacctggctagttacttgtagcatccaggatttgatcctgtatctctctgattgtaagaatcatgattattatcttacctgcatcctactatgctaatattaatatttcctttgcaatgtagagcaggtaaaaccttttaccattaacagtaatatttagagtctaggagtataagtattaaaaatgagtataatccttgtccataatacccaagatttggggaagaaattggactactgtaaaagaggtggaacagaaagagttaataagcatcttccttgtagtcaagctggttgtcagcaaatgaaaagatatattaataaattacaactaagctaggtgtggtggctcacacttgtagtcctacctcttcaaggggccaaggtaggaagtttgaggccagcatggacaacataaagcaactccatctcaacaaaatattttaaaagtttctgggtaaaataatgaccatggtgaaaatcgaatcaagaactcagtctcatttacatttgcaaaaaaaaaaaaacttatgaatatacttaaccaaggagatgaaagagctctgtaaggactataaaacactgatgaaaaaaatcatatatgacataaaaaatggaaatacatcctatgcttaagctcatggactgttagaatcaaaattgtgaaaatgaccatattgtccaaagcaatccaaagattcaatgcaattcctataaaaataccccaacgtcattttttgcagaattaggaaaaaaaaattttaaaacttatgtggaaccaaaaaagagtgctaatagccaaagtaatcctaagcaaaaagaataaatctggaggcatcatattacttcaaattttactacaaggctatagtaaccaaaacaatatggtacctgtataaaagtagatacatagaccattggaacagaatagagaacccagaaataaaaccaaatgcaacagccagctgatctttgacaaagccaacaaaaacatacactgagcaaagaacaccctattcaataaatgatgctggaaaaattggatagccagatgtagaagaatgaaactggatccctattctcaccatgtacaaaaattaacggaagatggattaaagacttaaatctaagccctaaaaccataaaaattatattagaaaacctaagagaaacgattctggacattggcttaggcaaagaatttttgactatgaccccaaaaacaaatgtaacaaaaaggaaaataaataaatgagacctaattaaacttaaaagcttctatacaacaaaagaaataatcaacagagtaaacagacaacttatagaatgagagaaaatatttgccacctgtacatcgacaaagaactaatatccagaatctacaagcaactcaaatcagcaagaaaaaaaataaataatcccatcaaaaagtgggtaaatgacataagcagacattcctcaaaataagatatacaaatggccaacaaaccatatgaaaaaatgctcaacatcactaaccagcagggaaatgtccattaaaaccacaatgagatgtcactttatccagaataaccattattaaaaaatcaaaagacaatagatgttaccatggatgtggtaaatggtgaaaatggaatacttatgcactgctgatgagactataaattagtacaacctctggaaaatattatggagatttctcaaagaactaaaagtacctctattattaaattcagcaatctcactactgggtatctacccaaaggaaaagaaatcattatatcaaaaagacatgtgcatgcatatgtttaccacagcacaattcacaattacaaagatatggaatcaatttaagtgcccatcaactgataaatgtataaagaaaacatggtattataagtcaggcacggtggctgatgtccgtaatcccaacattttgggatgctggggtaggaggatcacttgagcccaggaatttaagaacagtctgagcaacaaagtgagaccccatttccacacacacacacacacaattagctaggcatggtagcatatgcctgtagtcctagctactcaagaggctgaggcaggaggatcctttaagcataggaggttgaggttacagtaagctgatcatactactgtactccagccttggtgaagagcaagatcatacacacacacacacacacacacacacacacgcacacacacagcacacactgtggaatactatttagccataaaaataacaaactagtgaaagtattttgcagcaacttggaagtaattcaggaatggaaaactaaataccccatgttcttatttataagtgggagctaagctgtgggtatgcaaagccagagtgatataatagacactggagacttagaagcagggaagtgtgaagggagtgaggggtgaaaaattacctattgggtacaatgtacactatttaagtgataagtacactaaaatcctagacttcaccactatacaattcatccatgtaaccaaaaaccacttgtacccctaaagctatagaaataataataacaaaccaatgaaaataaaattaaaaaaataataaggtaaaaaaaaaaagttagttggatgtggtggtgcatgcctgcagtcctagctacttgggaggccgaggcaggaagattacttgagcccaggactttgaggttacagtgagccttgattgagccattgcactccagactactagacagagtgataccctgtctctaaataaatgaataagaactatacattctttgtagttcagtatggaagaagtagaaattctaccatgagaaccagaataaacaggtattatgttttctctaatcctttagatgtttttggttgttgttgttccttgtcagctcagataagggtgccagatttcagagaaaatgggtatactgctgtttatactgcttatttggtaattgtattggaaaaaaacatgaatttgagcatcttctttttttcaaatagagatggtgtttcactgtgttacccaagctagtcttgaagtcctgggctcaagctatcctccttccttggcctcccaaagtgctgggattacaagcgagagccaccatggccagccaaatttgatcaccttatatgtgtcagttattatgtttggtgctagtaatatggtaatgcaatagaaactatatgctcaaatagggaataaaactagttcagtgaggccaggaacagtggctcatgcctgtaatcccagcactttgagaggtcaaggtgggcagatcacctgaggtctggagtttgaggccagcctggccaacatggtgaaaccccgtctctactaaaaatacaaaaaattagccaggtgtggtggcacgtgcctgtaatcccagctactcgggaggctgaggcaggagaattgaacctgggaggcagatgttgcggtgagccgagattgtgccaaggcactccagcctgggcaacaagagcgagactccctctcaacaacaacaacaacaacaacaacaacaacaacaaccaaaactagttcagtgaggttggggaacaagcaaacaacactttaagtattgcatgaaatgatgtatggtatggatgctatggagcattcccaaaggggtgtgccacttggccaaaaaggaaaatctttctagtgaaataaagagtaattcttttttttttttttttttgagacggagtctcgctctgtcgcccaggctggagtgcagtggcgcgatctcggctcactacaaggcccgcctcccgggttcacgccattctcctgcctcagcctcctgagtagctgggactacaggtgcccaccaccgcgcccaactaattttttgtatttttagtagagacggggtttcattgtgttagccaggatggtctcgatctcctgtctcctgacgttgtgatccgcccgcgtcggccttccaaagtgctggggttacaggcatgagccaccgcatccggcaggagtaattcttgagatgtgtcttggagcatgaggtattgtgagggagagaaggatacaacgggtagaaggcaataaaatccagaaatttgcatgtgtaaagtgaggagatgtgaaacaacattgcatttcagtgctgtaggaatgaacaaagtgaggaggttgaaagtcaaaaacttgcagctccggaaataagcaagtaacagttaatgaagggtacaatacactatgctgaagagttttgattttcttcctgaaggagaagatgattagctgttaaattaggaagtgacaaaattaattcctgcttagaaaaatctctctggcaaataaggaaagtgatagagataaaggaaaaatcactttagagacaattacagaaatttgggtaagaagcaacaagtacttagactgtcaatgtggaatggagaggagtaagtccaagaaatagtgaagaagtggagattaaatttggttccagatttggttcaaagtgagtagcagctgagcgtatatgatggcttcctgattattaatttaggaaataggaagataatggggaaatcagcagaagtgaagtcttaaggtggcggaagaggatgttgaattggagtgtctgtggaacaatattgagtatatgtttagtgagtagttgtacttaagagctggagcttggaatacagataattctggattagctagttgtatcttgtagttactagctgtattagtcagggttctttagagtgacagaactgatggaatatatatatacacacacacacacacacacacacatatatacacttaataaactcacatatatatacacatatatatatatatatatataaacacatatatatatatgagtttattaagtattaactcacatgattacaaggtccacaataggccatctgcaggctgagaagcaaggagagccagtccaaattccaaaactgaagaacttggagtccaatgttcaagggcaggaagcatccagcacaggagaaatatgtaggctgggaggctaggccactctctcttttcacatttttctgcctgcttatattctagccattctggcagctgattagattgtgcccccccagattaagggtgagtctgcctttcccagctcactgactcaaatgttaatctccattggcaacagcctcacagacacaccctggatcaataccctgtatccttcaatccaatgaatttgatactcagtattaaccatcacaccagcatagagtagtagaggccatggatgtggatatattgtgtacattgaggtcgtggttgggtgtacatgcagagtgagaagattaaatgcccaaagattgagctctagtgaaaggcacaattgttacagggacatcactaaagatgagcactgtaacatggatattggtttgagaattaatatttaattatagccagggaccaaatggtagatatagtatctatactagtccattttcacaccactataaagaacaacctgagactgggtaatacataaaacaaagagatttaattgactcacaattctgtgtggctggagaggcctaaggaaacttaaaatcatggcggaaggctgaggggaagcaaggtacttcttcacaaagcagcaggagagagagagagcttaagggaaactgccacttttaagccatcagatctcatgagaactccctcagtatcaccagaacagcataggggaaaccacccccatgatccaatcacctcccaccaggtctctcctgtgacacatgggaattacaatttaagatgagatttgggtgggatcacagagacaaaccatttcattctgtccctggcccctcccaaatctcacattcttgtcacatttgaaaaccaatcttgccttcacaacagtcccccaaagtctaactcattacagcattaactcaaaagtccaagtccaaagtctcatctgagacaaggcaaatctctttcatctatgagcctgtaaaatcaaaagcaagttacttaacttccaagctacaatggaggtacaggcaatgggtaaatgttcttattccaaatgaaaggaattggccaaaacaaaagggccacaggcctcatgcaattctgaaacctggtgggccagtcattaaatcttaaagctccaaaatctcatttgactctgtgtcttacatccagggaatgccgatgcaagggatggactcccatggccttgggcagctccacccctgtggctctgtggggtatatcccctgcggctcctttcacagcctggtggtgagtgcctgatatagtttggctgtgtccccacccaaatctcaacttgaattgtatctcccagaattcccacatgttgtgggaggaaccccgggggaggtaattgaatcacaggggctgttctttcctatgctattctcgtgattgtgcataagtctcacagatctgatgggttcatcaggggtttccacttttgcttcttcctcattttctcttgccactgccatgtaagtagcatctttcacctcctgccatgattctgaggcctccccatccatgtgaaactataagtccaattaaacctctttttctttccattctcagatacgtctttatcagcagcatgaaaatggactaatacagtgcctgtggcttttccaggcacatggtgcaagctgttggtggatctatgattctggggtctggaggacagtgaccctcttctcacagttcccctaagcagtgccccagtggggattctgtgtgggtggctccaaccccacatgtcccttctgcactgccctagcagaggttctccttaagggctctacccctgcagcagacttctgcctgaacatccaggcatttccatacattctctgaaatctaggcagaggttcccaaacctcaactcttatcctctgtgtgcccgcaggcccaacaccacatgtaagccaccaatgcttggggcttgtaccctctgaagaaagacctgggctgtacgttggcccctattagccatgactggagctagagcagctgggatgcaggctgccatggcccaaggctacacagagcagcagggccctggacacagcccacaaaaccatttttcactcctaagcctcctggcctgtaatgggagaggctgcttcccttgttgggagaggctcctgtacggtgatgggaggctgcagtgaagatctctgaaatgacctggagacattttccccattgtcttggctataacatttggctcttcattacttaggcaattttctgcagtcatcttgaatttttccccagaaaatgggtttttcttttctacctcatggtcaggctgcaaatttttcaaacttttatgctctgcttctcttttaaataaaagtgcctgtttccaataatttgtttttgaatgcatatgactgaatgcatttggaatcagccaggtcacctcttgaatgctttgctgcttcgaaatttcttccaccaggtaccttaaatcatgtctctctagttcaaagtttcacagatctgtagggcagtggcaaaatggcaccaggctctttgctaaagcatagcaatagtgacctttactccagttcccaataagttccttatcttcatttgagactacctcagcctggactttgttgaccaaatcaccataacattttaatcaaaaccattttagtttctaggaagctccaaactttctcacatcttcctgtcttctgagccctccaaactgttccaacctctgcccattacccagtttcaaaggtgcttccacattttcagtttatctttatagcagtgccccactccaatcaccaattttctgtattatccattttcacattgcaataaagaatgatctaagactgggtatttatacaggaaaaaggtttaattgattcacagtttctcatgactggggaagcctcaggaaacttacaatcatggtggaaggctaatgggaagtaagggatgtcctcccaaagtggcaggagtcagagagtctcagggaaaactgccacttttaaaccatcagatctcatgagaactttctcactatcatgagaatatcatgggagaaaccacccccatgatccaatcacctcccaccaggtccctccctccacacgtggggattacaattcgtgatgagatttgggtggggacactgagccaagccatatcagtatctttttaaatgtagagttatttctgttctacttactatgtatgcacaaacatgagagggaataatttaggaaggtttcctggtttctgtcataggcaaataaatcgatagaggaataccaaaaacaaaacaaaaaactaagcaaaaacatatgtgtgtgtggatgtgtgtgtgtgtgtgtgtgtctacatgattatgtgtagcataaaagcattttttggatacattaacttattttttgcaactaagaatatattatgaaaaatatcatactatagagggaatttgagtttcgttagtcagatgcaattatctcccactgtgtgaagctgactttccttatcaagagcaaagtaaaagggctaagcctattatgctgtctctttgatgtttttataggatataatgaaagatgaatgctcgatgctcaagctgcagctgaaagagaaggatgaactcatttcccaacttcaggaagagctggtaagtgataacaatgcttggcccacgagtgtactttactttcaaggttatttgttccacgcccttatttattaacaccaatggcattagttatttgtaaatccttccagtggttcaatccaatgatcagtttttataattctgtcatgaaaactatagatctttgacaagctgaagaatagaaaggatgttttataatatatgtggaaatgtatatggttccagaaacatatcactgaaccaggattaaacatttcggttgtatctatcagaaatcttgaaggcttaggccacattgtttttgtaaagtgcatgatttaactccataaagctatacctaaagatacagatctataatataaagcaaaatacttgatctagcaaacaaaaccagattttacattttacttttataaagccatcaaaaatacattaacctaatgagacttcttgttaatttattatatagttcccaaattatgtaaaaattatacaaaaatatgcagtgtgtgtggttcaggttttagagtatggtttttaatgtaatatcatgaaagaaagtaaggaattacactttcataatataaaaatacatttggtagatagcagacagagcagtgggcattattttttctaagtatgtgttttctatgtatctatgaatattaacagtattttgcaataaaatgtgcactcaatataaattttaaaagatagtactctaaaacaataattaaatagaaagaaataagaagagatatttttaattcatcattcatttttacactaataatagattaaagaaataaccatgcaataagagagaccctgactcattatcaagatcaagaaacaaatccttctcaacgtatttttaatgattatttcagactcacaatagtgtattatgtaattattgaacacaactaaattacaaaacagactttatagaccatcgaacttctgaggactcctaacatattagtgagatattggagaaattcagagcatagtttatagactcttcacaactgacaatgttttccctgaaacttgatctttatttaaacagtgttctaggattggattgatgctgatccttggtcccattaacatgttactgtggctttagaagacttataaactagtacttagcataagaatagtatcacagacaaaaggaacacgtgttacattaccaaaataaccttttataaacctgtaagtaacatattgtagtgtcaattttatatattacataatgaaaacatttctttatttaaatatagccctctaggtacatattatctaataatgcttttttacgttgcatacaaaaatatctttgagttgactaaatatcacctatagatatttattgcataatggttaaaataatcaattttaacatagcagagtatttattactttgtcagagagtgcttattttgaacttgggtaattaactcagaaaagagtattctttttttctcagcattagttatgatcagttttaaaacattcatatacaagaaattggaccttcatttgctgaattaaatgaaaaagaaaatgattactttcaaagacagtactacatagttataatttaaaaaatttagtatacctccatctaaaaaagtcctatatatttctttttcttttctttatacttgaattactcaaattggctacttagtttctaaaatttctcagggaacaatcaagcagcattttaattttgtgctattgtagtttccataatcatcttgaataaacaggaaaaatgttaactttaaaaaaaatatagtttattttattaattaaaaaggactgcagctaagggagaagtatgtaattggtgattcaagaattttacttagaggaaacatggttggaaaaaaaattgtcattcaaactggatttggagcatggataagaaatgccaatcatgtaggccaatacaaaccccttgcatccacggaaaattttggtcctcctatttctggtcctggtaataaataacttgtgacattttgttatggtggaggttaaattttacacttatgctttacttacattgaaaatttcaaaaaattttagaaaccagttgagttataccctactatatactacaggttcataatctttaataatttagaactgattcagttttctattctttctcatgggtttctgatttcttgaccactgttattatcacaagcaattgtatctacatgtatgctgtagaatgaaattagatgtaattgtaccaagaaaggctttattcccaattagtaattaagaaagttttaaattttttgattatttatatttttgagttagcctcatcaatagtgggaagagttgtaaaaagttagggacagaatgggtctagaaaaaaagaaatgtttttcttttcttttttttctttttttttttttttaagatagaatcttgctctgtcaccaggctggagtgcagtggcatgatctcagctcactgtgcaacctccacctcctgggttcaagcgattctcttgcctcagcctcccaagaagctgggaccacaggcacacgccacagtgcccggctaatttttgtatttttagtagagacgaggtttcgccatgttggctagctggtcttgaactccttacctcaaattatctgcccacctcggtttcccaaagtgctgggattacagatgtgagccaccactctgggccataacaagttttttagtcatttaaatgcaagtgttttagtcatttgtttttagggcatggtttctgaacaatagtgctggtggcactttgttgtgtctgtgctatgaattgtaggacgtttagcagcatccctagcctctctcctctagatgccagtagcacctctacacattgccaaatgtcccatgggggcaaaattgcctccaggtgagaaccactgctacagggatattagattaaatgtgtagtccccaatgaaatggtatgttatagaaaaaacatctatttatagatacccaggaaaaaaacaaaaaactccagcacaagagatgcacctttccttgggctattaaatatgtaactgtttgtacactgtatttatctactaaggctaccaaaacaaaatgccatagatggggtggcttaaacaactaaagtctatttgtcagatttctggaggatagaagtctgagatccggtgccagagtgttgggattgtggtgagggctgtcttcctggcttgcagatggccatcttttcggtatgtgctcccatggtctttccttggtgcatgcacatagggagagagagagaagagggagaaagagagatcatgtgagccctctgatgtctcttcttctaaagacactaatcctgtcataaggaccctacctcatggcctcatcaaaactcccatcatctcccaaaggtcctatctccaaatatcatcacgccgggagtcagggcttcaatacatgaattgtggagcagggggaacaattcagtacatagcacatactctttgtgctcatgactgtttaatattagcaagttcagttgtggaaaattagagagttctactatatatttttttccagcattaaatgcacgtttcaaaaattattcttttctaccatatgatttcaaaattattacattgccttaattcttttttattgctgggtgggtagatttcacaaagcataaagacactgagaaactgaaaataataatttcgatttaggattatatattgatattatttgggtaaactattcagattattaattgcatttctaatgtgaatgtatttttgtattttatagccacacttccaatttattccttctttttaaaaagaaaacaataagctgtttgtactcttaggaacaattttaaaaagtcaagacttattatccctgaaatatttatgcattacttaccttggtgagatttactgttttcaacagatcgagataaaaataatcacttgtaattgttttattatgtccaaagggatattaaatgttagaatattacagtgtcctgggattatgtgctagggaaactaattggagaaaacgagacatacattctgtagccagaagtttgcagtatggtaaacagagaggaaactagttcacagcatggaacatctactcccaactgttctataatagaacaaaatctcctctgcattaaataagaaatagagcaaaggaaaaatttcttctcttcatcttcctggggccttagctttctttacttgaggagaagagtgagtcaatatggtgatatggaaaattgggatatgagtttcttgtcctacctctaatcttaattgcctatgtgaccagatttaggtatttttctctatttgggcattggtttcttcaactgtcaaataataccactgtatgttttggtctgttttgtgctgttctaacaaaatatcacagactggataatttatggtaatttataaaaacagaaatatatttctcatagttctagaggctgctaagttcaagatcaaggagctagcaggttagggcccatctctctgcttccaagatggtgccttgaaagctgagggaaggaatgcttgtcctcacatgatagaaaggcagaagagtatgaatctgctcctgcaagcccgttttatagcagctttagtatatacatgacatggaagccttcacgagctaaacatctctccataggtggcacttcccaacactgtttgggattaagttttcaatgacagaatttggggcgacatactcagaccataggaccataacattaaaaatattacatatttatcaatagtgaatttgatagattatagcatatttatatttatataactgtattatatattatatatatttttatagctatgttgcttataaaattattaagtggagggaaaagcagattttagaacagcatattgtataacacgatgtgaaaaacgtatattgtatagaaagtctagaataattaatagtatttaactttgagaaattagactgctcaatttctgctttaatttggtaatgtgtcatttttaataacaaatatattacttgtataatcagaaaaacaccagactacttctttggaaaataaatgaagaatttcaatgtgtttaatggttttcattccgtgatcagtgtgtgttgggggaaataagggccgcagagggatcctgtggatttctattccccacccacttaatgatagtagccctcatttcattgttttttgcatgtcattacttattacagtatcatttcaatcaataagcagtttttatttaatgcatatcattatactcctaagattttatttgatgaaaaaccacagctgagaacaaaatcaagcaaacaaaccaaaaccctgaacaagatgattgctaagaactactgcgaactattaaacagggtgggaaatgagaacaaaagctatgacatacacctcagtgagaattattacacatcatggtgattggagagaatattagctaattgagggcatggaaaagaaccaacgttcagaatcaaaaataaaaggaggacttttttgataattaaatgtttggataaatagtttaaaatataggttctatttatgttgtagaatatattggactttttgaatattagaaatacatcactcttatccaacagaaagatttagggattttactaatttaatttattaagatatttaaagcagagctatagatttagaccaaaagtctaaacataatagctaaacgtatgcatacttaatcataattaattataataaaaggtattttaaatatttgcatcataagtttaatttattacacttaatgatataaaacagagagatatttttctcacttctgagaaagtttcagtgtctttccctcagctattttgtgaaggttatgttgaagaatgccatgtaattttattgcttatatgatactgaagggcactgtaaatattatcctcaggttactaaaataaatttgagatatttgtcataaatgttgatggtgaagtgtagtcttgtgttttggggggatggatatgttcttgtaaatgattattaatcttatcagtggtttcaaaaatcttatacatggttttacactatggatgaagagtgtgtaccatacgacatcagaaattgaagaaagtatatttggtatttattaataaattaattcaaaatattttttaagtaagttagagttaaattacaaatgaaaacataataaatttagttagttctatgaccgtgaagagaagaatttaattgtcctaattaaggttagtagacggtgctgtgaatttactgttttaacttggatgacaatttacatatacactttcaaaaatgttaaacagatttgtatggataatcacattactaaatgtaagttgtcagcagtttatatttctgaacttttggggtttctaccattcagaattttcctgttggacacttttatttgttttctagccgatcggggtaaaatgtatcagatacagctttctatgtctatttctgtaaaaacatatgtgttttggctgggcctggtgactcacgcctgtaatcccagcacgttgggaggccaaggcgggcgaatcacgaggtcaggagtttgagtccagcatggccaacatggtgaaacctcatctctactaaaaatacaaaacattagctgggcgtggtggcgggcacctgtaatcccagccactcccgaggctgagacaggagaatcgtttgaacctgggaggcggaggctgcagtgagctgataacgtgccattgcactccagcctgggggacagagtgagactccatctcaaaaaaaaaaaaaaaaaaaaaagtttctatttaaaagtccaattcaaatgggtcaccggaaaaacaaaatagattttctgaaaaagtaagtttattagccctctgtaaaataaacactttaataacagcccttaataacattatttaaacaaaaaagcaaaacaaaaatacttattatgttttctttcataatcttcctctgtttactaacattacaacaactatacttttcaatgctagtgaaatttaagttacctctgtttactaacattacaacatctatacttttcaatgctagtgaaatttaagttaccttcaccaccacatctttttaagcagtaagggaatacattgactgtaggaataatgtatgactattatcagaggcaaaaatttaaaacatgtcggtaatgagagactctttcctaagaagatttttttgtgggtctgaattctaaatgtaggttatgattaagttttaaacttcacacacacacatacatacacacacacacacatttttccccacacactttaaaatttttttcaattatcacatttttttaattacctgtcctttaataaacaatgcatttttaaatggaagtttaactaggagatttcagttatggagctgaaacactcaacgattccaccacacatttttattttgagagttaagtttgtgatcttaagtcagaaccttccaactagctgtaaactgtttgtgtttctaaaatttgaggtgctacttattaatgtattcaaatatagatttcaaaataagcaatgagagcatagttattgtaaagacaaagacatggaacttgagatacttaaattatatcagttaatagtaaccatttggagtatttatttgtatttaagattcaaaacaaaagaatagtgtgtgaaccgtgagctctctattttggggggggatgtttggacattttagtttataattaaatattttactgaattttaataatatcttcaaaactgaactttattttttattttaaaatgttaattttacttttaaaattaaagcacaattaaaaaataaatgttacatcaagagcgtgatttagtaattacctatactgtatcttctgcagactctttttttattaaacaaatattacatttattaaaatttactttttactttttgacatatagtttacacaaagttaaataaaagttttaactagcttcatttcttttctggccattattaatattaatttattgccatattatttaatcctatgtttttcttttagaagaggacggttaaaaataagcttttcaggcatccattataatagatacatcattgagttgaacactttttcctcccgtaatgtaaatatgaactcaagaaagccaggcctcattaaaaaaaatgtttaaaaacatgtatcccttttcgtgttattcaacctactgtgttctcactcaaagcaaatattgaaaattatattcttacttgagtgtaagtaagcatgtaaacaatcatgtttctccaaccttttcaaatgtaatttactttattaactgtaaggcaagttctcggctcatttgttaacaattgaatagcaaaacatgggactgaataaaggcacttgtagaaatgatgatttttgaaaaaaattgaaggcagttgaaaaactgaaagtgtatcattatgtgtaatcaggttactatgcataataaaaagggtgagctaaaaataaaagactaagaaatacatatggctaactagcactttatcagaaatctagagaggagtaattttgatactttcagaattcaaattgaataaaatggtatgcccttgatactttaataacagaataattcctgcatgataagagaaacattctttgtgcatgaaaatcatatcatgaatttatcttaaaagtaattccccacttgctctacattctattataatttatggtattatttcatgctagtcattttagaatagaatattacagctccatggatgatttacatagaaatggacagctgtaagtactttcaaatcctctttctttttcatatttaggaaacattacgaacagaaaagtaatagattaggtatacttaaacattattaaagtgtcaggctactttccttcttttttcaggagaattaattgcatatattccagaaaaggcttatctcagcagtaattactctcctagtcagctctgtaagacagatgtagagtgtgaatgtgacagtatcctatgatacataatggggactgcctccagtttcttacacactccagtaccctgatgaagagctgccaaaaagatacaatctttaatattcaatggaatttgctgtagcaatagtacatatttgttaaagtctttatcacaaagggttgttatattgcagtacagcatggatataagaaaataattgctctatgatttaaatgccaataggaaggtgttttacctttaaggcataaattgagttaaaaatattccaccatattgtgatcaaattaggcatgtagttgaaattaatttatacgtaaagttaaacagttgaatattttggatattttaaatttattatataagctatgtcatacaatttacaaactatcttctttattttatacttcttttgttacactaatcaagattccagtacttagagtaatttaacaaacgcaacaatttaagtagtcagtgggacataatgatagccaaagacttagaaaaaaatatataacgcatgttcctgaattatcatggaaattaataatatgcagaaggggaaatatgtgtttttttgtgtgtaactgggccgtcaaaaacaaaattacagcaaatttagtttaaagatgtaattggcttttattaacaatttatgaatttgtggcatctcatataaagatttacaaaagttcctcctctgggcatggcaaaacaattggtatttttttgtttgttttgtttttgttgttgctttttttttttttttttgagatggagtctcgctctgtcaccagactggagtgtaggggtgcaatctcggatcactgcaacctccacttcccaggttcaagcgattctcctgcctcagcctcctgagttttctgtatttttagtagagacggggtttcgccatattagctaagatggtctcaatctcctgacctcgtgatccacctgcctcgtcctcccaaagtgctgggattacaggcctgagtcaccgcactcagcacaacaattgttttttataaggtactttgaataggaacaaggaaacaagctaatacaaaaagtggattgtttaacatcaggttacttcatgttactttccttgtaagagttaaagtggaggaaacttccttattatgcccaataaaaactagcttgtttgggatttggctatcacctctacatgatttcttggaaggccagaaaaataagttaccttgagtttggtgacgtggaatcttaacatgaatgactccattttggttcagtcttttggactctagtacagaagctcagtccaaaacaatggcctcctcctttatttaactgtatgtatataaataaacatgtaatgttctacttcacaataaagtatgtttaaaaatttgaaagtcagtctgagccggggactttgactggagcaagtgttaacatgatgaaggagtagagtggtatctgtcctcaaggaagcaaagggagataggcttacataattttaataacaacagccactagctactgagctcctaacctttgacaggtactgtgaatgctttaggtttattattgcctttactttttataatacaattgagaaataagtattattactcccagttcattcataataaactaaattcagggggattatgtgattcgtttaattctgcataatacatgacagttaagattgagaggaaaatctgtctgactccacgcacatgttattttccctgttacatcaaacagatttataaattacagagagattacaaacatattagtggtataaaataggataacacagttcacttttgctacatatcaataccgaaataaaaataatagctactatttatggattggttaccattcatctggtagtagcagtcagacttgggtggtcagggcagaaactcttgtgatagtgttactggcaaagccggtcccccagaagtggggggtctttccccgttcagtgttacaaagccattatgtgaaactggaaatgagcatcaagcagttcagactttatttgatggccatggaattgagaagtgggagcacagctcacaaatcaacttctcagctcctgagagctggaaagtcacagatagaaggctacttgaattaaggtgttgagcattaaaagcaaggggaggaatatccgtgcagtttctgggaataggcagagaaaatctcagaaccagagtgctgccttccttttatggtttcttctggtcattgtcatgatgattaactgtcatggcactgatgggactttcatttagcatggaaattagattacaataaagttagagtttcttcagaggtcaagtgagctgccatcttggataccactggtttcaactggtctgatcaggttgggaacttcagaccacagacatcctgttcttacaaattaggagagtcaaggtggggtagcaatttagctatgctatacaggcattacactgggtaatgataacaaaacagaaaaatttattttagaggaatcacctacagccacttcttccagccttggaagtgagaatggtgggtttcatcaaaaagcacatagggcatcacagacacatttaatgtcattttagtaatcatgtcctatttcatggacactctttatatttgagttaaacacattattacttgtaaaatcatgacagcattatcagagacatgaaaagagaacaatttgagcatcttatctaaaagctgtgtaggggagggaagaattttcttttgccctctgagagtttaataattgaatctgttaaataatctgacaacgggcagattaataggagaatagttacacaaatttatcatgtgcaccagaacattgcaggaaagacaactgaataccctaaaaccaagtgagatttatcattcttatataccctggttatagagccgagggggaaggggatgtaggcaatttataggagagtaaatggttttggaaaaaatgaatgggccctcagaagaatacatggtggtttgtgacaaagttggtctgtgtgtggtgccgacttcttgtcttcctctcctgtgataagagttaatcttccctggttgatgcagccctcagggagaggattggcaatagctgtattactttcggaggagctgtctttagccagataaggggagctctgagaaaatgtccacctatatccaacatacctcaagtgctctcaatttgaagtaattagcataccaaagtggcatattttgaagttgcattttttgaactctttcagctgagaaagcaaattttttagtgacttaaaatgtatctttatatttttataacatgtgtgaatgcaatatctacatacttatccataagtctatttatatcactaagaaatctcccatagtcagccaaatacagagtgagagaatggtcaaaagtgaggagaagcactaaatccaaacagcatgatttcatcatgtcttctgattaaatattttactcagtggatgaacaaaacaagaatgaatgggctggagattgtttttaaaaatttagtttcgtatcactttacaactctttgagctattctaggactattatagtttctgtaaggaataaaaaggaggattttaccagttgtaatccccactagaagcttgagcttaagtgtttttcctgtgtgttccctttttactgtcaaatgtggctttatcattacttgtttttccctctcattggtgggctccttaatgatagggtctttgttctcctatagcctcaatatctaacaaagcaggcaattagtaaatatttgaaggaatgaataaaatttatatcgtattttttgctcttacatttgttaggagaacttttagagaataaagcaagacaatgtcacattattaaattatatagatgaaagatagaaatgaaaggggaaagaaagactgtgagtttaggtatataatttcctggaggaaccactagatgccaaacaagcatgtggggatgtcacctaggaaacttaaatgcaaaatgggtatcaccagaaataacagcaagaaaataagtggaggaaaacagagctatgaaatgatccaaagacaagtagtcaagagaaattatagaagtaaaaagatagggtaaagttaaaattgattctaatctaaaatattgtagaaaacaaagaaaaactaaggaaacaacgttcaacaaaaccatgaaaacttttcaaaaatttaggaagtgctaagatcatctgcttctcttcatttcaccagaaaaacatcttagtgaaataatacaatttgaagcctctcttaaaaaactgattttttagatagaatggtttataatgtgaacaattcataatagaaaatagctatgggtaggaagttaatgagactggagaaaaaaacagctacgctaaaacataagtacaaatgaaagagtaaaaataaatttaaaatgccaaacatgttcataacctatattgatgaaagtattgttagtggtggtagagatccaagttaccatgagttaacagcagcctgtctgtatgggtccatagtaacttcagtccttgccgcctcagaaagaatttgactgaggggcatagagcagaaaaagagagcgaggcaagtttcagagcaggagtggaagtttctttaaaaagtctttagaacatgaaagaaaggaaaatttgcttggaagggacccaagtgcacacctgaaggtctgcgagagagtagatgacagcaaaaaaagagatctttaaccttgatcctagaactttataggctggtctgtttcccgtaattctttccttagggtgggcttcctgcatatgcagtgctttccttaccttttggaattgagcacattcagtgtgtttagggagttatatgcatgcctatctgaggcttccttcctttttctagtagcatgtgttcttgaaacatcacacttcgccattttgactgttaacactcatgcccaagaagctgcttctccctgaggcctacattcaattaacacttctaatgttagcctgtgtggaccatcaggagattctctccctgacagccaaattatcgtttctagagaggcaatacgataattgccaaaccatcaccggacatttctagtgagtcggggagagacctctcctgctccgctcatgcttaactacagcataaaatgttgagaagtatatgaagcaaataattgttcatactatgtgtcaatattatgctatgccatttacttgtgtatcttacctcacccttggccgtaatttttcttttatattgaggaaaccaaggctcaaagatgttaaataaatttctcaaagctgcagaatgtcatttaaagaatctaagcatatgcaaattaaattttactatgtttgctatggagaagcaaaaagtgcttcagtgtaaggttccttcactcaaattatttcccactgttaatagcatacacagacttgtggagtatgacactgagaggaacaaagcaaatagagaccagtcaatttgatggttatggggatttctgagctatttaagttcatggaactttgttgctttggaatgagagatccttaaaattcttctaattgccacagacacaactgcccatttttctgttttactaaattcacaatccctactctattttgcagtttttggtttattacacagccagacaagatgaacttgaatcagtaaagtccccaaagatttgaggcagccaaacacacccttccttttttctctattgtataacttttgttaattgtccttggactatgaacaaacaactttggtagtaacactaaattactatttaaaaagtgacatatgtgtattttaataatgaatgctgaggagtgaatcatatctaacactaatataacagatatcccatccatataaactcccttcccattgtcctttttcatgttaatctgtaatcatttcactcagcctgtattccacttactgttcccaaccattctgggcattatgttggttttactgtcagtctcaatgtattacaaacaggggaactgaggttcagcacaattaatgaactatctcattagctaacaagcagtaggaaggtatgcgcatactaagatatgcgtcagtgtggttctacactacctttgctgaagactgacttctttatgtgtgatatgcgaagagatgccattatggagaaaggaaggtagggttgaatactgaaaaaggtatttgattattgatttttctttcttagtggatttgacttttacagtgaagaataataggtactgtattcattattttctatcattttgcacactgagatattggattgcatagcctatcttgttataatctgtcatttaagaaaactgtatcattatataatttctattgatgagcatttatatattttttcctcctctgaactttgccacaaaaggcatatttgttttagcaaacattgataacctgctaggaagatgagaatatgcctattacactgttgaagattggctacataacttgagttatctacaatatgttgcaaaaggcagatacttggcaagtttaatgccatccatctgatgtaattgaacttaaggttggatgaatagcacttcatttcatccttgaaactttacgaacatgactgttattatctcaacaactaatgttgcttaaagaatgttcattacttgcatatcattttttttccacaaaagaataaccttgactaaatattaggtaaaatttagtttagactatatttttgaaaactttttaaatgaaagttatctaataagagaagaggaaaaaattatgttacctaatattccactacctcaatatagcctttttgatatattcatatgtctctccctcctccaatttttatatagcagaaatgataatggctatatgttttgtatcttgctttctaataattgtatatcacatatatcttatatgtgtaattacgttcttaaaataaatgttcaaaactctgattagtggagtaaagggcaagacagtctttttacaagcatcaggtattactatgtgactctttttttttcctagttcagtgttataagtaacaatttactagtaatgttatcttttatcatttgtctattaaaacaagcatatattaaatggattgccttcttgaaataaaataaaaatttaatagatttatttttcaagttttctttccatagtagaaatgtctgcaaatgaagagaaaattcttcatttcagttgtatatattcaactacagctataggtgtagatacagatagaacatgtgatgatagaagcaaatatctgaaaatatttttctgagctgcagtgaatgagcaagctacataaataatgaagcttttgttttctagtgtgtgaaaaagtgtctacttcttaaaaaactaaagaacttaagcatcttcatcgctttgagttgactttttttaatgtttgatgatccctcttttgtgatgtatactgaactaaggttaccaatgtgcaccatctttgagatccataaaaaaataaaatagtgttttttggaaacattttttatcagtcattaagcaaatgatcattatttcttttgtcagtttaaaatctgcagaaattttccatattcttattttaattagaaatgtttgacaattaaaaatccacaccaaaggatgctgacaaggccagtctttgtcaacactttatagatttgtccttctagaaccaaatggtgtgtacttcttaaagagaatattatggaacaataaaattgcaacattatttatagtgttcttccatagaaaaattactaagcttacttttgtaaagaatatattttctatgtataaatgggaagaaccaaatctactgataatcaatatatgttatcctatttatagtcatctgtgagagagcaggaagatattaagcaattggtgttactttaaagacaatggtctttcgttattcacagcttttcaaataacctaatgggcttatcctaattttctgtgcggccataacgaaagacttgagactgggtaatttataaataatagaaatttaattctcacagttttggaagctgggaagtccaagatcaaggaactggcaggttcagtgtttggtgagggcttttaccctgcttccaagatgacaccttgttgctgcgctgtgtcctcaaatggaagaaaggacgaagaggggcctaactcattttctccagcccttttataagtgactagtcttgtccatgatggcagatccttcatggcctgatcacatcctaaatgcctcacctcttaatagagttgcattgaagattaagtttcaacataaattttggaggagacacagacattcaaaccatagcagggctacttccctttctctaataggacagtgccaaatagcctctgaagttatggagcctacagatggccatcttattatgcctattccttgtgtgtttctttttttggcaataataaaagacttaatgatgagctatttgtgcatacctataaatacatttcgtttgttcactaccagccagtctcctaagaaccagtgtataaaatggttcatgacccactagcactcaaatatttaatgaataaattaatgcattattcttagtagacaaaatacatttgtaatctctcaattaaacaaacaaacccttttcctgtggcttgaatgtgtccctcaaaagttggttgtgttgaaaacttaatccccaatgcaactttgttgggagctgaggcctaccctcctcccaacagctggtcttcaccctcaagaatggattaatgtcattactgggaatgggttattcaattggagagtgggttattataaagctaattcagcccctggtgcctctctttgtctactctgtttgcttctgctttctggccttccaccatggggtgatgcataccagatgccagtgccatactctgggacttttcagtctccaagaccgtgagctacataaacttccttatgaattacccagtctgcagtattctcttatagcaacagaaaatggactaagagaagtttgatgtgtgcaactttaaatgaatttttgtgtatttttacagtttaaaggcagtcctctgtaagattccagcaatcagccctcatggaagcctcaagcctattttccttcctagtactcacaaggtgatttttaataatcaggataaaatccaaagtgaataatttatttcttgctaaaaaaactttttaaaagttattaggattccacacatcattctcaaagggtaaatcaaatattagcccctcagtaagttgaataaagaattgataatgaacaccacattgatgctagatgctacttgatttaatagtttcaatacaatctccctcttcctgttgaaattccttagctatttacagtgcagagagaaaaaaataataattctattctaagagtagtagtgaacagttttcaggtgtttatcactgatacaaattaagaactgtgtctatattttgtataattgcatcatacagctgtattaaatcttatagtatcaaatattagatctgatttaatagtattaataaatttaaacccattttaatcaattttcaaaaaaataccgtgttcagttacagaaaatggtgcttagttgcagactgtatcgtaccttttaacacctgatgtgtacatcccatgtaacggaaagggcgacaataaaatggggattcaaaggaaataatatggcagaataagatgtgtaagcacgatcttattttcttttctcgtacagaatacttacagttattgagccttccagaaattggaagttacctgaagccactcaagtttccttaaaaaacaaaacaaaactgtctatagttaacttgatatgccacttttcaaatgtttctaatatttattttattttattttaaagtatgtttttcatctgcatctaccaacatttattcttgggcttttaattttacctttttctcgctggcctggtggctcacgccttaatcccagcactttgggaggccgaggcggatggatcacgaggtcagcagattaagaccaccctggctaacacggtgaaacgccgtctctactaaaaatacaaaaaattagccgggcgtggtggtggacgcctgtagtcccagctactcaggaggctgaggcaggagaatggcgtgaacccgggagggggagcttgcagtgagccgagatgacgccactgcactctagcccgggcgacagagccaaactccgtctcaaaattaaaataaaatgaaataaaataaaataaaataattttacctttttccaaactaatgtaattgcttacagctcatatttgagcttctaaatgcaatgctattggacgtatttgccacttcatatttaaggcctcttttactgtgtacggtatttattaccgtggagccatgagaccaaactgcaaggctctaatctcagttcagctatatgtttagaatcactgtgtgctgttcatacatgggatttgccccctgagcatattttatttaaatctggttgcaagacattttttttttctttcttcatacatcatcgataacatctaatgctttgttcaatagcacctggaattttcatccaagatgacagcttagggaaattgaattttcccagagaggtatctccaactagaatatagttttaattttgccaagctgaaataaatcataccagattgttttattctatgcaagacatctgggagacttttgctgcagtctacagaatctcatgccattgtgaaatgtttgccttatggacaacacaaggtctggggcataatactgcgtgtttgctcatttccagtgactctatttaattaagtctagaatacaagcatagagactctgctttgtgaatctgatgctcttgtatatgacttaagtttatgtcaggatttagggaaaacattctcattttggtagcattcccaacattttgagatagtttgacttctgttcagacctagcatgagatttttgatatatgtgcaaattgtgtgacactgttggataaaaaattcttaggtacaaataaagttgacaggtaggacttctgtccatccacatccatgccccacattccctgatctttttaataataacgacaaaaacatgatcagtgtgcactcagaacagacatttagatcaaactaacctttgggtctggcatcctaatgaatgtattagtcaaatgtcacaaactgcacaaaagcttttgtattagaaaaacaaaaaaaaaacaagcttagaatggatgagcagatgcatattcttctgagcttctttgactcacaagctttgctttgagagtcacctttccccccactgccctctctgactcactcttggagtttctggtacataattaagacatatggacaaattcccaaattctagggctaagaataccagcaaaggtgaatttactatgaaaataaatgaagtttaagttcatgaagcttcacctatacccatcccttccaagacttgattttcttctaggaagttgtggtatgaagcagcagccacagccacacactagagtgtgtgggccacagaagtcctgatttgaaccctggactgggtggagtcttggaagcccacactaccttcatgtccctcagaacctcagaggtaacattcctctggtggacttcatcaagtgttcatcccctaactttgactccaaggagaatgatctaaatcagatgttgctctgttccctggtctagaccatcgcaacaaaactgcttggccacttggccgctgtttttctcaagaaacaagtaacttcactgagcaaaaatgtaccagtgtggcatttgcaatgatcagttgaagctgaaaataactttatctaccactaataataaaaataaaatttaatcaaccaaatcataggccacactgaatcatctttctactatctttataaaaaatattgtaaaaattgctgtcatattaagaagcaatcaaagcatatgaagccaaaaataaggaaaaacagtattatagatgactcacattcagttaaccataaaaatgaaataatatgtttttctaattataatttttatttctggaatttgtcacttttaaataatctgtgattatttttcttctaagtatatatctttttaacaaagttaacaaaaaacaaaatatatgggcactaagaggcactctagagaaagactgaaattttttttgagtatttgaattacccataattacaaattttagcttctcactattcacaatacattttatgtccctttgttttgcttagttagataggatggaaatcttggctttctgtcatttcctgtgcagccctctgcaaattcttttcccaacctatttctttatctgtaaaatggagattataatacctatttcatcatattactatgttaaacaaaatgtttttgaagtacttagtacgatgactgaatacaaacaaataataaatagtaggaaagtctatgttgattatactatgtaaaataagtataaaaaaatcatgagacagcagtgtaatattctaagacattggaagagtttaaaagaacagttttggaaaactgacttcatacttgtatgtactaaaattgagatgcccatgggacatcttagttgagatagctgttagatatttggattgcaggtctggaacttagcagagaattacagttataaatttttaattattaatgtatcagaagtagttgtaaccatgagtaaggatgatattatatgggacagtgtttaaggcaaccataagatagatttgaggataaatcccagtaatgatatttggtgcttagtttttttagaattatcaaggaatatagaaattgcatattaaaatgccctgcataatttctagcacatagtagctattctgtacactttattgtttattttgattaatttaagcaattcagtataaaaaagaaaaaaaacccaatctttttagtctatcaaaatttaaaggaagacttctaaacattaacatagtaattttgtatatcccatataaatctatataagaaaataaatcctataaactaagatacttttaaaatataagaatatgagtactttttttttagtgaatgtgatctttatggaatttttttattattagaatggaagtgaccctggaagctttcttattgtatttatttaaaacatttcagttgtacaatttaattcagttgtctaataattaaaataaattgtgtaaatatgtaaattgaatgaactgttttctactgttatgtacatatttgaattcaatttatatgatctgcttgatcatttttaataatttaatatgtatttaaatataaatatttcataatattttttttaagtttttaaactttttatttgcatattaaaaaaattgtgcattccaataattaaaatcatttgaacaaaaaaaaaatggcactctgattaaactgcattacagcctgcaggacaccttgggccagcttggttttactctagatttcactgttgtcccaccccacttcttccaccccacttcttccttcaccaacatgcaagttctttccttccctgccagccagacagacagatgggaaaggcaggcgcggccttcgttgtcagtagttctttgatgtgaaaggggcagcacagtcatttaaacttgatccaacctctttgcatcttacaaagttaaacagctaaaagaagtaaaataagaaggcaatgcttgtggaatgtacagtgcatattggcggcgcacgcctcattacgattcgcctgcttgcttctcctgttcaatcgtttctttggaaggcagtggatttttctcttgcgtctctgtcttcttcagtttcggcttatcgaatttctcgatctcagccatatcgggtttgtcagacatggttgcggaggaaaagcggagcgaggcgcgcgagtacgagcgaagtctggtctgcgcagtggccaccaccgagttgtcgccataatatttttaataatgtttgcatttcttctatattgctaacttctttgagaaatattattatgatctttgtctaagaagcctattatctagattgagaatctaaacaaatacaaaggtaagcaattagtatcatctaataaatgtctcagttaattctatcacacacttagataagtttatcaaacgtgtaagaacataatttaattaagcagagcatgtttcagtaaacaaatgtgagtgagctttttataaagtttcagattcaactacaggttatgaaacaagtgaaaactaaatatgggatagggcatggaactgtgccttcaccatgtgttacatctatagagcatatgccaactgaacttgctacagcttcattgttgcatcgtacccatcaagacccaacagtggaactacaaagacaggtgacttgtttctagaaagcaggtcctaagccctgctttaagtgtgtttatctggagggaggagcaagaagagaaagcccacatctacagatcaaattaccctaaaagagagactattggaaaggctgagctttcatatttcatccttttgcccaatcttaccaagtagttaaggcacttctgttgttgaagtaaaggtgcagaagatagaacaaagtctaaaaattcttctcccattcttctaaaagggtagaagttcatactttaaaatttaagatggggacactagaagagaaagaaaatggttcccccaaagggaagtataaaggattgatacatgaattgtatatttattctctcatcttttagtcattagtcaatattctggtctctaagttagtagatgggattgaagttattgtaataaattaatataataatgtgactgtgtaattatataaatataatcaagtaaatataatacaatatatgttatataatccatataacatagcatttattttatagcattcttttgatatctgctgctttagtaacttgcaatttattgttttattacatctgctattaaaatgaacatcaactatttattttcataaataagagaatcctttattttagtagagagaaaaattttaaatagttctaccaatatctaatattaaatgtgtgtgggtggagaagaatgaggagaaaggttgtatcttaattcagaattagaaaggcgacaaaataaccattttctattacaaaagacgttaactctatgacattaatttcaccatgggaaatctgtaatcttcattttagagaaattaattggtagcagtactatttatgaagtgctgtgtgctcaaatccttgaagaactttcctacattatgattagcctaagatgtctagcctggagtgtttcacatttttctagctttgtgattacatcctcccactaggtatctaatgaactgaagtagaccgccctgcatttcagcaaattcaggagtaaggttttatgagtattaaaaaataattgaaaatgtcaatattcaaaatgtttcatagttcatatattttatgtcctcactacagtgcctatgcatatagcttaaagcatatcaacagagggaaaacactatattgcagcaagaagcaccctcatccatgaaagctgtaaagctccttactctttttttttttaatagttataaccttgtatgcaagtcactgtgaattttgctggcaattgtggcatttctcatcagagagtaaattcttcttcaggctggtaaaatgacatctgaataagaaggcagaaaaaaattttcaacctcttaaaacaacttctaaaaattgcaagtagacagtatcatgtattgcataatagttacataaagcagattacctaagattccctacagctctaaaacaccatgccctgacatgtcctgattgagatttttgagatttttacctgtattctagagatactgagtcagcagctagagtaagttgtcactaaatgatgcttttcctgcactttggcagataagatcagtatctgaaaacctcagccaatgtagaagcttgagaatggcatgtcttctgaaaaacaaagtttattaaaatattagtttgtgacttagataactcattcttaagaaagcaggaatgtggcagcaagggtagaaacaaacatagaagacaatgcttaataaagaagaaaatatttggccaggcacagtggctcacgcctgtcatcccagcactttgggaggccgaggcgggtagatcacgaggtgaggagatcgagaccctcctggctaacacaatgaaaccccgtctctactaaaaatacaaaaaattagccgggcgtggtggcagatgcctgtagtcccagctactcgggaggctgaggcaggagaatggcttgaaccctggaggcagagcttgcagtgagccgagatcgctccactgtattccagcctgggcgacagaccgagactctgtctcaaaaaaaaaaaaaaaaaaaaagaagaagaagaaaatattttgcatgttttccctgacatagtctgggtcaggaaacattttctattagaactgtttattagggcagttttcttctttacctgtgcttctctctattctgtagactttcaaaagctaggttgaatcttttcacattataaatcaaggtgaagctgtattattcctcttctgagtgttgtcttggtactctggaagtgtgtctgactctcattcattatttctaacaataagccaaactccaaagtaaaaaactgtggtttctcttctcagttaattcttataagttgcccaatgaatgagaatttgggcatgactcacaaataggaacttattgtgtttaatctacattctgctgtctgtcttttcatatttcccttttcctgcatattgacgtatttactgatttctctgttttttttttcccattaaaaaacacagcttggcattagtttatgctcagtaaatgttaattactccacctcattagccttgactggactaatttgttagtcaacatagcttattctcactagtttcttattcaaaacatctttaaacaaagcaaaattattttgaaagcaaaaacatatattttcttctgtcttttaaaatgacaattgtttattacattaataatctcattaaaattcttgttattttttctttgtcaagaacaagttagacagaaagtggtttttgtatgctcaaattttaatttcttgattgggtgagttctatggctatctgttgctgttgaaatttgatagaacttctcagggagagagtaaataggaaagtagtgggaatgtagatgcaaaaatgggtacagaaatgattagtccagggatgaagcaacatctggattatacaggaaactggtctaatttagtcagcactggagtcagaaagggaaggaggaggaaatttgggaatgttcaatagggcatgggtttggatgtgcagaaaagagactgtagtaattgacctgacatgtctgatcattgaagagaaccatcagaaaatgaagcaggaaatagtaagaaatgggcttaatgttaggaaaaatagctccttcaggaaagagatgtataagaaggatgcagttcactggtaaggtataggcagggattctcagggaactaatgcaaagggagtgggtcattcaaagaaccctcatggttagagtaaccgtattctggtttgtccaagacaatgccagttcacaaagtcattcttgcattattaatggttccctttctcccaaaaatttacagtttttatcatgtttgtagtcaatactcaaaaaacatgtgtgaggaggcttttgcttgttagaactatgaaattgcttttaggttggcagagcacatgaaagccatttctagacttagtttgaaggggatgacatctcttgaaaagagtcagcacaggttaataaataacccttaagagctgcactggatggtttaaggcccaacttttcaccacggattatttgcatgaccttgggtaagttacaagttacataacctctcatttcttcagttttctcatctgcagtgcaaaggtaataatagtatctacttcatgtaatgtggtaaggcttaaatgagtcagtgaaaaaaaaaagtgtgtgtaacattgtggctatttactgctaaactggttccattctgcatccagtaaatgtaattcctacggattttcaggtggctctttgatctgctgcattaaaatgtggttacaggagaaactggtaataaactaagagttaggcctcaaatagtttaaagcacttttcaaatgcaaaatattcttaacctgcattaatttatgagttgggtatcattttgctcttaatgctttagaaaatgatttaaaatttttaagatttgactcattcttcagattaatttttttcctatctcaacatccaagtattttctagaggattatatttttggtgtattgtggaacttttctgattttacaacacacaacataaacagaatcattctctcatacctattcgtcccttccttcaacttttgctggattttccgtatgccttgttattgtatatctggtcaagccatttggtacaaaacattttttaaaaacaaatcttttttatttcttggtcatgttaatctattccaagagagtgctagttatattccctccttgggcataaaatctatgtgttgttgtcagtttctttgttctgtaattattactgcactcctttaagaaaatttaactatctgatgagcctaataacattacttagtcactagaagcttaaaggtaacaatataaaatgtatattttttatattttcagtactcttgagactcagccaatctttcaagattttgtgtatttgtcaagcactctatgacctcgtatattattacacactatacattctccaatatattattataaattgtaccaccattcaaatctccttcctctgtttgtgtgtgtgtgtgtatgtatatatatatatcttccagtgtgtgtgtgtgttgtgtatatatagatagatagatagagaatatatacatagatatagattgagaatatatatatatatgtatagagagagagagaaagagaggaagacagatatgtagcaactgggtattactaaacttcagagttcttaaattatacttgctttactgtgcatgttaaaaaataatatctaagcctaaggcattgattcacatttttacagcaattactggcagtagcaaatactattaccactaaagaatgaagacattcctcataaagactactttcccctccctcattccactccagccacattggccttcttattgttccttgaacacacagagcatgcttcttccttagggtattttgccttagctcatttcttagactagaacattcttcccccaattaattttacatatggttactaacccccttccttcaaaaatttgctcaaatgttaccttcctcaacttcactactctacactatttaaagttgcaacctgtcccccacaccacttgtttcattcctattatcctgctttttttttctctgcatagcattttcataccttctaatacatgatactatctaattatttatatgcctatggttaatatctgtccaccccagccaatatgtaagtgacagaagacagaggtttgcattgctcaacaacatatttgtagttgctagacaaggggttagcaaagagccagacagtaagtattttaggatttataagccatatagtctctgtctcaattaaactttggcattgtggcctgaaagctggtatagacaatatgtaaatgaattggtgtggagctatttcaataaaacattatttatgaaaactaactataagctggatttgacttgtggacttttgagacaatatctggcacatagaagctcttaaagaatatttgttaggccgggtgtggtggctcactcctgtaaccccaacactctggggggccgaggcaggcagatcatgaggtcaggagatcgagaccatcgtggccaacaaggtgaaaccccgtctctactaaaaatacaaaaaattagcctggcgtggtgacacgcgcctgtaatcccagctactagggcggctaagacagaaaaatcgctagaacctgggaggcagaggttgcagtgaacctagatggtgccactgtactccagcctggtgacagagtgagacgccatctaaaaaaaaaaaaaaaaaaaaagaatatttgttgagtgaatgaaatagatttattgaaacctggcatatttaggatgtgagcataaattactaataaatttgccctttctcccaatccaaaattgacaatcatttttttcatttaaaatattgacactggccttactgcccatcataatcaaaagagttccctgtcctgttaaaactatagtgcctgcttgcatatgacagaggaactgtggtagagtagttatcagaatcagaactaggagtgaaaggctgtcctaggccagaaggcaacaaaaccttgaattcaggattcatattaaatatatttgttagttagtgcttttttttaaatttaattcctgaacaacaaaagtatattttcagtatgtgaacatatcatgatttatacagcctataatgtttttcttatttcaactgtgaaaaaaaaaaaaaccagattttcttatttcttgagttaattgtaaacttgaagtgatggcaatggacttgtaacttattttctcattctgcagtacatttccaagccactatacaaatgctgagtcattagtgtcatagtgctgtgtctatttatagattttttttatgagtgttattaaccataaatgctcaatatgaaaaaaatgaaggaaagtagctttgtctaatcacagtagaacactggatttattctataacaaactgaagggtgacttaatcacctcaaattaaaacttgttctttatctcacatataaattgaaattcattgcattcttatgtttccaataaatggcagatttctccattgcccagtaactttaaggtgattgtttgctcactataaatagagatatgtgtgtttatgtatagaaatccttcagcgtgagagttaaattactccatcttaaagaaagaaatgcattaatgtacaaccatggaaggtgtgataagtttaggtatatcatccatcctcacagaatctgtttgcagttattggaataaaattattttctttatagagatctatttaatattgttatagacacctgcccatcataatgattaaatttttattgataaaaacaattataaatatgtataggtacatgtgatattttgatacatgcagataatgtttaatgatcaaatcaaggcattttggatattcattgcctcaaacatttattattactttgtgttgagaatattctaaatcttttcttctacttattttgaaatatacaataaattactgataactgtagtcactcttctgtgctattgaacaccagaatttattccttctaactaactgtatttttgtacccattaaccaacccgtcttcatctctcctgccattcttcccagcctcttgataatcatcattctcctgcctcagcctcccgagtagctgggattacaggcacgccagcacacccagctaatttttgtatttttagtagagatgggatttcaccatgttggccaggatggtcttgatctcttgacctggtgatacacctgccttggcctcccaaagtgctgggattacaggtgtgagccactgcacccagcctattttgtgaaatattatgtttattatgtgttagtcttaatttgatttaattctttacaatggggtgtcttcgttccctctgaaactgttcccccatttgtagcatacttttacattcaagtaaattatttaccaatatgttcttagctgatattacaaaggctttattcattcattcgtttaattattaatgtattaaccaacacttactgaatgtttatcttatgtcacaacttggtgatcaaaggaggattcttacttaaaccattatacttttctgggacatatatattagtaaaaaaatgatttccattccatttaaagaacactgggacagatgtatgcatgggctgtgtgtgcatgctgtcagtggagcaccccatctggcctgcggcagtgtccccttggttctgatcaggagaccttgagctttgccacttagcatctcagaagtctccctcaggatcttgaccttgcttcttactacatgttctttctgaagatttcctctatgaagtccagaacttttatgatttcatttccatttctcacgtatcagttttttttattgaattctctccatcttttacattaaaatctttctttagttcatcatctatctaataacagatacttacttcaccagactcatctttgttatcaatatttcctttaactttcttaggttgtcagattttaaacgtcgacttaggtatactttaaaaaacaagagaaaaaaaggaaaaagtcgcaaataatccagaaaacaatataaaaataatgttataattcaaatcaaatacgcactgtgagcattcagtgtttccatggatcttctaataattttttgttgttgcttttagattttttgttttgatttgattgctgttttactttttgctatagatatgcagtttttattttgatgatgtttttctttttctcttgttctttttactcaaagacctccagtgataaatgatatatgtaagcatacatatcctaacatatatatttgtttttcaaacttagtatgtggtagtcatcataattagataagactgatgtttctcattttgattatcaggaaggtttgtttgaagcaaattattgtggatttttttatgtttgctgcatttgtacttcttacacaatcacttttaattaacaatgcatagttgtatatttgctaaatgtaaacactatgtaagggggtaggaatttattgttcagaagatgagtgcatagtagcaatgaagcacatatatcatatttgatttgtaccctggttttgtggatcacaactatgagacagtggaaaaaccatcaattccatgtaaaattggtgcccaaatgttaagtgatatttatagaaattataactggaagctaagggcagaaaatggctctaagatataagtggcaatagcagaaatatagtattgaaagatataaaagggtagtataaatatcttataagtaaatttctttctttccctaggaaaaggacatagtgaatgaagtcttttttttctccaagtctgacagtgcctcaaacattctaaaataatcttttctcccctattagtcatcacttaagtgtgagtttatttgaagtgattttgatttactgataactcattttagttactcagaattaactccctgcggaagacctaataacaatcagttttatggtcatgtgcattacctttccccatgatatggtttggctttgtatccacacccaaatctcactttcaagtgtaataatccccacgtatcaaggacaggaccaggtggagataattgaatcttggaggtggtttcccccatgctgttctcgtgttagtgagttctcacgagatctgatggttttatttattttatatatatgttaggatatgtatacttacatatatcatttatcacctttgctcaacactcattttctctcctgccaccctgtggagaggtgccttctgccatgtttgtaagttttctggggcttcgcctcccatgcagaactgtgagtcaattaagcctcatttctttataaattacccagtctcaggtatttttttatagcagcgtgagaacagactaatacagtaaattggtactgcattaagtggggtactgctgtaaagatacctgaaaatgtggaattaactttggaactgggtaacaggcagaggtaggaactgtttggagggctcagaagacaaggaaatgggggaaagtttggaacttcctagagacttgttgaatggctgtgaccaaaatgctgatagtgatatggataacgaagtctgggccgaggtggtctcagatggagatgaggaacttgttgggaagtgaagtaaagatcactcttgctgtacaaaggtactggtggcattttgcccctgccctagagatctgtggaacttttaacttgagagagatgacttagggtatctggtggcagaaatttctaagcagtaaagctttcaagagaaaggagagcataaatgttgggaaaatttgcaggctgaagatgcaatagaaaagaaaaacccggccaggtgtggtgactcatgcctgcaatcccagcactttgggaggctgaggtgggtggatcatgaggtcaggagatcaagaccatcctggctaacacggtgaaactccgtctctactaaaaatacaaaaaattagccagatgtggtggcaggcgcctgtagtcccagctacttgggaggctgaggcaggaggatggtgtgaacccaggaggcagagcttgcagtgagccgtgatcgtgccactgcactccagcctgggcaacagtgcaaaactccatctcataaaaaaaaaaaaaaaaaaaaagaaaacccattttctgaggagaaattcaagccctatgcagaaatttgcataaggaggtgaatgttaatcaccaagacagtggggaaaatgtccccagggcatgtcagagaccttcacaatagcccctcccatccaaggcctggaggcctaggaaggaaaaatggtttcatgggctgggcacagggacaccctgctctgtgcagccttgggacatggtgccctgcatcccagctgcctcagctctagccgtggctaaaaggggccaaggtactcctcagaccattgcttcagagggttcaagccccaaaccttggtgaccttcacatagtgttgggcctgtgggtgtacaggagtcaagaattgaggtttgggaacctctgcctagatttcagaggatgtatggaaacacctggatgtctaggcagagtctgcttcaggggtggagccctcatggctcactaggcgatggcccagtggggactctatatggggcttcaactccacatttcccttccaaatgggaagatggccaccatattctggatcccagaatcatagatccaccaacagcttgcaccgtgcacctggaaaagctgcaaacactcaaccccagctgtgaaaccagctgggagctggcctttatcctgcaaatctacaggggcggagctgcccaaggccatgggagcccacttcctgcaccagcgtgccctgaatgtgagacatagagtcaaaagagatcattttggaactttaaggtttaatgactgccctattagattttggacttgcatggggcctatagcccctttgttttggccaatttctctcatttggaatggacgcatttacccaattcctgtacccccactgtatcttggaagtaactaatatgcctttgattttacaggcttataggtggaaaggacttgccttatctcaaatgagactttggacttggacttttgggttaatgctggaatgagttaagactttgggggactgttagaagggcacaattgtgtttttaaatgtgaggacatgatatttggtaggggctgggacagaatgatatggtttggctttgtatccccacccaaatctcaccttgaattgtcatattccccacatttcaagggtagaaccaggtggagataattgaatcatggacgcagtttccccctgtgctcttctcaggttggtgagttctcatgagatgtgatggttttaaaaggggcttcccccttcactccacattcattctttcttctactgccctgtgaagaggtgccttccaccacgattgttaagttttctggggcctccctaggcatgtgaaactgtgagtaaattaaatcttttttctttataaattacccagtctcgtatttcttcataacatcatgagaacagactaatacaccccagtccgatgaataatttcagaaaacatttcagagaagcaaaccaaaataactacaaagccaaaacacaaaagaactctacaggcacatattttaacccttgagaatctgccttaattgtgaacacagaatcaaaattcaaggttcttactagggatgataacctttcctacactttgccaatcattgtattaattctgtgacagaggctgcctgaagtacatggggaggggtggggggggcgctgtccagtttttaaatggttgagattttacccttgttccaatgcagcccttggagactatgcacttgaaccacattttattggctacttatagagcttttttttttttttttttcctgatccgacctttaccatcatgtgttttacccactcaaacaagtattctaaagaagaggtgtacagaatgtgctatttggcttgttttaacaatgttcacaaggttgttctgaaattaaacagtatgtttctagatagctggattgatctttaactgtggacactgtaaatcttaaagttgaacatgtttctttttaaattttgaccactagcttaaatgtacagccatttagtaattgtacataactgtgtggcatgttatctgtgcgttaatattactcctcagttttttaatttgcctaaccactactttctttcttcaaaatattcaaatcttaattttgacctttaatatatatgtaaatttcttccaaccctttgtggaagactagcaatcatggtcctgtcaaaacagaaattataccttaatttgaacaggaaaagtttaatataaaattattaactataacagtagttttagataatccagcattagcaagtacataataaagagaagtcaaaaaaatataggaatagcagatataaggaacaaactttactcaaactttactcataggactgagataaaacaactacagaagagcccactcaccctaaagctgagatctagatcttgctgaatagcgtataattatggctcattgaatggcaaagaagtcactgtggtagtgcattggcggaatttactggaattctctcctctggtacttgctggaaatctacactgtacagtgttgaggaatggtgtttatgtcaatatatcttggaagggacactcttctacgagactacttaagcagattcctaggggaagcttctggccactgagtgctgcaggcagtcatgcactgcaagccatggtgctgcagaagccagatactgcagaagctgctcacactctgagtgcttagtgacagagaagctgctcacattgcaggagactgtttagagaacacatcagaactaggaaagaaaaccttcatctctggcaacggctctaaccctttactgacaaagcttaacatcatgctagctaggaagaacatttaatgttcccagctccttttttgttgttgttgttttttccagaagaggaaaggaagggtaaatgaagtaggacaattaattgacaagtggcacaaaatccttgttacaagcaaataattaattgtatctttgctttaatttgacaatgtgtgattttcagaaacatataaaagtttttgtatattaaaaagaaactgatatcttactatagagcgatttatacttatggttcaaaactctctttaggttctggcaggtgtattcattttcctcaaggctagtgatttgagagagaccctaagctgcttgcaagattagacaactgtatttatacagtgatttgggatgactttgaggaggagcgagagataaagtacggaataaagaagtacaaggtttaaatatatatagtatcaaaacaacagcaagaacaaccacaaaaaaaaacaaaaacaaacatataaagatgtagagtccttcttctacctctgttcataccctactaatttactggctttgtattctctgtaaggataagctatttttatggacagagcagagaatgaaagtttatacatagtatgggcaattttcttctggcacaataccctttagagatgttcatttttttctagtattttcttcattttcaagaatttgtaaataaaaacaaaaatctttggaaaaagaggaactcaatgaaccaaagcattgaagcattgctcctataattcgttttagtgattaataaaagtacaagaaaatcagacaagatgtaaatataagcagaatcatgattaaaaatccaatttaacatttaagctacaaattaattgttatttttgatcaatatgttattgattcttttcactgggtcatcttgtgttttctctgtgctcgtgttttaacctttatatttgaaaaacacatttaaactatgtaagccaatacttttaaagaccagtattttttatttattacaattaaaacaacttcaaaatgaacatgttggtttaaacaaaaagactttgaaaaagtctatatacactttggaaagttctgaggaataatacatagtgtttctgatctcttgtgttttatttcacatttcataaacagcaatctccatagtagtacaacttttatggttgtccaggaggtaaaactaattcagatgagttatgtaaaatatatttacacaataaattcagtaaaggtgtaacaataaaccatgggaagagggggatgcagcccacctaccccaattataaaagccaataaacccattcatctatgatatatattttaggacatactatatgcatgtcaaaaggaaagttcagagaagtatatagtatagtatggctcctgattacagtgaatttgaattatcatttatttcagtctaccaaatgtacaatgaactgaaatattccaaccattcttcaagaagctagagatacaaaaatgaacatgatatggtccaaatttctgcagaaatagtagtgaattttcaaatacgatggtaatgcaatatttcatggatattgttgagttctaatttagatcttgaggaaagggtagtctttagttacaaggtaaaccagtttggctggaatgcaaatcctggataaggatagtgagctggaaggtacagtatccatgctggaattaatagtatagatttactccaagtaggtgtttcatgcaaattctaaaaccatatatttcaagtgattgttgctttgttattgctcagataatgtcttataaacaattatccactctatgcctaaagtcattttttgcattgctattttattttaggaactcatgtgcaactgctttcaggaaatgattttttaatgtctactacaaattgtttcggctaagacacttccctgagttctctgttgctgaaatttggcctgaatactccacttttccatcctccaagacctctatcatttgagatatttcctttttcttacttaatggtataggtggatacagcctccttaccttacctctttttttcctagcctgaagaagagtactcagaacttttttttttaatttagaatttattgatcttcattataagattgctcctatgatctctaggctactacattactgtataaatcattctcacactgctataaaaactactggagactgggtaatttataaagaaaagaggtttaattgactcacagttccactggctctacagaaagtatggctgggaggccttaggaaacttataatcatggctgaagggttaaagggaagcaagcaccttcttcacatagtggcacgagagagtgtgtgtgtgtgtgcgagagagcaaagggggaagtgctacacactttcaaataaccagatctcgtgagaactcactcacgagaacagcaagaggaagtctgcccccatgatccagtccagtcacctcccaccaggtccctccaccaacattggaaattacaattcaacatgagatttggctggggacacagagacaaaccatatgaatgaccagtcagaatccaaatagatgactacatttgttttcattctctgaagatctcataccaccactttgcttctaccaccaccactgctcacactaccattagtggagactagggatctagaaaacagaggtagggagcctcagtactatttgctcaatctatttctttatttttagttttggaataagtctagctttggaaactattaaacatagaactactgtagaattattaaataaatattttgtttattatatcatttcctcttgcaagaattaaagctaaagaaaaaatgaaaaatatttggagtttagatattaaatcttagctggtttccactagtaacatattttgcatttttatgtagtgcaatcattattcatagagttcttcaataatatttacttaaaattattttttcaccagccttttaactctaaagtgtgttaggaaaatactttttttcttggagataagtgatatttattaattgattaatatctttatgttctggcttcactattagatgactatttactaactctgtatcttaacatgataagaaataattatttgaaatcacttcatataaatgaagaggctatgtctttggaataagtagttagagtttagcattattcacagtggcattttaaatatttatctacttgtgcctcattgccttcatctattacatgtgaatgacactcattcatttcacacattcattcattcattgaacattttttttcagcaactaatttatatattaatatgaactaggttagcaacagccaatgcagaggaaagacaaggcattgtcaatatatttatagcactcatatttctactttcaaattaaattacataacctatgcaaaatattaatttaatacacattcaactcaatttggttattccccccatcttcctttcttccttctccaatgctaattataaatgacagcttcttgctgattgggctcaacacatgagtcatataccaatggagcagatggagtagcttccttgttctgttttgtttaagctgatgttgatttctaatttctaatgtacttcatttacttataaattgttattgctgcagttattattttgcaagactcatttataagataatatatagaaagtaacattcgatgtatcaaatttttaaagctaattttaaaaattaacttgacatcttgactttatattcttgatagtttcacttaaagaatatataaagtgattttgaaatttcaaaaacaagtatgggaattaagatgggttttgtggagaataaagtgggtctgataaattaatccattcccctgggttcagatgctatgttttataatgtggtagaattatggaaataaccatcttccccgacgtaaaagaagtatggcataataacagaattctagactaaaaacagagtattaagatctattcccatttataactcataactcattagcttgtgactttaggaaatttgcattatttcattttccacagtttctgtctataaaatagaaataacaatatctttggatgcttcaaagggttattgtaagaataaatgaaatatatatcaaaatgtattctgatatgtataaaatgccataatattttatcagtgtgaacttccaaatctctatgtaggggaggcttagaggttgcaatctggttggaagtagactctggcagggactcattcggagctggatttttttttttttttaagactacaatgttttggtcttagactttttttgtttttccttaaaactaccatgataggcatgctatcttttacttcaatcgcatattaattttgagggagttagagtgaggctggaattctggggcttaaactgtgttagttatctctatctttgtgatagattatcctaaattacaaaatttattatctcccaatttctgtgaatcaggtatctggaagtagcttagctgagtcctttggctcagcatctctcataaagctgcattcaagctggcctgcagttgtctcaggacttgactggggaatgacccactttcaagctcagtcacatggtctttggcaggatttagtttcttgctggttattgaatggaggccacagttcctcagtagctgttaacctccttgccacattgatctctccatatgtaacggacaaaatggcagcttatttcctctaagggagcacatgagacgagtccagagaatgagagcaggacagaaatcacagtattttatgacctaacctcagaaatgttatcccatcacttttgctgtattctattcattagaagcagattaccaaatacattgcatacatgagaaaggaaaattacataaagtgcatgaacaccagggagcccttttagtagctacctaccacatcagccacatgacatagattatgggtttttcttgctccttctcaacctccaactgtcataccaaccatggaatatatatttttctttatatttctatgctgggtctaacatgaagaacaacaggagaaatggggaaatgtaggtcaagggatacaaggtagtaaatatgcaggattaacaagtggagagatctaatgcacaacatatggactacagttaataatagtgtattgtattcaggatttttgctaaatgagtagattgcagctgctcttgccatagggagaaaatgggtaactatgtgagatgatgtacaagttaatttgttccacatttgtaaccactttactatatctacatatatgtatcttataacatcatgttatatgccttaaatatacccaataaaagttattttttaaaaaagaacagatagccatttcccacatctaaatgcagtgaagtacagtaacagaattctagcctagaaatggaatgttaagattgagccccatttctagcttattagattgtgattctagagaactcactttatctctttttcctatatttccatcctgaaatgggaaaaaatggtatttcttattgcttcaaatagtagttattcctaagaacgtagttgcccacattatgatttgaacaaagatgaaagaaatattcacctcagtaaaatttcatcacaaatcgcttaagtaaaaatggatgtcccacatgacagagcgtaccaggttttctcagtttcccaaacatacagactctaattgctttttagatcaaataagacaattgcacacatagaaccttcaacctcagtggtaatatataaaagttaattaaaccttttctatttgttttcttcaaagttcaaattctttacgttaaggaatctaaatacatttgatttggagatagtattgcctgtggtatttcaattattaatatggagaataaatattgttattcatgtgctgaagtgacttttccacttcaaagtggtgtctgtaaaggaaaataatgaataaaatctgcatttcttacctttaccacgtctatggtcacagacgcaacaaagcctaatctgataccataatataatttagaagtattttattatggcatttgatatatgcaagtactctacagaattgataaatttatactttttacttaggaaatgattctgccctccatatttgcttatcatttactgccaaagaagggaggaaggaagagagggaagcggaagagctgtaagaaatagtgacttatcagattgggagtaaaagacaaatacatatggctcttgaaaaatgacctagaggtcaaaagatattttgcagtgcatttatgattttcacaagtttttggcacctacttgacatttatgtcttgaaagagaaagatcaaaatgaaatgtgaatgcctaatttcactagtctaatgtttgaagtgacagaagtgaccagtgaccaggacaaattcatatgtagcacacagaaactgatcccattctagtcttacttctgacacacattgttgtttggcacaatggaattaactaatttctctttccctgaatctcatctgtcatgtcaggctaaaggaataataggggaaacataattttagttactgtaaataaagtttatgaatttcacattgtggaaaaaatgttattgtccactcaatatatgtattttgaaggaatattgactgcatatttaattaatttctctttcaaaatcatgatacaactacagtaattgctctctttatgggaaaaaggctctttctctagcgaagctttatgattcataaacactgacaaaagattcaaggaattctggcttatgtaattaccgggcatgtatttaattgttttccttggaatacttgtttataggatgatagaattaaaaaataattgaatcctaaaatctgaacttcaaatttctatttctctctgatattatgattaatatagctatttatttgcaacagttctcagatcattgtttttctttataagacaattttgtggtgcaagtattacttaatacaaaatacattaataaataaagttaagtgtaccaaagcagatgctgctactaaacacatgtttctttgctagaatcaagatatatttaaggactgttatgagattaggaatcaaagtgaataattttggatctttgccgttgttgaatgaatttattgttttttaacacagattttatttcatatgtatggcttagtcctcaaataggtaagacttcactgagacagttgtatttaaaaatttgatataatttttatcaaacagatttgaatttgaacaataagtactagatttgaggtatgaaaatgtgagcctttgtgtcaaaattaaaaactttttggcattaaagatgactatcaagaaagtgaagacaaccaatacaatgaaactgtttgaaaatcatgtatctgataagagacttatatccagaatacataaaaaatttgtataattcaacaataaaaagaaaaataacctagttttaaaatgggcataccatttgaatagacatttctcactgtaagatatatgaatgtccaataagcacatgaaaaatgtgatcaatataattattcattaggaaaatgcaaacccaaaccacaatgagataccacttgacacccactaggatggctttcatcagaaagacagaaaataaaaaatattagcaaggatatggagaaattacaacactatactttgctgttggggatgaaaatgatgtgactcctttggaaaaagttttaatttttaaaaatgttaaatatagagttaacattttttgatatggtaatagtttctacttctagatgtgatgcaatatctactcctcggtctatacccaagataagtaaaaatatatgttcacttaaacctgtacctgattttcatagcaatggtattcataatagctcaatgtggaaataatgcaaatgttcatcaattgattaatggatttaaaaatatggtatattcatacggtaaaacattattcatccatgaaaaataaaacactagaacatgaagtaaacttgaaaatacgcaaagtcaaagaaggcagagagaaaaggccatatatggtattattccatttatataaaatgtccacaataggcaagtctatacagacagaaagtagattagtgcttgtcagggaatggaggagtggggaatggggaatgatagttaatgggtatggagtatttttttaaggtgaggaaaaatgttctggaattacatagtggtgatggttgaacaactctgactatactaaaaaccactgaagtgtacactttgaaagggtaaattttattgtatatgaattataactcgataaaacaattatacaaatgataataaaaaatcagcaagtaagtattgatgaattaggatatgtgccattcgggaaacaaacaagatccaaggatagtaatgcacagggatatattttagaaattagtttatgttggatttttcaaaagcagaaaaagatgcaaacctctgagttttctggatttaaaattgaatgcagaattgtctactaatgatatgagagttacaaaacttgaactaaatcaaaaagccagtgctaagcactgagagatgtaatgtgtatttaaattagtccctgcagggtttgtagcttatgattctaataaataaattccaaaagcaataacacagtattatgtataatgattgatgtcccagtgatataaacatgcagctataggattatacttattttgcttatttaaataactgagaggttacattttaggagaaataagtaatctctaagtacacatttaagaagctttggagttggcatatttttaaaatttgcccttgtaatagaaaaggccgttgattacttgcttttaacgaattagtaacttttgcttgatgaagtaaaaaaggtacaaaaagttaactaattaagcaagtgacaaagaaaaagcatacaaaattcttgtagagttatcacaacttaattaactcagaatatccaataataatcactttaaacatttaatgtactttgtgaatactatgtctcatttgacccttacaaaatctgtgagatagggcatcagcctatatttccagatgagaaaatagagaaaatgagattaaatgtaatatttcatagttggatgatttcttagaaagccatgatgaaaaccatggatctcctgatatgatgactcatatatatatatatatatatattttttttttctgttagactagtgttgattgctcagtgatattggtgggattggagtggtaggagtggtagtgatgaaagactaaaaggaacaatgttttgataaagaaatatattagagtccatttttcacagactaagaataggtagttcaaaatctgagaagtaaaaaattaaaaacataaaaactttgtagaacaattagaagatacatttctgagtacaatttattataagattattgtgaagtaggatttagttatttatttaaaaaaactcagaaggttctcagcataaaaatatatgttagcaattagattgtgttttcatatgcacttaaaaagtgtctgggctggtactgtgtccccaagactagtaaataattatgtacgttagaaacaacctaccatatggtccctcttctcaaatgaaagtcaattactctctaatgaagcatttcaaaagcattttggccattttccaaataaatcattattcaacatttctttttagtaatgacaactgacttaatggtggccctggttttttatgcttcctctcttgccttatgtgaatgtaaatctaatcctacctttaaagacaacaggatgtcacagtacagcacccttagctagttcaaggcatgaaacaactctatcacttaaggattttgtgatggcagcttcacattagtccagcaattcaagatggaaataggacaatgtaacagaggacacaaaagctgttgctttatgactgaagttgcaggatagaggtgagccttgattctgtgttatgtagctggactccacaaaaacgctactactactcagcatattatgcactcaatagactggcctggtttggaaatgatgccacagtttgccccatcattatgtcttctctctcttttattaataaactttaggttcagaaaacccgtattacagaagcacactacaggagcacactattttttgtctttttttttttttttttgagaaacaatttctttttattattattattattatttaagttttagggtacatgtgcacaatgtgcaggttagttacatatgtatacatgtgccatgctggtgtgctgcacccattaactcatcatttagcattaggtatatctcctaatgctatccctccccgctccccccaccccacaacagtccccagagtgtgatgttccccttcctgtgtccatttgttctcattgttcaattcccatctatgagtgagaacatgcggtgtttggtcttttgtccttgcgatagtttcctgagaatgatgatttccaatttcatccgtgtccctggattacctgatgtaacatttttccttcttttatttttcacagaaattattttattaacatctttttcttttgagatatagagtagtgagttcctgtaatattcaaacaaacattattcacaggaatcattattttcctctgcctccagttcaataacaattttctttttcagtcagatgatagatacttttacatatcacatctcactaactcctaaataagtgtgatcatatatgtttctattatacacccttttcgtttcctttatccctcatttttctttgcgtttctttttttctttttacagcaaacaaagctctttatttagctatctttaacaatgtagtaaaattgtaatttttgttagatatttaatattgttattatccaaaataacatttgaagattgtcacttacccaatcagaaaaaaagaaagaaggaagaaaaaagcaaaaaggcaaagaaagaaaggagacaaagaaagcaagggaggaaggaaaggaaaaaagattgttaagccttcatttcttaaaacttgaaacatatttgcttactctaagtggcagcatggtagttctatgtaaaaacactttgtcattaaaacaccaacaaaagccctttagcgctttgttgaaccagagaatctcatctggatcagatttttttctactttattcaattctacctatcacgtttttattttattttattttattttattttattttattttattttattttattttattttattttattttaccaccatgagctgtgctctaatatcactttcttatatcagggctcttcatttccatcttttccatgtcaacttgctcactaatgttttcatgggctaggatcctcccatattttccatgaactgctgtttgtttgcttcagcatgcttgcttgacaacccacatcctttttctaacctgagtgctctatgcttgctttctacatgcctctgtgataaacagattcttttattctgcaatgtttgtcagaaaagaaagaagttggatttaggttatgctatggtttgaaagtgtcccccaaagttcatgtgttggaaacaacctccaatgcaacagtgttgacaggtgggacctctaagaggtggttaggtcatgagggctctgctttcctgaatggattcatgttgttaccctaggagtaagttcgctatctaaagagtagttttcttatactatctctggcaagctctctctccatgtgatacctcctaccatgtgatgacacatcaaaaagatcatcataaggtgtggccccccaatcttggacttcctagccttcagtaccattcagccaagtaaacttccattgcttataaattacccagtttgtggtattctcttatagcagcacaaaacagagtaaaactgattctcagtgaaaaatagatctatagatgcaaaacatcccttgacaatctatgggaagagtggttatttcttttttgattattgatgttcccagcaatctaggcacaatctctggtccaataaatatttgggactagtctactgcaagtcgatatctgttgaactatgctatgtctagcattcttgtaggctaaaatatcaccaatatcttttctttgtgtttccaatgacttgtaattaattacatttctatgactgctggtaggtgttctcgagaggttttgactattaaatattaaatatcaagagataacttttccatatgtctgaaaatttcaatgtcataagacccttaggtttttgttttctttattcatctaggcagcactttttcattttggtgaatccaatatattcttttccttgtcagttgactattttagctttaagaaattgtaaaatcatgtaaaattgatgttattttatagacagagtaattgtaatacggcttgctcagttgcctaaagatataaacatatattgacaggaacaggctagaaattgtcttcagatgatcactcacaaaaccaagtgcttttgctatagtcatgaataaggatcaagaatgaggaagataataacacaaattctctctagaatttcttgtagagctatttcatttcagtttgccatagttttgtttagtcagaggtgaccttttgagcaatgaaaagacaattttgccttcaattgaacactaatccctactaattagaatttagaaagtcatgtttttttaaatgtctaccttccagctgtcatatctctgatatgtgtttgcctttattcttgttggtttcctattgattatggaaacattagacttagtatctcacacactaattcaggcaactggtaggcatacatacatcagtaaagtaattcattttatccttctagcattatatcctcctatttttttgcccatttacacaaataatcatttcagtatgaaagatgttataaatcatttaacacctaggggacagttacaacaacaacaatgcaactttatcttctcaattttttttatttccttatccctctccatacacattttttactgcctgtattagtccatgcttgcactgctatatagaaatacctgagactggataatttgtaaagaaaagaggtttaattggctcatggttccacaggctgtacaggaagcatgatcggttatggggaggcctcaggatactttcaatcatgctgaaaggtgaaggggaagcaggcatgtcttacatggtcagagcaggaggaagagggaagccagattttgcagtaactcactcttgggccaggacaacacccagaggaatggtttaaaccatgagaaaccaccctcatgattcgattacctcccaagagtccccacctctgaaattgggtattacaattcaacatgagatttgagtggcaacagagatgcaaaccatatcactcccccatgcttgttccctcagccctctctcttctccttgacaatggctagcactgtgaattttacaaaactatggaaaattagaaataaattactaatttgctttgaggaaatatttgagcatgttataaatgagtgagtagccgaagtaatgaagcaaattacaaaggcaaagaagcattaaccttattttacaaagggtctttatagtcacttcccagaacagaatgtctgctagtgaaagaaaattaagatagaagagcaatgagatagtttgtataggcattagccaaaatcttcaatacaatttggaaactaattattgatcttcttctacttgtttcacatatcctttatttttcttaagaaaacccattaaatttagacttacattttaggctataagttgaatccataacataagaaattttcttgtgtgtagcaaggctatggatatgaaatttcttaagatgccacaaaactaatcagagattacgtagaataaaaaccacttccacttcactattttttctcatctgcagcagcagttcccaaactttttggcaccagggactggttttgtggaagacagttttttcatgtatcgggggtggagcagggtggggatgaaactgtgccacctcagatcatcaggcattagattctcataaggagcctgcaacctaaatcccttgtatatccagttcacagtaggattcacacccccatgagactctaatgccaccactgatttgacaggaagcagagctcaggcagtaataaccccttgccaactgctcacctcctgttgtgtggcccagttccttataggccacggactggtacaggtcagtggcctggggattgaggatcgctaatctagggcgtttaattagctgaattacttctattcgcacttgccctccccagctctcccctcctttgtagaatacagtgtgctgtatgccatccagaaggctttagatggctcactgttgccagttttgagagacttgacaggctcttcataaccaagcctcagaagacctgagtaaacttatttctatccactcactgtcaggcacagtacactcttaaaacaacagctccacacagcttctcagaagggaataaagaagccaaattaaaggtaattcatctttcaaatatttataaatatttaaccgcattcaatttaatagagaaacatgcttacagttttttaaaaatttctggatacgtagttgctatatatgtttacaggatatgtaagatattttgttgcaggcatacaatgagtgataatcacatcagggtaaatgagttatccatcactgcaagtatttatcatttctttgtgttacagacattccaattatattcttttagttatttttaagtggacaataaattattattgattgcactcaccctgttgtgctgtcaaatactagatcatattcatcctatctaagtatatttttttactcattaaccattaccctcttcccccaatacctccactagcctttccagcctttggtaaccatcattccactctttggctccatgagcttaattatcttaatttttggctcccacaaatgaatgagaacatgcaaaatttgactttctgtacctggcttatttcacttaacataatgtcctccagttccattcatgttgttccgaaggacaggatctcattcttctctgtggctgagtagtactcattgtgtatatgcataacattgtttttaatctatttgtctgttcatggacaattagattgcctccaaatattgactattgtgaacagtgctgcagtaaacatgggagtgcagagttcttcaatacacttattttctttttaaaaaatttttaattcttgtggatacagagtagttgaatattatttatggggttgatgagatactttgatataggcatgcagtgtataataatcacatcatgctaaatagtatatccatcttctcatgtgtttatcttttgtgttgcaaatagtccggttatactctttaagttatttttaaatgtgtagccaaattattagtaactatagtcaccctgttatgtcatcaaacacttggccttattctttctaactactttttgtacttactaaacatccctttttcccccaccactcccaccttactaccctctccagccttcggttaccatcttcctactctctatctcgatgaggtcaattttgttaatttgtagctctcacaaataggtgggaacatgcaaagtttgtctttacatgcctggctaatttcatttaacatgatgacctccagttccatccatgttgttgcacattacaggacctcattctttcttcatggttgattagtactcattgtgtgtgtgtaccaccttttctttatctgttcctctgtcgatagacacttcagttgcttccaaatactggctattatgaacagtgctgcaacaaacataaaaatggagatatacctttaatatactgatttcctttcttttgggtatatacccagcagtgggattgctagatcgtatggtagctgaatcaattttagatttttgaggagcctccaaactgttcttcaaagtggctgtactaatttacattctcaccaatagtgtacgagggttcccttttctccacatccttgccagcatttgttattgcctgtcttttgaatgaaagccattttaaataggatgagatgatatcccactggagttttgatttgcatttctctgatgatcaatgatgttgagcaccttttcatatgcctgtttgctgtttgtatgtcttgttttgagaagtgaatattcacatcctttgcccatgtttaattggattattaagttttttcctatagagtagtttaagcttcttatatattctagttattaatcccttgtcagttaggtagtttgcaaatattttctcccattctgtagttgtctgttcattttgttgtttgttttctgtgcagaagctttttagcatgatgcgatcccatttgtctatttttgctttagttacctgtgctttggggtataatactcaagaaatctttacccagaccaaagtcctagagagtttccccaatgcattcttttagcagtttcatagtttgaggacttagatttaagtattatttccactttgacttgatttttgcatatgggtagcaataggggtctagttttagttttctgcatagagatatctagttttcccaccaccatttgttgaagagactgtcctttccctaatttatgttcttgtcacctctgttgaaaatgaatttactgtagatgtatgaatttatttatggattttctattttgttccattgctttatgtggctttttttttctgccagtaccatgctgttttggttactatagctttgtagcgttaagttgaggtcaggtaatgtgattcctccagttttgctctttttgctcaggatggctttggctattctgggtcttttgtgactccatctaaattttaggatttttttttttctatttcagtggaaggtcatcggtattttgctcaggactacattgaatctatagattgctttagctagtatggacattttaacagtattgggtcttctaatccatggacatggaatatcttttcatttttttgtttcttctttgatttctttcaagaatgtttcatagtttttattgtagagatattttacttctcttgttaattcctagtattttactttatttgtagctattgtaaatgggaacactttctagatttctttttcagattgttcactcttagcatcaagaaatgcacagattcttgtatgttgatttttgtatcctagaagtttactgagtttatcagtttgattgtttttagtggaatcttcaggatttttcaaatataagatcatattatctgcaaacaaggataatttgacttcttcatttccaatttggatgtactttatttctttctcttgtctgattgctctagctaggacttccagtactatgttgaataacagtggtgaaagtgtactcttgttgtgttccagatcttagaggaaaggcttttagtttttctctgttcactatgataactagctgtgggtctgttatatatagcttaaattgtattgaagtatgtttcttatttacccagtttttttaggactttttaatcatgaaataatattgagttttattaaattctttttccgtgtcagttgaaatgatcacgattttgtccttcattttgtttttatgatgtatcacatcgatttgcatttgatgaaccatttttgcatcctggagataaacccacttgctcatgatgaatgatctttttaatgtgttgttgtgttctgtttgccagcattttgttgaggttttttacatcaatgtttttcagagatattggcctgtagttttcttttttgatgtgtctttgtctggtttggtatcagggtaatactagcttcactgaatgcatgtagaagtacttcctcctcctctatttttcttagttgtttaagaaggattggtgttagctctttaaatgtctgataaaatttagcagtaaagccaccaggtccttggctttttttttttttttttttaccgggagactatttattatggcttaaatctcattacttgttatggtctattcagattttggttttctttatggctaaattttttgggttgaatatcctcaaaatatatttattttttctattttttccttttttaatgtatgtttgctcgtttctaatgatcttttgaatttctccactatctgttgtaatgtctccttttttttgtcttttatttcatttatttgggtcttctctctttttttcttagactttttaaaggttcatcaaatgtatcttttcaaaaaattaacttttcattttgttgatcttttgtattctgtatgttttcatttcaatgtcatttatttctgctctgttctttattaatttcttcagctaattttacatttgcgatttgctcatgcttttgtagttctttaagatgtattgttagcttgttcaagttttaaaaaaaaatatttaggatcatatagctatacatttttctcttagtacttcttgcgctgtatcccatagatgttggtatgttgatccatgttcatctgtttcaagaaattttaaaatttccttaagcttctcattgacccagtggtcattcagagcatactgtttaatttccatgggcttgtgtagttttcagagatcctcttgttattgattttcagttttattccattgtagttagaaaggataattgatattatttcaaatttttttgtttttgaagacccttttgtggtctaacatgcagtctatcattgagaattatccatgtgccaaggaaaataatgtgtattctgcaaccattggatgaaacattctgtgaacatctattaggcccatttggtctatagtccagattaagtctgatgtttctgtgtggattttctatctgtgtgatctctctaatgctgaaagtggggtgttgatgtgtccagttatttctgcattggagtctatctctctttaattcaaataatatttgcttgtttatctgggtgctctagtgttgggtgcatatatatatttataattgttaatatcctcatgctgtattgacccctttatcattaaataatgaccatctctgtttctttttatggtttttgtcttaaaatttattttgtctgatgtacatagagctactcctgccattttctgcttttcattttcatggaatatcttttctcatctctttattttcagtgtatgtgtgtgtttatgggtgaagtttgtatcctgtagagagcagatagttggggctttaaaaaaaaatccattcagctactttatgtcttttgattggagagtttagtccatttggattcaatgttattaataagtaatgatttactactgccattttgtttctcgttttccagttattttgtattttttccttccttctccttccttccttccttttatccttcttcccaccttctatcctggcatactttttgtgaaagtgattttctctggtggtatgattacatttcttgctttttattatttgtgtatcgattgcagttttttgcatttgaggttaccatgaggcttgcaaataacatcttataacaaattactttaaactgttcaaaacttaacactgattgcataaacaacaaaaatagcaagcaagtcaatataaaatgaataaaaattatactgtaacttcattccatcagttttcttactttttgttgcttttatttatatcttgctatactgcctatgtcttgaatagttgtagttattactttcgattggttcatcttttagtctttctactcaagctatcagtagtatacatcccagaattacagtgttataatactctgtatttgtctgtcaacttactattaccggtgaactttgtaccttcagatgatttcttattgcttgttaacatcctttactttcagattgaagaactctatttagcatttattgtagaacgtgtctagtgttgaaaaaaatccctcaaattttgtttgtctgggaaagactttgtatctccttcatgtttgaaagatattttctttaaatatatcatgccaccctctcctggcatatcaggtttctactaagtcccctgccaaacatattggagcttctttgtatgttacttgtttcttttcccttgctgcttttaggacctcttttaaaaaaatacttgatttggggagtttgattattaaatatcttaggtagtcttatgcgggttaaatctgcttggttttctttaacctttttgtacttgaatattgatatctttcttacatttcaaaagttctttgttattatcttttgtaataaactttctaccccgatctctctgtctctacctcttctttagggccaatgacttttagattttctcttttgaggttgttttctaaatcttacagactgcttcattctttttaattcttttttcttttgcctcctctgactgtgtattttcaaatagagtgtgttcaggtttactaattctttctttttctgaatcaattctgttggtgagagactgatgcattcttcagtgtgtcagttgcacttcttagcttcagagtttctgctttggtgttcctgttgcgggaaccatcattggagggttctattttactatcttgttccacctccccagttcttgtaaatatgaaaccaaaatctttacaatggtattgacctttaaaactccttgcagatctgtaattgtaaacaaataatattttgaagctcaggtcattattttttatcttatgaggcacatgattggttatgacctttgaacaataatcttattgaatatgcacagatcatcttaagtgttaagagtgtctaaggaaatatacattacctgccagatttatgtatatgtatgtacatttttgagaggaaaaaggcaatttttaaagctaacatttggggacaaacaactaatattaagctaaaagtaaaaatgccttgaccttcttatactggttctatttttctctttgtccctgatagtgacagatgacattcatagtcccaatgagcttttctcatatttttgatttatcaaaatgcatgatttaataactgtctttaattttattttcaaaatataggcaaacagttgcatatggtacggtactaaatgtgttaaagaaccttttgttccctactctatttcgaggtgaaagagaatgctaatgtaatgataagtaaatgattctttcacatttggctttccttccatcttcaatttaaaaagttagctaggtacccactcagaataattgaataatgcttctttctacctaacactgctgtagaagcatttatttcctctcatatttccagttatctctaggcacagctttaggtaatatcttaaaagttacaaaaatattttcttatggtatgatttcataaatcctttatcaacaaacgcaaatcattcaaaggtttgtatttgaagttttttaaataagcacataaagctagtggccatgtagcaaacctctaaatttttttaaaatgtttcttttgttcttatttttgtgaaaatttgttatgtctttcaactttagaagaagttttttttcccataaaaaaaaaatctcaccatggggtttctattttgatgctatcttgtggatgggacatttggctaggtcatcaaatggtctgcatctcaccagctgctgtttttccctccctcccaagaccttgagaaagtaacgtaacattcctaagtatctatttctaactttgtctaagtatttcacaaaaaacgaattcaacaaatgcttatagatgacttttgtattcataagttgattttctttaaaggaaatactaatcccttgttttcttctccttgctcatcttgtttagtaatttagaaaacccaatgcctatattaaaaaacaaaattggctgggtgtggtgtctcacacctgtaatcccagcactttgggaggctaaggcaggcggatcacaaggtcaagagatcgagaccatcctggccaacatggtgaaaccccgtctccactaaaaatacaaaaattagctgggcgtagtgatgcattcctatagtcccagctactcagaaggctgcggcaggagaatcacttgaatctgggaggcggaggttgcagtgagctgagattgcaccattgcacaccagcctgggctacagagcgagactccatctcaaaaaacaaaaacaacaacaacaacagcaagaacaacaaaaactgcatcatctctctgtatccatctctttatttctctctctagtatgttcccgagtgcttgagttctctaatgatctatggcatgaagcagcctttatcagcttggccacttgaacaattacgtgttgcacatcacatcaaagaaaagggggatgataaatgaatatcatcttgttttggtggctattaaatgccttcactttcatacaatgagaaatttgataaactgagttgagcctcatggttaatgacatttccaaattttagaatatccataaataatggaggaacttattataaacaataggggataaaacaaagaacctctcttctgacacatgagaacaaatgacttcacatctcatctatttttagagaatgatgttgaagtctattcatttatcctctgttattcatttttggataaataatgatgctcttttaaaacctgaagtccaaatgccttaatacaataagatatgtgacattttataggcattttgtaacaagtcttgcatgtcactatagtgcggttacatacaatatcaattattccctaaggtattatatagttgtagatcataaacttatagcttaaattaaacatcacagctggttgctttaatttgatgcattatgccacaaatgtttcaacagcttgactaagatgagccatactgccgattcaaaagaagagcgaaggtcaatgcacaggaagcctagtcatttgcagattttctttgagaatattaaaaagcattctgcagaatatagttaaatggaatataaccaaacaaaattaaagaaaacagagcagactattgcgatggtgtttcacttataaaaagcagcctataaattcttaatttcatgtcagtgtttacgatagcacattttaaaaatcatgaatagggtgctttgagaatgttgtttacttctttcattgtggtagccttgcctgcttcttttcaaacttaaaacttcattaaatctgcaaaggaaggcaattatgagaagaaagataaaaaatgattgccccctttttcccctctctccaggaaagtttttccccctcaattagaagaccagaaaagctgtcttttcactcatcccattcttcactccaaaagtctttagctaagaatactgataataattccaccaagattatcattcattataatgaaaacccaatttttattctaactccaagggtattctaacccataataattagccctaaatattatttttgaagcaattcacaagctaaaataatctgttagttaagatcagaaaataaaactccctcaaatcatgtgtgctggcaacacaacagagatggaagcaatcatgtgtgaaaggttaataacatgatattttaagattaaaaagatgaaactaagcttttccgtatttgtcataaagacataaaatttcaaaaacaaaatgagaacccaaatatctctgagagtttgctctcacaacatctaactaatcatcatctcttagttcagaaacacttagttgttcataaaccacaaatcccttagtatgacatttggagccccattcaatcccattcatatatcattaaaccatacttaattacacactctagccattgcctgtgtgtgtgagtttttctttagccactattttaaacactcttcctcctttcaatacagttcaattattgtctcctattaacgtaatgctaatactttcaatcaaaattaacccttcctttattgatgtatctataaaacgtaattattatgggatttcagttatggaatactttttgtctcagagttattttaacaggcaaaatataaatttctttgtttcatgtatgactcatcttttctttagctcttcattcttctgtgtaggtaattaatgtctgttgagttaaattacatcatcattctaatccaacactttttttctttatagtgagggaaactaagtttcagagagtttaagtatgttttctgaacaagagaaactagtattgtttccaggatcaaagacttatttcttgctcaccatacataagtgccttataaggtgcaggtaaaaagcttgatctgcttaaagttactgatatagtcagagtttggagctactgcaagtttctaggtgctcagttcagccttaactggagcagaaaacatgccctgacctccttatcttgttttttcttaactctcttgtgtaccagtatttttggagtcgatttgaataacaatagtaatctgctttacctcactttacctatacatggaaaaagtataatcctggaggaaagtataatcaattgaaaagaatatggcatttacagtagagaaagctgaatatggaacctggctgtagtattggttgtcttccctaactttacattcagtattcctatttgccagtcgagggaacaatacttacctcaaaaaagttattgaaaggaataaattgagttcatttttaaatgttgactaagaaagactctgacacagataatttgctgaataaaaacaaatctattttcccccactctgctgctaaatatacccagatgcatttgattgaagatatattaaggaatggagaatagaaggaaaaaaaaagaaaaaaaaaaacagaagtaaacgggagaaaacaaacccactaagatttggagatcttgcatgataccactacatcagtggcactaaacccaataagatttggttctaagctttgctcaatttagtctctttcaagtagtctttctttagctattttagtcccttagtcacattagtccctttagttttagtggaaaaaaacatcagttactatccaaattatacattctaatgggaggaactttggcatgtccagcaagcttccattttctcagatgtaatgtgtgcattatcatgggaaataagccaaggcagttgctggctttttgtgttcccttccattctcccttttgctatcatcctagaaaatcacagtgatccattgtgaaactgaaactaagtctcacttttatggactatttatccttaatgaccttctcttttattcagccacagctgtatgttccaaaagtctaggtgttaccataacatagaccatgctatctagctatcttacacaccaaaatcctactccataaccatgagcccctgtccttgtaattcttctaaagccatccgcaatgccttgaagtccctgtcctttcagattctctcagtctatgtcttattttggccttttaaaatttcctgctaagtcttattattttcatctatattcttaattcatttgtacctctatttgggtacagagtgcaagcacattcagaaaatctcacttttagattaataggtcttttcacttcccctgttctactcttggggtgttgagaaatgctaaatgaataatatatctgggaagataggcttgtctaaagtgcatggtctaaaatatcaaaatgagagctccatgttgctatatgttctcatacccctaccctgaaaatctttacactatagttactttgatctcagctctgtgtccctgcacaaattaaaaactcgcttaagatattaatctttcctcaatggagatgcaaatgtactctagaagtggatgttctgtgtctgaatctcaactatgccactgactagttttgtgaccttagatcaaatatttatgtctgtacctctgatttcctatgtgataattagaaaagtacataatagttttgtgagaattaagtgacttaataattgtgaaacatttagaatagctctggtcatatagtaattaccaaacagctatccactattattggcatttttttgaacagaaatgtccatttcatttccttcttaacataaccaaaaatgatgctttaagaaaagtactcttccaaatatcctcaatggcattacctccagaggttttgctccctgtctagcaattttcttgtttgagcattcagtgtgtttgaacagttgtcccatcacataacttcactgcctttatttttgtctgactgtcttatttcagttaaccagtctttaagttctgagattcttttatcagcttggtttattctgctgttaatacttgtgattgcattgtgaaattcttgttttgcgttattcagctctgtcagacctattaggttcctttttatactggctattttgtccttcaccccctgtattgccttattgtgattcttattttccttagattgggttttgccttcctgttgaaacttgatgatctttgttcctagccaaattccaaattctattcctgtcattgcagccagcttggcctggttaagttgtgcacatataccctagaacttgaagtataataataataataaaagaggaagaagaagaagaagaagaagaagaagaggaagaggaagaggaagaagaagaaagaagaagaagaggaagaagaagaagaggaagaagaagaagaggaggaggaggaggaggaagaagaggaggaggaggaggaggaggaaagaagaaagaagaaagaggaagaagaagaggaaagaagaagaagaaagaagaagaagaggaagaagaagaggaagaaagaagaaagaagaactcttattggagaactggtgcagttgtttggaggacatataccactctagacatttgagttattggagttcttgcatgggttctttctcatctctgtgtatgggtgttcctttaactgcaatatagattgagtcaatagatacagtatagatgcagtatagatacagtcaatagacttattttctggatgttttcaccaggccgaggctttgtgcaaggtttttatttgaagctgattttttgtctctggttttggaagaaagtatgctagcaaagtattttttgtgttgaagctttggggtgtgatccagtaggtggcacttaggcatactggtcagctggtagactcttgtccagctatgtggctcccctgtttcctctcagttgtaactgttttctttctcaatgctctctgaaagtgtgggttcctctcccattgagtgctggctgtagaaggtggcttggcactcctgggctgcccactgtatctctccggtgatctcagtccttatgtttcttccccaacctggaaacaccagaggaaggaaccttagtagtagttatggctaagggacttttgcttgtctcctgggggctccacaccagagatacgggtcagtaatcactcagtgcagtcagcccaggatggaggggctatgctgtgggtccaagccagaggttccctgtctggtgatgagcagttggaggtgtgtgggacccatgggagactaactacctcctctctttgggtcaactgcagcttattggaggtgtaggtaaagcacttggggtctttgctacttcattactccaagggaagcaagagcagttccactgcagaggcagtggcagagaggctttcagttgcccttggaggctctgtccagggagttgccaagtttctactcactcagctctggcaagaggtggctggaagcccagtcccagaggaactgtctggtgaggaaatgtgggcaccaatgtacatctggccacttttctgtagggctgctgaggtatgctgggggcccacttcagtctctagtcacctcagattttcctgtacctggaggtatcaccattgaaggcacttcgctgggctggggaggttactttgtctctgtgtcatgcctgcgtgggccgtcatcctgcctggcttttctccattctccatgggttgagttgtttcctctattagtcccaatgcaagtacttagatgtttcagttgaaggtgctgaatttacctgccccttttgcccctctccgagagagccacgcacactagctgcttctagtcgaccatcttggccacctccctaaaaattaaaaaaaaaaaaaatgcttaagtgtttttagtaaacataagtatgatttcttatatgagtttttaaaaatttttaaaaagaaaaagaaaacatcatgtttcttaaaaacctaaagtttatactttcactatacaattttacactcttaaatatcaacctcaaactcgtttccacaatgccatctttctcatcttaaaatactttgaaagtataaacatacacacacatgcaggagaggagagaggcagagactgagacagacagacagacagagagagagagaggggggaaagagattttaaaagtgaactagaaaacagtaattcacatttagtttggggaatagaaagaaaactcccaaacagattactttgagataactccaagaccttttggtccttatgattatcctcaatttaaagaaaaacatatgtacacacactgccagatgtggtggcttgcacctgtaatcccagcactttaggaggccaaggcgggtggactgtctgagctcaggagtttgagaccagcctgggcaatgtggtgaaaccccatctctaccaaaaatgcaacaacaacaacaaaaaattggccaggcttggtggcacacgcctgtggtcctggctactgaggaggccgaggtgggaggattgcttgagcctgggaggcagaggtttcagtgagccaagatcatattactgcactccaagctgggtgacagagtaagaccatgtctcaaaaagaaaaagaaaaacatacacaaaaaacacctatagatgaatcccacttcatctccctactcttcccctgtctattccactctcaaaattcaactcactgcagctgaactgcaggagaagcagcaatgcgaatatgttttatgatgatacctttgcaatataaagttttcaaattctagacagttgctcttggcctgaagaaataactactacattaaacccttggaatctagtaatttcaaagaatagaaaattagaaatttcatcaattgtgttataataaagttggatattttcaatatttaatgcttttcttcaaaatatgaagacaacatttgttatataatatcagctagtcacgttatcctctttcacagtcctttatttttcttccaacatcaaagcaaaatgtgaatgaaaatacatcacatatatacctagtcataataaggagctaaagtcattgacacaaatttacgaagggacatgaatggatacatctgcctgtgtaaactagctcacaaatgaatacacacatatgcacagcattgagaaaccctaaacaaagcacaaaattgtgaatacaaagattggtttgcaagcagaacatagagagccaagacacacttagtatttactaagtattttatactgggcatttttttctgaaacttttatatttttcatttatatgctgtgaatataatgcctgaactgtctatatcataaggctgctgtgaggctcaaatgagttaatacgtgtgaaaatgcttttaaaacttgaaaataaattggaaaggttcttaactaattatagttaaaagagccaatacttttataactgagctctatctaatcattaaagaataatgagtagctcttattttgctcatttacttttatattgtagaaaacactgaatagctttttctaattcattctatgatttgaatctaactttaacactgaaaaaaaacaaagccaggcttcccccctcaaatatacgcaacttcacttaggaataggttacataatttctcggtcaaatatttgtaaattaaatctagtgatgaattaaaaagtatcacagaaatagtaggcagtatttatcaagcgcttcatgtttagaacaatatttatgttcatgtttagagcaatatttatcaagtactttatgtttagaacattttatgtttagaacaattctatacagtagtttctaatattatcccagttagactgatgagaaaagctaggtctagagaggtaagtaacctttctatcaacacacatgtagtaagtggtaaagctacaatttaaacccctccagtatgactcctgaactcatagtcatagcaccatattatgctgtttcactgaattttagtcaataataaagtttgaataaacctgtcactataattcatggcaatagtaaactaaagataacaactacaggttgtttccatagacctagtagagatgatgttatcatcaatgacaaaccattaactttatatgaaatggcccacaaaactttgttttattttcaaaatatgcatatttactaaaaatggtacatttaaattcagttaaattttcactaatatttatattgacactacagtgtgccaggaatagtgtgtttgggacacataaagaatgacaatatggagtaaaaaagaaattctgtccactctcaaagcaagagatccctaaaggatgaaaaagacaagtgaagaaagtctgagattttttttttaggtcgaatgaatggcaagtgtacatagtcctaaaatagccagatatacatcaagaactaaaaataattcagtgttaatcgagagaattataaagtggagagtggcagagatgtagcttaggaaaaggcaggtgccagttagcagagagccttctgtcattctgtcaccgtgaggtgctttggcttcatgctgtggaagctatttgaagccacttcctctttcagatggaatatatctgaaggctatagggtgaaattaaacataacaaaattgaaataatacagaaagttggcaaggaccttataaggacaattggagagaaagaaagaaggagaaagggaaatgcatttagaaattgttgaagagctaaaatcatcagagattggtgactaattagagagggatgcaaggtgacctctaatataaggtaactgagtgacatgtgaagccatttctgatattcataaattaggaagaagagtcagtgaggggtagaggaggctgactgatgagttaatcatgttcaattttaagtatctaagagacctctggatagctatatccaaatgcagataggcacagatgactagctctcaatggagaggtcactacaatgaatttgggacttgtagacccacaagtgatactgaaatcatgccaagatgaacaaaaaagattttgcatgcataatatttggcatatagtacattctacaaaagtatttattttaaaattaaataaagcaagttgtaatgaattaagaaaaatgtgtaaaagtagccccatttaggggcaacaggaagcacccatggagaagggatacatgtatatacacacacgcacatacacatgttgatatcaatatatataatcaatttatatacatattgtctgtggtcatatacatatgaagtaaaattattaaaatctccaggaaagtaagcatcaaattatctattaattctagctagagaaagtggtaaattggatagctctatacagaagacttgaaaaatgtctctttttatttctgttttataaaaaaattctgaaggagcagaaaaaaatgttaaaatttgacaaacctgcttagtgagtccatatctattttaaaatgtgtttctataagcttgaaatattttctgataattttattaaagagtacctaccaaatgtggaacagacttagtgtaaactacaatttgtaaaatttggctggaaggtgaaaaacaaacaaatgaggattccagaagaggagtgatttttccttttaaaagataggaaagatttcagcattttatagattgaagcaatgggcagataaagaaggatgatttttgaaatataggcaatagaagattgcacaacaatactgttgtgaaataaaaaatgagaacatttgtatgatctttgtcctttaaattcaattacaatagagttagaacttttatattttaatatatgacttctactaaaagcataaactcattttgtctcattctgcattataataaagaactaaaggtaaaatgttgtacctcttaggtgacatcattgaaaaacttatagtaagacaaagtcacataattttttttctcagaggaaatcaataaccatgagactccttcacaaactgcagtgcatttatatatttcaaagcatcatcacacagttgcagtattctcagtaatacattaccaacaccaaaacaagccagaaagagcatacctgctgaaagaaaaaggaaggaaaatgtgttacccaacatgtatgattttgtatttctgaatattgaagactgttgaaaagatgatataattgaatttattgaaatgtacaagatggcaatagagaatttacaatttatgatacagaatttctgacctgccctatatagtaacaactattgtgattctgtgagttagaaattcttttaaaattttgggcaatttatttggaagtacctttttaattttgtgagctcaagagggatgtttctcctttttggcccttagagaatagagaatattcttctgagatatatttttagccataaggtcattatttggtgtgctggaacgatgatggagttgaggaaaagatgacaatgataggagatggcatttgtgaaaaaatatgatcagtgctaaaagaaggcattacaaccacctcttgagtgacagaaagtctcttaatgaaatgctgaatttatcagatacataaatcaaatcatcaactgttacagcaaatctgccaaattaggaagaattcagctaccatcattactaatcccattactacaaattccttgtttcttactcttttcattccaaatgttctcttcctgatccttttgctcattttttttctcaatcctgtcactgacacttctgcatcttggtgtcagttcattgtctgaggtaagtcagtcaccttgcagtccctcacctcctgcccccaagagctgttcctcattggtgttctccagtgacctccactccctgaggtctcatatcagggcaagtcttcctagtcagatgatcaaagtctcaaaggtgttggctgctggtacaacaggattgggattcatattctgaggttaggcatgcctctcaccttttaagtaacttagttgaagctctccttgagaaaattatgaactagacaaaaataactcatggtacctcccaatttgcagaggtaggctcctttaaccctcctaccatcttttctggccctcagcctctttttaattccatctttcaggcatcaggttctgattcagcttcagtcttttcttatcatggaaaaaaaatcatcttcttgttcttaaacacaataattatcagcctaagtgagctacctcccccagaaatgcctgtcactgtttcagtgaattttaaacaccattgggggagaaaatttctctttggcagatgttaagatatttctgaaataatacagttgtatatgttaacttgtaagaagatctttatctctaaattgtaaactctaagataggtaataatcactgttagtaaaaattgtaataaaaatacatacagaatatttataatgtactagattttcttatttaatcctcagaacagtactatttgtgattatcctcgttttactgatcagaaagttgaaacgcaaagaggtttgtaaacttgcctgaggttgcctgacaaagaaagaactacagagacctcagtcttatgaagctaccattataaagaatatttcttaaaaaattctgtgtctactgaattgaaaaaagaaaatcagttctgtactgaactcattgtaatcctcatggggtcagaaatgtctaagcattctccagccaaattatttctcctgtttttcagtatccaacaagtattacacacattgaaactacttagaagaagaccaatagacctaccaaatgaaaacattttaatgaggagatttaaaagggaaggagatttatacacacacagatataaaccttccttaatgatgaagtatataaaacctaccctcagcttctttttaattccattttttaggcatcaggtttctggttatgtgatacagaatacaataaagacaatcttaggtagaattaagattttccagattcaggccaccaagaagaattatactggctgaggatactaccagtagggaataaagattccataaataacaaaactcaccttttctatttttgagaagagtgtggggagagagagagaaagatgctgtatcttttttatttacccctgcttgactttcaacagaccctggttccttgcctaccttctcaccatgtgcaagaagttgtgcaaaatgattccagtgcatttttgttactgggtaaattgaaggttaacttcttgggcaatttgttacagaaatcagacaagcttcaaatctattcttgcaccatttctctctattctaaatgaaattataaattcatatattcgggaacctcagaaattccaatttccagaatatctagaagagatgttaaatctaatttttaaaaaaccacactggccaggcacgttggctcacgcctgtaatcccagcactttgggaggccaaggcaggcagatcacgaggtcaagagctcaagagcatcctggccaacatggtgtaaccctgtctttacaaaaaatacaagaattagttaggcgtggtggtgcgcacctgtagtctctgctacctgggaggctgaggcaggagaattgcttgaatccgggaggcagaggttgcagtgagctgagatcgcgccactgcactccagcctggcgacagagcaagactccatctcaaaaaaacaaaacaaaacaacaacaacaaaaacacaataattagaaatcaacaatgacagagagatcaacacatctggaatttagttatgagaaaagcaaaaatgtagtgggtgcaacggagaaaaagttgtaaaaagcccatgtaaaaataaaatgacaaaataagttataattaaattgaggtaatatagttacagactttggaagaattcagaatacataattatactgatgatagtaaatacacaactacatttttatgtattttctttattatcttgaaaataacttaatgctactgtgcattaaatacttcttcattacagttgaattcaaaaaaatcagctctaatgccagtgagaaacagcacatggggatatataaaaagtagattaaagaggaaaacacttttatattcctaatttatcacactattttattactgatttattctactctttatgctttaatatcgagtacccttccttgatttaaatatactttgaaagggcaagagtagaaagagtagtgaacaagaaggcaataaaacaaattcagagaaacaatcctttctattttctgaaaatataatggagacttagccctgacttacagttttgtttttatatataacaatttgataacctctgttgcttgccacaaaaaaaatctctggtaacaatttaaaatgaataaaataaaacaataccagtattttaactaattaaatgggaaaataatcacctgtaactttgaggaaatgcgttaacatttctgcatgtcttttcattcaaaatcaagttaagtcctttgaaagtgggcctagagatacaagtgaaaaaaaattgttttgagatgtaagtaacataaagagcgagaaacagaacagatgttttcaattttctatccagtacagggtcacttgatgttactatagcattagtaaagctttttaactctatattgagcaattgtttagtcctccttttcagggtcagtagatagctatcaaaatttgtattttcattttcatttgactagaaatttcatggatgaaatatcagaaatatttctaaaagtcaaattgcatttagtgtcacatagcaatgtcatagtttgtcagatagtccaattttactgttaaaaataatacgtgatcaatattctacaaaggtaaaagaacggaagaaatcaagatatacaaaaaagttgtatcaacatcacttgagaaaaactgtcaactgcgtgaaagaatcagtatattgttatgaataagaattccatttacaaatgatttcaattcatacactgaattccacagacatttcctgctattattttacttttactctcaaaatacagagaatctcggaacctgccaagttatagaattaaaaagccttaattatctactgggtgtaagaaatttatgtaatggtaacaacacataatgatgatgaattctgcttctcttattgactcactctctcctacccctccttctccccacgcaagttaagtaatattagacaaacctgactattgtttcttcacagcagttagtccttactcagatgattaatttctgtgaatctagaactgttttcaatactttgggaaatactatacacaaaaacaggaatggagaaggataagcccattagggaaactgctagagcaaattttttttaatgaataaatgttgcagtattattgacagtaaccaagatgcagaaacagcttaaatatccatcaacagataactggacaaaggaactgtggtatatacataaaatggaatattattcagccttaagaaaggagatgtgccgttttacatagcatggatgatccttgatgacattatgctagcagtgtcatacattctaacaagatatatgtgtatatatttgcacacatataatcttttaatgttttctttaaaaactcagttcctcaaaatcagctcttctttatttgaaatagtagctgacagtatgggtagcacaataaagtatgaaaagtagataggctcaaaaaatacttgaaaatagcttaaacttattagtgatgcctaaaagtaaatattgcaggcataaagagcatattttcttttatgctcaatagaaaactctgttgaatcacaatttcttttgttgaatagcaaaaatctttctagattttaaaaaaagtcaaaattgcctccgtgtactctaggaaaaattatggtgtttaataatgcacaaaaacagtgattataagaaacaacaaaaattgagttactattgtagacagaatattgtcattgaatgtgacatgacataaagtaggggggacctggattccgatatttggtttgtcgcttcctagatatgtgtctatgaaaaatgtattttatttccctgggcttcagactcctcatctcacactttaaggattagactctaaactcctatccggataaattgtagcagatgctactggtgctgtgttcatatatatccccttacattattttacctttttgtgtgtgggtgtgtgcacatgtgctccaggtgaatgctcactctaagcagccagtaccggactgtctttgtcagtgagctgtccttagctttaggaaactaaggcctacattgcctgcagacactgagagcctgaaaaacatgggcatgcccagctttgctctcttcaccaatgacttggcctggactgggacaattctgaaatgagatttccctttctccagagctttcctgtgggatgaagccaaagccaccctctgagatcttgaagcagtcctttggatgtacttctgttttcctgacttcctcactctactgctgttagttctcctcagagtacttcctaataaatcactttcacaggaattctcatctcagagtcatctgtttctgaggattccaagcaataatattttgatttattttgttttggtttgacattggtttgtgtgaactctaatgtctagcattagataaggcacataacttcagaaaaaattgtaaaaaactactctactataatctgtatgagtaaaacaagtcaatgtaaatatcattttaaataagacccataagagactatagttacattacatagcaaagtaacaataatatcctgatgtagattcttggcatctgtgaactactaacatagattcatgtaaattagataatttccaaataaagttaggaaacttaacaaaaatgtaatctattttgagagtgaaacagaaaaagcaaataataaaaatatataaataatcaaactaaaataaataaaaaaccaagtgaattggtcagtcttatgaatgtattttaaaatgtagaattaatatagtatactaagagtaaggtttattctatatacaaagggatattattaataagtggctaatcaaatatatttatataatgtcaatgtcaagtaaacacaaagattaactcaattttgtgttttcatttaactttaaattaaaacaatgttttaaaaatactatttttatagtactggtaatatatattatatacatatctaatttttaaattatttataaggatttaaaaatgcttgcctgtggaagtacatattattttacaatacaagaaattactttgataaatactaattgtgggtttaatcagatcagctgaatgatataaatttaccttaagactaaaatatttctgagggtgaggactcctttgatatatgccaatgtatcaaaatacttttttcttctggcaagtgaaataagaagaaaaatcagcacaaccactatatctggcatttattttctctcttttaccagctggtttccttgaattcaacctaagagtgcggttttcatttatgtgaaaaaagtgtaaggttaacagtacattcactcctattttgcaaggtatttttcttttgctgatcaataatttcaaatactgctctaaagttttactgtttgacatacatcattttgacagttccttaaagaacttaaatgctacctacaaatgtaatatcaacaagatctatactggagagtagtctacactgctaaaccaacttcattcttgctgtagtggcaaactgaaaaagaaaattctcttccccaccttcttcattttaatccatgtaactcattttattaatgtgcatcatccagcaaagtaaaataaaaatttgttttttatcttgttaaacgtagtgttagattttaaatacatttatctaaagtgtatttaattactggcttcacaaaatctgaagttgagaattgctacacatgggtagagtttttttgataattaagaaaggcttatttttatactgttatatctttactggcagtagacctttaattttacatttctcatcctgcttttattttctagcccctctccttgcattattcctttttaaaactttgactagattaggattacatatacaaagaatatgtaaagtcacataaagctgtaaaccatccaaagaaggattttgcttatttgcctgcttttcagaaattagcattactactccagctttcctttgatttatatttattaggtatatattatcaattattttattttccatatttctgtggaacattatacatacagcacattgttggattttgttctcacgtcttcaatttagtatctttgtcttgtatttgattagcttaatccatcttcatttattttaatttctaattttttcccatatcctggacttcctaattcaattctagaaaattttcttgtggtgtttaacagttatgtaggccgattttattattgatttcttaacttaaaaaatacatatataatcacttctatttcttaaatgcgtaaatgactttatcttccataatatgaaaggaacacattagtataccacatttatttcgccttgtgttctcttcacctcccattgcattactaatgcctggaatattacttctagtactatgaatttttcttttctttgtttattcatttactgtagtatatcacatttatataaaatgattagattgctgtattaatactgtgattacagagggcatttattttgttcagttagttgtatatcttttggactaaacttctgagtactactattctcaggcacctacttcgtttggcctgtgagctcatattatctgtgcaatattggctttttggtgttggagaaagaccaaaggccagaccatagtcactgtcagtctagagtagtccaaggtgtatatatgtgggagttagggcataggacatgggctttctaacagaaagtcccacacaccaccaaccagagttattacttgattttacaatgaccaagcaagaaacgactctactcagaatttcactcctaaatcctttgggaagagaatgtaaggaaaggacagttttacaaagctgtaatctgtaaagcttggaaactggatttcagaagtaaaggactgaatgtctctggcatgtcagcccccacatactttcacctcacccagaaaaacccctgccaatataaatattcacaactgtagtttgaggaaaagaagataggcattgattgtccaaaaacaaggagatgggagggtgggatggcaagaggtaaaggagaatttaaactgtccttccgatgctgtctctggcttctctttgccctaagctgtggccacccattcactcttcacacagaaacatttaaaatagacttatttctgttattcttcttgttagatcttggattctgtctttctctccttattttgttctcagcattacttttacaaatattaaccagcaatccatgcaagttggacatcttgttgaacacctgaattcttgtgtgtgtgtgtgtgtgtgcgtgtgtgtgtgtgtgtggggggtgaatttttatctctattcaatatgtgttatttatataaataatttctatttagcagtctataatttttcctgaaactcatttcccgtgttaaattattcacatattttcattttatgttattttattgttttacatacactgactttatagctagataatattgttgtagagttgaaaatctatgtttaacttacaataaaaaaagttatccatgtaaaatgaaaatagatgttctgaaatagggccttataaatattcctttgaaaggacacttcatgaagtgtgaaaatgccaagcatcagctaataaatctttgtgacaatttctgtttaaatgcaatttttaaataatgcaccaatttaaaacgtagaataaataacatagtgagaccagaaatcttatccaaaattgtattctgttatgaatacaattgaatactgctagatattacttactttatagcttaagaaatctccatgcattattttaatggctcaaaccaccctatcacatttttttaaactaaaacaatacagcagtcaaaggaaatagttgatctatgtttgatactatgcacatacttatttacatgaaagcatcaacatgagcgcatggccctgtgttgaaaatgccgaggcaacaaatactgtaagacaactaatacttgtttaaatttcagttctttttgttgattctttttactccccaaaacaacttgtttgttccgggaaacattgactatatagtctattagctgcatctctccctatcctctctctactctgcctccccttttttgtcttcttctcaacttgcttctcctgttcatttttgccttattctttcaccatttctttcctcctccttcctcacattttctcctcttttcccttctcttcttcctccattatcaagtagtaatggtaccatttctcatacttacaagtgccaatgatggttctactcatcattcaccagacactttccatgtgctggacactgtgcttagctttttactatatgagtgattacagttggcagtgctcggaattcaatgggaagttcaatttaattggcatgtggtttgattaaaattatgctctgacagttttaaaattagattaaaatagactaattaatttagattaatcaagataaattttaaaactctaaaattatgtgtatacacttttaataaaatatatagcttcttaatgtatactttgtccctaggttgatttaaacatggagcaaaatataatgcttcaggtgtaaatatttaagacagttcaaaatgaaataacactaaaatgaaattaaattgctcataaatttattatataagattgttattctttaaaatatcctggctgtattctttcttttgcattaggacaccagccaaaaaccatatggcacataacatcagtaaatgttatcatataacaataatatttaagggtgcctgaaaatggtcctcttggagaaaattagttaataatataagcagatgcaaaattgcctctaggtaggcatatatttttatcagcaaaatatttgatgattggcttccaaggataaattcactataattaacttctgtattaaaattgtttacaagagattggtaacattagacaactcaaactgggttgttctctgtaagaataaatggaagtcacaagatttgccttaagcacctctttcaaaaagaataaaaatacagaaaaccatttgtactgtaattgcaggaatcaaactagttttactttatagattcacaatgaagtaaaatgtataaaatcatttacattttaaataccaaggatcaaggtccctagcccagttgaagaaggtagagtaaacatagttgaggctttgggtgaagtataataaaaaataaacctatgttagagagcttatcagaatctttgaacagaaagttgtatatattatatatatatttctcccctggggcttacagtgtcctggagagtagtatatcatacaaatagccagtgaccagaccatgaagaaccaaatgaataatgctaaagtatttcaaacatatgttgaatttataagggaccaatgaaacatgatctgattttattttagaaaggtgagtttagctgcagtatggagcatatattaagtgatacaaaactggaagagagaacacagttaaatggttactgcagtgattccggaggaaaaaatatgaagggctatactaaacactggtagataaaacagagaggaaggaacagctctaaaagttatttaggaaaaagaattatttgaacttataaccagaaaaatgtgagaagctaagtatccaggatgacccctagggtctataacgggagattctttgatagcagtgcctttcactggtacaaggaatctgcacgaagaaaaaattagaagatgacgaagtttgtttattctatgctgatattatgacatatctaagtgggtatgcctagtaggcaaactgacatatgggatgggcattgttaaaaagaagttgtatagattttagtaataaaatgagtgtaaggagagaggtgatctttcataattttggttcaccaagtttcagctttctactattattcatagttctaattcaagtcaattattcttaagtgactggcatcacgaatattttggtaatattctgaaaataattatttaaaattaatggtcgtgaagggaaattggtataatagacaaatcagataaggtaaagttagtgtacatacagctggtaatattcattttcccttgctagtaagccagtatgaacctgaaataacatagtatgtttactaatctagccaatatttttaaatataaatccaatactgggagcactggtgaaaaactggtacacacattttatttctagtgacatttttgcttgttaacaatattttgggacacaatttaacaaatatttagaatgagccatgaagatattcttaaaatactatttgattaattctattcttacaatttaacttaaggaataactgaaagtaaaaatagagatatgcaaaaaatgtttaatgtggttcaaaaattagtctaaatatcttcaagatttatcaaataacataacaacagcaaaatgcaatggtacataaccattacagattcacatgtaaagaaaggagagtgaaattaaaagaatttctatgagacattgaatcttacaaatttttccttttttctctgaaaattgtatttcaattgaattttgttttatatttggggaccaattacacttttttttactctaaataatatatacatataaaatcataacatttttatttattatggattcctgggttcttttgcaggtttgttacatgggtatattgtgtaatgctagtgtttgggtttcaagggaacccatcacccaaatagtgaagagagtatccaataggtggtttatcaaccctcaactccctctcataacctcccctcttttgaagtccccaatgtctattatttccatctttatatccatgtgtaccccttatttccaattcccacttataagtgagaacatatggtgtttgattttctgtttctgagttacttcacttaggataatggcctccagctctatccatgttgctgtgaagaacataatttcattcttctatatggctctgtagaattccatggtttatagacaccacattttcttacccaattcttgtttgataaacactaaggttggtttcatgactttactattgtgaatagtgctgcagtaaacataagagtgcaagtgtctttttgatgaaaagatcttcctttgagtaaatacccagtagtggggttgaaaggtagttctatttttagttctttgagaaatcttctaccattttccgtaggagttgaactaatttacattgtccatgaacagtatataagtattcccttttctccatatgtataccaacatttgttatttttcaactttttaataaaagccattctgactggtttgagatggtatctcatttgcatttctctgatgattagtgatgttgaaggttttttcatatgtttgttggcaacttgtatgttttctttagagaagtgtctgatgacctttgcccactttttgatggagttatttattttttcttgttgattgtttaaggtccttataaattttgaatcttagtcctttatcagaatcatagtatgcaaatattttctcccattctgtaggatgtatgtttactctgtttatagtttcttttgctgtgcatagctctttagtttaagtaagtcccatttgtctacttttctttttgttccatttgcttttgagttctttatcataaattatttacttaggtgaatacacagaagagtttttcctagattttcttctaggattcttatagtttgaggccttacttttaaatctttaatccatcttttttttttttttttttttttttttttttgagacagagtcttgctcttgtcgcccaggctggagtgtaatagcacgatctcagctcactgcaaactctaagtttccaagcaactctcctgcctcagcctcctgagtagctgggattgcaggtgcctgacaccatgcctggctaatttttttttttttttgtatttttagtagagacggggtttcactatgttggccaggttggtcttgaactcttgacctcaggtgattcccccgccttggcctcccaaagtggtggaattacaggtgtgagccaccatccctggccttaaatctttaatctgtcttgagttaatttttgtagtatgttgagaagtaagggtccagtttaattcttctgtatatagctagctagttctctcagcaccatttattgaataaggagtactttccccattgtttatttttgtatacttggttgaagattagttcattgtagatgtgtggcttttttctgggttctctattctgttccactgctctatgtgtctgtttatgtattggtaccatactgtcttggttattagagccttttgtatggtttgaagttggataatgtactgtctctggttttgtttttaatgcttatgattgctttgggtatttaggcattttttggttccatgttatttttagcattgatttttctaattctgtataaaatgacattggtcatttgataggaatttatttgaatctgtagatttttttgggatgtgtagtcattttaacaacattggtttgttctatctatgagcatatcatgtttctctatttctttgtgtcattgatgatttctttcaccagtgtattgtagttcttgttgtagagatgcttcaccttcttggttaaatgaaatatatttttaggtattttattttattttttgtggcaattgtaaatggaagtgaattctttatttggttgtcagcttgaatattgttgatgtatagaaatacaattgattttgggtacattaatttatgtcctgcaactttatttaattcattgatcaggtctaggcattttttggaggaatctttagggctttctatgtataaaatcatttaatcacaaagagagatagtttgacttcctctcttttatttacatgccttttctttgttttgcttgcctgattgctctggcaaggacttccagtattatgctgtataagagtggtgagagtggatattcttgtcttgttctaggtcttagaaagaattctttcaacttttaccattcagtatcatgttggttgtgggtttgtgatatatggatcttattattttgagatatgtttatttgatgcctagattgttgagggtttttatcatgaaaggatgttggattttatgtaaaactttttctgcctctactgagataatgatagggttttttaaaaattttgtttatgtgataaatcacgatgattgatttgcatatgttgaaccattgtttcatcctagtaacaaaattcacttgattgttatggattatcttttgatgtgctgtttgatttggtttgctagcattgtactgaggatttttgcatctgtgttcatcagggatgttgacttatagttttctttttctgttgtgtccttgccaggttttcgtatcaaggtgatactcgtttcctagaatgaattaggaagcattcccccctccttgtttgtttttaataatttcagtaagattggtaccagatcttctttgcagatcttctttgcctatctgatagaattctgctgtgaaaccctctggtcccagagtttttttttttttttttgtagatatttttattactgattcaattttggaactcattattggtaggctcagagtttcagtttcttcctggttcaatttttagaggtggtgcagttccaggaatttatccattacctttgggttttctagattgtctgcgtagagatgttcttagcagtctctgagaacgtattgtatttctgtggtatcagttgtaatgtcacttttgtcatttctgatgatgcttactgaaatctatttttcttggttaatgtagctagtggtctatcaattttgtttatccttttaaagaatcaacattttatttcgtttgaaatttagtaatataaactttcctcttaacactgctttttctgtgtcacagaagtgtttgtatgttgtgtctctattttcatttgtttcaactttttaaatttctgctttagttatttgcgcaaaagtcattcaggagcaagttgggtttttattttgtttgttgtttttttcattttcttgtgtagttctagtattgatttctaattttattgcactgtggtctgagaagttgcttgatatgactttgatttctttgaatgtgttgagaatctctttatgatcaagaatgtggtcaattttagagaatgttccatgagcagataagaaaaatgtatattctgcaatttttgggttgagtgttctgtagatttttttaggtcatttggtcaagtctaatttaagttcagagtttctttgttagttttctgcttggattattggtttagtgctgttggtggggtgttgcagttccccactactattggatgactgtctatctcttggtctagtagtatttgttctataaatctgtgtgctttgatgttacatgtgtgtatatttaggatagttaaatcttcttaaattgaatcatttagcatcacataatgctctaatttgactttttttaaaaaaactgttgtttatttaaagcctgttttatctgatactaaaatagcaacccctgctctttcttgtttttcatttgcatgatacatctttctttatctttttactttgagcctagggctgtcattttgcatgagatatgtctcttgaacgcagtagatggttgggtctctctttttttttaatccgattttccatttttgtcttttaagtggagtatttaggctgtttaccttcaaggttaatattgatatgtgaggttttgttcccatcatagtattgttagctagttgctttgtagtctcaattgtataattgctttacaggatctgtgaattttgtacttatgggtgcttttatggtagcaagtattgtcctttcatttccatgtttagaattcctttgaacatttattatagggccattctagaaatctcttagcatttgtttgtctatgaaagacatcgttattcatttgattatgaagcttcattttgaaggatataaattcttggctggcatgtttttttctttaagagggtaaaaataggcccccaatctcttctagctgataaggtttttgttgagaagtcagctgttagtctaatgggattttctttatgggtaacttgtcccttttctcaagctgcccttaagatttttttctcccccttcatgttgaccttggataatctcatgactatgtgctttggtgatggtcatcttgtgtagtatcttacaggtggtctctgattttctttcttgtatttggatgtcaacctctctagaaaggttagggaaattttcctaaattatttcttccagtgttttccaggttgtctttttcttcttcctcatgaatgccaatatgtcataggtttggttgtttttcataatccgatatttcttaaagactttcttcattttttaaagttcttttggctttatttttgtctgagttaattcaaaaactggcttccaatatctaaaattctttcttctgcttgatctaggctattgttaaagctttcaattgtattttgaaattcctttcatgaatttttcaatactataagttctattttttttattttgttttgttttgttttagtatagttatgtcatgttttatatcttgcattttttttctggtttctttgtgctgaattttaactttctcttggatcacactgaatttcctggaaatacatattttgaattattcatatgtcattttagatttttaattttggttaggatccattgctagatagctagtatgatcctttggaagatatcaagatactctggctttttgtactgctcaagttgtgctgattccttctcatctaagggagatgtacctttttatttttgtttttgctatcatttggatggaagatttttttttgtattcctttctcccttgaatgcttgaatgtgtgattgtgttgtatgttttctatgatattttggctttatttctgggtgctttgaggggcccagtgctctgtttgggttccttatttggggctagcttctggctttttcagatgctgcttgttgtagtgatgtgttagacatatgcctcctgcaaggcttagggtgaggaggaaggactcaggaagcttattttatggactagcagtgagcccttctggcagcaggtttttaatttggttgtacagttcaggatccagtccagtagatggtgattaagagtaacatctgtcttgccctcaagtaggttgatgatgagtggaagcacctgccctgaccaagtgggatatggcaggcagagatcctgttgggtgtattgagatctcaggggaggggacaaggggatggtgcactagctccttgtcctaagcaggcagggacatgatccacttccctatcatgcccctctcacagggcacatgttcatttatatagactttaaccttttgttcctgaatgcagcacagctgcagctggcaggtacaccctttggctgctaccaccgcacattgaccattctctaaaattgactacattcttgatcataaacagtgtctcaataaattcaaagaaatcaaaatcatattgatatggtttggctgtgtccctctccaaatctcaacttgaattgtatctcccagaattcccatgtgttgttggagggacccaggaggaggtcatcaaaacatggtgaccagcctttcccatgctattctcgtggtagtgaataagtttcacaagatctgatgggtttatcaggggcttccacttttgcatcttcttcattttctcttgccaccactatgtaaggagtgcctttcacctcctgccatgattctgaggcctcctcagccgtctggatctgtaagtccaattgaacctctttttcttcccagtctcgggtatgtctttatcagcagcatgaaaacagactaatatacatatcaagcaacttctcagaccacagtgcaataaaattagaaatcaataccaaaaccaccaagtaaatggaaagtaaacaccttcctccactcaaggcacatggctactgccagagctttcaggcaccacaatatgattagactgtcatggttcattgattttcagggaacagatctacttcaatacaaaaattagccagatgcattggcaggtgcctgtaatcccagctactcaggagactgaggcaggataatcacttgaacccaggggtggaggtttcagtgagctaagatcacaccactgcactccagcctgggtgacagagtgatactctgtctcaaaaaaaaaaaaaaataggtaagacaggtaaacatagtaaccaacctgaaagtagtaaacatagacatacatgaatttttaccttttatagttaaaattttactattgatttttaaattcctaataatttatttaaatgaaaaattaataattttttttgacaggaaacaaaactgtacatgaagttggcaacttatgattctaacaccatttactgagatctttttatatgtttatttcttttgaattggttttgtttctttgactcttggtcttggttttatcttttccttgactggttctcttttgactgtaattgtcagaaggacaatttgatttatcttaaactaaacggaaatttatcaaaagaccatggggatgactcatcaaacaggactgagagccagtgccaataccaactgtaattaacaacacaattgatactttcactctctgcactcatttgtgctgttctttaattttgtcttctttgcttcctgttttctttctttttctttgtagaagcaaacctctgctatttctctgttctacttgagcataaacttaaccattgtttgctctcaagcttttttacttttgacttaagtaccacaaaaatattaacttattttctttttattccttataccataattgccagaaaggtttcctattctagcttggaaagaggatctgttccctaaaaatcaatgaatcatgacagtgtgatcatattataatgcctgaatgctctggcattagccatgtgtcatgagtggaggaaggtaaagttcccgggaaagtatgtatgtgtgacgggagcaataagggggggcctggtcagaaaagtagcatgtttgcaaccatctgaaacaacgaatgcattcatgtaaagattccttgtgttcttagcccagatactagcagtatttatagctttcatcagctaaaccctgttatatgatgtgtatcactacatacctgcttggatgtttcacagttatctcacttttcattatgctcagtatctcccattcacccttattttcagttcatcctgcttcttcttcgcccattcatcccatctccaattgaacctgcttctcctgaagtgtttctcatatcaggaatatcaccatcaaccagcctcccatttgctcagaacagaaacttgggagttgttctttactgttcccttttgctaaacctaccaattacaattaattattcacttttaaatctaactcttattttgagtctggaaaatagataggactctatcccttttgcaaaaagcatttcctctagacaattgcattatcctctaaatttcctttctccgatatcatccctacctctaatttcttctgcatacaacagacagaatgatgttggttaaatacaattgaattgtgctagaaacacttctatgatttcccactgatctaaacataaaattgagcattttgtagagcctacaattgtgccaatattctccttgctcactacgttctagtcacaccacacacacacacacacacacacacatatattagtttcttaagaaaaaatgcatatactcctcccccacgcctcttgaactttatccagtttttctttctgaaacaatcccttgcttactgcctggctgtgtccttgtcctataaccttaaatgtcatttcttcactaaggcccaccatgagtgtcaaatagaaatggcatctttatgttattctttctcctaacttccctttatatcacttaccaaaatttgtcgttttttacctggtaaaacatttgcttattggaagtctatctctccttcgaagtagaagcagtgaaatagcgagaacaatgaccctttgcttacaactctctatgtcatgagagcattgtgtgctgctctctatacatcccactcctttgctcggggcctgcgcctcttctgctagctgtatagtggagttgtgtcctactcaggagttggactctaaaagggctcactgtgaacatttagccaaaatgtcgcataactagttttgtttataaatataaatatgcaaaataatacaatgtatatttaaatatacaattttattttagttctaattacacagagagaaaaagtgagcacagtttaatttgcataattaaatgtgctattactgatggctgaattaataaattacagatactcattaaatatttgttggaatcaattaagtccagctttaaatgtctttgctaccatttctatttgaaagatgaataaacagacatctaaagcaactgagtaattcctctagtcacgtgtaatctctttaggttttctgtcttcttatattttgctattcagataatacatatacggatttgactttatttttaatttttgctcatgactatgctgaaggaaacttgaaggataatgaatttcatggcactcagaatttcttgagtttgtcagtgaagtttggtctgtgtatacagtttgtctggtgaagtttgattcatgacatcaattgttttctagctgatcgtcaacctgtaataccatgctgactctgcaagtgtctagtgatcttattcttgtctcccttatgcttgtgtttctggaatgctgtcatcagcatattactgttaatgaatgactgtcttggagacttttgtgtcacttcacggtttactataagaatttttatacacattgaaattaaatcaataccataaaataaaatgctcacaatctcctaaaaaaccgaatattttctttaaaataggaatcttatttttaaaccatagtgattaagtgggcagggtattatatcctgatcttcctcaataaaaatatcaagcaagttaaagctggaaaaatctttatcatatattcaagatctcagtctcaatactgttggcaggtttctgtttctagtgatgcaagggttctggttttttttaatgagaataattttcaaggttgaattaaggacttatggttgttgtattagtcagtgccattttaactctcctaaatcttcgcaatgcctatattcaaaccctattactccaaattcattgtgtgtgtgaatgtatttgtatgtgtgcgtgtgcacatcttgaggcttaaaggggggcaataaattgcaaaatagaaaattcagacaaattgaactataatgcaatgctatcctaacttgtattggaatgcagccatataagcttctagtacattcttctctgaactgaagtgacctactggagttgctgacataaagggaaaattgcagacctttaccacagggcaagagcctataaacttatgcctagacaagttgaaacttcatcctgtagacagatcatgtcaataagaagcagagtatgtttctttatcccaaggtcacctaccagtttatagatgaataaaagtgagagagatgtagagcagaaattccctaatgcaaatatgggccaagggaatggagagcccctgacaaatagaatgtatctgtttacaccaggatgctgctagtgagggaatgtttgggacttgatgtgttgaaaaattcttctggacctatttcctgtagaagatatgtctgtattcatcattttttggatgatgattcaaaaaatcgtcatcctttggatgaatcacctcattaattttcattaattttcatcattaattggatgaatcacctcattaatctttcactcacaatgtaaaattcaggcaatagtgaaaatggagtatataagattcttttttaataaaagaaattctaatctgcgtatgaaagtaaacatttgtcatgtgatgttacagtatcaatttctcagacgtatatttgatttttacccgttgtttaatatcctcacttttctctttgtactgtttttttttcttactttcttttgtcttatcataaagtatctttgcagaccagaattactggaataaacccttagttcagatttcatttccaatctttccctacttaaatttatatatgatacaaatgccagaaattttgctggacttgtcatgtcatcaatattaacttccaatagcaaatgtgtctgcaaatgtcaagttcaaaagctgatctctgatgccactccagccttatgcatattctctcatccacccaattcttcattttttaaaaacaatagagtatctagagtgtgcctaaaagtatataaggaagtgtggagtcaatatggtactaaataaacatggtccctgctctaaggaacttaaatactagtgcagaaggcagaccaaacataggcaaaccacaaataaaagaaataattgtcagtcaaaatgacatttagcaaaaaagatattaagacagagaatcacttggagataagaatctactttaaaaagaatatctgtaaggcagtggcacctaatatgcagaagattccagatgaaggaatagtaggttaaaacttcctcaagtggtgaagatcttgatccattcaagaaactgaaagaaaatgagtgtgaggagagtcatgtttgcaagtgaaagagttgtgttaatatgagatgaaggtgataaaatagataaggtgatataaggcaggggctggctgtacatcatggtaaaaagtttaatttttattatataaaccagaatgctgcaataacagtataaaacaagaagcaaatggtagtcatgtgtgtaatttagtatgctaaatatgttatacttaaattaatatatccaaaatcgtatgattttaagatgcaataaatatatagttattcatgaaatattttgtgagtgaaacttttttgtactgattcttttaaaatccattgtgtatttgacacaaacatctcagtttacagcagctgcatttcaggtgctcatttgtcacctgtgcctcatgactactctattggaatggaaaactgttagtgtgttcaagaaggagactgatgtgatccaaattacattttcatgttactctgctattatttacagaaactatgtagtggagaaggtatggatgaagacaggaaaatgagttaggaggctgtattagtttcctgtggcttccgtaacaaagtaccacaaactggctgacttaaaacaattgaaatttattttctcagaagtctttcttgagaccataaatctgaaatcaagatgtgggcagagccatatttcctctgagggctctagaaaaggagtcttcttgacctcttttagcttcaaatggttgctggcaatttttgaagttgcttggcttgtagatggatctacactttctagtttctacctctgtcttcacatgaccctctcttctgtgtgtctgtgtagctgtgtccaaatgtccctcttcttataaagaacacttgtcttatttgatttgtggccaatccttatcaagtataatctctttttaatgtgattatatctgcaaaggccctatttccaagtaaagtcacattcacgggctccaagtagacatgaattttggaggtacacagttccagacagtgcagaggccattggaataaaaggtggtggtggcttgtacacacccagcacacatctatacttcactcccctctgcaccctaggtagtaggctggggtggaggcagtagatataaaaagaagtgattgtgaaatacattttagagatgtaattaactgatgtcttgaatgtggaggggcagagccaaagcaatttggatgatatttccaatcagagtttctatcatgcctttcctgatcagtcactaaatgcccactgtttttatcctggaaatttgtgtttctagcttctaaaggatctaactcaaagccatctcttttatgtccctctttacgaggcctttcttaattagctttaccttattggtaagagtattaaactagaagaaatggattagcctgtcttaagtactaaagaaatcaaatatatatttgtataatccattattagtgaaactttgccagtgtttaaatatactgcaatgtactctttgaaaaaatctagaaactggaaattttagaattgaaatagaaatcataattcaactcacattgtattagttcattttcacactgctataaagaactacctgagactgggtaatttgtaaagaatagaggtttaattgactcacagtaccacaggccctaacaggaagcatgactgggagtcctcaggaaacttatgctcatgatggaaggagaaggggaagtaagcaccttcttcacatggtggcaggaaagacagagagagagaaagagagagcaaagtgggaagggccatccttttaaacaaccacatctcgtgagaactcactatcaagggaacagcaagggggaaatctgcctccatgatttaatcatctcccaccagggccctcccctgatacaaagagattgtaattcacatgggatttgtgtggggacacagaatcaaaccatattactcattaaaaacaaaaagcaaaacaaaactacatatcctttacatctagaatatgacgcacagttatctgggtacaagtattcctaatgatttcaatctctaaatatactaagttttccaattcatattttttatcagtctgtctcattcataaatgaaatcacccaagttcttaaatctagtcatatttttagtttgtacaatctcttataggtgttcaattccataaatataaagtatactgtttaattttgtaagccctattatttcttgtaaaaatcacctgcaatctgctctcagagtggtcacagtgaaggatgtcaggcagttttctagttcaggtagcataaggctgaataaaaataaatatgttatccagatgttgtattattgatttactgacattccttcatttctgtttgtgtttagagtcttgacccattttttaaacatacaaacctgaaataagtttcctatccctttgtccttttctgcaattttttaaaacctcacattgcttttcctgaggtatggggacccaaaaactgaaagcatctcattaacaggccaactattaacacttgtgggtcccaggccaagaatatgaatgaaggctcacagaatgtaagtctaaatattgaagttataaataaagctttaaaaaccatggaataaaatatgttctaacctcttatcttggaaagtatactttgataattacttaaaaagcacattccaaatccagatttctttggacttcctggcattctctgcaggaacttagcaacgtggagagagccagcctgtgttcttatttaattccaatatccattgttaaatctgggtaatgattgcataagagttctttttataagtctccctttttttcaagttagcaattttctacaacaaaaaaattatattaataaagtttagtgtctccttgatagctcccgaaaattttgtgttccatgagaggaggttttatttgcttggctgtgtttcttgaagattctactgatgtcttcagtgatatgcatgcccccattaaaggtgggtgacaatgatcaatgtgatctgtataatgttgcattttcattcctgagctcatctttggccttggcatcattaagcaatccctatgattctctctgtgtctctcttgcttttgttttatttaaataatcttgggggcggttccaagatggccaaataggaacagcttcagtctacagctcccagtgtgagcgatgcagaagatggttaatttctgcatttccaactgaggtaccgggttcatctcactggggattgtcagagagtgggtgcaggacagtgggtgtagcgcaccaagcatgagctgaagcagggcgaggcatcgcctcacccaggaagctcaaggggtctgggaattccctttcctacccaagcaaaggggtgacagacggcacctggaaaatcgggtcactcccaacctaatactgcgcttttccgatggtcttagcaaacggcacaccaggagattatattccacgcctggctcagagggtcctacacccatagagcctcgctcattgctagcacagcagtctgagatcaaagtgcaaggcagcagcgaggctgggggaggggcgcccgccattgctgaagcttgagtaggtaaacaaagcagcctggaagctggaattgggtggagcccaccgcagctcaaggaggcctgcctgcctctgtagactccacctctggtggcagggcatagccgaacaaaaggcagcagaaacctctgcagacttaaatgtccctgtctgacagcttggaatacagtagtgtttcttccagcacggagcttgagatctgagaacggacagactgcctccccaagtggatccctgacctgcgagtagcctaactgggaggctaattatgtgtctgcccagtaggggcagactgacacctcacaagaactggtaccactctgagatgaaactttcagaggaacgatcaggcagcaacatttgctgttcaccaatattcgctattctgcagcctccactgctgataccaaggcaaacagggtctggagtggacctccagcaaactcaacagacctgcagctgagggtgctgactgttagaaggaaaactaacaaacagaaaggacatccacaccaaaaccccatctatacgtcaccatcatcaaagacaaaaggtatataaaaccacaaagatggggaaaaaacagagcagaaaaactgaaaattctaaaaatcagagcacttctcctcctccaaaggagtgcagccccttgccagcaatggaacaaagctggacggagaacgacattgacgagctgagagaagaaggcttcagaggatcaaacgtttccaagctaaaggaggaagttcgaacccatggcaaagaagttaaaaaccttgaaaaaagattagacgaatggctaactagaataaccagtgtagagaagtccttaaaggacctgatggagatgaaaaccatgtcacgagaactacgtgacgaatgcccaagcttcagtagctgattcgatcaactggaagaaagggtatcagtgatggaagatcaaatgaacgaaatgaagtgagaagagaaatttagagaaaaaggaatgaaaagaaacgaacaaagcctccaagaaatatgggactatgtgaaaagaccaaatctgcgtctgattggtgtacctgaaagtgacggggagaatggaaccaagttggaaaacactctgcaggatattatccaggagaacttccccaatctagcaaggcaggccaacaatcaaattcaggaaacacagagaacaccacaaagatactcctcgagaagagctactccaagacacgtagttgtcagaaccaaagttaaaatgaaggaaaaaatgttgatgttaagggcagccagagagaaaggtcaggttacccacaaagggaagcccatcagactaacagctgatctctcagcagacactctgcaagccagaagagagagggggccaatattcaacattcttaaagaaaagaattttcaactcagaatttcatatccagccaaaataagcttcataagtggaggagaaataaaatcctttacagacaagcaaatgctgagagattttgtcaccaccgggcctgccctacgagagctcctgaaagaagcactaaatatggaaaggaacagccaataccagccactgcaaaaagatgccaaaatgtaaagacaatcgaggctaggaagaaactgcatcaactaacaagaaaaataaccatctaacatcataatgacaggatcaaattcacacataacaatattaaccttaaatgtaaatgggctaaatgctccaactgaaagacacagcctggcaaattggataaagagtcaacaccaataagtatgctgtattcaggaaacccatctcacgtgcagagacacagataggcccaaaataaagggatggaggaagagctaccaagcaaatggaaaacaaaaaaaaaggcaagggttgcaatcctagtctctgataaaacagcctttaaaccaacaaaaatcaaaagagacaaagaaggccattacataatggtaaagggatcaattcaacaagaagaagtaattatcctaaatatgcatgcacccattacaggagcacccagattcataaagcaagtccttggagacctacaaagagacttagactcccacacaataataatgggaggctttaacaccccactgtcaacattagacagatcaacaagacagaaagttaacaagtatatccaggaattgaattcagctgtgcaccaagtggacctgatagacatctacagaactctccaccccaaatcaacagaatatacattattctcagccccacactgcacttattccaaaattgaccacatagttggaggtaaagcactcctcagcaaatgtaaaagaacagaaattatagcaaactatctctcaaaccacagtgcaatcaaactagaactcaggattaagaaaatcactcaaaaccgctcaactacatggaaactgaacaacctgctcctgaatgactgctcggtacataactaaatgaaggcagaaataaagatgttttttgaaaccaatgagaacaaagacacaacaaactagaatctctgggacacatttaaagcagtgcgttgagggaaatttatagcactaaatgcccacaagagaaagcaggaaagatctaaaactgacaccctaacatcacaattaaaagaactagagaagcaagagcaaacacattcaaagcgagcagaaggcaagaaataactaagatcagagcagaattgaaggaaatagagacacaaaaaacccttcaaaaaatcaatgaatccaggagctttttattgaaaaaaaaaaaaaacttttttgaaaagatcagcaaaattgatagaccactagcaatactaataaagaagaaaagagagaagattcaaatagatgcaataaaaaatgacaaaggggatatcacccccaatcccacagaaatacaaactaccatcagagaataccataaacacctcttcacagataaactagaaaatctagaagaaatggaaaaattccaggacacatacagcctcccaagactaaaccaggaagaaggtgaatctctgaatagaccaataacaggctctgaaattgaggcaataattaatagcatactaaccaaaaaaagtcctggaccagacggattcacagctgaattctaccagaggtacaaggaggagctggtaccattccttctgaaactattccaatcaatagaaaaagagggaatcctccctaactcatttcgtgaggccagcatcatcctgataccaaagcctggcagagacacaacagaaaaagagaatattagaccaatatccatgatgaacattgatgcaaaaatcctcaataaaatactggcaatctgaatccagcaacacatcaaaaagcttatccaccatgatcaagtaggcttcatccctgggatgtgaggcggttcagcatacgcaaaccaataaacgtaacccagcatataaacagaaccaaagacaaaaaccacatgattatctcaatagatgcagaaaaggcctttgacaaaattcaacaacacttcatgctaacaactctcaataagttaggtattgatgggatgtatctcaaaataataagagctatctatgacaaactcacagccaatatcatactgaatgggcaaaaactggaagcattccctttgaaaactggcacaagacagggatgccctctctcaccactcctattcaacatagtgttggaagttctggccaggtcaatcaggcaggagaaagaaataaagggtattcaattaggaaaggaggaagtcatcttgccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaaggggtgtgaaggacctcttcaaggagaacttcaaaccactgctcaatgaaataaaagaggacacaaacaaatggaagaacattccatgctcatggataggaagaatcaatatcatgaaaatggccatactacccaaggtaatttatagattcaatgccatccccatcaagctaccaatgactttcctcacagaattggaaaaaactactttaaagttcatatggaaccaaaaaagagcccgcattgccaagtcaatcctaaaccaaaagaacaaagctggaggcatcgcgctacctgacttaaactatactacaaggctacagtaaccaaagcagcatggtactggtaccaaaacagagatatagaccaatggaacagaacagagccctcagatataatgccacatatctacaactatctgatctttgacaaacctgacaaaaacaagaaatggggaaaggattccctatttaacaaatggtgctgggaaaactggctcgccatatggagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacactgaaagcaatggcaacaaaagcaaaattaagaaatgggatctaattaaactaaagagcttctgcatagcaaaagcaaataccatcagagtgaacaggcaacctacaaaatgggagaaaatttttgcaatctactcatctgacaaagggctattatccagaatctacaaagaactcaaacaaatttacaagaaaaaaatgaacaaccccatcaaaaagtgggcaaaggatatgaacagacacttctcaaaagaagacgtctatacagttaagagacacatgaaaaaaatgctcatcatcactggccatcatagaaatgcaaatcaaaaccacaatgagataccatctcacaccagttagaatggtgatcattaaaaagtcaggaaacaatgggtgctggagaggatgtggagaaataagaacacttttacactgttggtgggactgtaaactagttcaaccattgtggaagtctgtgtggcaattcctcagggatctagaactagaaataccatttgacccagccatcccattactgggtatatacccaaaggattataaatcatgctgctataaagacacatgcacagatatgtttattgcggcactgttcacagcagcaaagacttggaaccaagccaaatgtccaacaatgatggactggattaagaaaatgtggcacatatacaccatggaatactatgcagccataaaaatgatgagttcatatcctttgtagggacatggatgaagctggaaaccatcattctcagcaaactattgcaaggacaaaaaaacaaacaccgcatgttctcactcataggtgggaattgaacaatgagaacacttggacccaggaaggggacatcacacactggggccattgtggggtagaaggaggggggagggatagcattaggagatatacctaatgttaaatgaccagttaatgggtgcagcacaccaacgtggcacatgtatacatatgtaacaaacctgcactttgtgcacatgtaccctagaacttaaagtataattttttaaaaaagatcaaaaaaattacatcaggattttattttagtgattaaagaaaataaacacctaaaaaaaatcttttattattgacattgaagtcccttacaagatgatggtcaaattctctttgtcccacctaatttctagtttaaacttgtctcagaaggctgtgaattttctcatgttgaattatattacttttcaatttgaaaagttagcttttcccctcttttacagtgtcagtttttctagaatatttctctttccataagctttacctttagattcatgacttaggatctaaatttaggattatactattttaagcagactttgtgtttcttttacattaaaaaaatctttttctagcttttacctatcttttgccaaactttcttttgcaaattttggatagcaaccaaatgttttctgtttccttcagcctcaaggtacatattcagtaagtatgtaatcactattatatactagtgtctgttaattgtattaactaacatactagtgtctgttaattgtattaattaatgtgtgtacatttctttttattatagattctaaagcaaactactacacgtaggccatcatgttccaagtttttgaaagttcatctttttcatcttgttgataaatttcatcaacttttatgtaggtaattcaaatagaaatttgggataaattggactgattttttgggattattgagtatttttatttcagctcgttttacagcactgaaagctggagtaaaagacattagatatccctagtcacttgagacttcattttaaaagccagttgtactggctttgccatggctttgtcttggttttgatttctaccacatttcctcctcttcagtgcttcctcagcggcgtgtacttgagtatgcgcacgtgcaaatgaaaaaaacatggatatatttgtagtacctattatgtctttcatgctcattcaagagagatatatatatatatattagtaataaaactaaattttaaaagcctaaaaattaggacccagcctttttatatagacaagatatgtcatggagtcagattctatgaatatccagtgtgtaaaatacacacacacacacacaaacacacacacacggagttcacatatcaaatgaatgattttaacagtttaaatagaatatatttttagattgcttgaactgataatatcattgctatcaaaaggatttcatgccttttcaacatttagtttttgtttgtttgacatcttccaattttgtgtttaactctatgttgactttatcattttattccaaacttacgctccaaaatgcattgctgatgatatttatattagtaggcattctgtggaattgtgcttttacaggaaatacattggtaaatcttaagtaatcttaaattgtttccacagtaaaaaaaaaaaaaaaaaaaaaaaaggacttagtatgaatctgcaagaaaatatagacaaggtggacaccaaaaatagttttatttccatctgtaattactagctatgcagcaagtataaaaatatatatttgatatgtttccttgaatatgtgatgtggaggcagcaacactatttgtaagctttttaaaagagttatagtatctttgcagagatactgtactagggtctagagaccaataaaaaaggttttcatctgggctgctccacttactatcttgtgtgatatttaccaactgatattaacaaagtatcagtttgctgttttttataaaaggaacaaaaacacagcttttgtatgttctggagaggattcatatagatatatattacttgatacagtgcctggcatataacctacattctactaatggcatctattattagtagtaataattaaagtggtaatgcttacagaaggaaagggaatgtgagtacagttaagtacccttaataaatttatatattttattaggttcatatatatttatttgtgttactgacttttattatacaaatgttattgattacttttaatctcagatgaaataacttggaaacttagagaagaaaaatatttttattcatatagcaatattatataactcaaaacctccacatattcaggactcagattacatggaaatttaacaatcaatgtaaatcacaaaatctgtcactttcatctcattttagttttacttttttacataatatgctagccttttttgctttttctaagcacacatgttttattaatcataaatgtgaaaaaataagcggtgtattttgtcattgcttggaaaggaaacttaaagacaattaggtattttgtcaggggcatagatttatttataaaatttatctactacaaattgagttgttttaattcttcactatccttctgagagagattagaagaaggaatgacaatgtctgcttacatgggagaatactgaaagaaggccaccttaaatcacatggtgtaaattcattggtggtcaaagctcagcacacttccgcggtttgtcttctccatattgcttccttctgtatggatgcatacatatatatccatttttatgtacaatataaagtgaaggatgtatttaaataagttccatcctcattcagttaaaatattttatggtctttaattataaaatcatattttgaaaattgagctgactctcaaatcttttggcatagcattctatcctttctggcataaacttgagttaccactctaatctcattcctcacattgtccctttaattgactccctttaggcaattttgaagtagtagttgtttatgcatatctttgtcatagtctctctgacttctaaatatttgcaattactattgccttcttagattccatatcactcagttccacttcaaattggctaatagtaattcatttttctggtcttagctgggatgtcagtagcttctacattccaaattatttaactcttttgtacgtcccctctccaacataccatttccatacacacacacctcgggctctctccgtggtaactgtattttacctatagaatgcgaattgtcttatttttctgactcacagtggaagtgtcttcatagaaagggatatattttctttttttcccttagtgtcccctcccctctaagcaataaccataatatgcatttaataaaaagttataaaatacaaatatattcctatcatgaaggtgaaatttctgtatactgaaataaactgataataattttagtcaagactttaatcattatatcaaatcaatgtgaaactgaaaatacatgatgatactttgtttctatatctctgataaaatatatatatttatgaaattaatatagatagatttattgtataagaaatcaaaattatctgcaattctaccctctagtaatagctacttttgtggtacattttctgtttaattatctataaaactctttttgtacatattaaatttatcaatttataaatttccatctaccatttagaaatacaagagctccatcaagaatcatctcctgaaagctatgtattctttctttaatcttctaagtgtatgtgatagacatttgtcataaactttcatatgtttacggccttctattaagctaaaaatatttaattcttaattattgtacctaagtctataggaaacttagattttattctctacatctgaatatggcacacgtgcatacgtaataccataataaataattcaaacacatcatttgttgtgattaatgcctacaagagggagtaacaatgacatcccttgaaatgtctgtgttttatttaagttccaaagataactgttccttatttaaagtttttatttgtttgtttgttcttgttttggttagtatattggttaataaagttgtttggaattttatttatcattatttgaattttctaagtcttataactcagagcagtaatccagaagttaccaacaatttccaactcctatcctcaggatgaaagcccttgaaatagaaatgtgagctgtggcataatggaagcatttggcagctattttcccctgctctatacatgagtgcatagactctaattcatacaaaaaagtttatataattaccgatttgcaacaaaatttacttttcatgtacttatgattctaatctatctcaaaagtagataatcaaacttttgtaaataacctttcaatgatggacaatgttattgctcctttacctattactacctctccctgttcttttcttcatcccaatcaatatgtctagataaatacatttttttctcatttgaaatttagtttggaaaatgcagccacatttttacttatctttttcaaataattaaaaacttctacctcactcatgtaacatcttcctgcatgatctaatctgcatctaatttttctctgactagcagcactagatgttttgtgattagggaagtcagaagtgatgagactttaatagaacataaaatatttcttttctatatttcagtaagttaaactaaattatatttacctaaattatgtacgtactttgataaacatctcagataatcttgaaaataccaagcagcaatgaaggaaagtgtgagggaatagggagggaggggaaaaggagaagagggaaggggaaggaacaggaaaggaagggaggtgaggatggaagagttttgtgtaactggaattcttgagagtgaggttcttgataaccattgtcaatcctgggaaaggaagaattaaatcacagtcctttatcgtttgggtattatataactatcttattaaccattcaaaagaaaagaaaatgatagacattctgctttaaagcaagtggaaagcacagtctcatggaatcccatgaatttctttgaaaactgtctcaagttacttaaacttcctaaattgtattgtttttatttaacatgagtggtatttacagtacatatttgaagataaaatgtgatcaagtgagtacaacactctcagctgtgagaggcatttagtaaatacattacataataattaaactcaagatctcattttaagtgacacatttaggaatgagaagggaaggtcccagaaaaaagcacagtcagattagtttactcagaaatcgtagtttcgcatttgaaatatgaaatcccaacctagttcgtgtattacttcccttccctagttatcacagggtcggatttgtgtcagtctcttaaggtaaacattcctaaatgtgtagaggtttttggaaagaagaagcatgacaaaattaaaacaaactgaatagaatccattgggtcttttattaagaatattttttatttcaaatgtaagtgttctgaaactggatcagcaaaataatagcaactaagttatttaaaaagataacaggaaacaaagcatagacatttggtcttggatttaagcacattatgactctactgttgaactgtggttctgactcagtgacgcctacagtagaagaaaagatgcttaaggtgggacagttgtgacctaaaaattaaagctctaaatatttaagcttattttaagagcactaacacagcaaagcatatgcacagagaagaacatgaattatacactaatcaaattttaataagtggagaatattagtgtagaagtacacacctcaccaacaatgtgttgttgctgttttttcattttgcagggaaaagtccggcatttacagaaggcttttgcttcaagagtagataaatccacacagactgaactactatgctatgatgtaagtagctctgtaaaaccatttttaacttcattattggcattcagacctccacagcttattgacctctgcggctgctgtgtccatgcattgatttaacaggatttagcggtgcaccattcatcttttgctcttaaacaatccccaaatacctcctggaactaaaaaagatgattacaggcaccaactggcataccaatgccttattaatttttttacatcaacaattttggtacagtcttttgaattagtgtatttgcagacatgtagaagatatgcattagaagactagggcaatttattttttaagaaaatatttatttattaacagtttaataaagttactatgtttgtaatcaccaaaggtgaagcacatcatttttatatgcagacacttaaaggcaaaaacaactttgaagaaaaatttaaaataatgttttagctcttgggcttcagtgcaggcagcagaaagtaatttaattgaaagtatttttctgttagtgcgaaatacttgttgaactgtcaaaataggattgtaaaacatgttttaatacagtattacatctagtaacactggatgatttgggaaaacattgatataaatgctcatttttttcttaaacacagctaagaaatttgcattttgcctaagttcatgactttcaacttcctcttgatgaaaaaataaaggaattaatttgatcttgtagctaacatgtatgaggaccccctcttctatttaaaaacatttattcttatttttagcactttgctgataagtagaaataaaatagaaataattttaagttttatgatgatgaataatgataaattatatgtttatctgcatggtctcattatgttaaataacaaacttggatgctacttttgtgttgccgtgcaaattacattaatttaatataaaactacttttcttttaggaaataaaccaaagctttgaatcactgcacaaattgttttcaagtgtttatataccttattttcttaattaaaaacaacactaaaaaatatgaattaaaaattattcaattatgtttattttaaggtatatttactctagatatctaaattctagatctcaattttgtaactgaaatgcttctagcagtgttgtatgttacttaaattatgttgacatctatttttaaaaagaaataattttatggtccttaaagagtatttaccacaagtagttcaatattggtcttttgtgagggatttttttcctgtctaaaaacttggttttttgttgttgttgtttgtttgtttgttatttgagatggagtctcactctgttgcccaggctggagtgcactggcgcgatctcggctcactgcaacctccgcctcctgggttcaagtgattctcctgcctcaccatcccaggtaactgggattgcaagcacccgtcatcactgccggctactgtttgtatttgtagtagagacagggtttcatcatgttggtcaggttagtctcgaactccttacctcaaatgatccacgcgccttagcctccaaaagttctgggattacaggcgtgagccaccaccccctgcctaaaaattttttaatgaaaatatttatatgctagtccttaggatataaacccaatatgtgttttacaaataacaacctttgtatctataaatctgcaagacagagagtttgttcaatatgagtaataaaatcataattttcattaaatcttattctaatataacatcatacaacacagggactacaagttaaattagaatccacttacttcaagcccccaaatttttaaataagttaactgaatttcagaaaaatgaagtcacttttttactactacatgacgtttgttgggagtctagtcttttatttaaggtaatgtgcttggaaaagagaaaacaaatatacatttggattcaaattttcaattttatttaaagaaacaatgtttgggagacagaattctaactttttaaatgacaatataaatataaaatgtaagacttttatgtaataccatcaattttatgtgacactattagtgattgcttgtgagaattggttactgaggaatgaacgacacctctggggaaatgacttatctgtggatagttattctaacaccatagttaccagcagcctcttacgtatttgcctatccatgcctcataattttctaatttctatgatatttcttatatcaatgtcatttagttctctaagcatgaaaataaaaatgtaaaatgaagccatggtaattgttaatcctcattaaatcttcaatgttcctagcttgtttcgtatgttacagtgatagtttaatgcatcttactgtattgaattaaggttaaagaataatactttttttgacaatgagtccctaaagaatccccttcatatgagcaaattaaatttctaaaatatgcatgtaaaaacttatgaaagtaactagatgtaactgtaatactaaactttagggcatcttgcatgtgaaaaactggggatggaaatacttaaacaaatcaaaaataagtaaaacactttcagtatcataaactacataactggaaatatatgattcataaactgtacaatttctcccatgaccaggatatattttcaatatttatttgtaaatattttttaatattttatatgcaataataatcatttattcttcaatttatagtattttgttctgtttcaccctcaggaaatatagtttcaccttattttaactttcaaaaatattttataaacacatgtatctatttataacttgcaaattgtgtttattcaaaaacaagaaacatctcgtggaaatcttgtacattatggatgtttcttatactcttttgttttcttcttaaagctgccaacattagccacaaattgttctttacagattattatggatcatgttttattggtatgagtatcagaatatatgatactacatgtcatcattaatataatttccttgggaaaatagctgttgctacacattttgcttaagataagaaatagaattcccagaaaacattaattataataaaatctattaaaaattcactgccatgaataagtttaaagatttgtacaataaactacttttatcctgcaccagatttgtcaggagacatgaaactaatgttagtttacaatgtgctctgacttctaacgcacatggcaagacttaaaaaaaaaattcagagtgtctcagcacaggcctataaacaccatagtttttgtgatgagggagattgttaaataaatgatgaatgtgtcttaaataatcaatgccaatttaacctcttccacgttcctctgtctgcacaggcttagtttattgaaagatcaaagaataatttcttaggtgtcactgtgttattaaaacaggatagaagatgaatagatgtagttaagtagcattgctgcccatttcaagattacattgaggggtagggaagttttttatctaattacatcaaatgtataaacagatgtttcaatgtagtatatatgctgtctgtaaatattttatagcttgaactactacaaatagcattttgattacaatatttgagaatgcataatcaaaatattctaaagatcttatattctgacagtgagaaattcagatactttcattaatttgacatctttatggacagcttatgtcctgaagaagattgtttttgaaaatgtgacaggttgattgactttaagttcaagttttcttttcagataatgcctgaaattgacacagaatagtcagaggatttaaaaatttctctgagccacaaatgcactaaagttttaagtaaagcagtttcttccttcattagcatgtgttttacactaacatttaataagaagccatttttagtcttgaacttggcagtgttttctttaagacttctgatgttatcaggtatttcattaaatattaaattattattaattactgttagtttaaatatcattaggggtttcaatttggcttcttaaaatggactgaactgtggcatcacgtattttgtctcattcatgtatgaataaagcataaatcagtttgttaatggatgctcataccactgtttattttttcaaatattttaacacactttccaaatggtgggatttgctttataaatacagttttctacttacacatgaggaaaataatattatttgcattatggatgtacactttgaaaaacttttcaatgcaattatctgtgtatttcacaatctctggtacttttctcagatttaattttggtggtgctcctggcgcagtttgcagatagtcctaaaaaatatgaaaatagttcatcatgctgtattcatgttaggaataagaatgattagtttttactgtaattgttttattagatagagcagaagtgttttttgtgcttgtgctaatgtattatgtctgcctgtggattaagccctgttctaagaattgaataactatcaattaggctttctcatcatgctgctaatatactgtagtttattaaagtttctgttttgctcttatttattacttctatcttcttaaattcagtacttctcctgatcatgtatgaatgtgctctggcatttattagaaaaaagtgactcccccgcacatgcttcatgtatttatatttacttatctcaaatatttctgtttatttttacaaattaaaaaacatttagttttaaaaattgagttatatattccaggtttgcttatgggctataatttttcccattacattaaagataacttttagataagaacattgtttaaaaacatctatcatgtttaaaaacatgattatctgccacgggtgcttattaacatgtaatggagtcacatcttatccagtggtaatgttctaagggcatcacttttgaaaatttattcatgctttcattcaacaaatatgactaagtcccctctagcagccagctccattctaggtccttggaatatatcctttaaccaaacaaaaaatattcctgcatggagcttgcaactggtgagggcatacttaaaaatcaataagctaagtaaataagcaaattatataatgcatttgaaggtgctgaaagcaatgtgaaaaataaaaatagcacagagaaagaataattctaagtgtatagtgggagggtcaagactatgatcagaaattttaaatagggtgatctagggaggtctgagtttgagatttgagacttaaagaaggtgaggtgaaaatcgtgtttaatcaaaaattcctttgtgatgtgcttcttgaaaattccttgacgtcccttcagtcagtaagaactaagcactttgtcattgctggagccctagataagaatagcttcatttacacatcatgtagtataaaaattatattctagattataaaatctagattcaggctcagtacatcaagagactcacactagaggaatacggtctacctgagggaacagccgacgcaacttctatatcatattcatctagcataagcactgagaagaaatctgcgtaaaatcaaccacacagtattaattacatttgcttctcctctttctgtttgttgcttgcattcaccctaccctcttttttccctgaacactattcttcttccagagcagagttggatttatatgctttaaatgtataattagacctcattgtatatcagcgtatccgatttatcagaggtgtgctggtgaaactaaacaaatttagaaagcactcaatgattacttggtgaaaaaaaattaactaaaagccactaattttttataattctaaaaatttataacaaattaatatgcattgtttcattcacaaaacatacaggtatggatattgctatatactatattattttctatagtacttttttatatccaacaagtatttaaaaattactgcgttatgccttttagaatgaagtattaaactcaaatcagcatagacaactagtaatgtctaaacataagtgccaacatgcagttgtttttatagtgtggcactgaatgattctttttaaaatcttgaatctttgcttaggagccagatccccctggactgccaccaggtctttaattctgcagtgactacatagaattagtatcagtgaaccaaaagcccttttgttaagagaatgtgtggttgagatcgttatgaggaaaacagcaaggctagatgtcatctatgaaagttcttataattataaaaatattcattaagatgaaacagcacacgaggatggggagagaatgagttgttgctggtccaaggttataaagcttgagttgcagatgaaataaattttgagatctgctgtacagcagggtgactataattaatgataatgtattatgtatttcaaaataactaaatttcaaatgtctcactacaaaaaaagataagtaatgggatggttgatgtgttaatttgtttgatttaatcattccacattgtatacatatatcaatatcaaaatatcacattgtatgccataaatgtatacaatttgtcagttaaaaataatgttaacttaaaaaaattgaaaagagtacacacgcaggaggttttatatagtttaaaatagtaataatagatatcatatttgctgaaaattatgttgtggtagtgttgataaaagagaagaaaaatacatatttgttgaatggaaaatttctctctgtccacttctacttccaactcatagattgctacctttataggaaatctaaatttaatttcaaatttttctaatatttttcctagactgccttaggagtctcttagagtatctagtgtactaagtgagattatataataagaagtcctggctgggcagggtggctcacgcctgtaatcccagcactttgggaggctgaggcaggcggatcacgaggtcaggagatcgaggccatcctggctaacacggtgaaaccccatctctactaaaaatttaaaaaaaaaattagccaggcgtaggtggtgcacgcctgtagtcccagctacttgctactcagagactgaggcaggagaatggtgtaaaaccagggaggcgtagcttgcagtgagccgagatcgtgccactgcactccagcctgggagacagagagagactctgtctcaaaaaaaagaaaaaggaaaagaaaaaaaaagtccttacagaaagaatttttaccaccctttggaaggaaacaccaagtataagcttgaagtatctctcattatctgtttacaaagcatcaatcaattgcagctaattattataatctgtatgaagctaagttctatgacttagttcaggtacttgtttaaagtaaatttttgtggacttatattaatttatttctatcaaaaacattgctttcctttgatgtggtctacaatcaggaaaaatttgcaaaaggaaatttatccttattttatatatatatatatatatatatatatatacacatgacatatatatacatacatgatacatatatgtacatatatattgacatacacacataaatatccttgaaatatatatatatatatctttgacatatatttgaaatatatatattcttggaatatatattatatccttgaaatagatgtatctccttgaaatatgtcattgaaatatatatctgtacatacacaccaaaacatcgtctattaatacacacacacatgcacatatatacacacacacacacaaataagacataggtacaaaaagtttgcttttatttgatgtattattcctattatagaagttagaattagatgcattctttaatttttctgtgtatataataagaattactgggaatcatctcttacattaacacaatgtttaaaatgcttatttgaattttaatatgattaaattgaatttatataactattagctaggaatatttgctgtccattttattatacttggtacatattaatataaagatgatttctttttaaggtggtattcaaattaactctcagaaacactaattttttaatcgcagaaatcataaacccatataccttctaatgaaatagtgataacaattttttccgtaacatagaagatggtattttgtttttcacagtacactagctcatggcttttctgttttgtcatggtagagcttttgtttcactaggcaatcagatttcattaagttacctaatttttccctcagttttctcatgagatctgctattccctttgacaactctacttgtacttgatttagatgcacaaaaagggataatatgtaccaagagcattggtcctcagtgtggtctttgtccatcaaaatgtttttcagctacttgattaatgctttgggatttgagaatagctagcttctaccttttgccagtgaaataactgatattgatttgagaggaaaaaagtcattgaaatgtttacattaatagtgtttcaaaataaaactgtaaagggatttttaacttataaaaagccatagagagctaaagggaaaatattccataaatgtttggcttaataacaagccaacaaaagaacatggattttcagaatattatattagaaagtttcctaaaagaaagccacatgtatcattaaccttatgctctgtaaaataagaataccaggaaattttactcttttttcatgccacattgttaagatggtaattagaattttaaatttataaagttgatctattatagagaaaatttataccaaaaagaatgtaatttgcatttcagagtactgaaagcatcaaagttctatacataccagaattatttcaggtttgccattattttatgagttctctgtttataaatggctttatagatttgaatttaaactatcacattagaggacatttatttaaagtgtggtctaatatagagtaactttctgagagaaaagtacttaaacaggtttagcattttgttgtattggaaaagtataccctaaatatgaatgaattattcataagccaaagaaagtgctaatatagaatgaaaagtattatgtttttaagttttgggggttataagaaacacttagagcccagcgcggtgcctcacacctttaattgcagcactttggtggcccaggcgggcgaatcacccgaggtcaggagttcgagaccagcctggctaacatggtgaaatcccttctctactaaaattataaaaattagcctggcgttgttgcggacaactgtaattccagctactcaagaggctaaggcaggagaatcgcttgaacccgagaggcagaggttgcagtgagccgagattgtgccactgtactccaggctgggtgacagagcaagactccgtctccaaaaaaaaaaaaaaaaagaaacaatgttgttccgtctcaagaaaggaaggaaggaaagaaagaaggaaggagaaagaaggagaaagaaagaaagaaagaaagaaagaaagaaagaaagaaagaaagaaagaaagaaagaaagaaagaaagaaagagaaagaaagaaagaaagaaagaaagaaagaaagaaagaaagaaagaaagaaagaaagaaagagaaggaaggaacgaaggaaagaagaaaagaaagaaagaaaagaaaagaaagaaagaaacaatgttgttccaaaaatgttacctagaagtgtgtgtgtgtgtgtgtgtgtgtgtgtgtgtgtgtgtgtgtgtgtgtgtgattttattttatttttttttttgagacggagtctcgctctgtcgccgaggctggagtgcggaggcgcggtctcggctcactgcaatctccacctcccgggttcaccgcattctcctgcctcagcctcctgagtagctgggactacaggcgcccgccaccacgcccggctaattttttgtatttttagtagagacggggtttcaccgtgttagccaggatggtctcaatctcctgacctcatgatccgcccacctcggcctccccaagtgctgggattacaggcgtgagccaccgtgccaggatgaagtgttttttttttttaatttatgaaaaagatgctacagaccctaattgagtctgaaaagattaacttttctttgcaggagtatcagtaatatgacacaattatatgtcataaaagtacaaaactaaaaagaatttatgtaattcataaaaatgtaaaaaaatacttggtgtgagtgtattattttctatacttttggaagtttttttttttctccactttggttttagtatgttaaaataatcatataaatgctggattatgtataaatatattacaagtacatatacatgtcttcatatatgtttttgacatgtcaaatagatgaatattattttactgtaatgttaatgaatgcattttactattcataatttaaaggactgaatatcattcaatcacgtgaatattttaaacattttttacattttgttttaaattttctcctactaaataataacaatggcacatatcctttagaagagaattttgaaaactctaatataattaaagtcttatcctacacctagcaatggtatctctagaagtttaacctgaacatacactttcatatgtaccaaataatattttcataaggttttctttatgatcattttttgtaacagttaaagaagaaaaacaacacaaataacaataggaggctatttgataatggctcattatcaaatgagttacagtataaggacaaagacaaatgcaaaaaacatctaaaacttcaatcagaaacaaaattatattactatttttataataattgtgacgttatttgtgtgttataacatttaacaaccaaatctaatgtttctagcatccaagttatttcaggataagagaaaataaacataactatgaaaatacaagttaaaggaaagaacctgataatgttatattcaaatgtaaagtgtcaacatgaacttattatttgctaattgaagaatattttcttcttttgcccctgaaaaagtataaacctttcaagcttataggcttaactttcagtagtcaggaaacaggaagtaggtggataagttaaacaataccatgaatcaaaaatcagacaaaatccaaatgggcagtattctacaagacacctcatggtatccctaaaaaagaagatgctattaaaaattgggggactatctgctgggcatggtggctcatgcctgtaatcccagcactttgggaggccaaggcgggtggatcaggtgaggttgggagttcgagaccagcctgaccaacgtggagaaaccctgtctctactaataatacaaaattagctggacatggtggcacatgcctgtaatcccagcaactcaggagactgaggcaagagaatcgcttgaacccgggaggcagaggttgcagtgagcctagattgtgccattgcagtccagcctgggcaacaagagtgaaactccatcacacacacacacgcacacacacagacacacacaaaataggggactgtcttgattaaggaaactaaacagacataacgacatatgaaatgcatatatatatgtatatatgtgtgtgtgtatatatattatatatatatgatgaataactagagagagggagagaggaccaaaagcagctatggcaactcttaattactgaatctaggtgctatgatttcaatgttcattgcctccaactctcatgctgaaatttgattcccaattggagatggggtttaatgggagaatggggggtgtttggatcatgagagagatctttcattaatagattaatgcccaccctgggggtgagtgagttctcactctatgagttcctgagagagcagtcacctccctgctgtctctcctgcttcctctcgggtagtgagtgtcctgtctgcacgtaccggctccccttccatttttgccacaagtggaagtaggttgagactttcaccagatgcccaatcttacagcttgcataatcctgagccaaataaaccttttttaaaaataaataaactacccagtctcaggtgttagagcaatgcaaaatggactaagatatgaggtgaaggctacacaggtgttaatactacaagtctgtttttctgtatcttaaaagttttctcaataaagggaatggtttcccaacttaaaaatatgcaaaaatatttaaatggcattatagtaagatgtaatatatggccaggactaaattgggttgggaagtccagcagtaacatgtatttgagggacatctgaagaaatttgaacaaggattgctattagatgtaatgaaaacttatttacatgaacagtttagaggttactactggggaaaaaaaggcaagtaaagtgaaaaacacaatgtactatgtggttctctttttagttaaaaaaaataagtgcaaatgaatccagaaagcttggtatagtgatgatctctggtttgtaggaatgtaccattttatttccttatttttgtttatctctttttgtcactttttgcaatgaacatatgtatttttataataataaaatatactttcaaagtagaaatatattatttaaaaaagaaagctcatcactgctaacatgaatatgaaattatttgcgcaatgtatttactttctattcaaatctactttcttacaaaataaaataacttggaaaattttgtggaaacagaatttaatgacaattttgtttctaaaatgtaattattaaaaataaatgttaaatattgtagaatttttctttctaatttgacaatatattgaatgcattataccttaaagcccaagaagattaacctattttgtaactgattttcctagtttataatatccccagagtggtaaatcataaaaaagaatctttcaaattattattttcactacaatgtagtcacaggaagccatttgttctcattaggtgaactttactatttccttgcagttgtcttcatgttctacttgcttaaaatgacacagatggattaagttttttttgtccacttcacatcacaaatactaaagtattaaaacttttatggaaagagaaatgttagtatcatatattttcattacatgtgtgtctctgaacatattcaggctattatggtatttttcccttcattttactattttaaaattaaaaagtggatctgggttagactttcattaagtatatgaatgttgggaaccttaaaatacacagaaaaacagaattccagatttctaaaatgtataatataacatataaaatatattctctctgtctttcacattcactcaactagtatttgtgtaataaatactgaatggcaggcatcttcttaatgtttaattcttagtcttaaagattttgcagaccttttttaaagaaaatggttagtaataacgtatctgcatctgtgtgtaacatacagttatagtcctggtgttccttttattacctctattcatttataaagttatgtaaaagaaaaaaaaagagtaagagatattccagacactgagattgtagcagtgaacaccaagcatacacaaccagacaagtttttttgtcttcataaacctcatattctagtcaatgaagacaggcagtaaactaaaaaccaaagaagtaaaaaagagaatttcacaccgtattaagggcataaaggagataaacagaaagatgacattaagagaaaccacgtgaagggaaggagctactgtgtagaaaagagccatcagggaagatggttctgccaatgttgcatttgagctggaactcgagtgatgggtcactgttcacagaaccagaacaagcatggtgacagggaaaatcatactaccaagaacattcaactctcaatcctgctgagtgcttcaggatttcctcatattgcttttggtcttgtcatgttacacattctaatctatataacacacagataaatttgccgaaaataaaaaataaatgcaaacacacagcttacgtcgtgttgtatttctaatttgaaacacacacacacacacacacacaaacacacacacactgaatggctcaataaggcatatagggtagaatccacactccccaagccagcatccatggctgctaaaattgtaccctcccctatttatgcaattagaacacctactgttttcaaactaaaaccttttattccatcaacactgattcattacaaactgttaatcattttctaagtttttaggtttcattttggtttctttttaaccatttcatctggaatacctctgccccacaatatatctgtattttaagccaagctccaatttcatatccttgattggacaacgcaaacaaggagtgatttctctttctgtagaactccctcagcagttatcagttctatttaacctacctttacagttaccagtcctatataatgttgccagtttcctatattaacatgtatctgtcctattgattataacttaccatctttgtagtatggctcatcctttcatatattcatttatatcactctaactaaacttttacattcctgggagcagatatcatattctatgcttcttgcaaattatacttcttttcatatatattaccagcacaaaatgaagtctctttttgtaaaaagggtgacatattttgaaatgtcttgtatttcttattacttaaaattgcaataaagtttagagactaaaatataataataagataataattgttgcagattagcaaaattctgttgaaactttgtgtttatttagtactttggatggtgactacgggttgcaaaaatactaggacagccacgtgagacttatgtagtgcttaattatttaattttcttgcagttttctttaagatggaagaatacataaagaaaaaaagtttattagaacttgtttttgtactctaattataaaaccaagggaatgaaaatatttgctaattaatcttccctctttaatctcatgtttggtaatagagcatgtttaattggaagttgggagcctataagcattactaatatatttgttataaatgttaagagcaatttttgattgagaaaatcataaatagaaccgttttatgttggtctgtgtttgttaaaagtgtgtgaacatttaaaatattcatattaagtaaaatttcattttattttattgatttcattcatttctttttgttttcttcttttcaaggccctgtggaatcctacatgcactgaaggtttatttaaaccagtacttatttcaacttaggttaaatcattatctgacaataagaaatgcatcactaatctgtgacatgtaaaatattgagtaaaatcaattttttcatcatttcatattttaagtatgtaatatagaaaaattttcagttcaattacttcacaatttttgcatttgcaaaaatcatataaaatattgatgaattaagattcaactaacatatttctgctttattctcattgtatttttaaaacaaaaatagattttgtttaaaaaattctttctatatgtaaatattctaaaatgtaatattccacttggcactaagtatttttgttcactcttctcatccatgtcattggtctcccttgttatagtcttaatttaatttcatcacatattctttgtagattagatcagtttgaaaacaatgcctttagtgtcttccatcttagtaggacatttcctactgaagaacaaaattatctacagtcttttttccctcgcatcaagaccaaaatatgaaagcagtatgtctttaattagaataaataatgaagagtcttactctaactacagaaaatataacacctgtttagattcctaaatagttgaagatggtttattggaaattaacctcatattaaagggagtctcctgaatgtatcctaaaaggatatctgtggcctggacttgaattgcttcctgatttctgtgtgtctctgtctgttgcctttgcataacaggtcactttaattatcaagtgacccggtggctacaaggcactcatgaatgttgcagtttactgcaaggataggtgacagagatagacagcccaaaagaatggctcaatgttgtggtcagggttcagggcaatagaaatgccatagagccaagaagaagaaagcaggttttactgagagttctacctgttgggcaaacagacaaggaagtaatcatggttaatggtggtaacctttataaatatgttataaaattaattaaattatttcaatcattatgtaacatgtattatgaatcataaatgctgggtgcaaaacatggtattaaaataaaaactataaatatatttatttacacaaaatggtgtatttgcccttgttgattttgcctcttaaaacaccctccgtgatctaaaatacaaaaacattttttgtttttctaacagttttctagagttccttctttatcctattcttatctctttctttttattgtcttattttatacttaaaacctttaaatgtagataatgcaaaactccatccccttaaattaaagcactcccctgataaaggtttttatctacatgaatggtcaatactgtattatcttgaagaagcaagaattcaattgaagatcttttaccaggctaccaagacaaaataatttgtattagcaactgaagtaagtcaataaagaaaggtacattttttcctcaaaagcaatttagcagaagctttaactgcagacaagaaaaggtcacctaactaggtacaattttatgatttctttttaataccagcaaaacattatttttcttccctccctcccttcctcccttccttccttctttccttccttccttatccctcccttctcctcctttctccttttattctttccttgtaattgaatcaattctaaatatacatcagtaaacatgtttacatatcaataattttattttcaaggggaaatattttcagactttctcacagtgttcattatataatttgtccattagactcttaaagtgttttataaatatttatttgattacattaaaagtgaaattaaaatagggattaacggggatgttgtttttgtttttagaaaaatgcgtgagaactgttgtaatttttgtgctatattccaacgtgtaaaaaaattatggttgataattatttcccaaaagggggacaagagacatcagtatttattgatcaaaggaacattattttctgctgttatgccagcatgtttgtccaaaatgttctcacagttattaattcaaaatataagattgagcaaacttgtcgtcatctttcaaataaagaaactaaaatttgaagaagtcgagtaactttctcaaattcatatagcttttctaacaaaagacaaagacatagattgttctcatatgccccagaccaaaagtcagggttttgttttgttttcctgattccaaaatgctggtgggttgtagaatagcagaattaaatgtgatgtatgcattgattacatatgcacatatataattgtgtattatgtatacataatattactaagcttgaattttcaagtactctttatgaactagggataattgcaatggtaaacacttactatgtgaatgctacctactatgcctaaggtgtgaaatgtatgagttaagggaattattttataagagtgagaattatttatacaaatatagagaaatgcatggaaggaaagccatggacccttttgctaggtacttcaatgactatgaacatattttatttatgttttaaatcattctgacaatttaatttgaatcaccaagttttagaatgtaggcacttatcattgtctgttaagtttattacatatagctatgttttaaatgattttttaatgaagaccctaaagtaatatgttattatatgtagatgttactatatgatatacatatgattttattgtgacacacataaaaacttccttgctgaagttatccaaattgtatcattttccttagttacctaaatttaatattgttttaaatatttatttctttataaaacaaaatgcaatttctttttcatatttaacttgcaactagaagtagaaatgtccaaattaacaaggagatgcttttcaggttgtattttgagcttacttctccttatagtactctccaaatacagttatatactattttcaatttttaatatataatcactctctctaaaacaaatctctgtcttgttggtgattttttaggtaatcaccaatattatatgctggcaccttgaaaaacaaacagtaacactaactcattttcaaacacatcagtttcatttgctatatttacttgaaacaagtctacatgtcaatgaatagatcgatgtatatatccctcattgggggaaagacaagctattctttcttggtgttaataagcattaagagttgttagaatatcctgtcttctatttttttttcgtttgtttgttttgttttgttttttttgagacaagttctggctctctctcccaggctgcagtgcaagtggtgcgatcttgaccctgcaacgtctgcctctcgggctcaagccatcctctgacctcagccttccaagtagctgggactagaggcacacaccatcatactcagctcatttttttgtattttttgtagagatggggtttcaccatgttgcccaggctggtcttaaacttgtgagctcaagcgatccacccaccacctcggtctcccaaagtgctgggattacaggtgtgagccactacgcccagctgggaaatatcctgtcttttaaatgacatcttttggtatctgaatttgcataatggagaagattatgataggctataaaatggggggaagaaaaaatatgtaagcatattattttatctcttacaccaaatcgtactttttgaatctatgcattggtgtgctcttgcctctcttgtgtgaagccttttttaaaattatttttctattttcctctttgatttttgtatggggatacacatacaagaaattgatgaacaaaagtctcaaatgataataaaatattttctggctactttcttactatctgaaagctgtttgcctccttaatttgtaaacttgtggtcacgttatatatgggcacacacacacttttatgggaaatgagggtttcctcatttaaaagctatctttgttaaaaaaaagaaagaaacttgatacagaggagaaaatatgtaggtagcataagtattctttgggaagaaataaaaatggcaggtgaatgctaattttatcctgatggagaaaagcaattattgcagcaggggtaaaaagattgcttcttccctctaagatatagtttagattttttaacttacctaaaaaaattatatatatttaattaaatatgtatgatatatagaattaaatatatattatatataaaatgtatatattatataatttttaaattatttttcatatatatatatatattaaaggaagtattccctcacccctgtaaggaagaataagcagtaactgaaactttgatgaacagcctggaaggtatatgtgctaataaattttgaatataatggtcggggagagtgaatgaacctcatgccttcatgctcaggctcttcagaaaactttcttcctaatgaggctggcaagatttctgacctgagaagaaatttctgtgtacattttcactaaagataacaacagtaagcttgaaagaacaagtaactttggcaagaaatatgctacacagattttaattttgtttacctcgtggttcatatattccttaaaaagttattgtgttcatatagatttagggttcaatttatatttctagtacaatttttatagaacgttattttgtgagttatccattttgagatagtgatcatcttacagcctttcggttgtagctacatgaattttaagaataagatcctgaaaagtaatgactaacctcttgaaaactacctgatccatttcagtaatgcctatgcaacatgagtaaaactttacgcaatatactaataaacatgtactctaaaagggagagagacaggaggcggagacagaaagagagagagagaaagaggttcttgttctatcacccaggctggagtgcagtggtgcgatcatggctcactgcagcctcaacctcctgggctcaagcaatcctcctgcctcagcctcccgagtagctgggactacaaacatgagccactgtgccaggctaatttttttttttttttttttttttttttttggagatggggtctcactatgttgcctaggctggtctcaaactactggcctcaaaacatctgcctgcctcagtctcccaaagtgctgggattacaggcatgagccactgcccccagcctgttacttttgtatcggaaggtaaactttagaaaacaagtaagcaatttgtattgatttaaaaagtgaaaaatatcaggccggcgttgtggctcacgcctgtaatcccagcactttgggaggccgaggtgggcggattgcctgagctcaggagtttgcaaccagcctgggcaaaacggtgaaaccccgtcgctactaaaatacaaaacatgagctgggcgagcggcttgagcctgcaatcccagctactcgggaggctgaggcagagaattgcttgaaccccggaagcggaggttgcagtgagctgagatgacgccactgcactccagcctgggtgacagagcgagactccgcctcaaaaaaaaaaaaaaaaattgaaaaatacctagtagaatgctatgtatccattggaaatttattgttggttattaatgaaaaaaatcaatggtgagctaatacaaaagaccgcattgtcaaattagactcataccaatcagatatcttaccccaatatcaaggcttattattcatttcacttaaggaacatattattcatgacacttaaggaactcagatgaagcaggaacaggtctggggtgtggaaggcagctctccaaggtctttcattcgacattgaacatccactttgagatccacagtcatagctcagatctttaggagaagttttttggaattacctcacacagcagagagagtgtttcattcatgaaatatctctattttatatcccaacattgtggcattttccagagtgccatgctcataaatccataaattctaagttcatttagtcaaataagtccttaacctgggacatgctgttaacatttccatatgtaaggaccctccttctaccaaatactattagtctattgacctgcaggactaattttcttgttgacagagattagaagttacctgttttctttctcgtgaagacaaatcagttgctataactccttcttccccacctgctctgtctccaccattcactctgagcatgatatacaccattgacatgaatggtaaatcatgtcttggatttttcatgtctctattattgtgaagaaaatgctttatagaaaatgtttatctgatcgagaccacagttattttggtttctcttccgtgttttgaatgttttaaaacaagttgaagtgagagataggagagattgcttttcttgatgattatctttatgtttcccttcattttttcactttcagcaaactcagaaattttgaaggacaaagaatttagtgatttaactaggaaaaaaactaatattcagttttttttctggatgtgtgtcataatatactacaaaaagagaagagccaataatttaaatttatatatcatattttaaattagaggtattttttaaaattattttttcatttgctatttatgcagaattagccctgatagaataataacacattcagctaaatggaatggatcatgttccttctttattatgtctttctttcagttatactatagacttcattacatattttattgaatataattgcctttctcaaaatacttcagatgttgttttatttaatgagttataaaatctgtgttgttttatagtccattttcttttacttggtgtgtatcagaaatacatgacaattcccataagagaaaacacataagaaaacccgaatacaatatttgcagcctgatttctctgttctcctgcttttccacaaacagactgtgttatttctaccctcaagtctcagcacctttagtgcccgaaccgctaatgctatttcttctcgcttagcttgtttgtatgaaaagaaaaccaagttccatatgcttctccctaccccaatatatttcataacttctccaggcatcattgaactctatcttctctaaatcactctacagttcaataatggctaacatttttttttaatctatgtcaggggttgttctaaaagttttacatattttaaatattttgatcctcacgaaagctataaagtaattactctatatgatttccttttacaagaaagaaaactgaaatatagaggagttaagtaacttgctcacaattacatgactagtattattagcaatcaagtattctgctcaatagggaaatatcacatatacatcacattggtatgccacttttcaaaaaataaactaaaattttaataagataactttttgcctttgatttttataattacaattaagagtgacactaataattataatgattgatataatgctaattttataagcatgagcaaatacaagatactttaattttaagtcctcgaagagaataatgactaatatttattaggtgctgctgtgacaatgttctaagtgctttattatgtatattgacttatgtaatcttaaaaacaacagcaaactcaagaaagattgtaatattattctcaatttatggaggaggctgggtgcggtggcccatgcctgtaatcccaacactttgggaggctgaggtgggtgtatcactcgagattaggagttcgagaccggcctggccaacgtggtgaaaacttgtctctactaaaaatacgaaaattagccaggcgtggttccaggcgcctctaatcccaactattctggaggcggaggtaggagactctgttgaacctgggagactgaggttacagtgagcctagatcatgccactgcactccagcctggaggcaagactgcacctcaaaaaaaaaaaaaaaagagattatagaggagtaaattatgacctagaaaggtaacatgaaattcttaaggctgttcatgtcaaacaaatggtgacataactagaatgtaaatataagcagtcttgatttcagattttaacaccctttaccactatactgtatccaaacctcacccatagcacagaataaactatatccattatcagtcagagtaagctagatggcactggagaaacaacaattcccaaatattagaagtgactcataacatcaaatattgatttcttgcttgtgctatgtatctattgctgttcagcaagcaacgcttctccaggctccctcactctaagactcagactggtggaacaatcctcctctgttatgttgcagtctcagcgggaaagagaagaatgtcttagattgtacaacagatcttaaatttccacccagaagtgacatataatacttctactcatatttcattgatcaaaacatagcaagtcacatgatcacaggtaactcactccagggagcaaggaggagcaaatcaacatatgcctacaagtggggaaatgaagtttaaccagcaaacagcactaatgcctactattttatctgtttttccatggattaatctggtcttaatgaaaatatggaaagtatcatttggtaaatatgctatgttactgacacgaaatatcttggattccatcatgtttttcagaaaaatgtaattaaattttttaacctgtaattgaatatttctccttaatatatcacatgtacataaagctatctcaatttttaacatatgacataaacattatttacaccatattctccagctatgtttcagcagctcaactagatttttcaaatatttcaacattttaaaaaatatttctacttgcaatcaatgcattatctactgaattgcctggaacttgttgatattaccacagtcctattccagcttattttaactattaaaacagtcatacttgctgatatataatctaagcattattatacttgtcagaattaattcacaatgacagtgttatttcaacaacactttttagtcatttatctccttacaacctatcatgaagcacattttttcctttgcaagtatctctagagactgtaagtgacaagtataatatcttaaatgtgtgaacaaaaatgactttcctgttcccaaacaatatgctttgcttgatccagaaatagataatttgcatcaactgaaaaaataggtatcatgtaattttttctctgtgctaacttaatggtaaaccttcccatagcatctcctaaatcatgtgttgtattttcaacctttaagatataaaaatatgaccacctttaattcccacattacccaatttacatttgtacttaattagaaaattgtctactgtaattttagttcataaacaaagtaaactgcatctttctgcccttttttcagtgttgagtgtaaagtgaaatccttggtactatttttttttccagtctgtaattaatttgcgaattcctactatagtaattgattcaaatggttttcattgtacaacaatagttaggtaaacattcattatatcaagatggtggttagcattacccaaaatctgttgttttactttaactataatccaaatataaatgtaaatataaataaatatatatatgaaattagtgtcttcacttttcaggcaatcttttccaattcattttcaggatttaaaaaataattattgaagctggaagagaacattaatcagagttttagagatacatattttcttgttctcaatttttttcgtttattctttttctatatttacaacacataggatgaaaacaaagatttataaatacgagaagtattatgaggccatgttttattgtcacaatttaaaatcttgtcaatagaatttttaaattaatacacagattatgagaatatatcaattctcactgtttggcaataattttctaagttttgtagattctgaaattttaagcatttatatgcatcataaaattgcatatttacatgcattcttatgctttgtaaaaaatagaattaggtaaaatatcagactattaagttcagcataattttatttctcagtcagacttctctaggaattcatgattcacatgaattcacatgattttttgtttaattatttattcaagaaatgtttactaaaaacttacagtgtgttgggtccttaggctatgaaccatataataccacgtactgaccaaccacagatgaatagagtctagcaggatatgtaggcataatcacaatactttttaatgttattataattagcgtaacaagaatatgtctgacgtggaatgtgataattttatgagcataatgtattttaccacaattagagatcacctttcaacttattaaattttaggattatcttataaatttgtatagagaaagagatgctaacatatttagtacctcatgagtatcagacacagacctacttggtgctttttgatatgttctgtttactcttctgcttccttttattaatttttgtatgaaaaagacacatttgatgtctgtttatgtgagcaatctgctgcatagcaacccaatttaatcttttcggttccatcaaatatttaagaatttctttacccttaagaagaataaaaccataatagagtagatgatataaaaacacataacaaaataaatacctaacttgcaagaatattataatatcagactggtaaaacatattaaactgctaaaaaaaatcagaacataatacggtaaataggagtgtgtagggtgtgtcacaatgattttgttgtcactacagtgagtcagggggcaacaccatctaagaattcatttgttaactaaattcccaactggagttataggttttgttttcatgtgatatatgaggaaaacgaatcattacaatgcaagtaaaataagtgccatgtccttcatgcattcattcatttgacaaactatgtactgagcaactgttttgtgccaggtatttctgttgttgttgggcatacacagtaggcaaaataactattattcctaacctatggcatttacatctcatttaatagccataatgattctaagtagcagactctagaattatccctactgtactgatgaacatatagagcatttatatctcatttaatacccatgatgactctaagtagcagactctagaattatccctactgtacggatgaacatatagaggcctaaaaaggataaaaaacttgcctgctgtcacaataagtgctatgtgtcccttacgttagtctgacaataaagactaagccctctgctatcataccacacccctccaccaggtatggtgataggagtgattatctgtatctgaaaagtgcaaaaagggaggaatgcttttgttacattgccaggcaaatgaggatggagatgtgcaagaagaaccacagttagctaacctggactacctgctaaatcccaattaaaacaacatgttaataaaaagagaaagtaaaattaaaaagtcaatagacatccttggtaacattttcatggctatatgttatagatatctgtaaaaaaattaatgagtttgatttttatttgatcatatagcttctacatttctgagccattacactgaggtcttttaattttttttccctgagactaaataaacgtgatggaaactgagatatatttttattactgagtacgtctgctgttgaagacctgaataaacaaagaacaaaactgaattatggtgctgcagcctaatatcatcacctactaatcaaatatagaaactcttaaaacaaaacatacacatacacacacacgtgcacgcgtgcacacacacacatacacacacgttgaattcccacagctctagctgtctgattcagaaagagagaaatgaagtcatctctgtttttggtacaggcttttgtgtaactatagagccaagaggcatacagtgataacctttttaacaagcatatatggccattaaaaacagcagggtttcagcctggttatcttgggtatagagataaccacttttgctgactccagggtattcttgaaaacaatacgattgtactgtggagtctgtatttgtttatcctacatgtaattggagcagagctaacatgctattcccgtgctctcttttgtcccatacttttagagacctatatgttacatttctaagtttcataaatatctttagcatagctaatcacaaactagtgtgatatcttttatcattgattttcactgaaaaattgtttattgggcactaggtgcctggtatatgcacttttataagcaaagttaaagggagtattagcctagaaattttacttagcattggtagagattaggagaataaataaaatttatctcactaacaaatacctctgtatgatttctcaggagcgttaacgtcatgaatcctgtggctcaccacttcatgtctgaaggttagtgagccaatgactcatccctcaaggctctggatttgtttacttatttagcaaggtatagcagaaaatgacagcatgcccttaacacaaagcttttcctctagtactcttgtccaggaagaggtaataaaatttactttaaaaaactactcagtaactgaatagtttatcaaggcattccattgagaagagaaatctttggggtataaaaaggaaggaaaatgttgtgaagggcatcactccctttttcaatagagaatgtgtgaaaaagtaaggaaacttttttcggttacttttcttcctttcataaatgtctcatgaggcggaaagaatactgcaaggggagatattcttctttatacatttccataaattctactatttgcagtatattctgtagaaggttcacaaggttttgtcagaagtccaacatgataaaaaatgtacgaagtacatttgtaaatattaatgaagagatgttatcaaaaactacattttgttaatgctttgcatatactgcaaagagaaatagaatttgatgtccagcttcctaaagacacattttaaagactttcagtgagcataggtaattgtgatttattctgaatgcttctaaattctttaagtctggctttcataattgcaagtagaaagttgtattttctaaggagaggatactgaggtgattaggtaattgtcacacatgaacactcatattttaggttaacagatatagtaggctaattctctagggattttctgaatgttaattttacacgcacacacatacagacacaccttgcttttctcccttttactatcatgaatagggataaaacactaactgtcaatttggggtggaatattaagaaaaactaaaacttaaatcacattatgagaaaaattcaccagtaaagtcacctttaatggaggcatacatgcatacatcaacagagacaattaaatactttttctgttgatatattaggaaaatatttattagaagggagcaaagcaaatatataaaaagaaaatatcaagtcaaactatatgagaggaaaggtaaaaaaataatatttgggtaacacatgttaattctttttgttaccatctttagagcagcaatactcaatcagaggcatttttgccccccagtgaacactgagcaatacctagagatagttttggatgctacacttcagagatgccactaaaaagtaatgggaagaggccaggtatgctacttaatatcccacagtgcacaaggcagctcacctcagccaagaattatcctgcccaccaggttaatattgccaaggagaaaccctgctctaggtggtcattgttaacaatgttgaaatcttgattgataacataaaaatattttgtagcacttttcaggtaaataaaaatgggacttgtttactatctcatagaattccttttttgcctgaggaagcatcataatgtcatagtcctagacacttgatttcctacaactggcctgggactgagtctctattattcaaggtgatagcctatcatatttgccgaggttagctctgtatagttctgttttcagtccctcactttcctgtgacaagttttgaccaagatatctaggaaaataaatttaaatcatagactgtttttccaggtgcttctgcccactcccactaggctccagaagattctatttcctgtattctagaaacacccttgagactcacacagaaatctaataatgatcctgtgttataaatttttccaagttctaaatttaaagaccatagaaaaattatctaaatagtttctgctttaatattgtccgtctttacctttaatattttgctttaatattgtccttatctttacctttagtattttggggcatatttatattattttctgtataaaggattttcagatgcaacttcagtgaaatatgagttttgacatccatgtgttatgttcatatgcaattttgtcatctagttaacttttattgttatagttactaaacaaaacaaaaagtgattggcatattagtggcaaagttctgatataaattagaaaattataacagaactgaaggtgatcatcttagaacatcaaggaaaaaattttttcaactttaattttaggaaagcaattctcatttaaagtagtatttcattgatttttttttattttaacaaacataaatttagcaaaataaaaatgttctattttacaatgaaacttttcttactagcaatgttaattcagtaaatatttattgaacatttactattgtcaaggcaattagataaattatttatcctagaaatattttagatatacaattatttttaaataattgaaagctaaataaatatgaagaggatcaaactttatttcacctgcattcattacaatatataaatacacctatacattcctatatctatgtatgttaatatagttaaatataaatattctttacttatttatcctttggatatatgtgtatatttacatccatgtgtatatactttttacaagtaaatgtgcagatgtgtatagagaattttgtattgactcacattttttgataattgactgaataatttcatccatagtataggttttggtgagtgatttgtatctgtaaacactcaaataacaagcaacaaactattttttaaaatcccttatcatattataaatccacatagcttttccaatagtctttttagcaataagagaaaaattacaaagctcaatagagttgtcataacaaaagaggttcataaatttttctttaattacactccgtgttgcctctcataaaagtagcatacagcttctactatcggattgaatgcttaccaatttggaaaatgtttgttgatttttacataaatactttcatttaagaaactaatgatttttataacatttctctttaaagaaataatttataggctgcattggaaagcaaatacattctacagtattttatttgttatcagttccttcatatgtgactacatgaaacaaaatttgtatgctatatttgcagaataaagtagaaaatacattttgcatacctcaaagtaaaaagattctgtaatacaatttctatatgtattccttctctccaaaacatattttattataacatgaacattttagtagttaacatttttatttgtattgaattttgccaattagttagccaattttataattcatttcagtttttgtttatatttaaattacagtttacttaatatttcactaggtatttgtttcataaaagatgattatattagtgaatcacaaggatctgaaggaattcttaacatagttctcatcccaagtagctgataaaatagatgaatttcgtttaatattattccatggtagttcacacatgaactaacacattaaatagtgctttcagcttccacttagtgtaggattgaataaaacatgtgctgaatgaaaacaaatgatgcataggaagtatcaatctctgtgaatatttctctataaattctattgaagtaagtttcaactagggaaactatgatggctttgaaattcgtttttatgtgttgagggtatgcagtacatttactaaaaaaaaatgattatcaagtgataaaatggttgattttggttaaaacaacttctctaacttctctcttcatacatacccacttagctattgccacactagctttgattcttctatatacatgtatgccctagctttagggctctgatctttctgcctggaactatcttccaccagatacttttatgcttagtgtttcacctcctcaagtctttcatggccaaaataagattgtaaatatttatctacattatctatttcccttccttggttaatatttctcattagcacttgttaccatcgaacgtgttcgtgttctatgtatttattctgtttccccatttgaatataaactcaaggaaggcagattttatcctatgtttttcattgctatacccctgcacttggaagacccagctggtcccaaaaagacactcagtaaacaccctatgaatgaaggatatcagatgcttgtaatgcacaaggcccatgtcacttttcgggagtgctacacttgtgttggttttaatccttctgtaagagctggaaaactagtcctaagaggctgcagcaggcaagcattagctcacaaaaataaggcaaatcaactgaaggaaattggaccaatgagtataaatatcctacaacttcaagtcacattaaatcaaactcccaatagtaaacactccctcacactgcttcccagccttttcatgttgtgctacagatagataatgataatatttaagtagtatattggggtaaactgacaaagctgtggccagaggattctgcctcaggacattccattccaagcatttaatcacacttaaaatctaaaacccttactctgatttactatttatattatctgactcctgattgcctttccagcttcaaaagatggtcttattcttcttgccctcctgcacatgcctcatttctattactgaaacaaattaagtcctgtcttggggtatttgtactagctgtttcctccctctgaaaggcttctccgtcttaccaccattctacttattcgtaattcagatcataacttaaatatgtcctgcttcgaaagactattccttaccattcaatctaaagaagccaatctaaaatagatactctctcccacatcacacagatgtaatgttctgcacaagatttactaacatctaatgtttttcttgtgtattatatatatatatcaatgcatttgtttattctgtgtctctctgggccaagaatctctcacttcctcactgcaagatgggtgtaggaccgagaacagtgctggacacatcataagtgtttagtaaatatttaaagtgggtaaaattaatttccataaataaaaacgtgtattgatattgccaagtgccttagaactttgtcaaaagataaaaatgatttttatataatttcaataaaataaaaacctacagaagcattattatacagtggtttcaggtcagattttggcttaagaaagacctactaactattttctgggacaacttacttaacttgcaaatccttcatttcttcgtatagaaaaaatagggcaggatagctaaggcataggattttcctaagaataaaattaaatactatatatgaaatactatgtgggtggcataggtaggtaagaaaatctcttgaacatgtccctagtgatggagggacactattcagacaggcatctaaaatgattcctttttaaattaatttacctatccattaatccatttaataaaagttgagaaacttctgtttcctggaaagatgctgtatatgagacatagagaaaagaatttgtattaattttcaaaattaggtttcttatggagagaaatatgtaaataagcaattaacagacactttaagaagtgctatgttactggtttatacaaggatttcccaggaagtatgaaggcagaactccatctgatattcttttcttttcttcctcttcttttttttttttttttctttaaaagacagtattttaactctgtcacccaggctggagtgcagtggcctgatcacagttcactgaagctttgaactcctgagctcaagcattcctcctgcatcagccccctgagtagctgtgtagctgggactacaggtgtgtgccaccacaaccagcctttttttttttttttgtagagacaggatctcactatgttgcccaggctggtcttgaattcctgacctcagcaatcttccttccttggcctaccaaagtgctaggattacaggcatgaatcagcagcagatccagcctgatatttctttctttccttttttttttttttttttttttgagacagagtctcgctctgtcacccaggctggagtgcagtggcgcgatctcggctcactgcaacctctgcctcccgggttcaagcaattctctgcctcagcctcccgactacctgggattacaggccccccccaccacgtccagctaatttttttgtttttaatagagatggggtttcaccatcttggccaggctggtcttcaactcttgaccttgtgatctgcctgccttggcctcccaaaatgctgggattacaggcgtgagccaccgtgcctagccccagcctgatatttctaattgaggtgactctaaaaacgaacagcaatttcatggtatataaataatatatacataatttatattataatattattatataatattatataatataacataatatcatatattatatatattatataattatattatatatattatataattatattatataatatattattatttatattatatataatatatattatattgtatatattctatataatatataatatataattatatatataactatataatttcatggtatatgtataatttcatggtgtatatatatatatatatacccacacatacacacacagctaacaaaaggtaagatttggatttttaaactgaaatttcccctgatggagaacgcttgtttatgtcttgttaaatatttaggcaatactcagcctaacagattatcacatattgacataaaatgatgaaaggactagggactctgtcttggctcttaaaaataacatcctaattcaaacttacacctgcagcaagcttgaaaaggcatatttaataaattgaaaaaaatagtgaataatgtgttacagtttgaaggagttacttgagagagcttctaggttagctgggggatcttccaaactccagcacataattaagagcattctattagatgtgtgtggaatcctcttggagatattttgaaaatttatttatgggatgcatcaagttttatttaatgtttaagacctctgaattttctctgaattagaaataatccttctttttttcagaaaactatgatcttatacaatccaaatggtcaagggcaatgtaactaggtcgtgaaacaactgagtttctactataccaactgtgataaagtttataataagtaactagttgtctgctggttttcctgtcttctttttaaattatgcaagaggctaataaaacagtaaagtaatagctctcaggtttcaaactgttgtagttattggctatatcccttgtggtctccctgcatacctcttgggtaaggtttcctctctagggctgtcagccaacatgcctttgcttgagtttatggtaaaacattttttttttttctgcactgacattctggagcaggctgtgtgttttgggtcgagaaggctgcatgcagtccagtgtgatggctgcagcccacttgctaaccttagagacaggtcttgtagtctcgtgtccctcccttgggagataattaggatcagataagctcatgagggtggaattctcgtgaacaggattcatgtccttataagggtccagagtgactgccacatgagaacccagtgaaaagacagccatttatgaagcaaatcctcagcagacactgatcttggacttcccaccctccagaattgtcagaaataaatacttgttgtttaagccacccagactatggtattttgctctagtagcctgagcagattaagacagataccatccttcttctgtctctacttgtgtttagattattagagtataattttcaaaaagttaaaaacaggagtctcatgcaaatttaaaatgaatcttggtcaaagattttatataacaaagtaattaggttaccagtaacacgttaaaatcatttcaaattgcatttgaggaattagatatttataaggaacagagaatgttagaataagattacaggagttatctgttgaacagatgtaaataatttgcatctctgctgtaaattttctataagggaacatctgctcttacagaattataaaacagcctcattaaaaggaagtcagtgcatcctgctgtagcacagtgctccactggaagaacatgcagtattctttgcctatttccaatatctatattatatttctataatacgtgtcaataatacgggttaatcattgtgattattctatttcttggccacctactctatgccaggcacttggtcagatgttggaatccatttcatctaatgccaaaaatagctgcccagtaaattcttatataaacaaactgagactcagggaagatacattttccaaagtccaaaccattagtaagtggcacacctgagttttctttgttcttttatttaaaacttactatatatgctatgcactactttaagggatttataagtcttataccatttaatcctaaaaataacttaaagtgccctcactttatttatgagaaaactaggcatcatagaattgaataatgtgccaaagataaatttgacaccattacctgggacttcctaatatatgatcagataaagagacttctgcatcctgtggaagttctgcctcgggttttctttttttttttttcgtttgttttctctgatagcaatttgccttctttgcctatctcagtcaaccttgacctttaatccagcacctctcttcttgcctgtgacctctgaactcttgactctgagtctgtcatttaatacacatgctttgtattctggagcttctttccacgttactgcgtctgcttcaatctaatacccaaatccagaattttaattatgccttttgctttgacattagatttgtctatgtctgtctcttaattgtgctccagcaagacagttcggcaagaatcgcttaaattccatttttcaaagataaggaaatagctttcctttgtaataattggacatttaatgccatgagttagaatggaaagatacctgaaatcgtctttcacagagatagcctgttcacattgttttcattaatcattcattttttttaaaaaaaggattttacgtaatgcttttatatgcaaaacatcatgaagcatagttcaagaatacagagattaaaaattagacattattctgaaatggattcagccattaagaacattatactcactagaaaaactacacagaaacatgaaatgccttgtttctaacctttgcaccactcctttccccacagtagaaatatttgactcctcacctatgttctggtatcttgtcagtctttactcattgctcctatttattctacccagtctacatcattaggttcaggcttcttacctgaaacctcaactgcacctcaattcctaagccaagttagacagaagtgagaagcagatttatctgatctccaccactctcagcctatccccagctcagacagatttagttgtatcttcttccagtgtcacttctctgtgaactaaatgcctcactgctgaccaatgggctttcattttcggtatgaaagctacacttgccttcacctcagagctcttattctgtttatggaaccgctgtacctggaatcctgattctcgactccttgctgcattagctggaattatgttcttattcttagctacaagactagattgggtctagaagtttctatgaagttgtgaaatacttatttagcaccttaatatatgttaagacactgctacaagtgtttcacaaatactataaggaaggtactatttttatccccatttaatatgtgaggtaaataaaggatagaaaagtgaagtaacacaggcagtttggctcagagttcatgctcataatgactatgcaacctgtctccctaattatatcttgcatttacagctgtgctttcattcccagccactagagcaccagaattgccctaatgttgacaaactcttagattccccattagcacctgctctaaagatgctactttatcctgttctttgtgttatattcccagacctcccaggttaaaattgcttacctgtcatcatgcgttccttatttagagttcactttcccaatagttacacccagatccccttcttttccctatccagcattcatcaaatgtttcttcccagttccagtatagaccttctagcttgcctctttctcctattcataggtaaaatccttaaatatatatgagatagtaactgtagctcaattcaaggaccaaaaatggtcaaccattagatcacctgatccatcttttagcctttaaccttatgaatctgatcttgtaggtacatgtctatacctatattaaatgtatgaataacatatatacatgaaacttagacaaaatagaataatatgttgaaagcaaaagaaaatgtttcatatgaatatttgaatgttaatataaagtttcattcataaagtactgacaccttaagaatggattagagatcagtgatagattttacaaatttggcttacaaatataatgtttataatgatattattttaattttaagtaagtacatttatattcataaatataaaaatcaaacatatacacttttaattactattcagcatggtagaaaaatattgcaattactaaagactagaatataatattcttaataggcttcaatgtcaatataatatagaattgttttaaacagttcctttttctgatctgaaagttgacaatagattcttgaaattaattaatttggattgacctttttctcatttagcctgatggcaccaacagaaaatgagaaaagattgaatactcagaatgcttagataatcacatttcaggaaaacaaaaacaaaaacaaaaaacattgtttaaagtcccccattgagcactttttctatgttaatgagaattcccatttaattctcataacactttgagaaaatatttatccccatttgagaagaactgagatttagaagttcagtaacttgtctatgataatacatgttaatagtggatccaagaataagactcagatcttgccaactcacagaacattctgtaccattcacatctcctcaaacattatgatgccaatgtaaaaaaaaatctcttagtaaagataagcatactaagatgtaaatgggtatgagaaatggaaaatggcaagattgttgatttcttcattataaaataggaatgatggctttttgcaatatcacagtcaaaaccataaaaaatattttatacttctgtatttaatatactatttaaacatagcaatgaaagaatattattttgactacattagcttaattttaaaaaaggaatattttaatctaaattcaatttgacagtaaaataaaagagtatttgaaattctgaatacttatatgccctgtaaacttgcttctcagaatgtgcttcagtggcccacataggtaatatttttaactgaatataaccatattacatgtggaaaagtttagagcttggtaaaaaatcatttgaaatgtgtaatgttcaagcaagaaatatttagtagggtactgtacattagagatgacagaatatttactaatggcaaaagacaagccatgtcttgggttcttacctttcaccttctagctagtatcacaggcacaacaggattgtttttttctacactgtagccagagtgtgcatgtttttcatacagggctattttaatattcatttattcacttttggataatgaaaaattctactagtcactctaggcaatttatcagcattaatgataatgcagccagagtagcatgaaaggaacaaattagaacatggatttaggtaattatatattgttctagtttagcaaaaaaaaaatcatgttttaaatccgaataccattattctttagtaaaataaatcatattggatttcaatacattgctaattgttcaggtttctttttaaggtagaatagtattttaacaaaatttgttattggatatttatagttgtactgaacagctcttattatatagttccctagattagtctatttaaaggcgtttgaggaaactaagctttcatttaaaaattctgaagcaaatttgatcagtacatctattgaatagcatcttgaatctccgaggatgtgatctaacagaatcccaaaactaggttccttaacagcagagtctatgaattatgaaaattgatgacagatagatctatagatgatagagatgcaaatatggagatatatataaacatatattatgaaatacatatatacattttttttgttatggactgatttgtgtccccaaaattcatatttgaagtcataacccacagtagcttagaatgtgaatacttagagatagggccttagggaagtatttaacattaaattaagtcatttaaatgaaagtacaccctaatccaacatgactggtgtccttgtaagaagacggaaaacatgcaccgagaaaaggccatttgagggcacagtgagaaggcagccatctgcatccattggagaggacagaggcctcaagtgaaaccagacctgctgacaccttgattttagaatcccagcctccataattgtgtgaaaataaatttctcagtttctcacatggcatttaagccacccagtctgtggtattttgttgtggctgcctttagcaaactaacgtattgccttatgatctattgaaaggttcaagtaaaaaaaaataaagaaaatttaatagggcttcaagaagttaggagttgtcaaatattctttttattttcttcttctcttgcttttgttaataaagaatttctggggtagaaaaacaacattttttctcactaatttgtgtgatttccagcagttcattattagaaaccaattattttaatgcaagaagaactcttttttacactatttgtggagagcaaattatataaaattgacatacctccctaaaagtggccttaaaaatgttcatgtatttttactgaattcttcttttagaaattattttaagtaaacaatgcagttgcttaaagttttctgtaaataggtgctgatcacaacatagttcatagaagtgaacaactaaaaataacattgtttccaaattgaagtattcccataaattgtgattttttttgtatctataaatataataacagatatgtatttttaacatggaactgcctggtaatagagaaaataaaaattctttaagagacatgtaataaaaagcagcagttctagaataacacagtaaaggcatctgaaaatctgctattccataaaagcaacaaggataggccaggcgtggtggctcacacttgtaatcccacactttgggaggccaaggcgggcagatcacgaggtcaggagatcgggaccatcctgactaacatggtggaacccgtctctactaaaaatacaaaaaacttagctgggtgtggtggcaggcgcctgttgtctcagctactcgggaggctgatccaggagaatggcatgaacccgggaggcagagcttgcagtgatccgagattgtgccactgcattccagcctgggcgacagagccagagcaagactctgtctccaaaaaaaaaaaaaaaaaaaaagcaacaagaatatgggcaaaaattgtccaaatcaactttttaaattctggaaatccaccaaaggctttcgataccacggagtgtttattaggggtaaatggttgaatctcagttctaacagcaaacattgtgttattttaacttgcccactttctctacctcatgtgcagttgccttgctatccggtgaccttgcaacaaagacatctgtgtaaaagatcacctttgtagccactaagggggccttatctatgtggagctacccccaaaagcctcattcccagagttttatcaatatttgaattgtctaccagctccctagaacagggccatttacaagacttgtttttatttgaactcagggcttactcattgcaaaaagccctatcctatccacaggacatttgacagaaacaatcaattgtttaatatttcagttgcttgaggcagtgatacaagttggggaaaatgagtctgaccaaaatcttaaatggaaaatctgggagatgatatgtctacagaggcctttaaaaaggcttcttataaattctctggaacctagaaagccacaacaagtgcaggggtgtgcccatattcaaggctgtgtgtatgcccaagaaagacctgacaaggccctgttttctcacctctgggtgaccttgagtttctgcataggtaggaaggaaaagctaaggctgactgcaaaccatcagatcgttgaagacatgcccccaatacatacacaaaaccaattggcaaaagccgggagacttattggccaatacattcaagataatctttgtttaattgtaagttgatcactattgtaatccaccagggacttcagtgaactacagatgacaagaataaagacttttcagaatatttcattaaaaaaagatgacaccaaaatcaatgaactgcaacaacaagccatgtgaaagagaagaatctgatttttagagtttctacattatatgaaaatgtccaattgccaaaaaatgtaaaagacgtgagaagacacaagaaagtgtgactcataagagagggaaaaaatagtcaaaagaacctattttatgtatttaagaagtgatggaagccatgtctaaagaactaaacgaaagtgctttttttcctgaataaagaaatcagcaaagagataggaaatatttttaagtaccaaatagaaattctggagttgaaaagtatagtaactgaaatgaaagtaccttcatggactcaacagtatatttgagcaggcaaataaataatcagttaaatttaagatagattcatagagattatccaatctgataaagagaaaaataaaagaatgaataaaaatgaacagagactcagaaacctgtaaaaacgctgtgaagtgtatcaacatacacatgagatttaagaaggagtgaagagaaagtggcagaaagactatttgaagatatgatggccagaattttcttaaatgttatgaaaaacattgatctgcctaagaaacttgaagtccatgtggtataatttaaagagatgcatatttcaacacatagtagttgaactgttgaaagacaaagaaaaaaaaatgtgaagacagcaagagaagagccactcatcacacaaaagtctcctcaaaaagatggctgacttcttatcaaaagcagggaggccagaagaaagtgggatgatatattcagtactgaaacaaaggataaaagctgccaatatttcttatccaaccaaactgtctttcaaaaatgaaagagaaattgagatgttcccagataaacaaaaactgcgcgaattcattgctaggaaacctgccttataagaaattttaaagaaagtccttcagactgaaagagaaggacaataaatcgccaattgaatccgtggaagggataaagagcaactgtataactacacaggaaaatatgaaaacttatacatttatttttatttattactcttatctgatatcaaatacaattgcagaaagcaatagttgtaaaactatattgatgtatgttcatgggtcaataggcttaatattgttaagatgataatataatccagattgacctacagattcatcacaattcctatcaaaatcccagctagcttctctgaagaaattgacaagttgatcctaaatttcacatggaaatacaaagtacataaaatatccaaaacaatcttgaaaatgaaaaacaaaattggataacctacacttttcaatttcaaaatttattatgaagctaaaataatcaagggagtgtggtactggcataaggtcagagagattgataaattaaatagaattgagaatccaaaactaaaccctaatatttatgaccaattgattttcaacaagtgtgccaatacatctcaatggtaaaaggaaagtcattttgggctgggtgtggtggctcatgcttgtaatcacagccctttgggaggccgaggtgggaagatcagctgaggtgaggaattcgagaccagcctggccaaaatgatgaaaccctatctccattaaaaatacaaaaaattagctgggcgtggtggagtgcacctatggtcccagctacccgggaggctgaggcaggagaatcgcttgaacccaagaggtgcaggttgcagtgagctgagatcacagcaattcactccagcctgggcgacagagcaagactttgtctcaaagaaaaaaaaaagtattttcaacccatggtgctgggacaacaatatatccacaagcaaaagaaagaagttggacacctacctcacaacatatacaaaaataacttaaactggattatagacctaaatgtaatagctaatactacaaaatttttataaaaaaataaatgagtaaatccaataatggttagtgatggtttcttagatacaacacctaaagcacaataaacaactataacaatataaattggatttcaacaaaattaagaatttgttcttcgagttgatgccagcaagatgataaaatagaagttttcagcccttattccaccctaagaaacatattttttcacaatctcccatggacaaaagcactgttatgagaacctgggagtccactggaaaagtgccagcagcccaatgggataaataatccaaaaatagacacactgaaaaaagtaagaagaacagttttactttatcagcatcaccccttttcccaaggcagtaaagctcagtgccaagagagaccctcttaatccatgatttctctaacggagaaaactgaaagcgtagtgaattcctaccttccttaatcatgtggaatgctgtctaagaggcatgccccttccaaacctcacagataacatgagaacagtaggtgtaagtatcctgcagatatttaagagtagaaaaaagaaagataggctcacagacaccagagaacagaacttaaaataatatgttaaaatattaacataaaataataataataataataaaagaaccaaaatagtatgtcgaaagaactttaaaaaagagccaagaactccaccaaaaggttcacttatgaagcttgtgatatgcatcccttgcagatttcctcaactaacccacacatgcccccagcattcatcccttccttagcaggtgctccatgtgtgcccccacagatagcacatgcaaacctctgaagactgtactgtagcacatatagtcaccttgacagactgctggactgggagaaagcacagaacctaagcacttcagagcaaactgccctagggagaaaataaacaggggactctcagcacccaacatggctttgtagaattgagagaagacatacaatacttaaacttttcctcaagagggaacaggaggagtggaacaggtacatccatagaaaaggtctgggagaccccaagaatccatatccaggctgattggtgaaggtatttctctccagagatgataaattctacaggaagttacatcttcaccaaatgaaaagactgtaatgaaagactgcattgaacacaaaaactcaaggaaacataacactatgacagaacataatagttttccactaaccaacctgaaaatattagagatctatgaaatatctaaaaaaaaatcaaaataattgttttaaggaagctcaagatgctacagaaacacagaaaaatgaacaaaaagaagaaaaacaatatatgaacaaaatgtaaagttcaacaaagagacagaaattatttaaaaaaacaaatacaggactgaagacaataaatggaataaaaattgaaatagtctttcatgagcagactcaagcagaagaaagcatctgtgaatgtaaagacaggtcatttgaaatcatccagtcagaggatataaaaaaagaacacaaaagagttaagtaagccagtgagatctatgggacacaattaaatgaaacagtatacacattatgtaagtgtctgaagataacaaaaggaaaagagagcttatttaaagatataataactgaaaatgtgccaaatcttgagagggatatgaacatccacgttcatgaagttaaaagatttctaaaacagaataacttcaaaaagaatataccaagacacacgataaaaatattatgaaaagtaaaggacaaagaaagaattttgaaaatagcaagacaaaagccacttgttataagcaaggaaaccccattaagctattagatgatttctcagcagaaagcttccagtctaggagagtgagataatatattcaaaattctgaaagaaaaagactgccaaccaagatactacacccacaaaaactgtccttaagaaataaagaagagataaacactttcccagatgaacaaaatgacaatctataaaatgtctaacaaaaatttagagggaatttattaacattagacatgccttaaaaaatggtaaagggagttcttcaagatgaagcaaaatatgctgtttggtaagaggaacatatgaaagcataaaactcactggcaaaggtaaatatatagttaatgtcataattatctgatgcagcagtggtagtgtgtaaactacttgtaattctaatctaaaggtaaaagacaaaagtgtttaaaatgattagaatgaaaataatatgttgaaagttatacaatataaaaagaagaacctctagcagatacacataagaaataaaaaaaacctctagtaaatatacatagataaagataaagaaatcaaattataccaccgcaaaaaaaaaatcataaaattacaaaggaatatgacaagagaagaagaaagaaacaaagaaactgcaaaatgttcagaacaacaagatggtaattttccaaatctagtcattacctatataattattgaaaatataaatggattaagctttccagtaaaaatagatagagtgggtgaatggattaaaacacacgatcaaacagtgtgcttcctacaagagacttgctttagctttaacaacagacatagacaggaaatgaaggaatacaaaaaatatgccatgcaaatggtaaccaaaagacagtaagggtgagtataattatattagacaaaacgaacatcaagtgagaaattgtcacaaaaaaccaagaatgtcattatataatgagaaaaggtcatttcattaagtggatatagcaagtgaaaaaaatatatgcatctaacatacagcacccaaatatataaagcaaacattaacaaaactgaaagaagaaatagacagaaatacaatagtagaagatagatactatgttatcaacattgaatatatcatctctatagaaaattaaataaggaaacaacagacatgaataacattatagaccacatgggctcgacagacattttatccaacagcagcagaatgcacatttttctcaagcacacctatgacatctttcaagatagattatatgtttagtcataaaacaagtcttaacaaatttaacaaggctgaaatcatagaattatttctgaccacaatggtattaaactagaaatcaataagaggaagaaaaatcacaaaatttaaaatgtgtggaaattaaacacactcctaaataatgagttgaatctaaagggaaataacttgagagaaaggaaaatagtaacactacataccaacatttaggacatgaatacagtgaaaaaaaattactaaaagaaattttatatcaataaatgcccatgttaagagaaaaaggcctcaaataaaccacctaactatatacctcaaagaattagaaaaagaagaacaaactaagctcaaagttagcagaaggaaggaaatagtaaatattacagcagaagtaaagtagaggctagaaaaataataaaaaagatcaacaaaatggtatttgttctcatactatgataaagacatacttgagaccgcattatttatggggaaaagaagtttaattgactcacagttccacaggctgtacaggaggcatggctagggaggcctcaggaaacttagaatcatggtggaaggtgaagaggaagcatgcaccatcttcacatggcagagcaggagagagagagcaaagttggaagtgctacacacttttaaacaaccagatctcttgagaactcactcactatcacaagaatagcaagggagaaatccacccccatggtccaatcatcttccaccaagcccctcttccaaccttggggattacaattgaacatgagatttgggtggggaaagaaaagcaaaccatatcagagattgaatcaataatccaaagcctttcagcaaagaaaagcctgcaaccagatggttttactagtgaattccacaaacatttaaaaaataataaatgccaatacttttcaagctcctccaaaaaaattgaaaaggacagtatgcttcaaaactcatattacaaggcccaaattaccctgaatatcaaaccttacaagtattctacgagaaaagacaaccacaggcaaatatccctgatgaacatagatgtaaaagtcctttccaaaataacagaatacagtacatgaaaggattacactccatggtaaagtgggatttaaccatgggatgtaaggatgattcaatatatcaaaaataatgtcatacaacacatgaacagaatgaagaataaaaacatataatctcaataaatgcagaaaaagaaattgatgaaattcaacaccttctcatgataaatactatcaatatattggataaagaaagaatgtacctcaacataacaaaggctgtatgtgaaacacccacagaaaacattaaacagtgaaaagctctatgcttttcctctaagatcagcaacaagacaaaggtttctactcttaccacttctattcaacataatgctgtatgtcctatccagagcaattaaacaagaaaaagaaagaaagacaaccaaattaggaagaagaaaaattgtctctgtttgcagatcacatgatattatatgaagaaaaccctaaagatgccacccaaaactattagaactaataaataaattcaataaagtaacaggatataaaatcaacattaaaaatcaatattatacatatatcaaattactttgttgtacaccttaagtttatacaatttttatacattaacaattagatatccaaaatgaaattaagacagcaacaccatttaaaatatcataagaaataaaaaaaacttaagaataaatttaaccaacaaagtgaaagatctgtgcacttgaaactataaaacgctgatgaaagaaattgaagatgacataaataaatgaagatatcccatgttaatggattggaaaaaataatattcttaaaatacctgtagtacacaaggtgataaaattcaactcattctttaccaaaatctcttattttttgcagaaacagaaaaaaaattctgaaattcatatggaatcataacaggtacagaatacccaaagcaatcttgagtaagaagaaagctggaggcatcacaattcctgatctcaaaatatattattaaaataaagtaatcaaaactgtatagtactgtggaaacagatgtgtaaaagaatgtaacagaatagagagtgcagaggtaattctccacatttgtagtcaactgatctttgacaaaagtcccaaaagcatacaatggggggacgaaggaatagtctcttcaataaataatgttgagagaactggatatccatatgtagaagaaagaaactggaccattatctcacactatatataaaagtcaactcaaagtggattaaatacttagacataatacctgaaactataaaactgctagaagaaatatagaggaatgctgcttgacatttggctgggcaatgattttgggacatgacccctaaagtacagacaataaaaacagaaatagacaagtaggttttttcatcacagcaaaaagtttgtgtactagcaaagaaaacaatcaacaaagtaaaataacagcctaaggaatgggaagaagaaaatgtttgcaagctatccatcccataaggggtgaatatctacaatatatgatactcaagtaattcaatagaagaaaacaaataacctgattaaaaattgggcaaaaggctcagtcatttctccaaataagatgtatgaaaggccaactgttatatgaaaaggtgctcaacatcactaatcaccaggaaaatacaatcataagtacaatgagttatcacttaacacatgttaagataactgctgtcaaaatgacaaaacatgacaggtgttgaagaagttgtagagaaaaagcaacccttgtacagttggtgggaatgtaagttgttactgccattatgaaaaacagtatggagattcctccaaaagttagactagaactatcaaataaaccagcaatcttacttctgggtatatatccaaaggaaaggaaataagtacgtcaaagagatatctgcatttccatattcattgcagcattattagcaataaccaaagcatggaaacaacgtaaatatctgcccgtggatgaatggataaagaaactgtgagatacagaaacagacaaacgcatacatacacacaccaacacacacacactccagtggcatatcattcagtcataaaaaagaagaaaatcctgtcattgtaacaacatgaatgaacgagaatgtgttcctggtccattcatgctaagtgaagtaagccagacacagaaagataaatactgcatgatctcactcatatggaaaatctaaaaatcacgatctcataaaagcagaaagtagaatggtggttttcaggggctgggatacgtaggaaatgatgaggcatttgaataaacggtagaaagctttagttatgcaggataaatcagttctagagatgtaatttgcagcaatgtgacaagatttaacaatactgtattgtatacttgatatttgctaacagtagattttaagtgttctcaatatctacaaaaaagtatgtggggtgatgtatatgttaattgtcttgattgtggtaacaatttcacaatacatatatcaaaacattacattgtatacatatctcaaaacattacattgtatacatatctcaaaacattacattgtatacatatctcaaaacattacattataaactaaaattatgcaatttttattttttcaattacaactcaataaagctgggagaattgtgcttgaaaaaaaagaaaaaggctttcaagaaagtgaaaatacagcctccagaatggaagaacatatttgtaaatcatgtgtttgataaaagactcatattcaaaatacataaaacatatttttctctaaataagatacacaaattgccgataaatgcatgacaagagtctcagcacctttacccattaggggtatgcaagtcagaaccacagtgaaatacttcataaccataggatagttaaaataataataataaaaaaagataggcaagtacaacttttggcaggtatgtggagaaatccctcctacttcattgatatgattatataatagtatagtcactttagaaaacagtaagatgctttcttaatctattaaacatagaattaccaaatgacctaccagttccacacttcagtgtatacccaatatataaaaacttatgttcacacaaaaacttgtattcaaatgtacatagcagcattattagtagccaaatgtggaaataatacaaaatatacatgaactgatgaatccataaagcaaagtgttatatccacatgatggaatattattcagccttaacatgtagtgaaatactgatctattttacaatatagatctaccttggaaaatatatgtttagtaaaagaagctcatcacaaaacatcacttattgtatgattcaatttatatgaaatgttcagaataggcaaatttatggagacagaaagtatatttgcatttatcaggggttaagagaagggagagtaggaaatgagtgctgatgggtattgggtttatttttcagatgaggaaaatttcttagaattagatagcggttatgttgaacaattctgcaaatatactaaggaaacacagaattgtataatttgaaattgagatatatggatatgttaatttgcttgtctatgctaaccattttactatctattgtacataaaaacttcatattgtgcaccttaaatatatacaataatttttttctaaataataaaagaatgaaagaactgaaagagtgaattttatggtatgtgatttatatctcagtaaagctgttataaaagaaacagatacctaatgagtaatgaaactgtcaaacacggaaacagagtctctaagtaatttgctcactagttactgcaacttctctctgccaggccattatattattagtagtagtatggttatcattgtcattgttatttttgttgctaaacagatgaaaatccagttactatgtaaggatattgcaacatcacattattaccaatgtgtttttaccttattagcaatgtgtttgtttaaaacaaagagatatcctatgtatatttgtaacaatatttgaaagtaacccattttttctaatacaaaatactcattatattaattattataaattagaatgatgttatttattgttattatattcccaaagctctagaatgttaaatgatgaaaagagacctttactgggaatttagagtgggtaacatgtctaaatctaattttgccttttattaattgtgtgaccttaacttctcatttaactccctttgtactggtgacttcattttaaaaagtcagaggtttatctccgaaattggttcagtttgctctaatttttattttttgtgttacaagcataattagtatagaaaagccaattaacctaaggaaactatttgccacagattttgataggcagaattaagatttttaatttacattaaaaggctagacacattattaagaaaagtattgtgaatcaaattaactaataagaaaagggaatgattgtataatttacaaaaaacaaaatcaaaatacaactcatgaagaaacagggaaagtggaaaaatgttcacttaccaaaatgcaaataaaataagatttcttttttgtatgtaaaattttaaaagctttataattatatctaatttagttatagatcaaatgacatattttgctgttataaagtaagtagcaataattttaggtcaagcagtttggcggtaagaattaagattaaaaaaaatagtcacagccttcaacccagtaatcctatttctggaaatccaccttaaaatataaaccaagattgtgtaaatattttaagattaaaatgataattgtaacattatttataatactgaaagtctaaaactaatccacaggatcaacaataaatgagtatttaaataaagtatgttgtagttatactgtaaataaataaaaatgaaggaaatgttgccaaagaaaatatttctggagacttcatactactaaattatcagcaagtgtaggtgaccaaaatatggataattattttatccataatattttacaaagttttccagttttccatgactattcctctgtggtacacacagaaaatttcccatccaaaaccgtttgccatttcttctctactagcaaaatttcgaacttctttttagacaagcattattctcagcattcattcagcagcctttgaaagtgaaggtgacatgagacacagctgtgcttaataaaaatataaatagaaaaaattgagtgaagcttccaaaaaatttgtttaaaatgctttagtttttattggtaccaaccttttgttctctgcctctccttcttcatatttggaataaaaatacaatgctggaggtaaaacaaccaacttgtgacaacgagaacacaatataaactaaagcttcatgctaagcaagacttcgcagaaagacagagggcaccaggattcttgatatcactttggagattgttccagccctggccacctacctccagccttcttaagaaacaaaactaaattcctaacttgtttaagccattgactaattatgcattctgatacttgaggctaaaagcaatctttgacatatacatacgtatatatatatgtatatatacacacacatatgtgtttctattacatatataaatgcatatattataattatatgtgcttgaattggtggggttgtaattttctacataatttcaaattgcatatactggcattataaattgaacatgtatatttgcaattatgtatgtatatatacacagacatcatatatgtgaatgaataggagtacactagacagttaatttcctattcattcttccatatttagctcaaaggaactttctctgtgaagcatcttcattttgctttcttataatttgaatgaacctctaatacaacatacataatcttatattgtaatcatttgtttgtatatctgccttcccactcccactcatttcattgtcagttcttgttgggctgggatatcgactccatcatcatttacacatttaatagatgacaatagattagctcataagcaaacattgtaatgattcacttagatattattttcattttgatggtatctgtttaattctataatattctcaattccttttcaatgccctatgtgctatgatgtatgcaacaggcattcaatgatgtcattaattaactgataacagttgcaatacatgtatattaggggtttctgatatcctgcaaattacatctaatacaggaaacatttggctggatattcgttgatctacagtctagattcaaaatacgagtggatattttcaaatattttcatataatgctttttcagggactgaactaacagcaaatgacctagcacacagattccacaaccaaactgtgtggggacagaccaagttactaccttgatatattcaaatgcgtcacttaatcatttatattttgtgttcctcaatggtaaaaagaggataataatatttttattgggttttgtgagaattcaaagaattaatgtacacaaagctcttagaacaatgttgaatgtatggaaagcactcaataatactttctataaacaatggtttgcagtagggatgcataattagatcctaatctgccactttaaaaatacctctcaagagtctgtctttccaaaatgtctattattttcttttcttcttcattgcttcattaaatctgcagttaattaatgtatttatgttacaataatctaatttagattcagggaatgtgttgaatgtcctcacatagcttctcaatatgaaaataataaataattctgtagactgaataaaaatgaatcagagtgagattgaaattgcaatctcaaaattagattttgtgatgagggatctgtagaccgtaattcaatctttctctttgcttcagttaggttagatgatgttccttggaaaatgtgaagtttatatgttttgtatgcatggtttgtgaagaagtcattgatgggaattgtttatgtgatagtctttagaaagcttgtgtgatgaagctcagctcctataaaatttcacttcaaaaacagccctttgaataccagtttcccattttggagataatcttttattgtcacaaaatatgtatttaaatattatgaaaactaaaaacaaggtaaagtgtctccctaagtacaataaatattgaatagaattataaatttattctagaagagggaaaatgcaaacaactacttccaagcaccctaaaacaaaacagcaattcctttcatagttctaagttatactttctgatgtgaaatgagtaattatgcactgctttattttaatatatgtatataaacataaatatatacttttaattatatttaaggtgtgtatatatgtatgtatacaaaacattttaaatattttttaaagcaaagccaattagatactaatacagtcatcacattacctaaacatttatttattcattcattcagtcattcatcaaagatatgatgaatatctttgatattgtagacttatcatgtattgagaatggctttagggatctgaatataagagataagttcctatactcatggaacttataaaatattttatattttaaatgttatatatttacctgtatttctggatagatgttatgaaaaatgtctttaaatttgtttatatggtgtgtggcttattcaacctgcccatttattttttcgttatgcaagtacgcactgatgatctaatatgagctaaggacttctggtagttattaaggctgttcccaagggcacttgagagaattacacttctccatctgccgccatatgactactttctttagccagtgaaatgtgagtaggagtcttaacttgtgtcacttctgatagatttaaatatcaaagtgattgtggaaggcatggccattggagcctctatttgtctggtgattaatcgaccgcgatgaatagagctccatttcacgtttacattggctgtgtagacggagatgaaagatactctccctgtgttaagccataaaacatcagagttattttgttaatgaggcataacctagcatatgcttactgatatagcaccattgtaggtgctgaggatataattttaagcaaagcagataaagtacctgcccacatggaatttatgttcaagtgatgaaactataactaaaaaaaaataataaactgatacaggatatgatgatgaatagcactaaatgctataaagtttagtaaggagataaataatcagggtggatgctattttggatagaatgctcaggagagtaatttctggaaaggtgatacttcatcagagaccttacttaaagggcaagacccttaggagctgcactagcaacagtgttgcaaaaggcctggcacacaggttccaaaaatgcaagctatgtagtcctgagctcaccagttaggagctccagcaaataatctggagaaattatggggaaatatgatagctctgaggcaagagagtgtgccctgtgaacagcacagagcccaatgtgtctgcagtggactgagcaagggggagacctgtaggagataagtcatctaaggtcgtgtgagtacacagaacaagtgatgcctcatagaccttcatgaaagtaagttagagaagaaagttttgaacacaggcattatgtgatttgacttatgatttttaataatcactttgaattcttgatgaacaataaactctagaaggtaaagagtagaaactggcagactagttaggatgatattgcagtattgggttgttgtaatagcgatgatactaagtgtagactgagctaacaggatttgctcttattttgtaatggtgagatgaagggagtgtggcaggggccagaggagaggagagagagggaaagtagggatagattagagagaaggcatggaaagacgtactcgaaggaaggaatgccacgatgaaggcctggaccacatagaatgagaagtcagatcccattttgaattccagagcagattttgcccccaggctatattaagaggtgaatactcgaactaccacagttactctttcattataatgaatgttatctagaatttccggtagcgcatgctattggtgccctgcccatagtccttgattaattatcatttctatgcttgtgggtgcaaattgcagtcagctatcacctttgccaggagggctctacaggtagacctgaagtagaagggcattaactctctctagggaaagccctcaaacaattacagaagttggtggataaatattcatctccctacccccttgggcagaccctaagctgtgagttctgcaatgatacttagagtttcccagtggggttaggcttcaattgtccagattgctaacatatttgacaatgcaaactttatttcttttcttcccctttccactatgaaaaagtttagatatttcctagtatcagctcctaactaaactatttgtactcaaatctgtttctcaggatctgcttctaaggaaacccaaataaagacagtttatacacggatgaaaatttattgaagttgaatattatctaaagtaaaaccaaaggttttccattctgaaagtgaatcaaaatctgttgatggttcatagatacaatattgcaaagataattacgtttaatccccaaagcaaccatatgatgtttttagggggagcttcttgaaaatgaagtagctatttaaatataagtttaaacatcacaagggaaaggatctgtttgatttactcatgaactccaaagacctggaggagtccctgtcacatacaggcactcagtgagtatttcaaagaatacttaaactaaaaatagttcacatccatcttggaagaatgtttttgatggggaacccaagttcaagaggataactacgtgagctctgaaggagaaaggaactttcaagcaaaggagagacatcaagtgaagcagtaatagcaattaggatagcttatatgaggtctcctcaatggtgtggttgctataaacatttttataggtgccttacctaaggctaagagaagtaaagcatttttttcttagtcccaaaactgatgcatgagagtagctacatttgagctcaggcttgtctccatcttcctgcacccttgcataatctcgaattcttcctgctgactggcctaagttaggcagttagattttggagaatggatgtaagtccaaatatttcttaaagcaaagactttttaaataaaatgaatgccatagtcagttcaggctgctatattaaaatatcataaactgggtggcttaacaaacgtttcttacagttttaaaatctgagacattcaagatcaagatgctggcagactggtatctggtgagggctcttttcctggtttgcagatggctaccttcttgctgtaacatcacatgacagaaagagtgagctctgacatcttcctcttctttgaatggcagtaatttcatcacggaggctccaccttcatgacttcacgtaaacctcattacttcccaaaggccccacctctaaatattgttacattggggtgtagggtttccacatatgaatttgaatggagggaacacaaatactcagtccatagcaatatgcataaattagcaggattttttcaaacttacttctcacttgtaatttgcaattttaaccaaggtttaatctaggaccagaatgggaaagatattatatagaatgctagatgagatccaatagggtgagggcaaaggaaaggctgctatttattattctatatttcaacaagtaaatgatagcatctaaacaaaaaaaaattcctgcaaaatgtcataaattaccacacactaatatcaaagtgcctaaaataaacaaactcctatcatgaagggaagtaaaattcaactaacaggtgttcccacaaaggagaaaataaggtcattcctttgaacctaggtggctgaaaagagtgagaaaagatattctctaataagacttctataataggttcctgaggcttgacagcctaaagccaaaacaaaacaaagaaaaaaaagatagagtccttagaagcagaccagtgaacccatactcacttgcaccttcaggccaagaacacgattgatagttatagtagtacatctaagtgcatttcctcaggtttccatgacctcaatccatctccctctccttagaccttctcatttaccagtcagcagcatgacttacgctatgcatattcattctaccctgcctccagcacagagactcaaacacattctttcatgaatcactatcacaaccttttaacagtttggagtatattaaaataaaagcaattccatttgaatcccatttttttttgtccttggataaatgtaatcaataattaagttgtcagctttttgtagagaatagacatctcatgttgtttttaatgattattcatttacacataattctttgcttgcctaaaaaatatttctactacctcaaattcccagtctaatttaatttttttctctttatgtactaaacatttttgaaatcagcaactctgttattttgtcaaatttactgtaaataatttgggtagagaactggatatgtgacctccagggcatcttcagtcactgaaaatctgtgatcctcttcctaaatctttcgtggactctctccagatgtttgtattactagaaatacctgagagtcctgttttaacagtgtttattaataatatagagccttaaagaacctcataaagcaagattttggtgttttcaagcaagactaacaatccaaattaaggaaaaaaataacttacaaatatcaaaaaacaaaacaaaaagcaccaaagggaagggagtagaaattatgcatttgggctattagacatccttttctcacacacttagtctgtaatatgttacctaataaaatttaacactcaggcatttttctagtgagaatatttcatctttctgtgcactattcttttcctttagtggaatatctattatactcatttgcctgtatgccatgcagtttggcacataatcacacactgtttatacgattctctaaatgcttgtctccttgagagattacaagtaattcaattcactaaagtactgtttctctctttttgtatcagcaacagtattgaagtaaacattatgatacttctcagtataagtgacagtcctgggcacaatgccttcctcataataaattccattattggttggattaatgctcaaatgaataagtacttgctgaattgaagtaagatgaaatgcatactggacaagaatgactgttggtagcaaccactgaaacaatttttgttgtctaagctgttcacacaccatttgtccttaaaggtgcgttgttgagaaagtgcaatgtaccgagtactgtgttaacaacttatataatctaactttatcctcacaataaccttaaagaaaaacagagtcataattacttcattttcaagtaatagagaacttggattggcttaaataacaaatggtataacttgattctagttgcaagtaggcaaggatctgtctcttggctgtacgttagccaagcaggatcctggtaatggctgccagtagctttcgtgtctcccctcttggttgcaagatggctataattacaaagaagacaacttcacaccttgaaagcatgggaaatgcaggggagtttgtttgggagagtctaaacaagtgtctcttagttgagttagccccccatgcctggatcaataactaacttattgacttaagctaatcaggatctcttttaatggagtggtgtcaaattagcactaagagggggaaaaattgaaagaaatactaagcactagttattaaagagtgtggaaatgtgcactagaatgcaaaagtaaaataaaactattatatccattgcatctcttttaaagataaacattgacactctttctacagtcagacttagtatcttagtctgtacacagtcagacttagtatcttagtgaattattctttatttcattatgtcgtttaccaaaatatccctattgatgtgttttgtcttaaattccactgtctgacttatttccagacactgcccccaacttccatctcccttggctaagtgaagctgaaggctctggccagcaggaaaggcgaaggcagaataattgcctgacaggttttggattggaaaggaactggggagggaatggaggaggtagctttcaacctctctctgtcgttttattttaggtgtatatctggtgagtaatataacaccaaaaaattattttaaatataatttcataaattatctgttaataagtgagtttttgtttgtattttttgtaattgtaattaattatatttggacagatctacatcttattttgtgttgtttcttgcctcttttctctgcctctttttattcttctttcttacctctgttgaagtgataggcttttattccttatttttacctttactgtttagaaagccatcagattttttttttcttctttagcggttactcttaaatatttaataaaatatttggctaactttttaagataagaaaacaaaactgtaaagggctaatgttactttcttaaaatcacacagttaatattggcaaaagtgaaattccaaattaagtctgtcttcaacaccaatataataatgcctcccttaaatatttgttcattgtcttcagctctgttatctgccatacaataggtgcttctaatttttttattttggcaatgaaagagattcctgtgtactctcagtattagtaatacatacattttctttttattatacgtcatctgaatggcatgtctctttgctgccattcatttctatttaactgataaaattttaattcgctggctaattttctccctgcaactaatgaccgcccacttgtattttaggaatgtgttaattgaagaaaaaaagaaaagaaacagaatgacttgttcaattaataagtgacaaaatactgttaggagccatatttttgacagcaaaaatattagaccagttaactaatacattcagtgtaggatttgttttttattcagtaacttttgtgattagacataatgctagttaataacattaagtaaatcagttagtacattttgggtgaatattatttttgcattctgagaacccataaatgaaaaacagtttactaggagtttagctgaacatataaaatgaattgattaaacatgtaaagaaagtcataaaacttcatcagtttgattttcggcatgttaagtatatcttaatctggtaaatcaaagtatgtgcaccactgttccaaggagaaattttgaattaatttttggtaactttttggagtcctgctttctgtctttttctcttaacttatactggaagaaaactgtttcactgatgtttcatattcaaaactagcttgactagttttaaccttgatgtttttaatacacactaatattcgtgaatatttctatttgagtagaagtgaagattcatatgaggtagtctgaaagtttgaatgtcctcaattttataaatgaatttaaaacacctgattatttctgaaacaaaaattgctaaagaaaaaatagagtgtatatatgaacctgtatttaaatatttgatatgcctggatcagttagagagatctctaaatcaaagaagctggccaagccaagtgaattggagaggaaaatactgagatcatcagaattagagagtagaggctagttagacaccaaaccacatgcaataaccctcagaataaaatctgaggaactgtgtcaatcatcaagtttgagttggtcttgggtaaaaaaatggcagtagaaacactagcaactttttgacatgagaaggtagttaaatttaagtttcaagggaaaaaccataaatcattggcatgattatatttacaatttcgatattattacagaatatttgctaaactccccataacaacgccttcggagaccctgtgtatcatgcaaaggtagatttagtcaacttgctaaataagggagagcacctgcttaagagagagagaatgagggaagagtcatgtagggtttatggacctcgggttagacacgtactgtacaaggcagatggtcataagtgaagtctagggagggattgatcagaatttgtaaattaggtcagttgccagaactgtccatgagcccatgcaatcaatgaattgaactgctaaatcagcttgtgattttatctagaaaaatacacatgtgaacaaactggtgctaaaagaatttaagcttagtttgtctgtcaggatatggtctttacagttcatctgtttttcaagtcaagtagaatttgtggtttgtgtttcatttcgtatctagtattcagaacagtgtcttcccttttttatttactctttacccatagcccttccatggcattttgactgggtcttgtagtttcatgtgactattttacaattcaccaaaaaataaaactaaaccattatattgcttatgacatttgcctagtgactcttttgtcctgttctagacttgccttctcctgtagatcttaattctaagcatcctttctctctggttcaaaacaaatctttctggaatataacttccctcagtgttttgagattttcaaatgttgcccagtttcttaaatatatgctacttgtaccaaggcacccattcatattcaggactgttaaattgctagataatttaggaggaaaaaaaatgaatttttattactttttaattcaacttgtgttttttcttgtataaaattaccatgatttttgtttttatctttagcattagacttaaaaatgtgttgtacacaggtcatagcagcttgctttggacttgtgccatagatctctgaggatgcaaactcattcacctctactgttcattgtacccagaggaaaagcttaataagtactgctgtaacaaaatcatattattaaatagagtaaaatttattgacataaaccctataaggtttaatatcccctaatgtttgaaatattcaggttttataattttcacagatctagccaatattttattagaaattatgagaaagaggatatgctgcataaagtcagaactaaaatccgcaatattgtaagttggagtaaagaatgataaactaccaggcatggtggctcatgcctgtaatctcaacactttgggaggctgaaggaggagaatcacttgggcctaggattttgagaccagcctgggtaacataatgagacaccatctctacaaaaactaaaaatgaaaattaaaaaattaaaaattattcaggtatagtggtatatgttgtagtcccagttacttgggagactgaggcaggaggatcccttgagccaggaaggtcaagactgcagttaaccatgattgcagcactacactctagcctgggagacagagtgatatcttgtctcaaaaaaaaaaaaaaaaaaaaaaaaaaaaagaaagaaaagaacaagcttaaatatcctggtcttgacattttttttggttcatataacataatgttgatttttttgttcttatcctaccaatttaacttgctcaatagtcatatctttgtaaaatgtcagcaggaaattttgattccattaaatcaagccaattattgctggtgctaatcatcatgtttttatctgataagataaaataacaaagtgatgtttctaaaatttatgtgtctgtgttatgggaggggttccactaatatttacatttaatttttgccttttagaaatgaaaactataaatacttataatgacataatagacttgatggctgatttgtttcattttcattattgaaactctcacatatttgtatttgttactgatattttcactacttattttaagctttgataatacatggaaaattagaagccattacaataagtaaacaatgagattctccagcaagatttggcacacataagtggtctgttttgtggggttttttattttatgtcattgtttttattttactttccctttttgaaagtaaactaatcaacagacttggctagacacagcatctccaagttggaaaatgaagtattgaacactgggataagctacagaatatatattctatacattcaccaagaattccatttagcaatccatgacatgggaacataaaagtttcatacagtttgctaaggctttgataaattttatgttgaatattttgaggcagatcctgaaattctgaggatattgaaccacctttacagccaagagacatttccctttggcttcaggagagattttacaccttgtaacagagaagaatcatggagcctgcgtgtttgggcctttcagtctcctcttaaacattacagcaaaaataaacctaagacttgctattatggaacagcttgagttgctgggaaatataatcagtgtagatatttgtgtatcattgtttaccatttctatgccctttatctgagttaatgaaacacatctggggtatacgttttgaaggaaaatgaaaaagatctgcttatcctcacttaaaatacattctgttcatctccacccagagcattagaaaaaataggtaaagtaagctatctgagatagcttctgagaataatggtttcattttaaatgggagaatgcctgaagggatttctactgtaagggtaaagaaaagactgacatgcagaaataatgtctacagtaagatgagtgaccttccttttgaaaggtggaaggaagaatgcctagaaatgtcagatgcataagactaaaaatggagatgtttcccattctgaaatttatttttgatctttgggttagagcttcagatagtactgcaaaagctccctgagtgactctaatctttagcagtgttgaaaaccactaaaaaaaagcaagtcttatatttgacagaaaacagggagatagaattagagagagagaaagaaagaaaggaagagaggaagagagatgggagcagggacgatccggaaatatatagagcattaatatcagaaattatatggttctagcacttagttattgtttcttctgggctcttagtgacctagggtacccagaagatgtctggtccatgagatttttacaaccagatgcgaccttgaaatgtaaatggactttaagagattgtgtgacattatgaagtgggtccttatttgccacataatgcctattgcatgttaaatgctttaattatttatttgtttaaattaagcaactctcaacaatatagttcaaagagtgctttcaagtggagagtagagcataatatctcccaagtttctgggagactgtttcagctacaagatatacgaatgtcaccctatcaaaggcctgacctctgtatccccttaggcctcaatggtatgaattctactcactggggcaaaatgtaccatatagtaaagccatgttcttcttaaaatacgatgtacataaccaaacacagtattttgtgctcaattttgccattgcagaggatagacacttatcttccttgatctggatattatagttcttaacgctgacagctcttaatgctgccaaagtttcatcagcactctggctgctttatcagactctgcttatcagactctgcaattgctttgagcttgcagtgaatatttgtcagggagtgcttctggaaagcagttctaggttgccattctctcagaatcagatggagtgcttcctgcaggtctagattcttgggcccagatgcactgaatcagaatttctgacagtagagcccacaaatctgtaagtacaatacattccctgggtctttctaaaataccctaaagttgagaacaggtcttctgtttatctgtgaaaaatgaaaggggctattaccacctataaatatgtagatttgtgatgaattgggcatttatgggaacaacaagaatattagtcaaaaacagacctggggttgagtctgagactaggaagtggcagcagaatttttaaatttctaattctatattttcatgatttaactacctatcctctaattcagtgtttcttaaactttagtgtgatcagatcgcaaggagctgatagaatccaagcttaccctttcaaagactaatttttaggcaggtgttggggcccaggaattgcctttttaacacgcagtcaggtagtattgtgaggaaatgatccacaggttgaagtctcttgatcctgttcttttgtctcttccaagatgttcttcccttcaggtctcttttttttttattgcctcctcatcttctctatttctttgggttcttctccttagtttgagcagacttaagccactcatatcctaagattattttcttatcaatttgtattaattttctagagatgacataacaaattacccacaaactaggtggcttaaaacaagagaaatttattgacttgcatttttggaagctagaatcctgaaagttctattggtatcatcaggccatgctgtctctgaagcctttaaagagaaatccttctttgtgttttgcagcttctggtacttccacgtatccacttctggtacttccacgtatcccttggcttgcagcaccatgattccaatttctgcttcagtcttcacaaggctgtcttctctctatgtcagtatgtctatgtcttcacatggcattctcctccctgtgtttacattttcctcttctaaggatctcagtcatattgaactaggtcccactctcatcaagtatgacctcattttaaattaattacatctgcaaaccctgtttccaaataaagtcacgtccatagctatgattaggacttaggacttcaacatatctttttaggaaacacaattcaatccacaacaaaactgtatgttccagtctaactacttccccatctctctccttttttcagcgaagattctgaaacaaatagtttatactgattgttatcacttatttaccacctacttactgcaatctggctttggatgttactaccattgacagttctggagtgaccattgaagttaattgacaaatctaaagaatgcttgttagttcttgccttacttgttacttttattgcactccagagtattgaatgttctcatcttaaagcttttcttatttgaactgacctaagtcagcctgcttaagtacaacttttagttttactttggtaaattgctatagctgtgaaagtaaattattacaaaagcaatctatgataaaattctgccaaacttgtagataattttaactacactagcacaaaacttgagccattgtgccattaactaggggatcttactgttctttgtcatttaaatgtttcaatcacactttgaatttaaggtttactaaaagcagatacatcgagtgggaattctattattttgcataacctcatgcatgatatcacactgctcatacaaaaaatatttaaaattaaattatagatatctttgtaatgtaactctcatcttgatttcttgtcacatctagaaagcctattgccaagtaatgatattacaacaattttagtggattaagcaatatacatttattatctcacagtttgttttgggttaggaattaaaatatggcttagctaggtcttctgcttagtgtatcacaagactgagatcaaggtaatcttcaaaactgtggtcttatccgaagctcaactggaaaagggttattataagatattatgattattataagctcattcatgttgttggcagaattcaattctttgtggttgtagggccgttaggtcttcaattacttgctggctgttcactggaggccaccctcagctcccagaggccccttgcaattcttactacatagggttccctagtatgactctttgctttcccaaagtatgacttactttgcttacccaaagtaagacagggagaccacagacgataggtgctacaatcttatgtaaccatctaatcatatacccaaatcatatccattctattatttagaagcaagtcacagatccttcccatgcccaaggaatggggctcacacaccggcatgaacaactggaagtgggcatcattggagccactttaagtgtcttctgtccacaaccctaagtctcctcactgtaaatatactgcttaggtatttgcatcttcatatgtgacttcaactgccagttatgtactgttgcttccaaaatctatgtcccagcctctctgtctatcctaaaatgttaatccaaatagtcaactttcttttgatattttgatgtaaatgtagtcatttttatgtggacatcaatctcaacacaattcctttctcttcagattgctcctctctctttttaccattgtgaataatgatgcatcctatatccagtgtgcatgggacacaaacctgagattgtgatttaattattctcgggtggaactgagtcatcacagtttttaaaaagcttccagatgatttaatttgcagctataatggataactaatgatctataacattactctattttgtctgcttgatattattatgcttatttccttattttttttttctatctctcttctagaatgtaagcttcttgaaagcttcttcatcaatatattactgtcttagatggttaggtctgctataagaaatacatagactggatggcttaaacaacaaacatttaattctcatggttctggaggctaggaagtctaagataaggtatcagcaaatttggttcctgatgaggcccttctttctggtttgcagatagctgccttgtggctgagaaatcatctatcttgagtctccttataagagtgctaattctgttatgagaaccacaccctcattatttaattacttcctagaagtaccccttccaaacactaccatattgaggtttacgtcttcaacatacgaattttgagaagacataaacagtcactaacatacattacaatatttggcatatagtaggtatttaataatttgagtaattgataaatactacttattatatgtcagcattatgataagtgctctatacagatgttacttgacttatgatatggttacactcatcctgacaaacccatcataccatcataagttgaaaatattataagttaaaaatttatttagctgggtgcactggcatgctcacgtagtcccggctatttgagaggctgagatggaagcattgcttgaacccaggagttcgaggctgtagtgcattatcatcacatgaataaccactgcactccagcctaagcaacatgtagagatggaaaccccatctctacaaaaaaaggaagaaaaaagaaaatgcattcaatatacctaagctaccaaacatcatagcttaatctagcctaactacaaatgtgctcagaacccttatattagcctacagttggacaaaatcatctaacacaaagcctattttataataaaatattggatgtcttatataatttattgaatactgtaccaaaagtgaaaagcagcatggttatatgggtactcaaagtatggtgtgtactgaatgcatgatgctttcacacatgcttcacatggtaaagtaaaaaaaaaaatcataagttgaaccatcataaattggagaccatctgtatacattattttattaatcctcacaaaaacgtatgagtctattttcaattccattttttaaaaaaactgattaggtaaatgtagtaaagcaatttatctgaggtcacatataaagtaaagctgtgattgaaactaagtctgcctaacatcaaaactcatggttctgaccaatatgctaaacatatgctttccagctacatgtatttattgccgaagttgttataccttttagtgtgttgtttcttttttggaaaagcctatttctttgctgattcattaatccactgtggtaggattaaaagtcagatcatgtagctccaccagaatatagttatcttttcatgttgtgcatgaccatatatattcaggtttctgcttctggtggttattctaaatgcagttattatcaagtaatgcttaccgcttgccaacaatgtgctagacacagagcagagcagagcatctgacatgctttccattctgcactctgatccataactttcatccataaatctttttgcaattttacaaacatgcattctccaaacattcccatgaggtaaatgaatatttattatatccactttacagatgcataaagttagatgtagactaattaagtaagttcttcaagggcagagagtgagttggttggaaaatcaaggttagcattgaacattctggatgcctgcttctaaaaggaatgaatggtgtgttaagttgatttcactatacatagttgaaaatgtttattttaagctttcatgatatattttccattagtttttggacattgcccagaagaattcacagtaaattaatagtcagcccttagatatgtatgcagtttgtgtctgttggcttctgtgggagatgcaaaaatgaaactgaagaaagaatttagcccatagtaattacatcttcctgtagagattctggtaattatgtttggatatttttttcactatataatttaaagttttgtatttagtaatgtacctctaatttagcatatagaagtaagcagctaattaaactgagattactttctactcacagccaacatttaaaacatagttattattacaaaattttttaaagttatattactttttatgaatatgaactcaaatcaaaatgcatagcacaataacataattaagaaagactgtattagttcggtgtgttgccatttaaagatccaaattaaaactatatgcttttcattccaccaaatggtagatttttagaaccataaaagatccatagttgatttgtggactcacaactggtccttaaacaacatgatacatctttctgattcttttgttattcttattttttaaatgataatttgatttaactatacagatatgcaactatatatgtataagcatcacctctgtgtataattttcaatttgttcagattttgagattttgtcgaatctatatttaaatttagatgcatggtttatgctcaaaatcattttgatggaaataatattttattatagtccaacaatgctataaataataaaaggaatgaatatacaaggttaaataggactttattttcatctgtatatactgtttgaatcactgatgagcacatgcactaatataaaatttcctgttaatacatgccaaatcttgttgtagatgtgtgtcgtagaaaggtaggcattagatataaatctctataatgaatggtattttaataaggcaatctttaactttctgtttcacaagcttctattgagaatttgttgggaccattttatggtatcttaataaatttgctgggctatacattttataaattgacttcctaagacagctaccccattaataggtaaatagataatacttccatttatttattatttctgaaggctttccacctatttgcaagtattagtggacctgtcatgaagaagaaaataaaaatagattgaaatagtacaactggcagtgtgattattttgtattctaattgattagctgagggagaattatgtaactttcatcagttggactaaaactttaaatcattctaccaatagaattccttttaatcatttaccaaatttctcaccaccaaaatttcacaccaactttcacctcctttaccattcccaaacctagaaaacattattttgttctccattctaaatttttttcatttcaaaaatgttattgaaatgaaatcatatattatatgatctattaaaactggcttttattaactcagtataatccattaagaataatctaagttgattgtataaatagtgtgctgctttctattactgagaaacatggtgtatttataccatggtttgtttaaccattcaccccttaaaggacatttggattacttctggttgttaagtattatgagtaaagccactgtgaaatttgtgtacaagtttttgtgtgagcaggtttcatttctctgaagtaaatacccaagaatacaattgctggactctatggtgtattcacttcctgttgccactgtaacaaagaaccacagtgatttaaataatacaaattttgttatcttacagttgtgggagttagaaatctcagtggcctaaaatcaaggtgtgggcaggtttgtgttccttctggaggttgtaggggagagtcggcttcctagttttttccagcttctaaaatgtgtccacatttcttgatcatggcaccatccttcatcttcaaagccagcagcacagcatcttcacatccttccctctcttgcttctttctctcacctctgcttctgttgtcacatctcctctgactctgactgtcctgcctccccgttctgttataagtattcttgtgaacactttggatccacgtggacaacccagattaatattcctatcctagggttcttaatttgatcacttatgcagagtcccttttataagtaaagtaacatatttacagcttctggggattagggcatagacatctttatttgggggataggagcagagaagggtggcatcattctgcttactacatatagtaggtgcacatttagttttatgagaatttatgattgtcagcttcctggaattcatcacacacatacatgcatactcatacacaaatgtatatggagaatgtacatataagttgcatagttcttattattaatattcaaatgaaggaagtgttcccattcctgaagagaagtaaagatttcctcttactaaattgctaaggaaatttctcccttggaaactttacaaaggctacactgagagaaaataacctagagttttataatgaacacatacatgatttttcatttgtcaatttcttacagtgacctgatgaaagctgagagcataatattgaagtccagctctgtaaaggcatttctgctaatgtgatcttggtatccagctgaaaataataaaatatgctcactagaatttcccaattaaatatttgcttaataatgaaatttgctttaattttccattgaaaactcgcttcttttttattttattttattttatttatttctttttttgagatacagtttctctcttattgcccaggctttagtgcaatggcgcgatcttggctcaccgcaacctctgccacccgagttcaagcaattctcttgcctcagcctcccaagtagctgggattacaggcatgcgtcaccacgtccagctaattttgtatttttagtagagacggggtttctccatgttgatcaagctcgtctcaaactccggacctcaggtgatccaccctcctcggcctcccaaagagccgggattacaggcgtgagccactgcgcccaccctaatttttaaaataatcagttatttattttccgtggattttcccctctcaacaaaaaaaaattttacacaactttttcccaatattttctttaaatcatcagcaaaaaatatgaaattacatttcgtttttaatattctatacttttctatggggatgcctgctttattttacaccaatttgcaaagataaaaatgattatatgaaatacataaaatttattcttaattgctctgaaaataaaccttaatatttataagcaatgtgatttgggcattatattttaaaagcttaagtcaacttgtcataaatttgcatccataaatctaatttagcattacacagttttttttttttacttttacattagattatgagagtacatatgcaagtttggtacctgggttatattgcatgatgctgaggtttggggtatgaatgatcccatcacccaggtatggagaatagtacccaaccgttaacttttcccactcttgcctccctccctccctccatgccctagtagtccccagtgtctattgttgctgtctttatgtccatgagtacccagtgtctagctcccacttataagtgaggacatgcagtatgtagttttatgttcctgtattaatttatttagaataatgttttccagctgaatccatgttgctgcaaaggacatgatttcatttttcatggctccatagtattccatggtgtatatgtatcatattttctttatccaggccatcgttgttggacatctaagttgattccatatctttgctattgtgaatagtattgcgatgaacatgtgagtgctgtccctttacggtagaactatttgtttacttttggatatacatccagtaatgggagtgttgggttgaatggtagttctattttaaggtctttgagaaatctccaaattgttttccaaagtggctgaattaatttacattcccaccaacagtgtataagcattctcttttctccacagcctcatcaacatctgttgttttttagctttttaataatagccattcttactggtgtgaggtaatatctcaatgtggtttcaatttgcattctctaatgattagtgatgatgaacattcttttatacatttgttggctactgtatatcttcttttgagaagtgtctatttatgtcttctgcccgctttttaatggggttatttgttttatgcttgttaagttgtttaagtttcttacagattctggatattagaactttgtttgatgcattgtttgcaaatattttctccagttctctaggttgtctgcttcttctgttgatagtttcttttgctgtgcagaagctctgtagtttaattaggtcccacttgtcaatttttgctttcattgcaattgtttttttcttatttgtttttgtttttgttttgttttgttttgttttttgagaacctaatcataaatttttttctcaaggcccatgtccagaatggtgtttctgaggttttttttttttttttccctaggattcttatagtttgaggtcttatatttaaatctttaatccaccttgagttagtgtttgtgtatggtgaaaggaaagggtccagtttcattcttctgcatatggctagacagctatcccagcaccatttattgaatacggagttctttccccactgtttatttttgatgactttgtttcagattagatgactgcaggtgtgtggctttatttctgagttatctattctgttccattggtctatgtgtctgtttttgtaccagtaccttatagtataggttatataggctaatgcatagtatagtatagtatagtataggtatagtatagtatagtatagtatagtatagtatagtatagtatagtatagtatagtatgtatagtttaggttacatactacattataatataagctaatttgtagccttgtagtataggttgaaattgggtaatgttatgcctccagctttgctctttttacttaggattgctttggctattcttggctctttgtttgttccatatgaattttagtataatgttttccaattctatgaaaaatgacattggtggtttgataggaatagcattgatctgttgattgctttgggcagtatggcctttttgacaatatagattcttgaatttcatgagtatgggatgtttttccatttgcctgtgtcatctatgattttttttagcagtgttttgtagttctccttttagagagctttcacttccttgattagatgtattcctagacactttattttattttttgtagcatttgtaaatgggattgtgttcttgatttggccctcagctagaatgttatcagtttatagaaatgctactgatttgagtacattgattttgtatcctgaaactctgctgaagttgtttatcagttccaggagttttctggcagagtcttttgagttttctaggtatagagtcatatcatccacaaagataagttgaattcttcctttcctatttggatgccttttatatctttatattccctgattgctctggctagcacttccagtactatgtttaataaggggtgctgagagagggcatccttgtcttgttccaggggaatgctttcagtttttgccctttcacttggctgtgtgtttaacatagatagctcttattattttgaggtatgttcttttgatgcctagtttatcgaggggctttaacatgaagggatgttggattttatcaaaagctttttctgcatctactgagatgatcatatggtttttgtttttaattttgtttatgtggtgaatcaatttattgatttgcatatattgaaccaaccttgcatcccaggaatgaagcctacttgatcatgataaattaactttttgatgtactgtggaatttagtttcctaatatttcttttaggatttttgcatctgtgttcaatggggatattgacctatagttttcttttatcattgtatctttggcaggtttggtatcagggtgatgctggcttcatagaatgagttgaggaggagtccccactactaaaatttttgaaatagtttcatatagaatattctcatcttttcctcttcttcttttcttctgacaatttctcacttgtcttctgcacctcatatttgttttgtctgatataagaatagctactcctgcttacttttggtgtccatttgcatgggatgtctttttccacccctttaccttaaatttatttgagtccctacgtgttaggtgagtctcttgagagcaacagatagttggttggtgaatttttatgcattctgcaattctgcatcttttaagtggagcatttagaccgtttacattcattgttagtattgatatgtgaggtactattccattcatcatgctatttgttgcctgtatacctttttttctttaattgtatttttgttttataggtattgtgagaattatggtttaaagaggttctgttttgatgcgtctccaggatttgtttcaagatttagagctccttttagcagttctcatagttctggcttggtagtggcagattctcagagcatttgtctgaaaaagattgtatctttttttcatttatgaagcttagttttgctggatccaaaattcgtgcctgataattgttctgtttaaagaggctgaagatagggtcccaatcccttctagcttgtagaatttctgctgagaaatctgctgttaatctgataggttttcctttgtaggttacctggtgcttttgcctcagctctcaatattctttccttcaccttgactttagataacctgaagacaatgtgctgaggcaatgatctttttgtgatgaatttcccaggtgttctttgtgcttcttgtatttggatgtctaggtctctggcaaggccagggaagttttcctttattattcccccagatatgttttccaaacttttacatttcccttcttcctcaggaataccagttattcttaggtttggttgtttaacgtagtcccaaacttcttggaggctttgttcattttttcttattcttttttctttgtcagattgggttaattggagaccctgtcttcaagctcagaagttctttattctgcttgctccagtctgttgctgagaatttccagagcattttgcatttctataagtgcatccattctttcctgaagttttaattttttttaatttatgctatctctttcattgaatatttttcccttcgcttcttgtatcttttttaaaattttcttagattgggctttgcctttctctgatgccttcctgattaacttagtaactgatcttctgaattctttttcaggtaaatcagggatttcttcttggtttgaatccattgctggtgagctagtatggtatttgggggatgttaaagaaccatgttttgtcatagtaccagaattgttttttctggttccttctcatttgggtggctatgtcagagggaagatctggggctgaaggctgctgttcagattcttttgtcccacggcatgttcccttgatgtagtactctctgtctcttcctagggatgtggcttcctgtgatccaagctgtagtgattgttatctctctctggatctagccacccagtaggtctaccaggctccaggctggtaccgggggttgtctgcacagagtcctgtgatgtgaaccatctgcaggtctcatagccatggatagcaacacctgctctggtggaggtggcaggggggtgaaatggactctgtgagggtccttggctttggttgcttaaggtattatttttgtacgagtgggcctcctgccaggagctgtagtagtatggggaggaagaagtggtgggcaaggccctagaactcccaagagtatatgccctttgtcttcagttaccagggttggtagggagggaccattaggtgagggcagggctaggcatgtctgagctcagcctctccttgggtgggtcttactgaggctgctgtggggatggcggtgaggttcccaggtcaatggaattatgttcctaggaggattatgcctgcctctactgtgtcatgaaggttgtcagggaagtgggggaaagccagcagtcacaggcctcacccagcacccacgcaacccaaaagtctcactcccactgtgccccctccaacagaaccgagtctgtttccaaacattgggagagcagggctgagaacttgtcccagactacctgcctgccagctatgagagcagttagggcttttgttcttccccggcctgtggagtcagcacactggatttgcacactcccccaagctctggccaggagatttcctcaatgggttgaaattgttaaaaaaaagttcgactggaaatttccttccttctgtggccttttcccagtgcctctggctgccctccccaagggcctctgagaggcagggaagaaatggcctgctaggggacccagcaagcccacagggcttttcctgcttcttcctctacttctgcatttcacttggttctctaatttgtttcagctctagggaaggtcaaaatcttcttccatgatctagaccttcaggttccccagtcagggtgtgtgttcaggggcagacaattcccctttctacttccacagtttgggcacccacattatttggggtgtctcccgggtcctacaggagcaatccacttccttcggagagtctgtgggttatctcggctcttctggtttattcctgccgaggttctagagcaaaacgtcacaatgtgagtctctacacactgctctgtctgcaaatgagctgcaatctagtcttgcctccagtccaccgtaatgttccccttttcccaagtctcatcttaatggaaagacgatgggccaggctgccacctcctaagcctttcagtgcccaggaagtcattgtctcccaactgggccctcagtttacagttttaacatgagatcattgcaactctgatgctgaactagtgtttagtgtttaaaaatagcctttttagtaaaatggtaaaagttaataagtgatcatgaaataatttcatcttttccttaatgaaatcaagtgtgcattcacaaaattcatttggtcagtgtaattactttcttgagttctatgtgcatggcaaatgaaaaataatgttgtacgaaacttaagaaccttccaaaaggtgcctgagtatgtgattttgtgtttaacacttcactgcaaggcccacaggtatcagacaaatataatcttaatgaaaaaattttgataggtgtttttaaacactcaaaacctctgcttatgaaagcttctctaatatttctcaattcaatgtttaagcactaccttatttgctcataaataaaaatattttgtctttgatattaacattttatgtatttctgggtaatttatttatctagtgataagtgtgatttctaagttctgtacagctttattcaggttgatgaaatacagtcatagagatcttatttcaggtcttgcctctaagaccttgggctctgttctgattagcacaagggagagtgggagcttagcaactataagtaggactttgagagagaagtataaaatgaatagggacagcattgtcctggacatccctttccaaattcagtctgagcatcccacatctgacatcttggtatgtttaaactctggcatcaccctaggaaataacatttcttgtccactgttatctacctttcaaatcaatagccctgaaagccactcttccttgacttgtgacaagagttaacacaagagtctttttccaccaaactacttatctgacactaaggacaagtccttctgtcagatgagacaataaaatactggtaatgttacagtgtaaatttgtggtgatttagccttcaataaaaactatggttttacaaagcatatttagaccacttccaattttattgttttatatatcatgaagtaattttacacacacacacacacacacacacacagagacacacaatcaaaatagaattttttacaatttcatgagaagggaatcaatcttcagattgttaaacactaaaagcacccctatgcttgcctgtaagctggaatcattttttaaaatttttggtaataatcacataatatgaaaaccaccttattaaaaaatgtttaagtaagtatacagtatggtatggttatctgtatgcatattgttgtacagcagatctctagatttcatcttgcataactgaaactctatagccattgcttggatgaaggagaaacaggaaattggtgtgcaatggtaatagagcttaataactttgtgttgatttttgtatatgatagggttctagtttcattcttatgaatgtggatatccaattttcccagcaacacttattgaaatgatagttcttttccaatgtgtgttcttagcccccttgttgaaaatcaattggctgtagatgtatggatttacttctgagctctctattctgttccactggtctatatgtctgtttttatgccagtatcatgttgttttggttactatagctttataagtttattttgaaatcagatagcatgatacctctaacattttttctgtttgctcatgattgcgttgactacttgagatcttttatggttccatatgacttttaagattcttttttctatttctgtgaagaacgtcattagtattctgataaaggttgtattgaatttgaagattgcttcaaattatttgtcttctattccattttttttcaccaatgttttatagttttcagtgtagagatcattcaccttcttggttaaatttattcctggcgatatttttttttgtagctattataaatgagattttttttgtgtgctatcagcatatagatacactactaatttctgtaggttaattttgtatcctgcaattttactgaattcactagttctaacagtttttttgatgcattatttagggatttctatatataaaatgatgtcatctgcaaaaaaaagataatttggctctcaccttttctatttggatgccttttatttctttttttctttttttttttttcttagacggagtctcgctctgtcacccaggatggagtgcagtggcgtgatctcggctcactgcaagctctgcctcccaggttcacaccattctcctgcctcagcctcccgagtagctgggactacaggtgcccaccaccatgtccggctaattttttttgtatttttagtagaggcggggtttcatcatgttagccaggatggtcttgatctcctgacctcgtgatccacccgccttggcctcccaaagtgctgggattacaggcggccttttatttctttatcttgtctaatagctctagctatgacttccagtactaagatgaataaaagtggtgaaagtaggcatccttgtcttgttccagatctttcaactttttcctgttctgtattatgtcacctgtggatttataatatatggtttttattgggttgaggtacatacttgctatccctaatttgttgagagtttttatcatgagaaaacatagaattttctcaaatgcttttctgcatttttgaaataattgtatgttttttgtcctttattctgttaatgtgatgagtcacacttgatttgcatatgtagaaccattattgtatccctagtgtaagtcccacttgttgtgggacttttttactgtgagtgactgtgactttttactgtgctatttaattcagtttgttagtattttgttgaggatttttgcatctgtgttcatcagaaataatgacctataattttcttgctttgttatgtccttgtctgattttggaatcaaagtaattcaaacctcatagaatgattcaggaagaatttcatcccttcaattatctgaaatagtttgggaagaattggtattagttctttaatgatttggtagaatacagcagtggaggtgtcagattctgggcttttcattgctggatgaattaattattgattcagtcttgttacttgtcattagtctgttccaaagttctacttcttcatgcttaaatcccggtagcttgtatgtgtccaggaatttatccatttcttgtctcttatgatcctttgtatttctattgcatcaatggtaatgtctcctttttaatctctggttctatttatttgtcttctcttttttcctagttactctggctaaacatttgtcaattttatcttctcaaaaaaaaaaaaaaaactcttttgttgatcttttgtattgtttttgtcatctttatttcttttactcttgctttgatatttactatttctttccttttagtaatttttggtttagtttgttcttgttttactagtttcttgaggtgtaatgttaacttggttgtttaagctcttcctggattttttgacattgatgcttgttgccatatacttccctttgagtactgcttttgctgtatcccataggttttgatatgttgtattttcattttaatttgtctctaaaattttaaaattttgcttttaatttcttagttgacccattggccgccaagagtgtgatgtttaatttccatgtgtttgtatagtttcctgcttttactgattctagtttcatacactgtgattggaaacaatacttaatatacttttaatttttaaaaattcattaagacttgtttagtagcctgtcgtatggtctattctggataatgttccatgtatatgagaggaatattctgatatatccctctctgctacttttggaattctattaggttcattttctctagagtgaagtttatttccagtattttaaaattaattttctgtctggttgacagtggaatactgaagttttctactattattgtgtagttatctttctttatatctattgatatttgctttatatatttaggtgcttcaatgttgagagcatatgtatttaaaagtgttatgtcttcttgattaattattccctttatcattaagtaatattctttctgtctcttgtgacagtttttaacttgtagtctgttttatctgacttcaatatagtcacccgtgctctcttttgattaccacttgcatgggttgtcttcttctatccttttactttcagcaaatatttggccttgaggctaaaatgggtcttttggaggcatcgtatagtttgatcttgtttttttaatccattctgcttttctgtgtctttgattggagaatttaatccatttattttcaaagtaattattgatatgtaaagagttactactgatgttaccgggtggtccttgctcccagagctcccaagatgttggcaggctgattccaaaatggcagcaggctgcttccaagatggtggcaagcctcgtgttctctgacctggggttcttggcctcatggattccaaggaatggaatcttgggccatgtggtgagtgttatagctctattagaagctgtgggtcacagaagagagctggggaacccagtgactagtgttcagctcgattaggacgaacccgggcacttagccgtgcaggaacaatggtaagcctttagcctgatcgggagcggcaatgggtgcctccccggatcaggagcacagtggacaccctgggacaacctgccagatctggagggatggaagtcaggggcgggtctgagatgtcagcaaacagcagtggtggacagcaagacaaaagctcagctccagccttaacaaacacagagcagaagagagtgcatttgcaagatttaatagagtgaaaacagagctcccatacaaagggaggggacccaaagagggtagccgttgctggctcgaatgcctaggtttatatcccgatcattgtccctctcccagtgctttcaggcaatagatgattggctatttctttacctcctgtttttgcctaattagcattttaatgagctctctttactacctgattggttgagtgtgagctaagttgcaagccccgcgtttaaaggtggatgcagtcaccttcccaggtaggcttagggattcttagtcagcctaagaaatccagctagtcctgtctctcactgacattttgtaatttgttttctggttggtttgttgctctttcccccctttattactctcttgttatttatctttttgatgtcctgattttatgtagtgctaagctttgattctttcatatttatcacttttgtatctgctatagtttttggctttgtggttgttatgaggcttacataaaatattctattgttttaacagactattttacactgataacaacttaacttaatttgcatacaaaacctctagatttttaccctccctcccacaatttatatttttgatgtcacaatttacatctttttatattatggaattttaaaaacttattgcagctatcattatttttgaatcttttgacttttaacatttatactaaagatatatatactatttatagagcaccataacagtcttggggattctgaatttgactgtatatttacctttacctgagaattttttactttctaaaatttttatgttatatctagtgttcttttgtttctacttgaagaacttccttaagaatttcttctagggaaaatctagtggtgatgaattatttgacctttgcttgtctgggagaaagactatttctccttcatttcttaaggatagctttgctggatatagtgttcccaagtggcagggttttttttgtttttgtttttgtttccagaacaatgaatatgtaatctcattctctactggcctgcagagtttctgctgaaaaatccactgatagtctgatggagattaccttatgcatccgacttgatgtgtttctcttgcttcttttaaaattccctgtttgtctttactttttgacagtttaattacaaatgccttgttgaggacaatttttggttgaatctgtttggcaacttttgtgtttcatgtatctggaaatccatatctctttgaagacttgggaagtttctagcaattacagcattaactaagcttactgccccatttttgacgctttcctttctggaaatcccataatattgtttgtttacttaatggtgtcccataagtcccacaggctgtcttaattctttttcattcttatttcatttttatcctctgactgggtaattttacatgatgtatcttcaagttcagatattctttcttctgattcacctagtctgctgttgaagctctatattgtattttttcatttcacttgttgaattcttcacctcttaatatttctgcttgtttcttttttatatccatctctttgctaaatttatcattcagataatgaattgttttctggatttcattaaattgtttatctgtactctcttgtatctcactgagtttccttaagatcatgattttgaattccctttctggaaatttgtagatttatttttccttggggtctgttgttggacagttactgtgttcctttggggtgtcatattttctttgtttctcatgttttttgtgtctccatgttgatgtctgaatcaggtctggaaattacttcttccaaattttactgagtggcttttgaagggaaagactttcacctgcagatgagtctaactgcgctgtttgggaagagtgtggtgactctggttctgagtaaatgcaatggtacagcctccagtgcagcttcttcaggtgcaattcacatcagtgatgactgtgggtgcctctgtggcctaggttgtagcagtttgtggtggcagtggtagcataggttattaagttccttcgtggcaagggctgttggggtcctcccattctcatttccttcaaaatagggatacttagcttaggggacctctcttggtgctggatctgacatggcatgcaagctgtgacatggcctacaatctgtagcagtgctgggttccagaatgcaggtgctcagaacagctgtagagccaaggtcctagactcagggtgtcaagaacctattgtggcacctgagtcttgggctgtagattccctctctgatgcagagttgaatgtagattcttcacagagccaaagtctctgactctaaggcaccccctggcagcttgggctcagaggaccaggttgtgtctatgacactgaaccctgaggaacagggcaacaactttggctcagttctggggaggaaagggagatttgggcccaaggagcaaggtgtagctgcaatttgtgtaccagagccaatagggctcagtggcaactcaggtctcagggaatgaggcactgtgtagtggtgactctgggccctaggatggtgggactgagcattatcccagactgtatgaagccaggtacaggaacagccaaggcatagaattgtggaacacaattgtggcttgggcccgggtggtagggagcagcacaataatgacttcactccctctcaggaggtgggtgtttctgcagcttagactctagggagataatacagctccagggaagctaagtactagaattgtttgaccttttgggtaaggtgtctcagctcagccactgctcttttcctgggaaataggcttccccagtagctcagccttgggatgtgtgactgcttgggttggccaaggcaccagttttctaagaggcaatgtgccacttcagcccaggctcaggggctatgacttctcagggtagccagggtattttccccagaggtacagtacagctttactcaggcacagggtagtgtgaatgctctttgcagccaaagcattgtttccccaggattcagggtaccacttcagctctagcaaaggggacagggcatagcagtgactgggaggggtacatggagcagctctgccaaggcactctttccccaggcagcactgtgcagctttacctctggccccaagggacagggcacagcagtgactgggaagggcataaagaggggctccacaaaggaatcatttttgcaagaggaagtatgcaatttcaactcagtcctgagggagcaggacaaagctgtgtctgggtggggagggtgggtgaagtacctctaaggctgcttgaccccatggatagggtgtagtaggagctggaggtttggctgggggatgtcaggccactgggccagggtagttcagcagtagctaagcctcaagggtagaagggtacaaaggccatacactgctacaacagaacacactccaacagtacttccaactctaagataatgtagaatagtagccacatgggctacagggaccagggggatggtgttggcttattctctcggggaggatagctatttgaacactaggaagggctctcagctcaccttagtgcctgaaaggactgcaggggtccccagtggttaggactgtaggcgtccaaggtgttaatgtgggctgatggtgtcctcttgcttaccatttccccacaagaagaagttccttctggttccaaactgaccctggcagggggatggggtggttgaggccaagtgttttattttattttatacatggctttcctttctctccagggtttctgatactcctttgatgtactccagtgctcttctttagttatttttattaaaacatagctgtttattcattgttttgactgtatttgtcaagggaacgaaagataagggcttctaatcaaccattttgctaatgtcacactctcttttccaggagtttttttatttcaagtcttatgtttaagtctttaattcattttgacttgatttttatgtatcgtgttaagataagggtccaattttttcttttgtatgtaaatatttagttttccagacactctttgttgaagacattatttttccacctttgtatagtctcggcactcttgttgaagatcatttgactatatatgcataagtctatttcaaccttccctattctgatccattgttctatatgtctgtctttatgccagtaccacactgattagattactttaacattgtaatatgatttgaaaccaggaattgtaaagcctccagcttttttgttctttctcaagacatatatatatatatatttttttgctagtctgtctgtttccattgtggttcctgatgagttttaagattttcttttttttttttttttgagatggagtcttgctctgtcaaccaggctggagtgcagtggcgcgatctcggctcactgcaagctccgcctcccgggttcacgccattctcctgcctcaggctcccgagcagctgggactccaggcacctgtcaccacgcccagctattgtttttgtatttttttttttttttgtatttttagtagagatggggttttactgtgttagccaggatggtctgaatctcctgacctcgtgatccgcctctcttagcctcccaaagtgctgggattacagatgtgagccaccgctccgggcacacttttttgtttttgtttttgttgttgttgttgttgttttgtatttctgaaaaaaatgccaagggattttcataggaattgtgaaccaaataagaaggaaccaaacacataacaagagtccttcatgttatatctttcatgaatacataagcccggacatcacttaatgcttggaagagtgagatttttaggaaaaatattctttagcgggattttactttatttctgcagatttttctcctcctttatacctgacatgggaaaagattttggcgaccatcatttagtatccatgctctctctcaacactcagaaatctatagctatcttttaaatgtagattaaagctttccaacattgacatatgaaaattaaaaaagcaaaacttataaggaccaattctgattggtttgttaaaagcctaagggccatcagctttttatctgttattaatttattgtttctcctacccttagagtacctctggtcacttttactgcttctacttctccacaccacgtcctactcctaaatttgtgctataaaatctgctacattctttaaatattatattctatagtagttctactctggaaacattgttttattacctaatgaattcttctaggaactaaccagctaatccttttataataaccttatctgaagcagttatactaactgcatgatgcaaacattttcttgctgctttttaacaaagccagattcttattttttgacaaagtctaagcaaatgtaaacatacattcaaaaatattaatagaaatctacttcacacataatcttaaatgagagattattaagaatcaaatatttcacttgaattttgctaaaaataacaaatagtgtaaaggcatactgtaatattttttctgttctgcaaaatttgagttgccatacaaagatgattagattctgtccacataggactggaaggtgacatatttgaaacagagaaacagaaaagttcaagtttggagagaatcaaacccatagtttattacagtggaaattgtgcagataaattactcttcaaaattgtttttttttaaggaaaaaatacaatatcaatacaaacttactgtatagttcactggcccaaaataaagcacttgctgaggaaaattaacaagctatacttgaatccatcccatatttattaactgatgttagtctgtgaaatacttcatcttaccattatgtaatgtgagtataataacattgcagaaaggatgttttcattaaaaacatgtggttatcttcaactgaagtagattacatgcaaggaaagttctatgtgctttattatattagtacaagtaaggttatatcaaaaaagtaatacataatgaaaaattttaattggatctactgcttttcaaatattcattttttaatcaatttgctttaactaataggctaccgtgataagctgctattctgctcatcacaaggagttagagtcctaattatttaaataaacagaaggaagaaaggaaggaaattaattttgacaaaggacctgaataatccataaaccagatgcctttaggtatgaaattataaaagttttattaatcctttagtgtaagttatatttttatttgtgtgggttgatttttctcacattcacttttttatagttgctttattattatgtaaattaatttttatgtttgaaaaaatacaatatttaaatatttataaacaggtacctattataaaatctataaacatattagcaatttgctatataaaatatttcttttactcagaaaaaaatattaatccttaatttttagatcaaatgtattaaaagcaattcagcaataactagaggaaaacattcaacttcagtgcctgaaaagattcatattcagttcttgtaaattgttgttttccagctattgaaatattttgaattttatatttacaggaacattagaactattaaatataaaacattaaggactaagtttaatagcattttgtgtaaatgtgaaaaattatgtaggcttggtacttgatttattaagatttcatttaaaacagctcatgttcattcgtctgaatacttattactgaacagatttcttggatcacgagttctctgtctacatttatgcattttacacaagctgttggctttgaacactaggaaatgtttataaaaaactaacaaaaataattatagttttaatgtcactgcatttttatttgaagttgactggatgatgttgaatagctctaagttttataaacgtactttttatcttttcaaaattaatattaacaaaataaatttaatctcagtgaaatgatttataaagttttatactattttatttatttaaaggctcctgaaattcattctgaatgtatcggcagaataaatacaattatatatgattattttcattgactttagaaagcaacagaataattattccttgcacattttaaatatgctacagacttcagacatatgttttaaataatcatcagtattatcattgtcaaaattaacttccttattattatcatcattttttctatcacctttgccacaattatgactgtggtagtagctattgcacattttagaccatataacaaaaaaattaatttcttcctaacacaattatgtatcatggctaatagctgttatgatgttgatgttctttatatatacacatatatatgcattgttaatagtgtatgtacatactctttaaaaatacaaaaggaaatttctgctcaaatacataaaatgtactgtcctatgttctttatatgcagatataaattacatgtccctaacttcagccacttcccgcttaatttctagcagggaagatatggtgttagaaagatttgtagttgtagctctttgattttctttagttaaatagttagatttttatttaaagtgtgagttaagcattttcatgtattaaagtgggaataaggggaggagagtttgaatataggagagaagaaaatgacaaggaaaaatcttgtagaatacaggaaggaataaagttcatagaagagaaactggtctaagtctgaaaagtacctgcctcccgaggagacttaatattggagtaataggaataaattaataaactgataagataattgagggagagcataatcagtatacaagggcaaaaaattgatgactttctatgtcatggtctttattttcttagtgaaaacgaagtaagatcagctctggatacctcctaactcttcccctccttctcctgatgagggagaagtggaggcccaaggaaaatgagcaagttttgtaacaacacgaatggggaaggatgggaaagagaacagaatcggtggaggtaaaaggtctagaaacttcactaaagacattgtacattaaaccttgatcttccattgtatccctgttaattgaaaattgaatttatgcaggaaaagtattctttttttaacttctatttttaagttcaggggtacatgtgcaggttcgttatataggtaaactcgtgtaatgggggtttgtggtgcagagtattttgtcacctaggtgttaagtctagtccccattagttatcaggaaatgtattcttaacctgtcatttgaatatgtcagagtttatagtatccaggttgccttacctacagggctaaatgatatttcttatttccaggatgtatgagaaggggaaaaagtaaaggaaggtgcaggaaattcagtaaagtacattttgagggcttcaatgaaataacttagaaatttgtctaagtttgtcacatattctggaatctgacatttgctgtgtcttaaggccagtactgtcttcgtattaacattatggtttttaaattgtgtgtgtgtgtgtgtgtgtgtgtgtgtgtataaatttttttaagagtctcactctgtcaccctaggctgaataacaatcatagctcactgtagtcttggattcctgtgttcaagcaatcctcttgcctcagcttccggagtggtatttaataatcttttctaggaacatttgattattatggtgatttgattctgaatgtggatggaaaggagatgaaataattcatcttatttagaaagtctccagtatattaaacatatagaactatcaaatgattgtgtttttttctctgggaaatctcactcatgagcatgttttttgtttcaaattaatacttcgcacaattctttcatctatttatttagctcagtactctaccacaagcttcagacttgcttttctcactcaaagcatagctttccaaaacaaaactacactttctctagtatttcttttcttaataaatggtaccactgaagctagaaagccattgccctccgtcttttcttaccctgctttgaatcaactatcaaatcgggttgaatttatctccaaatatgtaggttttcttcatctctcatttgtactactaagcttcctgaattatctctttatctgcaatctggattatgacttcaagttaccataatccaacttccttagcaggcagagtcatcttagctaaaatttatatttggccatattattccctagtttatagtccttaattgctttctacaacccttagggtaacataacttttcttaacatggttatcaaacactgcataatgtggcatctgcttaccctttggttttatttcttgtgacgcttctagtatgctaagctcttgctctactgatgtgtaaattcaataccaatgtttcagacacctgagtcctttctcatgctgaaccccctctgcttgatatattacttcctaatctttattttcacctacctggaccaacccttactttttcgataaatttaagtgttgtaaattcaaatgttacttccatcagaaggtctccttgactgctgatgttgttggatgtcccactttgcattcttacagagtactgtacttcccctatgactttgctaatcaaatattattgtgataatgtcctatttaattcactatttcttctatactgctctgtatgagaggacagatcaagtataccaccttcatctctatcatttattgctatgcctgacaatgtctctcaataagtggtcattaaatgaatgtctagaatgctgtgaattcaaatataataagataatagatatttttatttttactatttcagatttcaattttttctcggtgtgctgtttcaagatacttccttttaatattctcatttttagaacaagttattttcttatgcctctataaacaaatatatttataaattaatttataaaatcaattttggactgtctctctcatttaaaatattccacactgggctactttcaaatttcaaatcttatatccatgggttctatgtaaagctatttagaatttacttttgctaatttttcattacagaagacatcatcatgacttattgattctaaaaacacgaattattttagcttactgcttgagttttttattaatttaataataaatttggaattttatttgatattgagagcatagtaaacaacattatcaactttgtgcttgtttttcaaaatccatatgatgatttataagacaaataaggtaaaacctgtgcttccagttatgtttaataatgcacactcccagcttttcttccctttcataagcagatttgtatctgttgcttactgctggagacaggaatcaataatgatgaataacaatgtatgtaattcactcagaagaggcatattacatggactttagaagcgaattacatgaaaatcccccctgaaatgccacaggagtcattgataaatgggatccttagagcacaatatatgccagactggctttagacagcataatggttttgcccataagtaaataagtaaatctttgtcatcacacattgctatttctttttagacttgctcttcagttatgggcaactgtgtacaaatatgctatattaatttaatagccattaaagaagaaagaacgtatatactttcaaactgatgatatgtgtcaaaaatagaaattgtcatgaactttaattaaatgagagttaatcagagctcccatttattgagagtaagaattataatatacctaaaatttcttgggggaaaacaatgaataaaaatagccaagacaaaaaattaatagaaaagcttcactttgaaaataaatatgtacttaagatggaattttttctgtacttagagttcaaatttaaatgttcatgtaaaactgaagtgatataacctcaatgtcatagatgttgctacagacccacatcccttgcaaagatatgtacacttatttcttgaatgatatgttgccctttggtaagtattctctaattatcgacatgtgactttaataaacattgtgccagtctttaaaagtacataccttggccgggtgcggtggctcacacctgtcatcccagcactttgggaggccaaggcgggtggatcacgaggtcaggagattgaaaccatcctggctaacacagtgaaaccccgtctctactaaaaatacaaaaaattagccgggtgtggtggcgggtgcctgtagtcccagttactcgggaggctgagtcaggagaatggcgtgaacccagaaggcggggcttgcagtgagccgagatcgcgccactgcactccagcctgggtgacagagcgagactccgtctcaaaaaaaaaaaagtacataccttgacaacttataagaacaagaaataagagcaaggaaatattagaaaatctgtaatttgtgtatatatacaaaatatacttcatcttatgcttatttcccaacttggcattagaaataagtatccaaggtacttctgttttctctgttttgtcttgttttttctacttggaaactaatactcaaagaccttgagccttatttaaaggcgatctacttactatacactatatctaatggaaaggttaaaacatttgtgatgataaataacccaagctactagctacattcctttaaatcgttaagaaaacgagatacttcaaagttagtgtcttaaagaaaggttttttacaggtaactcccttccattatgagattatgccaacttatttttgaaattaaatccctatatagatacaaggaaaaattggaaaggttggattttaatatcataaagaaattttaaaatttctcattgtttatttacataaatctgtttgactattttcttttagtctctttcttccttcctttcttcttcaatgacttctaagtcagtattagaaggaaagggagatattgtgccaagagtctgaaatgatactttccatgagataatatatatgataaaaaacaagaactattgctgcagattgtttttatgcaaaaaaaattagaaatgacagactttgtaaaaaatacagacactgactttagatgatttatttaaaccataaatatttcaaactgatctttagatatcaactttgatttaaaaatagtttttttaatttgcaatgacaaagtgtaaatttgcaatctaatcttcagtgcatatatttttataaaacaagatgagtcaaagtataattatttttcaatttttattcaaaaacattgttttgtgtctttttcaatagaaatattttatgattttccattaacttaggctgaaccattcagttactcaacacttatgtattgaccatctactatgtcccagaaactgtaaaagacataggaacaaatgatgtacagtaaatttcctgtaaaccattaaccacgaattaatcatacagcatcacaactggcaggaacagtgacaacattctaaaagggaaacttgaaagcaaagcacactttttttaaaaaagaattaagatgaattattaattcagtttcagttaatatgtgtacatatctatatgcataaacaaatatatagactgaaatacaacatatataggtatggtatatttcaaatgattaaatttttctaaaccttgtaattgtgaatattctcaaaatcagtttatattgaaactttttttttattatactttatgttttagggtacacgtgcacaatgtgcaggttagttacatatgtatacatgtgccatgttggtgtgctacacccattaactcgtcatttaacattaggtatatctcctaatgctatccctcccccctccccccaccccacaccaggccctggtgtgtgatgttccccttcctgtgtccatgttttctcattgttcaattcccacctatgagtgagaacatgcggtgtttggtttttttgtccttgtgatagtttgctgagaatgatggtttccagcttcatccatgtccctacaaaagacatgaactcatcattttttatggctgcagagtattccatggtgtatggtgtatatgtgccacattttcttaatccagtctaccattgttggacatttgggttggttccaagtctttgctattgtgaatagtgccgcagtaaacatacatgtgcatgtgtctttatagcagcatgatttataatcctttgggtatatacccagtaatgggattgctaggtcaaatggtatttctagttctagatccctgaggaatcgccacactgacttccacaatggttgaactagtttacagtcccaccaacagcgtaaaagtgttcttatttctccacatcctctccagcacctgttgtttcctgactttttaatgatcgccattctaactggtgtgaaatgatatctcattatggttttgatttgcatttctctgatggccagtgatgatgagcattttttcacgtgtcttttggctgcataaatgtcttcttttaagaagtgtctgttcatatccttcacccactttttgatggggttgtttatttttttcttgtaaatttgtttgagttcattgtagattctggatgttagccctttgtcagatgagtagattgcaaaaattttctcccattctgtaggttgcctattcactctgatggtagtttcttttgctgtgcagaagctctttagtttaattagatcccatttgtcaattttggcttttgttgccattgcttttggttcaaagagaataaaatacctaggaatccaacttacaagggacgtgaaggacctcttcaaggagaactacaaaccactgctcaaagaaataaaggagaatacaaacaaatggaagagcattccatgctcatgggtaggaagaatcaatatcgtgaaaatggccatactgcccaaggtaatttatagattcaatgccatccccatcaagctaccaatgactttcttcacagaattggaaaaaactactctaaagttcatatggaaccaaaaaagagcccgcattgccaagtcaatcctaagccaaaagaacaaagctggagacatcacgctacctgacttcaaactatactacaaggctacagtaaccaaaacaggatggtactggtaccaaaacagagatatagatcaatgggacagaacagagccctcagaaataatgccacatatctacaaccatctgatctttgacaaacctgacaaaaacaagcaatggggaaaggattccctgtttaataaatggtgctgggaaaactggctagtcatatgcagaaagctgaaactggatcccttccttacaccttataccaaaattaattcaagttggattaaaagacttaaatgttagacctaaaaccataaaaaccctagaagaaaacctaggcaataccattcaggacataggcatgggcaaggacttcatgtctgaaacaccaaaagcaatggcaacaaaagccaaaattgacaaatatattgaaacatttaatgccatgtttctcagagtgtgacccacaaaatgttgctgatacaaaatgatataagtattttcttagctatctttcttctttttaaaacagaacagctgaaactgggtaatttataagagacaaaattcatttattatatttctggtgtctgggaagtccaaagtcaagggggtgcatctggtgagagctgaaggcagcacagtgtatcccatggcaaggagactgacagtgctaacatgctagctcaggtctctcttcctcttataaagccacgagttcccttcccgtgataacccattaatccattcatgagggcagagcctttatgatccaatcagctcttaaaccccccacctctcaatactgctacattagagattaagtttcaacatgagttttcaaggggacattaaaaccataccaagtttagaaactgaaagtaaggtgtttacaaacttttacaaaaatttaataaaatccttttatgtctgttgaagctaataacaaaaacagaaaactattctgtatgtttttgcttttaaattttatttctagaatttgtttgtattgtgtttaccaaaaaatggtttgtaatacatttattttttttaaattctgagaaaaactgagtttttaaaaagttttaaatgtgaattctaatgagaaattaaaggagattttgccttttattagtagaactctgtaaaatctgtgaatactaaaatccttcattaactggtgccaacatttttccaaaggagtttctaattcttaaatattgttcagtggattgagataatcaatcttaatcaacagtaaaaagaaaataaagtactgatttatttcagttctctaattcaaaataggattaatatatgcaaattttgttcaataagagttttatctcttatttctatttatatttataggaatgatgcaaacttgtagacattttaatatatatgagatagtccatgaagactttcagaaataagcaggtatgactttaaaaaattgaaggttatgtgagttgatgagagacaggtagaagaatatagcttcttcaactattagtatattatatacatattagtaattctcttttatttaaatgaccttacaatcatataaaaaagctcatgttaaaagagcactattgtatttttatttgtctgtgcagtgtttacaaaggagtctgtcctgttcaatgtgtttaagagtgaataattttgtttaaggtgaaatgttgctatccagctgttacagctttttacaaagcctttgtaggagcatgtgcattctgaagattgtaaagatttatcgaatagactcaaatatttttcagaatatatttgtctcttgtaatttctatttttttatggtgtccagcctgggagtttaaaaaatggaaagataggataatagttttaaaagcagtaaatattcttccagctgtctctaatcaattcacatacctccaattctttaaagtcacactttcttatttctaaaaagcttcagggactatcttatatattcttagaaatacatattgaatttttcattttcacttcattcattctttctccagtttctgtgctggcacttttagatgatgtgctggcacttttagatgatgttatatgctggggcttcaggaaccctgggaattcagaaatgcctgtgaaggtgtatttttgtttcactgttgttgccactactataactgataacagtagcaaatcctgtggatactacctgaagtcattttgtggcaaagctgaaccccctgaaacttctctaatcagtaagaactagaacactgtgccaaggacagcaggatgttttgcagagagaaatacccactgcactgagctaagaagggagaaatcctttctctgtgccacactgttgcagtggaacccaaattgtgttttctgttcctggtaggtaatcatgtgtattaaagaatcttattctgtttttaattttactctgtataggggtgtgtgtatgtgtgtgtttggttttgattttgtctgcttgtttatttttaattcacaagctttcattttcctgggaacacagcctaaactcactgaggattgggctagatgaagagggatgaacaatctgaataacaaacacaagacagccttttgctggggcagtttcagtgcactgtgcttgtgctttgactttccactggtttacttgttagtatcctgtaaattgaccatggaaggctaaacacattctgcatcttagggtgttcacacattaggtacaagatgaaattgttacacatgcaagcatttcttggaatatcatttgctaaaaggaacatgcatgacacctaaaacttgcttttatgctttacactgcagacatataaattatagatgataataaactttgccattgttccttttctctcctgtttctctgtagttgtcctttttctcctatgtccattgtttaggtctcctattatggtttctcctcactgaagaataataaagtaatcagacgtatttggccttaataaattgaagcgctaaaggagctggaattgaaaaatcatgttttaaatcattccttgaagttaactttactgtttttctaagtgtcagtgaattttcaacatttcatgaaactctattctcttgttgtctagtaatattcatggtcttatgattccatcattataccaaactactttgaaatatgtgactagaaacacattttaaatcatgagatgttccaaatccatgaggacttttttcttggaggtaagaaaataaaatctttggttttctatacacgggatagcaagttgaactgatctgattattcttcaattaaacttcattaggtaccattttagcacttattctgtaagtacttttgagttaatagcttagtgtaaagtgtaaaaggctattaagcagatttaaacagttttgtttaaaggaagaagccatgtttttgcatcccattagctgaaaggtattaataaaaggtatggcttattaggcagtgaagataaaaactggatgcatttacgtaaatgggaaagctccaggcttggcatgaagcctgtagacaaattacagttttaaattcaatgtaaaattttctattattttaaaaataatttttaaaacaaaaatttttaaacagaattatgaataagagcagattattttctcttcatgttattgctagaagggtagtgtttaaacaagtgttattagtaactacccatgtagaactgggcaagatcaaagagggctgccaggtaaaatggaggatgctccaagttaagttttaatttcagataaacaaataatattttaatataactatgtcccatagaagatagttatactgaaaatatccattggttgtctacaattctaatttagtcaccacatcttccatttttatttactagacacataatcctaaaattaggaataagggagataatcacataagtaatgactaatgaaccttgttagttaacttagttaattgggtttttttttacttttttcattaagaaaattgcaattattttcaagatatcataacaggtcgtgcatatgcagaataaaatgcatgttaaatgtctttgtgctctagtttttccatcaataaagacagtatatatgtttcaaaagactacttttatatctatactgatgaagtgaaatgtctttttggggcacagtaaatataatttgggctacctgtcattctcacagccctatttttaccctgaaggtgagataagcttcggtagcaatgttgtggcatttataactctccttcccactccaaacacagcattctcatttagccacagctggtggatcagggtttacttctaattttagtgaggcatattgcctttggagtttgctattgtattagaaggaaccaggccctgttttctttagtgattggacctgtgtttagtcctggaaagagtcaatatacatgtcaaaccacatacaagccaaattgtgcagagggagaaacaactatattgtcagaaatagcttgaatacattctgtccgttataactctgttgcaatgtcattctgctgaatatattctaatcattgtaattgcatccattatagttaggacatggaaaagaaaaaagaagagggggtaagagaaactacaatatgtataaattcagcaacaacacactaatgatgtattagagtaaactttataattgaacatacttgtatttgtcatagctaaaaccttcaacttctgtacttgtatatccaaaatttatatgtagtatgttttatgtacatataaaaatatagatacgtatttatgttaagatatacaatgtatatctacaataatcttgtatttaaaaaattaacatttcatatacttatcagaatggagtgctcttctcatccattatttagaaataaaatatactgcccttatatattggcattctaagttggctagagtttggagctgatgagatcaaatcatatgttcatgtgtttattaacctttgaaatgatcaagtttaaggggggaatattgctgaattagcatgttttactactggtgcaaaataactcaaaggacacatcttactgccgttagaccagttactatttgctaacaaaagagagagtaattttattatctgtggacattgatatgtaatacttaccaagcatgccaataaataatgttttgaatgaaatagagcatgacataatgaatattagcaatacaatttttattgagtcaaataatgctccactaatgaacaaaagtaatctacttgtttctttagagcttgttaacagttccttgattattcatgtgtccagaaaaaaaaaaattaatgctcgaagccctaaacctggtgaatataataagcatgactccccatggatctgaaaaaattaaattgttggtttgagacagatgcagtcataaccagagggaatgcttttgcatccacattacaatgtagcagaaacataatttagaagctttaatacatattaatactttgttcaagacaattataagcttcagcaaataaaaagtaaagatacaggagaagaatgaagttactttgaactaaaatctcctctaaagacagtcgtagtcgtacagtaattccaccattaattttagtatatgaactaaagctagaataaaattatatgtaaatgcattgaataaattcaaaacaagctcaggaaaaagagtatagagtgatcctcttcatagaaatcaaatgaaatgactgtgaatctgctagtcatagttatctgagtttttttctcattaaatagattcatatttctgctctcaaaagtaattatttccttggaatctgtttgatacataatagtaattctaatgcagtacttatcgttcggtttttttttttacataaaaatacatgaacgtgtaaaagatactttgttgatgaaattatatactcgaggcaaaactatgctacaagagaatcatttcaaaacaagtaagcacatgttaaatgctagatactagaaataatctacccaaatactttttgaaaagcagggggaatgagatctccattcagtgaatttactacatgctttctctatgctggtagtgtgttctaagggccttataacaaccatgaaagttatcctcattttaaaaacgggtgtgtccatgacctgcctaagtcttgtcatgatttgggattacatgacctgtttttcaaagtcatagaagaactaataattataaaggtcagagttagaacatcccagcctgctccttaatagttgtacattcttaagtaggttacctaatttatatttgcctcagtttttcattctgtaaagtaaaaataataattatgtctacatcaatgagctgttctggtgattaaatcaattaatatatatataaagcatttagaacagtactgtaagttctatttaaatggataagtctctagatccatgtttgttttaccacactgcaaaagcatgggcattaaattcacactgctaacaatgtacaaaatgtaccactaaaatattgtagctttatattgattgattcattgccttctgcaatatttactgtatttttgaacttgatatttcttatctattaatcattaattaaaaataataaaaacaagtcataaagggtataataattgttattatggtacaatcattattactgctacctgttttttcacataaaatgtaagccattaattgttgtaagcaacccaccagagaacacatagaaaattgcagaattgggaattacagtttatgaaatttttttttaaaaagccagaaaaccacattatcaatataatagggaaaaccaaagatgaaaaatgtaaattggttgaagaagttaatcgagatgccaacattgtccaaatgaacactggcgatgatggaaatattccatatttactgtattcaatataaaaactacaagcacacatagctattgagcacttgaaatgtgaatattgtgactaagggattgcattttgagtcttattctgttttaatttaaatctaactaactacctgtggctattggacagcacagctctggacagacagtaaaagagagctgatgccggcctggaggatgagagagctgtggaggcaggactcatgagagagggtctttggtcattcatttctgtggaaaataagtgaccttttcaatctatgatgaaaaagggaacaggagtttggtaaactaaaactaagaagaatttgcagaggtttcaaacaaattggttttgggccatattgggtccattgtacaatgcaaaaatgtatatagaaacctcaatttctagtttctctgattaaaaaaaaagaaccaaatggagcaaattaattcatctcttttttttcatctgtaaatccaaaagctgtgtgaaaagctgtataaattaaatttaaattaatattccattctgaaagtctactttagggtttatgatcacacattactctgttagacctcttttggtatctggttagtcacagtttttagagcagtggtctaataccttcatggtcacaccttctgtcttcagaaagttcatttagtttcagactgttagccagacatcttacaaatatttcccattgcttacagggaaaatgagaagcaaaagcatatttctatgtgaaagtgtttttgttttgggaaaagtgaagttgcggatatttttcactgtggctcattatatgatgttcacgtttaggcagtatacaaaataagtcggactattacagatgtcactgcctggatgagcttgattttgatataaaacctgtaattaatttttcacataattgttcatagccttaagcttacaaatttattaggttatcttgggataaagtcttcttctgatacaatgcctggaatactccctttgtcctacatggatgagtgctttactcctaaatagtactttatgatctgggtctactgtagcacaaggaaacacatgtttgaaaataaacatttagttaatgaatggattttattttcaaggtgtttattccctctggtgactgatatataacaaggacttacaaatgcttattcaataaaagctccctaaaacttagacataatgtttgcaataagcatagtaaatagcaaacctttcatataaaaatcgtctaagtttcactttggtttgactatatttttctgtggggcgcttaaaaatgtagatccattgaagtcttttaggccacttctctcttatggataatttcagcactatttttttcttcagaattacctggttttctgagaattaaattttcttttgcagttacataaattctgtaaggatttacaataccacagattgtttatagcagtattttgtaaatgactacattataacatagagatattttggtagtatataatatcaaataaatgaatcattaaaacatatgtctgctgtaaaaatttatctttcaccacaaattcattcatgtgtcatatagacattttttcctaatatttcctaatgttttttaatcttgattaatgttgcattctaagtaacagtgattacttctgagtcataaatattttaaaagctattttgtcacttcaaccagctctgacttcatactcccaccttaatgcactatattctagaacagtatttgttaaagaacaattgtctagaaaggaaaacaaaaatgtgcttttttgcataactttacatattgttttaataatatacttccattagttctcttgcctttatattacttacatgttatacatttcttcaaataattttactgtgggggcgaatatgttaacatgcattttttggtatcaacagcatttttgatgaatcagataatcctagaataatgtctaacccatctacattttatcatgctagaataaataattcaaggaaaattgaagcatcatttgtactctcaatagcattctagtagtctaggaaaactaagtgaaaactacaaaaaaggagaaaaaggaaacgatgtacatcacagtgttacaatgcagcactagcaacgtgtacgattgcagaaaaaggacagatttatcctgactttgaaaagcaagaaataatttaagggcaagtggcattcttgtcagacttcaattaacaaataggattttgatagataggaaggaacactgaccaagaagttaagtagagtcaactgctgaatgtttaaagtaataactggatttgattgcaggaaatagggagatactgaagatttttactttatggggaatagggattatatttcttaattgttattaagagttgtagtttctaagactttaatatgcagcagaattgcctggaaggcattttaaaatatagattacttgggcccaaccccagagtttctgattcagtaagtcttgaatggggcctgagaatttgcttttctaactggtttccagatgatgccagtgtaggtagcttgggaccacacttggtgaactactgatctagagcaagacttctttggtagttccttccacctccccgggaatggtgtcaaataatatttagctttcattttttagcagttaacttgtattttgaaacactctgtgagagacgaacataggagaaaatacatacaaataaacaaaaaaaaaactttaattaagtaaatgagacaaattaaggtaatactggaaactgtaagtaatactattctacctgtatcagtcagggtcctggcacgaaatagaatacacacagatggtttaaataaagatattctcatgaagacattgttacagaaatatggacagagttggggcagctggaagccagtgacacccagcgggcacagtgtaatcagagcccatgtggagctggagtcatggagaggctgaccagtgaaaaggagctggaattttcttagagggatgcagtgactttcagagaagtattgcagcagggaaaaagggtagaaggaaatatcccacttctctcttcctttgcactccagtctcctgctgttgcctccttctgtctgaaaccagcctgaagtcagtgtatatgtgggtgagacagccagcagtgtggtcagtgtctgggggcacagataacttcttggaaagatgaagattgtaaaggatggacctcattctactttttatcttgttcattttaagccctgctcccagttttctactcacgctatcatgacctgtcatttctactctgtgccacaggatagcaacaggctaagcatctagcagcacggagatgagatgagcaatctgttgtaatagcttacttactacggactcagaagtgtctttaaagcttcttcatcagtaggtcaaagaacttcaaatatttctgctacagcagcaccgtaaggagaagtacttgtaactcaaaagtgctattaaaagcctgatgtttgctctaaatataaggaatataatgattgaccaattcaagctgcacagagacaatttgctttttttgagttgcctctaagtccctggtgatgttattgtataaataccaacaaggcaataagagctcaattgtcccaccatcaaagaggaagcaccctttggaattggttttaaataactgtaggtagttcagtgctataaataccagcactattttataaatctcagtcacaaacatgagattgcctttactgtctcaatcattttaggatctcttcctgtagtctctgcagaatttctgaagcaagagcagaggctgtattcattgcctggcaatagcagtgaatgatgtcttacattcaagatgataggaggatcctaaatgtcttcctagccttaagtcctatgacttttcagtatgcaccgtcagttcaggctaactaagtaaatcactttttacccaaaatgccacttgtttacttcacgctgcacttttgttcatgtaatttgtttcattgagactacctttttaaattgttaaaatatgtaaagcttcatctcaaatactaatctttccacaaatcctagcttgattcttccaatgagaagcttgaatatccagagcacaagttgttacttttaaaccactttacacatccttaattatatttaaaaataactaaaaatttcatacaccccccccaattgaagcactttttactatttattggagcgaattatggagaaatatttgtatgagccttggccatggaatatcagaatagctgtgtgtgtctataagttacttaatttagaatcatttatatcactctagtttcatctgtaaaatgattagtatctaacttacatcaagatgttgatgttcaaatgtataaaggatgaggaaaacaagttgaaaagcaggctaaaaatgttagttacaattccttattattttttgtgtcttttacatggtaggaaatcaaaaagtttgtattatattgaactaaattggaagtccacagaaatctatactgggattaaaaatccttaattcttttaattgcatgaaaaagagaggggagaaatagcttgacattttcttcatgatgacaaagcctgggcaaaacacatgtatgtgcatgcatttatgtatgtgaggcttgtttcaaaaagggttttttaaatgttttctataagtgtataagaaatatcaaggtatactaacataagactgaagtgatgggacacagtggtcaaagataaaataagaaatagaagtgagataaaataagaatttcaattaatatacttcaaatatgtcataagaatgtcatcatttgctagaatttgaccaaaagattagtattaaacattcatggaactgaaataaagctttatttcagatctaggatcccccaaaatattatgggagtcacatacaagaaagaaaagatgaattggtcatgagaaacacaaatatttctggaactgagtccagagaaaaaaaatcatcctttggtctctttaagaaaatgatgtatcttaatgtggtgaacagtgacattcttagagtaaatgcacagtgtagttgaatattttcctccataaaactgaagggcactgtgccaaagcacagctctgaaagcttatgccactggggattattatcgcggaaatctctgtggtgtggattgttgggatggaggggctacagggtacttctctttttatttacagatttcatattttaaaaaatttttacaatataaaacatggcttctatctttttttaaaaaaagctagcaccccacatcaaatcaaaacaaaaaagcaaagtagtaggtaattttgggttttctaaacagccaactcaatgtttatacttgatcttagccaaaaggctgagaagcgatccaactcaatgtttaattgtgggtttcatattttcaggtatagatcactgattcccaaactgctgattacaactcactcctaaaacgccacaaaataaggatttaataataaaaacatttcagaaatgcaacctttgtatgttttcttggtaattctcattgcagagacatcaccacttggctggctattctagtagttctggcacctgtaaactgtggtggtaaaaagtcatttgggagtttaactcacaggagtcggatgtgggcaggatgccccttctaaggggtatctgaaaatatgtttgtgtgaagcagatgcttcattgtcaaagattcaataatcactgatatttagtgagctgaggacagagatgctaaaagtgctacagtatatgagacaatttcaagaaacaaaagatccaactgcataagataccaaccttccctcattgaaaaacattgttcataacaaacttacttggcatgaaacagtattttgtaacattcttatttacataggaatgtaagtaagattgtttcaaaattaatttgatgattaattttgtgattatttcaaaattaatatttttctttaaatctataaattctaatgttcatctttctttttgatattctgctcaatatcttaaagatatattaaagtcaatgtgtccaaagtagaactccagactcctactccctgccaaactgctacttccccaaatcagaatattgtacattttggtaaatggaactaccagccattcatttgttcaagacagaaaccacgatcctaaatttgtgtcattccaccttcaaaatatagtagtctcattttatttcccaaactgtgaaaggtaaaaacctaaagtgagggtataatataaacataaaaccagaaatattaaaaatagatacatttttcctttaaaggaacagaaaaatgtcttagaatggaaataaaaaataaggagttagataaatggagatcaaaatttaaagaaatggagggtgaactatagtgggaaaataggtcaggtgcaatggctcatgcctgtgattccaacactttgagagacccaggcaggtgggtcagttgaggtcaggagttcgagaccagtctggccaacatggtgaaacccgtgtctactaaaaatacaaaaattagccaggggtggtggtggaggcctgtaatctcgctactcaggaggctcaggtgggagaatcacttgaacccgggaaggggagtttgcagtgactggagatcgtgtcactgcaccccagcctgggcaacagagtgagactctgtctcaaaaataaataaatgaataactaaatagttggaaaataaactgatgcctgaactgctagaatagccagacaagtggtggtgtctctgcattgtcttttcatactgctcttcccttctgtcccccaacacacaatctttgtgtctttctatctctgtcacacacacacacacacacacacacatacatacacacacacacacacacatagatgctccttagcttagagtcaggcttctggccccacctgggatctgtgaccctgaagaaaagtagcagatacaaggttgtctctggtgagcaggagtctctcagcaaagcctttcccctgtcctccttctctaagaaatctcagatgtagctggagcaaattcaacttttgggattggaggacaaagcaatctattttctgatagattgtatttatttttaattgtgttccactttaacctttgttttagcactaatcttttcttatcgagcaccttgttatagatatttctacttttccttcttctctctccttcctactttgtaattcccctcttattttaacctatttcaacatttctgtgatgttttttgtatttgccataaaaatgaaagaaagataactccacggagaaagatttgtgtgcatatttaaatatgtatctatatatcttttaatctattcatttattttttaaaaatatttgatggaaataattataatttatttaataaataactacagaatatctatatttagtaggaaaatggaaattttagaatgatacttttataatgaatcaatttttctgaaacatacatatgcatatacaacagacatatctctggatagtaaaaatatgaaaaattttttttcttaaactattctgtatacatatcatatttacaatgaatatacattgcttttgtaattaagagaccaaatgaatatatttcaatacttcagctcttaatttgtgggcctgacaactatatcatagagataacgtcaattgaaaggtaccctgtccacaagagtttctttaccagccaggcagagacccaaatgctagcattgacataacagaggaattaattgcttctgtgtacatgagcagtaagtactgactgtccttgttaaacatctgaagtttattgctggtgtaataaattttcattacatttcatttatagtaaagaaatattagtcaagtatgaaacattgctaatttgaatcctctataaatgaaagatgacacaatgtttcctaaagtgcttgaaaaaaatatataattaagtgaggggttcaaaaccctagctaatgttccttaaccaaggctacaaataaacaattagcaaaatattttaaaaatacaaagaaataaaaagattcatgtgaaaacagtaaaattcttaaaaatatacccttggtttcagaggtggttgaagtaatttattgtccccattaagttggatgaataaagaacaaaatattgtaaacaacaattaattttaatgacatgaagatgatcacggatcctggacttgatattccaatctaagtatttcttttaatcttggattagcacttgatttggttaaaacattgttggattacctcacataaagtaagacagattcattcttgcatatttcccccctttttattcaaagtttattgtataaattctatgttcttcactcaaatcatgatatgaaatgaaaatgtagatgacataggagtcatattttattaagggagtgaagggaaaggtagaatttaaatatcttgcagtggccagaaagaggacacagtaaaactacaagtagaactggccaaaaggcaaccctgaagaaatgttaggttgatcagtgaaccctaaacaggctaattttaagaatgtttgcagccttaaaaattatgattcttagtttcttttgagaatcatttacatattccttttttgaattttttatcttttaaaacagggtctcactctgcacccaggctggagtgcagtggcacaatcatagctcactgcagcctcaaccacttggctcaagcaatcctcccacctaagcctcctgagtatctgggactaaggcatgtgccaccatgtccaactttttctttctttctttctttctttttttttttatggagacagggtctcactatgttgcccaggctggtctcaaactcttgtgctcaagtgatcctcccacctctgcctcccaaagtgctgagattatagtcatgagccactgcacccagctcatttccatattctttaagcccaacatgggatcatgttctgtgaaaaagttatagtagtatacaacattgtgttttttttcttattatgtgttctggctgtctctccaataccagtaaattatggctatctttccaatatcagtaaattaagcctaccttgttctttctaatagctgtgtaatagataattgaatggaaatggtaaaattgtatttgactggtcccttatttttgacaatttaggttgttgccatttggctactatattttaaatgctgaaaaaatgtatgtgtgtttatatacatacatacacatatatatttataatgagtatatgtatgtatagatctaaaatgtgtatatatatgagtatctttctgtaaaaaattttttaatgtagaattatatatgtatatataatatccacgtatgtgatatatatacacacacacacatacacgtaacatatttgagcaattgtatctataaggacagttattaaaggtggaactactatgctgaagagtatgcatacttcaaaatttggaaaatatttacatattcaatttagtcacctctgtttgttgtcatgtgtagaaaggcctgctttactcccaaaattcaaagaaataaacaaaaaactctattctaatatttaatgactccaatttatatgtttgattctttgaagcaggttgaatttattagagacaaagcaataagggagtaatacagatttacagtgagaaaatcaaggcttaaatagctacatactactttctcatggtcatgagtctccagataccttttaaggtaacataaatgctgtgtctgagaatatcttaagcacaaatgacatatttttaaaaataatagccttaatattttccatgaaatttctatgttctagatattttggttgttcatttatcctggccctttaatttaaaaatgtgaaataattcataaaagaaactttatctttttggaattaatgatttttgagacatagataataaagtgatagccaaataataatattccttaaaggagacaaagataactgatgatttgactcaccagaaacagctaatatttttgtaccaaacactctatactgagtgtatattgtgggaaaggatattatcctaaatcatattgaaaatattggcagagtctagaatctaaagaaggaaaaggcatcctatgtagaagggagagtcatagataatgtttgagacatttgcacaaaagatgtgcaagccaggctgtgttgaggctcatcagtgggatgtttagagcagacaactgataggccagtccagtagaataaaataacccaagattttcaaacaggaaaccaaacatattcaggagaaactgatttactgtcctgggagaaacagataattcacagaaggacataaaacaaggaactcaggatggagccacattcctgagagttttcactgatagttttgccctttctacctgggagctcctaaaggtatttaaaagagatgagagacatatttttaaaaagctttatttggaggggaataaagtgttatcaatgaagttcaaatgtataaaagatgatgaaacttagcaaatggaaaaattgactgtgtttgttacaaatctttattattatttttagcatcttttacagggtaggaaataaaaagttgtattatattaactaaattggaaattcacagaaatctatattggaatttaaaattcttaattttaaaagactaaaaatgtagtatcaggtggactaggggagatgagggggaggaatcaggaaagcaatgggctttgttacacaatttttcttttgtgtggcaccatcagtcatgacataagtcccaggttctcatccctgacttagaaggtttttacacatatcatttgaattttatttaaagagctgattgatgctttgtctgtactgttctcccacacattatccattttggtcagtgacagttcaaccatcttagaaatggcaaattatgtaagaaaatctcctgtgttctagattactttttgtttttcctctatgagctagcattgctttgtgggttacattagagaaagaaactctgaaaaacattttctttatttccgatactttgttttaactatggaaaagacatgcatcacttggagataattagaagcaaagaatccccgtgactgtacaacagatccccaggtatggacaatgccattgcctgcagtatttgaatttgacatgacagctaccaggtgttacaggcttaccggttttcaaagtaaaagaaaaaaaaatgtaagcaccttcacaaatgaaacagaacagattttgccagcataaaatacctggcttacatttcaacaaagtcaattccagcccttttaactaaggcacaacaacctgtttcagtacacatgaattataatgctgccaaatcttctgtcctcagaaataactcacatgtgcttcaggtacttgaaaagcattgtggatttttgccaagctcctgaggatgcgcagacattgtttgactgatcgcaatgtcacatctgaggtccacttgttagttcttagtttatcagaaactaagcttttgaaactatccatggtcttccttttgatgtgttcattaagctttttagtcattcagttataaaatctaacctggaagaatgaacaagatattgtctcgtttttatggtggtttttgtttgtgatatggtttggctgtgtccccacccaaaatctcatcttgaattgtaatccccaaaaaccccatgtgccaagggacagaccaggtggaggtaattgaatcattggtgtggttttccccatgatgttcttgttatagcaagtgagttctcacgaggtctgttggctttataagtgtttggtagtgcatccagcgttcattcgccttcctgctgccttgtgaaggaggtgccttcattccccttctaccaggattgtaagtttcctgaggcctccccagccattcggagttgaactgtgagtcaattaaacctctttccttaataaattgcccagtctcgggcggttctttatagcagtatgaaaacagactaatatagtttgcttttacaaagtattttttaagggtaaaattaattgtatgtctccttatttagtttatcaaagtaggtctgtgcatacattaatgaaggtatacaggtaattctggtctttcactaatattcagtacataatcttccatctaaaatctgcttttttcttctgtgttgctacgttagtaaatgttcccattttctaactagttgttctgcaagaaacaggattctcaggaattttttgttgataatacaactttttaaaatttttatcaccaatagaagaatgaatttccagcagtcaggaatctaacacattacaggggggaaaaagtacgtgaaaagtggtagggggaaattaacaaatgatcttgaaaaatctatggcggctagcaaagtattcttgaaaacaaagatctctgcattccggtattttagggatcctcaaaaacaaaatgaaaaccaaaccatctggttttgcccaatcatcagaaagcaaaataatcttgcctacattcagccacccccataatattatacagagctctcaagtagctttctgtggcataatcattaaatgtgttttggagtatcatccactatttgagatcagaaagcaacatgaaaacaaaagcccaaagaaataactttaaaaacaccaaaacgaacaaagagaaaaaaacaaagaaaataaaaataataacttaaaaacaacttttagttagtatttatctaattacagtcctgatgataaggcattcactaaaaaaagaaatgttattatgaaaataatcatagaaaaataaaaaatatcttaaaaatcaataataaaactccccaaattattctttagaaggttgaaagtgaaaaactctcctcctagaaagaacaaaagagaaagaagcaattagagataatacaaattaagcagaatataatccagcagggtccatttcttatccctagaattgacagtgttcagattgataggcccaaccaaatgcacagtccacatacaaatatataattttaaatttgcagaaagtaaaacatatagagcgtccataagagggaaaaattattcacctgaaaaaaacaaggataacgctaactagcatcagccttcttttttttttttttttttttttttgaggcggagtcttgctgtgtctctggaggctggagtgcagtggtgtgatctcagctcactgcaacctccacttcccgggttcatgcgattctcctgcctcagcctcccgagtaactgggatcacaggcatgtgccaccatgcccagctaattttatttttagtagagacggggttttgccctgttggccaggttagtctcaaacccctgacctcaggtgatctgccctcctcagcttcccaaagtgctgggatgacagtcgtgagcaaccacgcctggctcagacttcttatggaaaagctggattcaagaagacagtggacaagatggttaaagttctggggaaatattataactaatctagaattctatacccatgtaaactatcaatgtgtgagtcaaataaagactttatacatacaaagacccaggtgtttacctccaacacatgtttactaaagaaaccactagtgaaatgaaggataaaacaaggaaaaagtgtgtggggtctgggcaaaaatgaaactatttggttatgcaattctatctaaggtaaaatcccagcacttgccttaaaaaccatctaattcataatggaggcagagacttctggaaaggaggactccgggaaagaaacatgaatgatagaattgctacaattcaaagatatacagagaaaataggtgaaagcatttgaaatctactttagaaatattattctttgaatagcatagtagtcatgacagtgcctacagaggaggaaatataatcctacagatttttggctttgcagcgcacaaaatgttcataattacacttatccaacttttataattcatgtatagacaaatcaataaagacttaactatgatttatcttgacctacatgatcctgcagtttctagccttcccttcatccagcctcattttgtgcagactgctccactatcccaatacattttaattcaggttggtctgtcaatttctcatacacatccatttcatccacatcagtttctcatatcctccatctcagggccttttacacaagtttttctatttgcctggaattactttacctcatctcccaacctactcccaatccctgtcagatttttcagataaacctgccctactttacctcaccaggttagatccacctgtacatctcatcaaagcacctgagacataataagtaatcaagaagtctttgttcatcatatgaataagtgctatttttcttgcatataattctccctgtccgaaatgcttgatatttctttattaaagagttcaacatttaatttataaacttgcctatgtgtcttgtctgttttgtaatctttagtatcttgctcagaaaagaacttattggctctacctcttgatctgtagcatgtattatattactctttattggacatgcctaggttgtaggcaggggagacagagggttgtatcttatacatataaacctagaacagtgccctatagctagaaaataaccagctctagtttttggtaaaatacctatgtgggtattcacactcatcttgaaattattttaccacttgtaaatgcagcagtcactgagccagatcctttttaacttctaagtctgtcaagtaaaattcttgaataaattttaaaaatttagttgttaaaatagatttattaatatgtgaaaatgttctcttgatttaatgttatatactttatgaaataaataaaaattcctttgtgttttatgtaatctcaagtgtcttagaaaagatttggcatatttttgtagattttatgcattttcacaattaggtttctgtttttacaatagagatattgcctgcatacacaattcttcattatcccttaacaataactagtgtttattcatataaaatatcaaattaaaacttcattattctgcagacatggagcacctggaaaaaaatctgcatgacataaaaataaaaacagataaaacattattattatggaaatatttggtgtatctctattccataatcctccatagtatctacaattataatgagattctttgatagatataattctttttaaaactcctataaagtagcttttaatatattgggtcttttcaatttgttttcattatatagttagacaagataaaaataatgcaaaatcttggggtataattttcacatgcatccgtgtgaagagaccaccaaacaggctttgtgtgagcaataaagctttttaatcacctgggtgcaggtgggctgagtcagaaaagagagtcagcaaagggagataggggtggggctgttttacaggatttgggtagataatggaaaattacagtcaaagggggttctctggccggcaggggcaggggtcacaaggtgctcaatgggggagcttctgagccaggagaaggaatttcacaaggtaatgtcatcagttaaggcaggaaccggccattttcacttattttgtgattcttcacttgcttcaggccatctggatgtatatgtgcaggcttgggctcagaggcctgacaataataaaaactgacacttgcaaatggatgagaagtctagctaaaattttttcaataactgtttgattatgtttaattacaattcaaacctaatgttgtcatcctttaatattcagctactatagtctataattaagatggaggtcttctaagtgtaacaattaatttttctatgtatgtatagtttttcatttttagaaaattcttacacttttctatggcttcataatactaagagctttcttttatttttagtaattatcagaagttaaattgaaaaattttaagttttaatcattcaaattgaactactttctgttttggagtttcttgaaacaccatttactttcttttttattgtttctttacttagatgataagattcaaatctaagtattgtgttcctgaactcacacaagaaaggtttctttctcattcacactatggatgaaccagatctctttcatattgtagttatgacaatggatatatagcttccaaagttgtgtgatacaagagggagaggataatatgttttttgttgttgttgttgttgttgttgttttgttttgggagctttttttttagatggagtcttgctctgtctccaggctggagtgcagtggcacgatctcggctcactacaacccgcacctcccaggttcaagcaattcccctgcctcagcctcccgagtagctgggactacagatgtaaacaaacatgcccagctaattttttgtattttagtagagacaggctttcagcatgttggccaagatggtctcgatctcctgatcatgtgatctaccctcctcagcctcccaaagtgctgggattacagggtgatatgtttttaactgtcaaggctaagagttgtttatatcatttacatcctaatttccactgactaaaactcagttacattccccccaaccccctcgcaacaaagtgcaaggaatgctgggaaatggggaaaagcagaggctttaacaatcttggggaccattaagaagtgagagttgcagtgagctgacttacttttcagttttataattctcacagtttgatatccaaagcatatatatatacacacacacacacatatatatatttctcaaaagcatatgtataacacatacatatatattcacctcagaatgatttccacttagcttctagctcaccattttcaatacctatttatttagatatgtatgtaaaaataaataatgtgaaaccctgaaaaataatgcttccatctctccatctctctaccacaataaagaagccatatatcttgactcagcttgatcaccacaacaaagttaatgcaaaatttatgacaaattacctattttccctcccactcactcctgactttctaccaattggattccatttctgattacttgcaattcttggctctggtttttgtatgtgattctactgctgctcctttataattagtattgtcatttagatttcagattacctctatgaacttgaatttgattcattactgacattatgggtgagatttcagtttttgatggaaagtcactagttcttattctcagaggccattttcagacgtagcaggtgtccagtgaaagaggtatttaggcatattttgaggaagcaaccaaattctttttaagccatatataaatattcgccagaaaataagttcaaatcctcaagaatcttaaagtttcttaaagtaatgtatgattttttcttttcaattaatctaaatcatacttttagcaataaacatgtatgtgttaatttttattaataaatggtaagctcttattctggttctttgagtataaatttattgtcgtataaactcctatctcaaaaaaagtccttacaagtaaaaattctattattcactcaccccaactgaaaaatcactcatataatactttattaatgatataatgccaaatactgtgtagctatttaagaggtttcattatatttcatgaatattaatttccttccaaataattaaggtaactgccagaattacttagcaagatagatggcagtgactatactattttatgtatgaaatagacatcatataagatttatatatagttatatatacacacatatatttacacataaataaaatatcaataacaactaaacaaatttccttcccttcatttttttcctctgacatttaaaaatatatttttcttctttactttttgttcctcaatttgctataatttttaaaaaacccttccaatttagtgaaagagacagtattcaatttttaaataatgtgtttttgtttataaaagtgtttcaaaacggggacttcaaatatggtaattgcacctgaaatatgatttgtattatctgatggtagagaatctatattcccatggacaggctacaataagagagaaggtttataataaatttcatacatacaatgtacattatttaataatctgatatccttctgcagagtatgattatacacactccttcactcatgatcggcatatggcttccagaaaccctactcatgatgaaatctttctgtgtttctacaattaactggcagttcaaaataaaatcatctgtgaaataagcttacattggtagagaagcaaattttcatagttatccattccaaactctctgaatgaatctcaagtacacactgcattacagtcattgaaagatcaaataatgggcttccttatgattctctgcgagttcatcccatgcttaatgatccattattggcataacaagggattagataaaaactattaatgataagactctaatattaaactaaagtctgggatacttaaggcttttaacatacttacaggatgattttaaaagactaacaattgaccttaggtgcacacaacagtaaagacatgaacaccataattgtttttcttcatattaactaggggtgactgtaattaatatttatccatttaataaacttttaaatgagaaggccaacaaaataagcaatgaagatatgttttgtttattctagggtattagtcagttttcacaatttaaccatgaatttttacaatgataataaatagaggtagtacagaaattggatctcggaataataatgcaactagttgtatcagttcaatgcacctatttgaatcctttacatgtcacatgcttgtgaatttttgccaatgatgaagccaaaaattaatttactgagtgtcacacaacaaatggtgatatcaggaattcagccatggccattcaagtccagagcctcaatttagttgaagctagtggagaaacagggcaacaaatatgaaaaggaagatttttccattttcaaaaacacgtttggtggtcattcttattttttgtttattatttttaactgagtgaagagctaaacaaaataaagataatctcaaaactgaggcagatacataaactggtgagagaacagtaatcaaattgtgtcattctttgtgggaaaatctaaatgtaatcacatctctgcacaaatgacccaaagaactcaggaactagcactgaatcattgcaatgagaaatgcctactctgggtagatgattaacaagtatcaattttatgcaattttatgaaatacttcttttaaagaggcagcattacttcatttgtaattttagaaagattttccaattttacatttctatcataacttgatcatctttgacgggtagaacacagaatcagttatcagaagtctcgggcactggcccaggctactacttatttgttccttgaccctaatcagaatagttacttctctaaacttcaatattttccttccactgtgaaattaggcttttatcttctgctttccctacctcatggggttgttttcacaatcagttagagtatttcatatatacacatttgtgaataaatatacatatttaggattgtatgtatacaattgaaaattaaaaatgcatacactaggccaggagtggtggctccagcctgtagtctcagcactttgggaggctgaggtgggcggatcacctgaggtcaggagttcgaagtcagcctggccaatctggtgaaaccctgtctctattaaaaatacaaaaatgaaccgggcatggtggcagatgcctgtaatccccgctacttgggaggctggggcaggagactctcttgaacctgagaggcacaggttgcagtgagcagagattgcgccactgcactccattctgggtgatagagtgagactctgtctcaaaaaaaaaaaaaatgcatagactaaaccatttaataagctttctttgtgtaaatggtttaactccatttaaaatagtacttacactgaaataatgcctttccgtgtcacaaatccattgtattgataacataaattttgtatttatgcaaattaagataacaaaggaacaaagaccctgcttagcaaagtcactctgccaatgtaattagctttgtcttgtttcaactagtcgagcaggagcagttgcttcctttggaaggaagcctgaagaactatcatagaaatttagaatagaagacaaagcatcagaggccagtccagataacactgtatcttgtgatttatcttcccagtctctattaattcccttttggtgtcatagcacagatgactgttactctcttctttcaagtttctttgcctaattttgaatagctatctcgttgaaaacagacaagaaatttggaataccctctgtattattctcattttattcccttcttataatattttcaaacaggaggaaaaagcatggggattttccttgactgttgatattctctagctctgtgcttttttggaatttcatgccatatatgagtattttgtgttgggtatatatagagggcaacattcataaataggaaaacttcaagatttagaggtgttacttcatgtatttctgttctgagaatggaggttcttggacaaatgtatttgaagtacagagcacagagggttaatacatataatattcaaataactattaccaaatatcaaggagacaatgagcccaatgcaaattatatcaaaaaacaaatcaaacgcattcaagtggaaaatgaatatgaaaaaatatcagatttactagttgtcagaatgtaagttatatttacaattaattattttatagccattaaatttaacagaataattttaaaatcagtaacatcaattgctattggggatgcttgaaaaattcatatattgctgttagaaatgtgagttttcacaaaattttaaaaaccattgtaaatatctactaaaattaagataaataacactctttgactttcaaactgttcctaaaaatccaaaacaaccaatgcttaaagatttatgtacagttatttattttcagcattgtttaaaggggcaaaacactaaaaatggattgatggtccattaatattgtcatagctgggtaaattgtgctaggataaaatgcaccctagaaaggaaggaagcaggcacacaggcagtttgttttctgaggaatggacatttttcaaagagattcctgtgcattcacaaagtaatattgcttgattcattctatatcattactatagagtgaatattttaatttgtgcataatatcataaatgttgctcattgtgtacaaatattcaaaggctagtttttacaaatgtaagacaggcaaaacaacttactagcagtaatatcttatcattcatcttctgcattaatattatagttggatagtcatacttaaaaatctaccacagtaagggcagtaagctcaaaggaaaagacatgcaattgtattttcttcatgctttatctaaaatattttttaaaatttatatgagaaaatacaagataattatttgaaataattttttgatataattgttatggaaccctagttttttgtgggaaaaaatgccttttttacatacattgaatagaacaggaatgtactccttaattttaataatttatttgctatcgttatataatcagtgtctagaaagattaaaatggcagaattgattaaaacactttttccattctctactcaagttattggtttatgtctacaggctgagtgcctcggatatcaggatagaaattttatactgaaggaaaattactatatgataaaattgaaaaacttattaggttcatgatcattgtttgataacctatacttactctttaatagtaacttacataaagctttttaaaaatatataatctattgtatttattacacttatgtttggacataaagctttatgtcatcccgtctatgatctggaagttgaaacaaggtggtttcaactgaacactttgcatcctgttgtggatcacttgaagacctaaaatctgtttcttagatactttgatagcaaaagatgcaggagacttctagagataatatttaaaggaaaggaacttttgtactgtttcacataaacctgtatctctatctgtctgtctgtctatggatagagatagagatcaataactaatatcatactgtgaaaatagctattaacatttcttcctttccatatgaacatataccatattttgatgtaatggatttactctaaacagtatttaaaaacattattttgataggtaagtctttaagctccttaaaagacctgagattacatctttatgtagggcatgatttaagaaacctatgaagcttaataagataagaatagcctgtttacatagcttaaagtatttaaagtgtagtaaattggtggttgagctatgtaggtgttctcctctggtaaggttgtttagcatatataaaccactaaaatgatggaaaatacaccaagctgaagtgggatcaggatgactaaacaaaatagttttcaatttctgcaatgagtttggaccaaaattagtttgagaataaatttagggaaaaatgtccttgaaaaaaccataatctttcttaaaagtttttcctaattgtaaatttcactaagacttatgaagtcccatagattataatgaacaaaatttctatatacacctgctgtcactatgagcaacaacaggacaactctttccagcttggatttgtttgaactagacataccaaaatgagttggaaacacttctcgaaccttgccctcccattctgaaatgagaattccatgcaatgactgtacaagttttgtcaagctatggtggaacatggtatcacaaatacagatattccttaaacctaagtattcctggctggtcctaggctgacttaaccttttttattttctctcctaagtcccacagatttggttcatttagctttctattcttggctgccaccaactactttgcaatcctatgttcacagacctccagaggatagagtattttaaacttcccttcatgcttgggaatttatcaatttatttacatcttacaaaattcaaaaagcacccagtttccatccccagatgcaatcactgtccggattcctgggaaacatcccgaactattctatggataagtgagcctaaatgtaaatacatcttccctctttctatgcaattttagcattactgtgcatctttgttcacttaatagtgtatcttataaatttttatgcatttacacatcttgtactgtcttgttctttttctgttcatactgtaatgtcttgctcattttagctggatgtgtagtttcttgcagcatgaatgtgctaccatgtattaagccagtcccctatggagggacatgtggatcagtcctttgccattataacatagtgttgcaataaacatctgtatacattcatcctcttgcatgtgtatgagtgtaccttgaataaattgctacaagtggtatcactgggttataggggggcttgtaggcttgattttgagatatatgagaggttgccctcagacttgtaggatgagggtcctggtctttggccacatcatatacttgccagctatactctgccactgcctctggagctgtccgcaatcacagcttcacataacgtgggtgaggtgagggagcaccctagacccaggccaggcaccaatttaatctcagacattgagcagagaaatcaaatcgctcaaattcaccttgaaggctcaggtactcttttgttaaatcaacatcttttcagcttagcacttcttctattatttacctagttttcatttagatggaatcttttatttattttttgttatatcctcttggtttattgagccttttattaatataagctgtccttctttgtcttttttaatctttttttgatttaaagtctgtttgttcagctattaatatagtcacccttgctctcttttgattactatttgcatggaatatcttttccattctttcactttcaacctatttcaacctatttgtgttttgggatctaaagtgagtctcttttggatggcatgtgtaggttggatattccatatccaaaatgcttgggacaagcagtatctcagatttgagatttttttttggggcggtggggttggtgggggtggatttggaagtgtttgcattgtatttactaatccctaatctgaaattttgaaatctaaaatttgaatgctccaattagcattccctttgaacagcatgttggtgctcaaagagtttcagattttggagcatgtcagatttagaattttcaaatttgagatacttaacctgtagctggattctgtttttcaacccattttgccaatctctgtcattctatcttggaatttaatctatttacatttaaagactttactgataaaaaagaacttacttctgtcatattgtgatttgttttctatatttcttatagcttttgtgtccttcctttcctagcttactgtcttctttgtgtttagctgattttttataatgtttttattcctttctcatcccttttgtgtttatttctaaagcaaaattatatagctatttgctttatgggtaccatggggattacacttagtattttaaacttataaaactctaatttaaaattatgccattttaattgcaatcataaacaactctgctcccttatatctatatcttgatcctttttagttgttgatatcacaaaataacatttcaatacatgtgtatccgaaacatgaactaattgttgtttatttttaatgcattagtctcttaaattatgtaggataatttttccagatataggattcttggcttacaggtcttgtttttctttcagtattttagctatatcatcccactgctgcatggcctccaaagtttctgatgagagatctccaaataagcttattgagtatctctcagatgtgccaaattgtgtctctgtttatgcttgccaaattccctgtttgtcttttgatagtttgattataatgtgtctcaatgtgtgcttgagttcatcttacttggagtccattgagcttcttgaatgtttatattcatgtctttcatcttatttgggaaatttctggcctttatttctttgaatattctcttttcccttcccctctgcccctctccccctctccccttctccctctatacctctctccctccctccctccctccctttctttttggaactcctcagtgcatatgttggtctgcatgatagtatccacaggtcccttgtgctctgatcacttttcttcaatctttttccttctgttcctcatactcaataatttcaatggtcctgtcttcacattcatgcatcctttcttttagctgctcatgtctttggatacctcttatgcgtttttcatttttgtcattgtacttttcagctccagattttctctttggttactttttaagtttttatctccttattgatatttccattttgttcacatgtagttttcctgaaattcttcatgtctttagttctttgagcatctttaaggtaatagttttaaagcagttttttagtagctctgtcatcagcttcctctcagggaccatttttgttggtttgttttttcctttgagaggccatatttttaccatttgttatatgctatcttagtccattttgtgattctatgacagaatacctgagactgggtaatttataaaaaaaaagaagataatttatcatagttctggaggctaagaaatccaagaacaaatagctggcatctggtgagggctgctctctgcttccaagatggcaccttgaacgctgtgtcttccagaatggaggaacccaatttctttctttgccctgtccaaagagggaagggcaaaagaaaccaaattccctctggcaagaccttttataacagcatcaatctattcatgctctgtctgtatgacctaaacacctcctagaaggccctaattcccaacactgttgtcttgggtattaagttttccacacatgaatttgggtggagacattcagatcatagcataagcctgttgaattttttgtgaaaactgtgcgtctaaatccaataatgtggtaactctggaaatcagattaggctccttccctggggtttgatattttgttttgttttattgttttaggctgtctttgtgctaaggatcaggctgaggtgtaaagtaaaacctttttagatttcttccaagcctgtgtctttctttgggcatgtgtagtgactttctaatttctttcacatatgtagttgcttttgaatttctttgtctttagtgtgtggttctcaaaaggagaaagacaaaaatgaagggtggaaaaaatgggccagccctttaaatcaccaagaattcctttcagccagaggaggaaaggattgcaactatgagggagaggtacaacaacaatggctgttcacctctgtgtctgcacctccatgataagaagcagcaatcagcaagtagaacaaagatccctgatatttggaggacaaggtccttattgcccaccctggctcctgtaagctgtgtgcaagctgctccaggaacacatgcatagctgcctgtctcaggaatggagggtgggtaatgggtagctattgactagttaagagctgaaattgatgaaaattcatggttcaagctttcctcttgaagtaaaaggcttcagtacactccagagttccaaaatagctacatcagacagattctctcagtgtaattgttgtctgggtgggctgaaagattcctggtgttccccacccctttgtcgttccagaatcctcccttccctgctatttttaaattgacagtttttattgctagaagcatgagagaaacagtaaggaggctaacataattggacgataatttggaagttataatgttataaccaaagaaatcataagtagctgtttctagtcttcattgaaaagtaaatggagtttgaaaagctcctctttgctcaaggctgctctttcgttaatgtttgtgtagacaattgttgagttttgctctaagaacaagcttacccactctctggattgtcatttcatagagctattccaaatttaaacttaggtagattcaggttgagagccaatatcagtatgagagtggttataaaatgattatcattttatgcaattagaatgactactttttcaccatacatgtgtgtgaatttgtatgtttctccttttttccaactcctcaaacagttctgtgtgcataatttagcaagtaaattgagtgtcataaaacctatataaggttaccatcattactcattaaataaatggccaaggtaacacttatgacaaatctgtcttatggtaacatctgcaccctcttttctgctttatgtcaaaacccagattccttttatttaacttttatttttagttcagaggtacaagtgcaggcttgttacataggtaaacttgtgtcatgggggttttacagattatttcatcacccaggtgttaagcctagtgcctgttagttatttttcctgatcctctcccttctcccacccttcaccctctgagaagctccagtgtgtgttttttgcctctatgtgtccatgtgttctcatcatttggctccctaaagagaatgtggtacatattctctttacatggtgtattacatacaccatggaatactatgcagctttaaaaaacaacaagataatgttctttacaaggacatgggtagagctaaaggccattatccttagcaaactaaaacccatgttcttaaaatttaccttctcaatagaccaacatgttccctcttgtaatgttttctgctaaatagctaccatggtctggcactgaggcaagtatctcttatttctaaacaagttcttaatttaaaaaatagtaatcataatggcatttgtttttggccagattcccaatcttgtattctcattattatttactcaaaaataactttgtcatcttcatcctcaggagtcttatcctcctactattactcattctctggtcttctaaccacagaaagcacatttttatgttatcctttctggaaccctccttgactcaaggccttagaatccctaaacttatattattttatgaaaaactttaaagtttgatttttttatgtaatagataagaaaactgaaatttataaagtttaagtaacttgctcaggtttatatagctcttatggaagatctgagaaatgagctcaattctatatttaaccagtatgaattattgtctttcccaaacccacaagcatcatttgcactgaagactttagaaggctgatcaatcataatttgcatcctactctataattcttacagtctttttctccccaaagcacaagataccaaatctatttcccacgcaaaaataagaaatgttgtactactggtaaaaagtaatatgcagtttttaggaaaaaaatcatgacatttgaaagaatattatgtcactttagtattattttcagactgctaaacaaccacccttgataacatacttttattttgtgtcacattctaatttggtttatattctgtctatattattcatagcagattccaaaatctccttagttcttgacttgcttgtatataataaagttttttttttctgaaccacatcattaagctgaaatgtgtgtatatatatacgtgtatatatatatacatatagtgtatatatatgtgtatatatacacgtgtgtatgtgtgtgtgtgcgcatgcacacctgtgttggttattttgtggtttgtttttgttgtattaataaaagattttatttgtatgctttattaaggttatatatatatatatatataagtctccaaaataccagtcccgattttgaatactaaatttctttctatcatggtattctttgtttttaaatcaaaccagtataacaaaaatctaagcaagatagacaagagtaaacttagaagtcaataactaaaaggcacactcacacacaaacacacacacacaaacaccctagcgatctgtaattacagcaatctgtaagcccatcagtcatatttccattttttgtgaccatgtgaccacttcctagtttttagaaaaactaattccacctagcatgagtctgtatttggcacatttttttccaaaaacatttatgcaagatatgagcagtactatactgcaacatgtttgtatgctttggggcaatgattttcaaaaagtcctctatttccagcctctaaaaatctcctcattagtctgagtagtgacaggttcacacaaacctctctatcactgctgaaatgccaacaaaaatagtaactgcttttttctctaggatcaattctcttgtcataggtcaggctgctgagcaatcattcaatcagtcttttagtcatggtcctataacaaactccttttctccctgttgggatcagtatctgattcaggagaatttactaacatttgtttagctctgaaaaatttctccttttattcagtatctttaaaattcctcatgaactattgaaatgttaataaaaatattcaactagctattattatgatgttaaaactgatagcttttcatgtaatttggttgaaaagcactagacattatcaagtgtagctaagtaaataagaaataaaacatttattaggaaatactgataatttttagctttaataaacagaagaattggctagtcatttctgaaatcagtcatttttgaaaacataattatattctttacccagagcaaaactggggtaatttaatgagcaatataaataagatgccccttaaaagtagaagaatgcatttgcaaaactatgagaataaaaatgcaatcctgacattagaattatgtgtccactgggaaattctctgaagcaagttctttcaaaatgtcattgaataagtttttaacctctccagctttttccactacctagctgttctacttcatttattcttgtcttttatattgcacttcttcttcagggttagttagttgctctattctctaaagttaggttttctgtacccaaatctgaatgctaggccctgtgtcctcatccagatacttaatgtatttcctagttcaacattttaagtggggttgataatggtgtaaatatttataaatgctaacacctggttcattttaacaggaaaatgttcaactttattgaccatagtttttcacatattctctcagggactttgtttttcactggccaagccattgtgaaaatgttttgaaatgtccagttttcataaaaggtttagtgatattgttggtttttgatacacgtatgtaaaattggtaatttttaatttctgaattcttctacacaaaaaataatacctacatatatttttaccattttagtttgcacagccatgattgttagtgaaaatgaacttaaatcttaatactatttttatgctcatactcctaaataatgactttaaaatgtattgcactttataggttgctatacaatgacaaacatctcattagtatcgataataagcttctaatatccttagggatcatatagtaaatgaaaaaaatatattgtgatgttaaatgacttatgtaatactgtatccgttcagatactttcaaatgcaaattaaaaaaaaaaagaactgaaacttacataaataataaagcaatgtattagttaacatgaaagaggaggaaagcttcaaactgacttaatccggtggctccagctttgggtccacttccctaagatttttctcagccctctccaccaggtttttttgtctagtcattaggctgggaaggaaataactacaggagatactggctttagagttctttgaagaaatatccagctaggagaaaggtgttgtttttattttattttattttatttttttctgtctaacttaagattaaattcaaatttccctgaagctataacaagcttcatttcactcgattgcccaaatttagtctcatcctcagttctgatctaattcatgttgatggaggtgtgtcactgattgataggttctcctactacttctgtttcatagcaattattataatttgaataataagcaaataaagttgtgtgcagttaatttatttttttttcacctgtggtagggtagaggctttgcctattttgttcctcaatgtagcacagcatagacaagtccctagaacatggtatttgataattatttagttattaagtagagacaaagaaaattcatgtaattagtttcatatggaagttggtatttaggtggggtggtaactccaattctttctgaggacagaatttactatgggaaatatttaagctattatccttgccatccacaatcttagtacatttctgcatgctctctctctctctctagttttctactgtcagtgtagcatacataaatactacataaatacaccatatttactcattaaaaaaacaaggctgcaaacattgtctcatctttttcccaaattaactgcagttagcagaaagtttagtaactctgggttagtttgccttcctattaattattccagctacttcagagtttatagccctaaaagggatcagtttgattccctcacccatgcagagggaacactcaaactcccccttgcatccctgctaatgattccttctatcctgcagcgtgtatcattcatgcttagttatgcgagtccaacagatccttgatgttaccttgctgatctggctcattgtacagattcactctgtccctgaaggatggtgatacccaacttcagggctcatttcagacaatggcttctcagactatgtctgttaatattgcaacttttggtcctaaccttctttagtccctatacattttcctgaaatgaggtggtccctggagtgctgatttggactagctcgtaggtacaccacattaaaacactttccccttctcttgagcttacccacacctgcaagtcaagcagattaatattgtcattttagtcctcaaaacacaaataatttatgtaaagctcttttctgccatttgtttatggaagagcaaacttaaattattctactggtcctggactcttcatttggagatctctatcttcaataaaatgatttttttgtcatctcactaaagaagagaaaaagaaaacaatctacaaatatcatttctggtatagactctgaaatattacataccccttaatattgttgtaccttgttttattgttgttgtttacatatactaatgtatgtagacatggcaagggaattctgaaaagcaaaattcctggaataaccaatgatttatttgagcacagtttagtactctattagactatgttgagagatcaaataatattcacattcatattatgaaaaatacactattttaaaatgaaaaacagatacctaactatgtcatgaaaagttacattcaagtaaaatagaaaatcttgaagtttcgtgttcccaaccaaagacgagaagaagaaaatgctgtagtattagtcaagaattttgcttaaacagtgcccctctacttactttgcttaatccttgcttagatagagaccagttgcaactttgcaaggtttcattgcctcatctataaatatgggataataataatatctaatctctaacttgacacataggattaaatgagataaggcatgtgatgtaattagcagcttagtgcctggctcacgacacacacttaatagagattattgcaattactattgtcatcatcattctttaacacataaatttgggatgaaaaataaagagattcttgcatggtaataatcaaatgttttaagttgaagtagatgctccctaaagaggcttactggtgtattaaaaatatgtttatgatttattttcttattcttaggcagttgctatttatcttgactcattttcttatttgattttccttatattccccaaagtgagggtgaaggttggtatacttctaattttgcatggagatataggaatttaatagaactacactccctgattcttcctttgggtttctttaggcttaagcctaaaatctacaattagaatggaaataaatcctaagtaaatataataacgttcagctatatttcgcacaattgaatttacttgatctcagcatccttacaagagtggtggaaaagttttattattccattttacatactccgaattggttctcaatgacattaaatgatttccctaaggtctcatgtctgggaaatgtcaggatagtaagttgatcataaaatcctgtaatattttctttctactacattacctcacattatcttttgaaacataacttaatctttttaaaaatagttttcttatcttttctttcactctcccttcttttaactaggcaaaaccttgtttaaactatgccattgctgtgaacaagtaggaattgctgatagaggaattaaatgttagaagatacagggaaacattaattttttctgtgtaacattgggttattcagcttttgtgataatggtttcccaatgactggaagaagattgccaaaagaagtagtaagacagaatctaagtagttttctcccatatcatgagtcccaagaatacccacatgtttgcaaaaatcctggtggagagggcctctgataactcagaggcattgtactgtcagccatggcttattacagtgaaaggctacacaacaagctcagcaagagaaaagacacatccagcaaagtctggaggaattcatgcacagcattcagaaaaccctttctctcaggaggggccacacagaatgtgttctttcttccggcaattaaatacagcaacacttatgcagtgtttctgcccaggagagtctgctgttgactgagttcaagattttccctggggactggtcatgcaggcactctctgcctatgtgatcagccacaatcatagaaattccagactcccagaaggaaagcagctgtttactataaatcaggctgatacagctaattcagtgcctcaggcaaacaaaacagctttatcagtgtagggaacttcaaaagccacattgctggaaaccagccaagtaacagccctgcaagcaggcccttctaaagagtagtttaagacctcctgtggtaactgctctattttccagggacaatacgtaggggacagaggaacacagcagaattttgaaacaggatatacaatcacaataagagaaggagcaccaagtatcttctgttatcagtagaataatcctgatattctaaacctaggttttcaattttttttttcaggattttgcttatattgtaagtacagtaaaaaatcaagatggtgaaatacaactcaggaacacacatgtattaaggcaggtttgacagttccatcagtatactacaaaaaaaaaagtgctttgtaaacctaaagccacagtggccttagaccatgttaaatgctttaatacatgtccaaaggattaaggaagtataaggaaagagaatgtgagttctttttaggaagatttaagaaagctccaggaagaagtggcatttgagatccttcatccttaaagatttcaatgacaaaggtggtacagtgatattcttgttattgggaacaaatacaggaagctatgaatatagaaaatattgggaaatattgcgtaatttggtgtaatattgtacaaaacagtgatgtacattattgtataattaatataatggtaaaagttatattcatatcatactattacaattaattatttttgatattcgatatatacaaggttagaattgggaaattcataccaaagggatttgttcacctattttctatcaaaaaaaatcccattggatattaagcagcaaattatttatacaatgttgggaaataatgtggtaacacttgtttactttttaatgttccatatggatttaatttttgtgttattgtctgtagaataaaggacaataaaaaaattaccaagactttatctggttgttctggtatgtttaaacaaattccttggggattagtatttcatttactaataaaaacttttcaacttcagtggacagctattagttgatacacatacaggtatagaaattataaataatttttcaccgaatcatactgaaaaatttatagtcattgttttagaaatcatatttgaatatgacttctttcaataatatgacaattaaaatgttaggaaaacactgattcaatatgtactaatttattctaaatgccaagtgctaagtgtacttatatctataaaaatgaaattatatgaagtgtacaattactttatcaaacattcatccatttaattaaaattttctttgcgttttatacctaacttgtaatattttgtatattcccatcaagtttttctaattgctttcaattggaatgagatgtgcttgagatggtattagaaataattaagaagtcagacacagggagattgctttttccaggacattatttaggtaaactattttcaaaaatatcaaacagtcaccaaaatgggtcacattctataaataatagaattaagttttgaaacaaaggttgcatactttccttgttaaaatccaagccattctcagaaaaagctaattatcttaaggctgtgagtcaactgttgccaaatggtcgcacagttagcgacagaggagaaatgaagcacagagcagtaaaccttggggattcacctggcctccttcgcagccaagatttttcctatggtgttagacaacaattaaaaaatttgaaatggaaggtgactcagtaaagggcaaactgaaaagtgtaactctcaatcagatcatccatatcacagtaaaagaataaccagagaatagtgaaaaaataaggagaaagtaacattttccaaagccggtgtgaatagataattattcttctgcgtaactggagaagtagaacaaatactgacatcatatataatagggacctttaccaactagctgggaagtcttcagaaatcatattctctatctctaggtttcagtttttcaccaataaaataaagtggagtggactaaatgatttctgaggctgtttttccatgctaacattctatgtctttatataaaaggatctatttgtagaatagttgagtgtaagcagcaggagaaagaccttatctgttttgacccagcacatagaataggccctgtcccgctgggcgtggtggctcacacctgtaatcccagtactttggaaggctgaggcgggcagatcacgaggtcaggagatcaaaaccatcctggctaacacggtgaaaccctgtgtttactaaaaatacaaaaaattagccgggcatggtggcaggtgcctgtagtcccagctatttgggaggctaaagcaggaaatggcgtgaacccgggaggcggagcttgcagtgagcagagatcgcgccactgcactacagcctgggcgacagagccagacaacgtctcaaaaagaaaaaaaaaagaataggccctgtcccacagtcagcactcaaaacaacacttgttaaatgagtgaataagccagaaaataaaggctggtggattggtaaaatgacttttactggaaagactgtgtatgctgacacatacactggtacaataagatgtttgtctcatccttttttttttttcttttttttttgctgagacaggctctcactttgttgcccaagctgaagtgcagtggtgccatcatagcttactgcaagcttgaaactcctgggttcaaacagtcctccctcctcagcctcttgagtagctaggactacaggcctgccctaccacccctgggtaattttttattttttgcagaggctgagtctcactatgttgtctaggttggtctcaaactcctgggctcaagtgatgcttccacctcagtctcccacagtgctgggattacaggtatgagccactgcacccaccccatccttcttctttaaggtaaattacaccctttgtgatggtggagcaggtagataaaaacgaagtccctaaggagcctcagtgtttctcacaggtttctgtgctcctggttggaaaagctaaaaagtggtttgaagttagttatgaatattagagaataccttttgtaatgagttatctgctatagagagtaactagtcctctaagcagtggtcagattgctgtttcatgagaaacagtgactagcttttccatgttgaatgaatccaagtaatatcatttaagttaatatacagatttaatttcaaaatctatcttcttgactggtacatcctggctaacttgttagacatagccatggaatttatttaattagcttctccttactataacaaataaatgctagtttgaatgaaaatctaatgagagccaattatatatttaaagcatcacctgacttttgaaagatgttattaccagatagggagaactaaaatatactcaattagttataacattctcttctcaatgttcatggatttcctagtaggatccaattctcagaaattcatgatgcaaatgcagttaaattgaagtagatatcatagagaaataaaaatggtcattttattttcagttagttctttgggtttgagaggatattaagttacagtatgagacactgatctgtcaaaattatgaaacattgatctgtgagataaaaatgtaagccacggtacattttctgacttacagtctgagactgcacatttatttttctgttatgttttgctgttcctagaaattaataatgacagaaataaacacatttaataaagtaagatttccagcagtggattttaacacaatctgatttatttgtttaatattgagtcttcaatagagtttctcagatagtatgtagttttacattatgagtactacatttaaaagtgggaacttaatatggatatactgaaagcaatgccagtttacaagataataattattaaaaatgtaaagtacctacagcgcaggtgaaataatgcacgcgtagactaccactggttacttgtttaatattttggggtactcttaaaagaattgagggaaattttaaaagaaaagcattgagactccagtttgatataggtaaaggccacaacttttgtatactgatacacttatttagttgaaatcgtttaggtaacaatgctcaaatattaaaatggagacatttttaaaattttgatttttggccaggcatggtggctcatgcctgtaatcccagcactttgggaggctgaagcaggtggatcacctgaggtcaggagtttgagaccagcctggcaaaatcctgtctttacaaaaaatacaaaaattagctgggtgcggtggcatgcacctgtaaccccagctactagggaggctgaggcagaagaatcgcttgaaactaggaggcagaggttgcagtgagctgagatcgcgccactgcacagacagagtgagacatcatctcaaaaaaaataaataaaaaataaaaattttgattttctaaaagacaagaaaatcctagaattttatagccaatagagatattcaagattacctagttcagtttattaattttcctgaaaaagaaatgtagtctcagagtttttggtgatttgcccaaggttagcgagagaaaagaaacaatttattcatttcacttttttttttctgaatgaatttgaatggttaatattatactcaatatattaatggcatgtttatgttaaaaagggtaaataaatatcattttatagtaattatagagatttattcattcagttcatttaattaatattagtttagtatctactaagtgccagacactgttctaagtactggggatataaagttttaccagatggacatactgtcatggactttacgttctggtgagaagaatagtcagtacacaaaataataaatacattaatatgaaaaatattttccagtgttaaatcctgagcagaaacttaaaattgagtgatatgacaataagcaagttgatgtctattttagaatcaatgctcatgaaagtcctttgacacaggaaatttaaactgagatttgaagggcaaagggataaccctatgaccttgggaaggttgtggggagagatcattaaaagaagggaacagctggtacagaatctcttgagtagaaaagattcagaaacccattgaatgccatttagaatttattgtatataatcatatataattttaccattttaaatgtgttgttctcaatttataatatagagtcagactttcttaagtaaaccttttttaattttttttttttttccaagaaatagtcttgctctgtcacccaggctggagtgcagtggtgccatctcagctcactagaagctccgcctcccgagttcatgccattctcctgcctcagcctcccaagtagctgggattacaggtgcccaccaccacacctggctaaattttttgtatttttagtagagatggggtttcaccatgttgaccagactgtttagaactcttaaccttgtgatctgcctgccttggcctcccaaagtgctgggattacaggcatgagttcccaggaccttctttaattttaaaacattatgttaaaactaaatcattactcttggtattgtgctacttctaatccatcctctttattttagttgaactcagtttatatttctaaacattgcaagttagtttagttttcaccctgaaataaccattatcttgatagaatggggacactgtcctgtcaagaattgtgctctttggcaggggtccctaacccccaggccacggaccatgcttgtccatgacctgttaagaaccaggctgcccagctggagatgaccagtaggcaaatgagcattactgcctgacatctgcctcctgtgagatcagtggctgcattagattcttatgggagcacaaaccctattgtgaactgtgcatgcaagggatcttggttgggcactccttatgagaatctaatgcctgatgatctgaggttgaaaaatttcatcccaaaaccatcctcacccccagcggtggaaaaaatgccttccacaaaaccagttccaggtgccaaaaaggttgggaaccgccgctctacaagagagtctggtattaacaattttaaaaaataaagtctttgtcactgattattgtttagcatttaatagaaaaacatgatggcacactctctgtggtgttgtagatagtgtgataagaaaatgctgactctcttaaaattatagaagaaatactagatttttgttggcttaactttaataagaataaataaattaatatgatctccaaagtgaacactactgatattacttatggatctaaattaatatagtacaaatttggtaaaactatttagatacatggatgcttagaaaagtaaatattccattcattttgcaaatatttaagtacttatttagaacctagcatcatgcaccaagcactgtttgagcaactggtataatttagaaacataaaaacaaagatccctgtctttgaggtacttttattctaacatggaaagatgataacacacaataataataaatttatacagtgtgttaaaatgttttaagggtgccagaagtgaagtaggcagaagattgtaatattaaatagagtggtaaaagtagtgctcattgagaaggtgagatacaaacaaagacttgataagccatgggagttggctatgcagatatctaggtgaagagagttccaggcaggatgaacatctagtccaaaggcctatggtggaagaatgcttggcatgttaagaactatcaagagagtcataatgttgcaatggattgatgggtttggtgtatagagagatggggacagacataatagacagattcatatgcaaataatcataatctagctattaatactctctttttacctatttgagtgcattctctctttttatgatctacggtacaaatatgaaacgtagcttactagatagattgattcaataagcttagtatctcatcaaatagtttttcaaatagcaaaataattgccttatgatgtgacatatcacacattaagtgctagtccagttcttacatatttaaattcacggttagactgtttaccaccatgattgcatgctaaatcaacatgcctttcactgacaatatttagagttacttgttttctgaaagggtgtctttgacttcctatttaaggattagattaccaatcagaattgttagaaataataccccataaagtttatattggtgattagtctcatatctgaactggaaaacaccatcacaaacaaccactcaggtatgagcatcagacatgctataagtaatctagtttcaggataaactctactgtatgaaacctcataaaatatgatgacccaagtccctggagcagaaggaatttaacttatgcaatgtaccaagatgagaactgctagaaaactggggggcatggaagtgctaatctagtttaatattttagttagccttaagcaacaataatcacagacacactctatgaaatgttatttgtgcccatacagtaacattaattttcttttaatttttgtctgcctcaggaaatatttcaattgaatttcacattttttcccaaggaatcagggcttctggaattcaacgtcatttacttaactttttttccccacagttattttcaaatctaaatgaattcaaaaccaatcatttattattttgcatttacttcttcagttggtaaaaatgacatggtttagattgatctcttgaacattaatatagttctggaattaggcttactcatttaataggttactcaatcactgatttgctaaacatgtatccaaatcatgtcagttagttatctcaacacacataaaaataaagtattagttacttttggaggtagtatgtgtaatagttccaaaagtagctctgtaatgagatactctgggctcagtattcaactctgctttctttgatctgtatatccttaggaaagttaattaacctctccttccctcaatttttctatggcaaaatggggattagtaatggtaacatattgtaattgtgaggtataaaaaaagtatataaaatgatataaaaataatccatgtaacatgtactgcataatgcctggcacctagtcagactcaaaatgtaaatatttctgttacatacatatgtgtatatttagaagtatcctgtggtatggttacaatattgcttaaggtaataagtgaggattttccatttttacaaagacagaaccttaaaagtgaagcatggttaagtgcctgaaaataatgacatatattctttttttaaatgggacgtgaacaacaattcaaagcttccagtgaatggcttattacagtatagacattcaaagattaataggattaatttagaaaggagggaagaaaaaatatagtttgataaattttgacatttggctgttctttgtatttcaatagattttagcccaaatcatgataaactccataaaattttcaaacatgtgctttagaaatccctctgtgacttaaatttcaacatagcctagggggtgaatattttttcaataaatggctaaaaaagagataaaagaattacaaatctttaaactatgtttattaacttaaaaggaagactggatttatgtgtaagaatgaattagtgcagtttttaagtaggttaagttgccttaggaaatgttctgtgtttctaagtcaattctgtaaacctatgacactcctcgatattatcacttacaaaacgaatcctaagtaagactaacattagaagtccatatatgcaacaaaatatttttatcaacaatataattggaaattgaaactgaatcaaaaatttacacaacaaactgatagagtaaaatacagatatgtaagttaaaaaaatcagaaactacggaagcttaaataaggctgacaataggtgtgtaagctgtgttcaaagttttttggaattttttaacttcttgagtagtttaattagtttcactgagaggccatacaaaacagaaagacacagagtaagaacctgtaaaaggaccaatatacctgtcttaaaattaaaacataatacagatactagattttaccactctgcagagatcatccattacaactctctatatcctcctcccgataatcatcaattttttaccaggcaagcaaagacccagagacttaaacaatatccttatcatccaacaatgtgtttctgtcactaatatgatgctgccatataataaatgtggcagtgaaaagcaagcaggccagaagtgttttacgactcttgtcgttctttgggccacatgctgtagctgcaacgtgaaactaacaatagcaagaactaataaggggttgcattttattttgtctaaagagatcagttcaaaaacaaaacagaataactggtagatcattttcatttcagcccaatgggggaagaactattttgcaatataacatgtgataaggctatggtcagaattaaattaatccaggtaaaacacttggaatggtgcttggtacatagagaacatgcaacaaatattagttatttttataactgaaatagtaatgagtcttttatttagataatgccaataagggcagcaacatcttatgccactaacatcagtgcatgttgcagttaacgatggagtaggcactgtgctgcgttttataaagattctttcatttatactataaattatttcaattttatagctgtggaacctggcccatgaaatggttaaggaatgctctagaagttatacagtttttaagactatgatttatgatagaactgctgaaacaatttgtttaaacaaagataattctggattagggaccccgtggccagagttcaagtccccaaactgacacttataaattaagttccctggctgcaagcctcctcatctataaaatgaagaggttgagctacagttatctaaagttccttctagctctttcctgtgccttcacggctaaagctaaatgttaaaaagtcacacagttacttgaagccttttaaaaattattattttattcagttaaatcatggctactttctacatgttaagaaaaactgtcacaacgaaatctctgaagttctagaaataaaatatttattccatctgtccaatctatattttttcaatcagaaaaaataaatcaaccaaatctagggatattagatagtgatttctgcctttttgtttacagggaagcaggagaaatccttatgacatgatagaagttttagaagggtttctaatcattatgaaggggtagatctcttccctcacctccctgtgtaccttagacaaagtgggtctgtatgccagcgcagttaccaggggtgttcatgcagttactagaatgcaagacaaatttggtaggaagttctattttttttttttccagttaatagcctttctcccttcctgccgtactaaaccatcttaatttagcacactgcagaacatttgctttagggtaatttttttcctacctaaaatttataacattttggttttgtctcatgtgattaattttgatcaatgcagagatttcatattctatagtgagaaatatgtatactgagggaaatgaattttttccaaccacatcccccagagtatttttaaatatgctttgctcaagacatgctaggcaaatattacatttatatatggttgaagaataacaaagtggattttaaatcaattaaaattctgtgaatcttatattaatattaagaatcaacccatatgcatacatatatatgaataatttgactgttcgtgtgtacatcaagtcttttgaagagtcagacaaattgtctcagtgaatagaactaaaacatattcttctttctgaagtattttaatatgtgttttagtggaaatgatataaaagtataaaaatgcaaaggatttttttgttgtgtggtatatataagtgaacacaaataaaggtgtttgggttattttagattaatacttattttgaaagtatcccttgtgctaaatgttatttcttagttagttggggtgatattacagtatgattttttttaaagcaaatcaaccaaattactgtcaataagagtcagtaaaaatcaagattgtgcatgtttcctagcataggttgtaagtcacagttgatacttccctaacagttttccacattcaagccacctgaccttccaacttgaagacagtcttgctctagtactcaagagtaatttctgctatcagttaaggcttggcatctcccagatcatagaattaatgaatcttactataccttacttctcctttgaaacacaatcttgtctaaagccctagtatcatatggaaaatcctcttaagccattattttttgcccacacagctctcaaattcttgtcatcagatatactgcttcaggttttcaacctgaatcttggtctgtcaataatctagtgcctaaattataccaagctttttacattgtttatacagtacctcttatctactctggcaagcttgcctttcattccatattccaaccatgcagttttttttttttccactaaatgcttattcccagctccttttaatcactgtgttgctttgaagaatcatgatgattcatacatgagtttcatgttacaataaatttgtattgaaaagtatgtaatacattaaacattttgactgatggaagtttaaagcaatttgactaaggatgaaaggatgaacttggtattgaggctcttaaaatattggtttaagttttattttatgcttactagatctggaacttagtcacataatttaaattttgtaaactttaatttcctcctttgaaaaaataagctaaaataatatttaccttgacttctgtttctattcatgaaggagttacatctgtaagtcttgtcttccagctttcattgctagaaaactggactaaatacatagaaaggctatgatcttcaagagaagagaaacaaatgagatcaatccaacactggaatttctgactggaggcaatttttagaccatggtacatggtacatggaggaacagcctaaacataacttcatggtattcaaattttgtagttgagaagataagatctgagtttagagagaacaaaggagctagaatttgtggggcagattaccagagaggagggaaatacacaaagagctctagaaatccgcatagggcctccccagaatatttgtttgaatagcaatctacacatacataatgtgaaattccacatgaccaggcaaagaacaactgtgagaaaagaataattagagtgaactgtcagtagaattcccaggggtctcacaggtctggtaatcttttgatttcccatcagccagaatagggaacccccattaaatacagagggtattcagtagagagcacagagggaccaagccttaggaacagggataaattaacactaaagactacttcagactcaccctaaaaaatgtttaatgcaagcctcaaaggaatcagtatcactcacaggtaacttaactgcctgccaggaacaattctacatctaaatcaatgcacctaaatgtaacactaaataaaataaaatttataatatctggcaaccaataaaaaattactggacatgagaaaaaatagtaaaatgtgactcagatcaggagaaaattcagtcaatagaaacagacctggaaatgacagataatgaagttaacagaaaaagttgaaaacactattgcacagtgtgaatgacgaagaagacgggtgatttctgcatttccaactgaggtaccaggttcatctcactggggcttgccagacaaatgggtgcagcccacagagcagggtggggcatcacctcacctgggaagcacaagaggtcagggaattacctttcctagtaaagggaagccctgacagagggcacttggaaaattggggcactcccaccccaatactgcacttttccaatggtcttagcaaacagcacaccaggagattatatcccacacctggttcagagggccccatggccatggagcctcactaattgctagcacagcagtctgacatagaactgcaaggtggcagcgaggctggtggaggggcatctgccattgctgaggcttgagtaggtaaagcagccagggaagctcgaactgggtggagcccaccacagctcaaggaggcccgcctgcctctgtagactccacctctaggggcagggcatagccgaacaaaaggcagcagaaacttctgcagacttaaatgtccctgtctggcggctttgaagagaatagtggttcttccagcacagagtttgggatctgagaacagacagactgcctcctcaagcaggttcctgacccctgagtagcctaaataggagacacctcccagtaggggcctactaacacctcataaggctggttgcccctctgagacgaagcttccagaggaaggattaggcagcaacatttgctgttctgcagcctccgcaggtgatacccaggcaaacagggtctggagtggacttccagcaaactccaacagacctgcagctgaaggtcctgactgttagaaggaaaagtaacaaacagaaaggacatccacacaaaaaccccatctgtacgtcaccatcatcaaagaccaaaggtagataaaaccacaaagatgtggagaaaccagagcagaaaagctgaaaattctaaaaatcaaaagcctcttctcctccaaaggaacgcagctcctcgccagcaatggaacaaagctggacagagaatgactttgatgagtcgagagaagaaggcttcagaagactggtaataacaaacttctccgagctaaaggaggatgtacgaacccatcgcaagaagctaaaaaccttgaaaacagagtaaacaaatggcaaactagaaaaaacagtgtagagaagtccttaaatgacctgatggagctgaaaaccatggcacgagaactacgtgatgaatgcacaagcttcaatagcagatttaatcaaatggaagaaagggtatcagtgattgaagatcaaatgaatgaaatgtagcgacaagagaagtttagagaaaaagtaaaaagaaatgaacaaaccctccaagaaatatgggactatgtgaaaagaccaaatctacatctgattgatgtacctgaaagtgatggggagaatggaaccaagttggaaaacactcttcaggatatcatccaggagaacttccccaacatagcgaggcaggccaacattcaaattcaggaaatacagagaacgccacaaagatactcctcgagaagagcaaatccaagacacataattttcagattcaccaaagttgaaacaaaggaaaaaaggttaagggcagccagacaggtcaggttacccacaaagggaagcccatcagactaacagcagatctctcagcagaaactctacacaccagaagagagtgggggtcaatattcaacattcttaaagaaaagaattttcaaccaagaatttcatattcagccaaactaagcttcataagggaaggagaaataaaatcttttacagacaagcaaatgctgagagattttgtcaccatcaggcctgccttacaagagctctggaaggaagtactaaacatagaaaggaacatctggtaccagccactgcaaaaacatgccaaataaggccatcaatactaggaagaagttgcatcaactaatgagcaaaataaccagctaacatcataatgacaggatcaaattcacacataacaatatgaatcttaaatgtaaatgggctaaatgctccaaataaaagacacagactggcaaattggatacagtcaggacccatcagtgtgctgaattcaggagacccatctcacatgcagagacaaatataggctcaaaataaagggatgcaggaagatcaaccaagcaaatggagaacaaaacaaagcaggggttgccgtcctagtctctgataaaacagactttaaaccaacaaagatcaaaagagacaaagaagacctatgtaatggtaaagggatcaattcaacaaaaagagctaactattctaaatttataggcacccaatacaggagcacccagattcatgaagcaagccttgagagacctaaaaagggacttagactcccacacaataataatggcagactttaacaaccccctgtcaacattagacagatcaacaagacagaaagttaataaggatatccaggaattgaactcagctctgcaccaagcagacctcatagacatctacagaactctccaccccaaaacaacagaacatacattcttctaagcaccacatcacacttactccaatattgaccacatagtcagaaataaagcattcctcagcaaatgtagaagaacagaaattgtaacaaactgtctctcagacaacagggcaatcaaactagaactcaggattaagaaactcactcaaaaccactcaactacatggaaactgaacaacctgctcctgaatgactactgggtacataaagaaatgaaggtagaaatgaacatgctctttgaaaccaatgagaacaaagacacaacacaccagaatctctgggacacattcaaagcagtgtgtagaggtaaattaatagcactaaatgcccataagagaaagcaggagagatttaaaattgacaccctaacatcacaattaaaagaactagaaagcaagagcaaacacattcaaaagctagcagaaggcaagaaataactaagatcagagcagaactgaaggagatagaggcacaaaaaacccttcaaaaaatcaatgaatcctggagctggttttctgaaaagatcaacaaaattgatagaccactagcaagactaatatggaagaaaaaagagaagaatcaaatagatacaataaaaaatgataaaggggatatcaccaccgatcccacagaaatacaaactaccatcagagaatactataaacacctctatgcaaataaaccagaaaatctagaagaaatggataaattcctggacacatacaccctcccaagactaaagcaggaagaagttgaatcccaataacaggttctgaaattgaggtaataattaatagcctaccaaccaaaaaaagtccaggaccagacggattcacagccaaattctacccagaggtacaaagaggagctggttccatgccttctgaaattattccaatcaatagaaaaagagggaatcctccctaactcattttatgaggccaacatcatcctgataccaaagcctggcagagacacaacaaaaaaagggagttttagaccaatatccctcatgaacatcgatgcaaaaatcctcaataacatactggaaaaccgaattaggcagcaaatcaaaaagcttatccaccacgatcaagttggcttcatccctgggatgcaaggctggttcaacatatgcaaatcgataaacgtaatccatcatgtaaacagaaccaaagacaaaaaccacatgattatctcaatagatgcagaaaaggccttcgatgaataaaattcaacagcccttcatgcaaaaaactctcaataaattaggtattcatgggacatatctcaaaataataagagctatttatgacaaacccacagccaatatcatactgaatgggcaaaaactggaagcattccctttgaaaattggcacaaaacagggatgccctctctcaccactcctattcaacatagtgttggaagttctggccagggcaatcaggcaagagaaagaaataaagggtattcaattaggaaaagaggaagtcaaattgtccctgtttgcagatgacatgattgtatatttagaaaaccccatcatctgagcccaaaatctccttaagctgataagcaacttcagcaaagtctcaggatacaaaatcaatgtgcaaaaatcacaagcattcttatacaccaataacagacaaacagagtgccaaattatgagtgaactcccattcacaattgcttccaagagaataaaatacctaggaatccaacttacaagggacgtgaagaacctcttcaaggagaactacaaaccactgctcaatgaaacaaaagagaatacaaacaaatggaagaacattccatgctcatgggtaggaagaatcaatatcgtgaaaatggccatactgcccaaggtaatttatagattcaatgccatccccatcaagctaccaatgactttcttcacagaagtggaaaaaaactactttaaatttcatacggaaccacaaaagagccttcattgccaagacaatcctaagccaaaagaacaaagttggaggcatcatgctacctgacttcaaagtatactacaaggctacagtaaccaaaacggcatggtactggtaccaaaacagagatatagaccaatggaacagaaaagagccctcggaaataataccacacatctacaaccatctttgacaaacctgacaaaaacaagaaatggggaaaggattccctatttaataaatgcttctgggaaaactggctaaccatatgtagaaagctgaaactggatcccttccttacaccttatacaaaaattaattcaagatggattaaagacttaaatgtcagacctaaaaccattaaaaccctagaagaaaacctaggcaataccattcaggccataggcatgagcaaggactttgtgactaaaacaccaaaagcaatggcaacagaagccaaaattgacaaatgggatctaattaaactaaagagcttctgcacagcaaaagaaactaccatcagagtgaataggcaacctacagaatgggagaaaatttttacaatctacccatctgacaaagggctaatatccagaatctacaaagaacttaaacagatttacaagaaaaaatcaaacaaccccatcaaaaagtgggcgaaggatatgaacagacacttctcaaaagaagacatttatgcagccaaaagacacatgaaaaaatgctcatcatcactggtcatcagagaaatgcaaatcaaaaccacaatgagataccatctcacaccagttagaatgacgatcattaaaaagtcaggaaactacagatgctggagaggatgtggagaaatagggacacttctacactattagtgggactgtaaactagttcaaccattgtggaagacagtgtggcgattcctcaaggatctagaactaggaatagcatttgacccagccatcccattactgggcatatactcaaaatattataaatcatgctgctataaagacacatgaacacgtatgtttattgtggcactattcacaatagcaaagacttggaaccaacccaaatgtccatcaatgatagactggattaagaaaatgtggcacatatataccatggaatactatgcagccataaaaaatgatgagttcatgtcctttatagggacatggatgaagctggaaaccatccttctgagcaaactatggcaaggacagaaaaccaaacacctcatgttctcactcataggtgggaattgaacaataagaacacacagacacaaggtggggaacatcacacacaggagcctgccggggggttggcggggggaaggatagcattaggagatatacctaatgtaaatgatgagttaatgggtgcagcacaccaacatggcacatgtatacctatgtaacaaatctgcatgttgtgcatatgtaccctagaacttaacgtaaaataaagtaaaatgaaataaaataaaaacaaaaaaactattacaaataaaaatgtcaaggatttaatgagaagtataaagagaagtataatatgagagaaatagatagtaaaataatatcaaaattaaacttctagaaatgaaaactaagatagctgaaataaaaatttcactgaatgggattaaaagcagataagacactgcagaagaaaagatcaatgaacttgaaggtgtaacagtagaaaacatacaaaataccaagagaaaaggaggttttacaaaagtaaacagtgtcagtgattttggtgacattaacaagtcatttaatatataatttgagttccagaattagatggtaggaaaattgagggtcagaaaaactgtttaaagatgtaaggccaatgttttccccacaagctttatgaaaacaatactcccatgatctcgactcactgtaacctctgctttctgggttcaagctattctcctgcctcagcctcccgagtagctgggattatgggcacccaccaccacacccagctaatttttttgtatttttagtggagacagggtttccctatttggccaggctggtcttgagctcctgacctcaagtgatccacctgcctgtgcctcccaaagtgtagagattacaggcatgagccaccatacccagcctcaaattgatcttatatttagctaattatacatgtgtaataatgataaaaatgagaggaggcagaagagaagacagtaattactattttgggatatgctgtgcctggccctttgctaaatgctgttacatataatatctcatttaatcttcctagcaaatacatttggtagctactatatttattatcatttttcagtcacaaaagatgaaattgagagatattatgtaatttgttaaagggcatagagaagaaagtgacaaaccagagatttaaaattatgtcagtctgaattcaaagcatcccattatactatctcccagatgcaaaaatctataagcatgaatactacttcagaatttacttttagcataagctttacatttaagaaatgttctaattttttgttttatattctttgtcacatataatttagcctctttaaactgttctataaatttagataattttctataatcagaaaacaggctaccacctatatacaaaaataaatggtatgccatgttgatcctagaacattttctagggtcaagagagtagtaaagctactgtttaaaataaaatggtttagttaatatgtatgttcatgtgtttttatctaaacaatcaagaaatgatgatgaagagataacatgtttgaaaaaaccctgaaaattttttaaacataaatgctgtagccaaatgaaaaaaaagttatcatgtaactatgaaatacttaactacaatattgcactcccagcattattattgttgctacttaatggaataacaacagtaatagtatcttcttaaattcaaattcctaaatataaagctagaaacataataggtctagtgcatctttactacaggacacttttttttttttaccttatacattgatagtgcaatgtatgtgataaatgcattggtaatgcaaatatataattattattatgtgctattcaaattttcatcaaaaatagataaatactttgactttaatcaaaattcttaatgatagtgtgaacatttttaaatttgtgttctccaaagctttgttaaataatttatcagattagagcaaaagtaattgtagtttttgccattacttttaatgacaaaattgacttgctaagaaaaagaataactctttcttcttttaattaagtatagtgcttattaggaacttaaagtggatccttcttttatattgtggagatcaggtatgctaatagaagacagagaaagccctttgacaggaaataaaatcctgaatattttatagataatcagcagtactgcaagggcttctgctgtcttttatcaatctgactttgtttgggcgctgagatctgctggtaggtgaactagagtaggaggttaccatcatagaatatactgtacatactagttcaagtttaaacatctttggtttcaacaaagggtaggcaatcattgcttaaaatagatgtattaacattttatttttacttatgatgtaggggtcggcaggaaatgcattgggactacatttgaagacttacttagctacacacacatagacacatacacacccatgagatagtcatctatattcagatcttctttgttacgaataagtgaattatttcctttatttcaaaattattgcactaatatgaattattatttaattcttcgttgccaataataatatactttgcttttctttttcagggtttaaacttgaaaagactagagacagtacaaggagggagagaggtaagaatgtttaaagaagaggggtgggaaaaagaggaaacatggctatggtgttgcagtgatgtggtgatggtgattgacgataattacgttgataatggaaatggagatgcattgaagagaatgttgtctgcatatggctctgttcattctgccaaagcatattttacatgtttatgtaaatgtgttatttgtgcttgttcctctgaagctaaagaaaatgttgtttctctgattaggcaagcattgtttctgttataatggatttctgtagcagcaggtcctttcacagggggcagaaacattacaatgcaatttttaaaactgacttactgagaagttaacaaaattctaacaatgcaaatattttatgacatttgggattcctcattttcctgtcaaaggcttttggcatatgctactaggttggtatgcattattagagagtatgaagttgctctggtaaagctagtaattttaaaactaactgaatgtgaagacttaacatcacttaattttttttccctgctaaatgtataaatgctgtacttaactctgtgattcaggttgctgggagttgtgggaagggtggaatatttaattcagtaaatcaaaacattctaactgcacaaaaaaaatcatttttgatgatacttatattgcaatttttgtacaaaagtgaaggtattttgttctatacaaatgaggaaaaaaatcttactgtcctctccatttgtagcttcctttctgtataaacagatttcttccctatagtggtgcttgccagctttcctttatgttttaattccagttgcatgattttagtatttgacattttagttcctagtgaatttgtcatttaaggtctctttccattttctcagatattttccatccagaaaaatctatttttatttaggaacacataaagttggttcacattgatggaagagctagatgaagtgaaacatagataaatctttagatatttttcatgttgtaggagagcaagatgataagaatatggtcatcagtatgactggggaaaaaaggcacttcataaggaagatctcagaaccttttacagctttgtgagaatgactgctttcattcagatgtaaccaaaatggatctacttatagaaagaactaaactgatcacctcctaaagtgaaagttttcatccgagcagtactgctacaatttatttctgctgatttagtgcctttagggacatactaagtggagttactcggcttctccttgctgcttcctggtctaatagcaactttgtgtcaaaagaaggaaaactgaaatctatatatccgtacgatggcattgctaaatggtgccaaattctgcatttgttttactaagatttttatagtttttaatgttatttttaaatgcataatgattgggttttattgaaagagtggctcttaaatcatattgcttatttttctaacgtcctttgattttatttttattataagtgtacttataagtaaggaacatggtaaaatgtgtttaaattaattttagaagtatattgttctcaaaactattttgtgatttctctgaaggtcaaaattgtaataatttacaatttaatgtatacatctccatagaagggacaacactgattttggccttctccctcagggtagtggaataattgtaaaaagctaagatcatcaaattaaccataatccagtaatgtcttctgcacttgacatctctaattcatgaccagaaagtaaatgtcaactattaaaattcaaaacaactacttaacttccacttagggcagcactgggttacttaagcatatttctattcaatgtaactacttaccttaactttccctgtgactaagaggcctagtatgttctaagataagaaacttcagggaggtataagacaattaggtgaagtatgttgtaaaaactgttcttttcaagtctcaatggtagatgacctgtaaacaaagagtacaattactatgttaaggaccttgtgatctcacttgcttaagaaatgggacgtgtatgtatctaatttccatttgttatgttctaggatgtgtgtgcataacaagatgtacaatgtaattctgattatgttaaattgaaatgtgagggtttagaaaactcttactccaaatgatttcttagaatttctcattgtaatgctattatgattgataaatgacaataattgtttattatgatgaattaatttcttagttcaaatgacagctattccccataggtgttgatggatgcaatatcaagggcttattaccaaatatttataagaagatttaagaagtgtcatttaaaatattctatttacttattgaagtaatgaaaacagagtattcatagaaaatgaagtagacagtaatatgctatttagctaagtggtaaataccattaaaaaacgaattgccagacaggaaggctagatttgaaactatatgctgtataaaaatataagttaaggagaagtgattaaaatgtaaattacttttctgaaggaaatagagataggtaacacctaaattgctaaattgtgaaatatacaaaaatagttattagctgtatgaaataaccccatttatattggtatttttacatttttatacgtgcatattgtgtatacaatttgagggggctgattataatagataataaaaagcttgtttaaaaagggagattagtagaatgctatacaaaatgtgattgtttaacagatatttctaactgattataaacaattttcttgcatccagtgggattttgcaactcatagaaaaacctcagtgaaattcactgggtaagacacatagataagtcattttttttttcattaagtgtggataatactaagttactgtaatttttcttaaaagactttaaaatacctttgttattttaggtagtttttttgttttccaaaggccagtttttgtttaagtattaaagcttctgtgtgtgcctgtagcaggacgagccatggacaaaaccccacagacaccgaggtagtgaaggaagtagcttttaatcagctgaaagcatcagcagactagcatcctaaaatccgagcttgttgagtgcacaatttctgtcccttttgagggctcataacactaaagattttacatgaaagggccgtgattgattgaacaatctaggcggtatgtgacaggggctgcaagcaccagcaatcagagtgaaacagaacagaatgagaagcttcagagtgtccttccatacaatgtctggaatctgtggataatatcggttgctaggtcatgggttgaattttaactatcaggctaaggtcaggcaggcccaggcctggttttgggtctggtgcctggctctgggctgcctgcctttggtttcacttccttgtttcttcttaaagcaggtactgaatataaaacaatataaaacaatatggggggatctctttctctcttctttcatttcccacctttgagactctcactcattttattagtgggaattctcactttcattttcactacttatgtcttcccgtgcaatagattgatagtgattcatataatatacttgtgctgaagcattctggtgaactaaggtaatgatgaagctttttatcatttgaagaagtacaggtagcaaacaagggagtagtaagcaggttcctattactattataactcctatgataagagttttaaatcctcctattgctgggaaccaatttccaaacatggccccaggatcaaatccgtgccacacttgcatgggtacatgtgccagttttgttatatctttaaatatgtcttcaactacttgcccttgatcatctatgtggaaacagaaattagtaaggttaaattttccacaaactcctccttcagctgctagcaagtagttcagaactagtctattttggtagatagtattccttatctgagtctcttgctgggcaagaacagtcaagacttgacaggttttattagtaataatttctaaaacagcttgcaaccgtatgattcagttgagcatgaagatgggggtccgatatccccatgagccatcttgtgcccaagtggtgggtccacagtattgtataattctttcagggggccattcatcatctttccagttacctatggctatgcttcatttttcgcgggaagcatagacagggaatcctaggagtttgtctgtttttatgggcagtaggaagaaaggtggtgtaatagtgccaattacacagctacctgtccactgatcaggtggcttagcataggctctatgtccacatatccagtataacctgctgggggcaatccagtcctggcggaattctgggtgggctcaaacagtctgcaattttggaaatttactgaatggatttctttctgtgtaattggaactccaccatgtaactgtttttgtggtaccattatacagtttttgtccaagacacctaagccttactacaggatgagtgaattcttttccttctctagctatgcaatattgtccaataattgaggcttttagaacccagaaattgtcagggtggttcttttgggctgggaattcatcaggaactgggtctgcaggaactaattcttgggcttcccatggccactgatctcctgttacagttcctccacaaacataccattaagtgacttagacactgagctacatgctcggctaattgcaaaaacaaatttctagtttttcctggaatttcaggtactggcacatttagttcatcatagaaagtctgaaatactggctctggagagcattttcgaatctctccttttattaaaatatttacctcagggtctagtccttttccatcaatgcctggagatacgtactctccttttctccattttgggtccaaggggtttgtgattactaattcttaaaggttgcagcttccactcatgcaggaggggcttcctttccctttttggagccaaacaggatcttcttcatccttttcccaagtagcccaaatgacacatgaccagtacccacatttttttccacacaatcctacagatgtacttattttcggtcatgtatcttttttcccaattaaaagagccacatcctgctcctagcttatttctattaatgacagcacaagcgtcaaattataagattatgcgtttgggcacccctttttcttctgttctggctaatactttacttgtatcatttatgagtcctcactagtcttcagtccttaatctgatttcaaaaactatggaaatgggaggttcagaggggtcatagcacacgtcaggctggtcacttcctggattacagactttgtactgagtgttattatacaaacatgttccttttggaattactaggcattcataataactatagaacaaaaaaaattgtcttaacgtgttgtcctacctcagtgacctgatatatgcactgaaagcagtcctctgtgtgggaagaagcagtggaagcttttaccacaccagtccatgttataaggaaaataagtcccacgactattttcctcatgcttcagccatgcgtagaccagtcagcttccgggtgtgactggagcagggcttgtcgtcctcctcagggttactttgcagggattgtctaggcttggtttggcctcccaggttccagtggctgcgggctttatgtggctgtggtgaatccaggctggaattccttctaccttcacagctgtgggagtggtcaggataacggtcttgggtcccttccactgtggccgtaagggagctacatttcagtccttgatccacacacggtcacctggagaaaaagggtgaactggggagaataagctgactgagcacctctcatttacccaagttgagattgtctgggtaattttccccaaggcctgtaactgtctctgcaattcaatttcatccaactcttggggagtacctggaagtcctcgcggtataggaggaggcctatgatataatgtttcataaggggagtatcctgttttcttagagggggtgcacctaattttaaataataccataggaagggcctgtatccattttaatcctgtctcttgatatactttccctaaactatttttgatagtctgattcatttgctccacctttccggaactgtgaggttggtaggcggcatgtagcttccaagtgagtcccaatacctttgctgtcctctgtactaagtcagccacaaatgctggcccattttctgagccaatccgtagaggcagtccaaacctagggatgagatctcaaagaagcacatgggttacttcatgagctttttcagttcatgttggataagcctctacccacccagagtaagtacacactagaaccagtaaatacttgttacctctgcatttgggcatctctgtgaagtccatttgaagatcttcaaagggagctgctccataggcttgtatgccaggaggaacagaggggccttgctttgcattgtgctgtcgacaggtaacacattgctgtgctgctgttttagcaagagctggcaagtgtgagatgtagaaatactggctgaacagcttttcaagtgactcctggcctaaatgggtagtttcatgtacagccagcatgactgcagctcctagcagctgtggcacagctattcttccatctggtaactgtatccacccttcttttattgtttgtcctccctctgcctgaagaaagtctttttcctctttagaagaagtaggcaccagatcaggtgtttgagggagtaggggggctgtgactgatgcccggtaaggagtagatgctgcttttcctgcctctgtgtctgctcaggggtttccttggctcactgaggtggaagctcactggtgtcccttgcaatgcatgactgccaccttttggggtttccatactgcctctaataattgtagaatttcttgttgatattttatgtcctttcccccgaatttaataggcctttttctttatataatgctccatatacttgaatggttagaaaggcatatcaagagtcagtataaatgtttacagtcttaccttcactaagttctagagcccgagttaaagcaatgagttcttccttctgggctgaagtgccctgaggcaatggtttggcttcaataacatcatccaaagttaccaccgcatatcctgcgcatctttctcctcgtggactgatgaagctgctcccatccacgtataactcccagtccactgatgcccatgactggtctcgaagatcgagtctgctagaatacactgagtccaacacttccacacagttatgttcaacagggctgtctgatactgggagtaaggttgcaggattcagagcgttacagacctcaatggttatgcgggggttttcacatagcaagctttggtacttggttaatctagcatttgttagcccatggtgtcctttggtatttgttaaagtcaccaccacatgggggacctttatacttaagttttgcccaagggttagcttgtctgcttcttatgctaacaggactgtagctgccagggctctcagacgtggaggccagccttttgaagctccgtctagctgttttgagaggtaggccactggtcttggccagggccccacagtttgggttaaaactccaactgccattttttctctttctgacacatagagtgtaaagggctttgtcaaatctggtagtcctaaggctggggctgacataagtttttcctttaacttgcaaaagtcttgctgttgcagaggtccccattcaaaaggctcccagttgcccccctttgtaaccccatacaacggtttggctagcactgcaaagtttggaatccataatctgcaaaaccccacagatcctagaaattcccttacttgccttctggttttaggtttcggtaagctgcagatgacttgctttctttctgaccccaggctgtgcttctctttccgaatagtgaatcccaggtagcgtacctgctgtctgcagatctgagctttcttcttggacatcttatactcacagtcctccaggtgtcgaagcagggcatccgtccctttggcatacccatctgccgtggagtgtcctagcagaagattgtccacgtactggagcaagacacagcctaggtctttagcaggaaacttctggaggtctcgagccaacacctccccgaagatggtggggtaatttttaaacccctggggaagccgagtccaagtgtactgagtagtaacacctgaccccggatcttcccactgaaaggcaaacagcttttggctctcaggagctagtctgatgctaaagaaggcatccttcaagtccagacaagtgaaccagctgtcctcagctggcagcaatcctaacagtgtgtaagggttaggaactgttgggtgtagagtcactgtagtttggttaaccaagcgtaagtcctgtacagttcgatagtccttggtccctggcttggggacaggtaggaggggggtgttccatggagattgtcaaggaactataatcccaaaagctttcaagcatgtaagatgaacctgtattccttcaagatcttctctgggaaccggatactgcttttgtctaattggctgagccccaggcttaacttgtatgagtactggggcttgattgatcgtcagccctggaggattgtcctccgcccatactcagggccatcgcttagctagagccggttttatctcctgacctggctcggttagaaaaagtctccattcttcttctcaggggactgtaagggccatgataactcctgttcctggtaacttcagttgtaaagagccctgttttgtaaaggaaatggtgtctctcagcttactaagcaagtctctccctaaaaaggcaaggggcaatcaggtatatacagaaattgatgagtcactttatgtcctcccactgagcaggtccaaggtaggcagaaaacctgcttggcggagactcccgttgctccaattatatcaatggtttttttgataagagggccactggggtggttactactgagtgtccggcaccagtatcaaccgaaaacttaatgtccttgccccctattgtcatcctgaccatgggctccttggaggcatttgagcccggtccccttcagtctagtagcccttcgaacagattgaacaaagtcccttcgtctttatctgtggtcttttgctgtgcgtcaccttgcttctcctttagttggagacacttatctttccaatgtcctatttctttacagtaggcacactggttacactgcacatgtgagtgattggactgggcattcctcctggaacccccctttccctgccctttgggggggatccctctaattgccacagccagcaaatcagtgttctgcctggcctggccttcaccctccttatggctttctcagcggcttgttacatctctatttacaaatacttgatcagctatctcccgtaactgcgaggtattcatctctgcaaaaacagcctgtttttgcgatttcctccggatatcttccatgctttggctaactaaggccatgttaatcatatgctgattttcaggactatccggatcaaaaggagtgtacatacgataggcctcacactgtctttcatagaattggtctgggcttccctcctttccttggatgacttcagaaacttcatttacattggtggccttctgagccccttttttcagcccttcaattaatgcctcccagtatcgttttaacctctccatatctggtccttcatttggatcccattgagggtctgttcctggcagaacaattcttatgtattcctgaggattttggtaatcagctgggacatggtcctctagccatttagttgccacctggagtatccttcacctttcatctgtgttaaagatgtacatgagtagctggtggtgatcagcccaagtaggattatgagtctgtataatagtttggagcaagtcaattagagcttcaggcttttcagtgtaagatggaatattatttttccagttgaggaggtcagcagaggtgaaagggtaatataaaaagcacacctttccactgtatgtccatcctcatctatcccagcatattgctgctttctcaggggcatttggattccagtattgggccgtaaatgggccgccaagggaggagtttctcctgcagcttctcttcctttcttgtctactctgtgtggtctaggggctgtgggctcaggagtagggggcctttccacttggtaaaggtggggcactgttggtgccatctcctgccatgagtcttcaggctctgaatcagacagaactttaggggctggcttccctcggcaggtggagtgagaactttccttaactaactgtccctttgctactagtactgctgctgcctgtccccttaaccactatgggggatctaaaactagctgtaaccaggaatctatatatgggaactgatctgggtgtcctggcttgccagttactttatgccatacctttgaaaccagagacctgtccaggcttccttctgatggctaacttacctctaattcgggccaatctatttcacacaaagttcttagttttcctggagtcatagtgactccatagtctcctttgaatcctttcttgaaattatttaacatagttcccaatggagtgggcttacattttgcctggcccatgttttctgaagacaaaatatcatgctcacaccacacactcaccacaaaacaaagaacaggtaaagagggcacacacacacctttatcgtttataccaaaacaaaatcagagtaccaagaaattcaagccaagtcaaaaccaaaaccaaagtatcaggcaattcaagtcaagtcaaaaccagaacagaagtgccgacacaggcacaccgtgggtgatcaggccacgcttccacttaaatggagtgggcaagtttcaaagacatgtcttaccaagtttcagatgtccggactccaagtgccaggtccttcccagtgtccagccggtgcctgtgtgcacagttttttaatggcggattgtctttatttttaccctacctcaaaaatgcccaaccatcggtattctgaatattctgtatcacaggtctaaaatcacatgatatgtgactttatatcatgatgaagagaactaataattatggttgaatatctaaatcaggaataaatatttagcttctgaaattctattgaatgtgataagctaatatgaaagacactggctattggaacttttggattaaggctgttattggaagttacagaaactcaggaaccatagaggctatgcaaatgaagtacaaatgtgtagtgatcaaggatcacttttatataatttgcatgactcagatctcttaaagtgatgaacagtcttggcagggataatgttgatcttattaatctgaaattctgaaaaaaggttaatattggtacacttgaatattttagatagtttatactcttataaaactgattataaaaatgcttcttaaacatcagaaagagaattaacactttagataatttctagaagtatttagaaatatgatcaataactttatagacatactcattccattactgcaaaaatccccgcttgtgttttggaaatttttcagttgatgatatttgtgtgatcatgccattgatatttaaaaatcccacttttgtttgtgggattgcaagtacagatagattcttatagacacttaggaaaaaagtgtacattttaaattattaaaatagatgatttatgaatgtatcattctcaagaaaataatgagcatatcttataacctgttatctgttttagagtccagaatgcttcactaactttctctgctggattacagtgtgctgattctccattttctttgctgaaaaccataaataggaaattactgatgatacaaacctcagagacttaaagaaacataattagagacagttgaaaaaggcagattgaaaatcaatgtttagttaagtactcttttcccagccctgttttatatttacattcattaatcattgaaaataatacttcaagattctttattgatgtaaagtatcatttgaatatataacatcctaaagaaaggaattattttattctgatagtggactttatgcctttgctaatagacttggatagactttgcattgtttatcttttgaggaattaaatatttctacttgaaattgaaaatcattttaattctctccaaaagagaaaattctgagaatcagataaattatattctgaatttcaaagtaacttgccaacctgcaacattagcacaagaatgatttcaactggaacaaaataaaaatcacaaacaatttctctttccatttataacttaattagaattatgaatcagactactttaggactaggttattgcttgagttaagcaaagtcactcttttctcttgcccaaaagatcactggagataatttttttttttttttgagatggagtcttgctgtgttgcccaggctggagagcagtggtgtgatctctgctcactgcaagctccgcctcccgggttcatgccattctcctgcctcagccttctgagtagctgggactacaggcatgtaccaccacgcccagctaattttttgtatttttagtagagatggggtttcaccatgttagccagggtggtctggatctcctgatgtcgtgatctgcccgcctcggcctcccaaagtgctgggattacaggcgtgagccaccgcgcccagctgagaattgtttttttaaagggataaaagaagaaaaatacacaacttccaagactagaactaaaattgaagaaaatgtactattcttggaaataagagttagcaaaaatcattaagcactattgttcccttaaggtctagtattttgtataatttggaaattataggagataactatacttattttatagccttgtgcattgaataaaaagaatcttccataagaaattgatcatgattacaagttttctttgataatttttgtgcaaaacttgcttctacttgtatgttttctttatggtctaatatgcagaatacactatcttgaatttttctacttcagttcaactttagagatcccattcttagtttctgtatagtttagtagaataagaaaatcttgtataatatcagtgatgacaattttttgggaaatatatagaatttttcagtggtttggtgcctatagcccaccactaagatgtatctgatgaacagtgtgaatttaagatcaagagaccctttaaggactcagtaaaaaatatctcaaaactcagaattgataggcaataaggagagtaaacgatctttatacttattgtcaatgaaaagggtcaaactctgtaaaatatttgaagagatttattctgagccacatgagtgaccatggtccatgacatagccctcaggaggccctgagaacacatgtccaaggtagttggggcgcagcttggttttttacattttagagaggcatgagacatcaatcaaatacatttaagaaatacattggtttggtccagaaaggtgggacaactcaaagcagggggtggggtggggactgcttccaggctatgggtaaatttaaacattttctgtttgacaattggttgagcttatctaaagacctgggatgacagaaaggaagtgttcaggttaagataaaagactgtggagaccaaggttcttttgaggtcttatagtggctgctcttagagacaatagatgacaagggtttcctattcagatctttaaaaggtgcagacttagttaatctctttaggcttgggagggccaggaagaaaaaaaactagctatgttagtagagattctttacagatgctgattttcctccacaaaagacagctttgcagggccatttcaagacatggcaaagaaacatgttttggggtaaaatattttgattttcttccttgtcttgtaatgttatgccagagtcaggttggaaagtaagtcacaatatatagagttaaataaaacccatctgatgagaatttatgatttgtagggcatgactccccagaccctttatataggaatttgggcaagataaaaaaaaaatcagtttggtcctcattataaatcaacatttaattaaaagaactacacattacaagaccataataattgttcctgtttcaaaagtttgttgagaaaatgagttaatatgcataaagctctttgagtagtgtctggcacataggaagcacccaatacatggcaacagttactattattattattattatttatataatcaggtctttccttcatattttcttctgtcagagagtgtttgagtgtcatgctattcagagattttactgtctgcgttgactagtccacaccatgacaatcaatgatatcctatgccaggtctgatttttaaaggattttacattccaaatcggttctgaggtagcaaatcccaaatatggcaaaaaattctactttggaatctttatttaacctcaaatattctatttccacatgttatattacagatgagagaaaaaatatttaccttttctacttatggcattgtttattgaaggcagtgcttaaggactataggttttgtaagctgtttttcacatcctatatatgttctgggtcatcttcagattggattttgaagatctcttctatgtttgtagatcactgaccttccaagaaatgacctcaaagaaacctgttgatcaagcaaaactaagcttagtagatctacttcagtaagaaagatcacagtagtgtctcaaatggggaaaaaaataacagtacactcagtttaacttttttcttcttctttggaagtgtttgactggttatctggatcagatatatgcctagagtaggcacatagtgacagaaaaatactttgcaagacaaacaggaaaaaaaagagagaaaggaagggaaacaagtgagggggagccagcttctgacagacacaaaatcactgtgggatgataaaacagccttaaatataagaaatccattacatacatagacacgcacatgcatagaaagccacacaaaataatacttacaacaagattaagcagtaatttgagcactaatcaattacatgaagaaacagttcaaccatcatgtttccaagatagagttccccaaaagggacactaatttaaattgtacctggtaggattatgccagttggagacatacacacataagttaaacttaaaagtaagcaggaatttgacctgaaaggtcaaaagaactgataagagcacatgaaaattttgctggggcaacctcttaagaacctggtttaagaccaggttgagcatggtgaaaccctgtctctcctaaaatacaaaaattagctgggcatggtggcatgtgcctgtaatcacagctacttgggaggctgaggcaggggaatcacttgaactcgggaggcggaggttgcagtgagctgagatcgtgccactgcactccagcctggggacagagcaagactccgtctcaaaaaaaaaaaagaccaggttgggggcctgacaaaccctctacctccaagcaaaataaaactaagtggaacaaatgaagacaagattgagaaaggttttgaaaaggtaatcaaagtaatttgtctaaaggacatcaagaacttctgaactcctgagtctttagaactatacctcttagtgactcagagagtgacaaaaacaaacagtagtgtcctaagtaacagagcaggtttctcatcacggataagtggatttgaagttgattaaataatcaaaggattacttaaaaagcattctcattcctaagaggcagaaactttgtatttgagagactgacaaaaataaatttagacccaaagcaggattttcctcacttttgcagtcagacagacccctgaatgggggagacttatgaggcctcagagaaacatgtttcagacagaggagctcgtgcagatcggtttcaattcaccccgtgttatagctctacaattttttcactgttgatgccacaaaagaccagaatgaaaaaaatctgttgattgaacaaagctaggtatgttagatcccatgcaataaaaaaagaacactacattaacaaagtttctgtaagtctctaaatgggaaaattaagggaagatattttgtaagatgttaaaatccaggctgggttagttaaagagaggtattgcaaggttgagaataggcagggattaggcagattttatgacattgtagcttcgtacagcaaggttagagtttgtgatttcagggttctgaaatgaagcatatttttcttgtttatgtcttttctttttaatctggatataagtaagattttgtagctttacagcggattttacaaagagatgaggaccaagaaggattacagtagaaggattttgacttttgaatcaatatgcatttagatgtcgtttttataaggcacataagttatttttagaatcagttaaaccttggagatatttttatttgaaaaggcaaaaaacaaatgataatatttattttgcttcatcacatatttatttgaaagtatattcataaacaaacttacagtgtttttgtgtgtgcaactgatcatgtaattatttcttgctctttaactatgtcaattaatataaaagaaaatactactccagatggttgaactgattcagcctgcttttatcagaaaagtatttattcatatccaaatgaggttgaactcttatgattcccttcttaattacaaatagaagctaattgccacctcaaaaatatagagaagaaaacaaacattttcattatttgatacttatcatatcatagtaagattttttttctgttttggtttatattttcatattgaacaaataatccttgtgtaaactatctacactttttaatttttggcattgctgtgtaacgtatttagttcctgtaaacccacaacggaaaaacactgctcttctctggagaactttgctgcccttctctcagcttggaaatagatctccaaatttcttcccattccttagtcatctctccttcgaggtcatttatttgacattaggtccattctctgttcacatcctatcctccaagcactttgaaacaatctccagccattggtcgtcactcagccccatgaaagatgagcacttctgatgagtttttaccattgtcctttaatcataccaaaggggcccctcagttccttcccagtgatcaccacatcctcacctatatgtcatcggaaccttttaaataagattacctaataatgaaaaaaatgcatttctaattttttagctcctaagaaacattgtgttgtcaaactattatataaacaattgtctcaattagattaaaatccaagaattagagactgttgcaggaagtcagggaccccgaatggagggactggctggaactgtggcagaggaacataaatcatgataatttcatggacgtttatcagttcccaaataatacttttataatttcttatgcctgtctttaatctcttaatcctgttatcttcgtaagctgaggatgtatgtcacctcaggaccactgtgataattatgttaactgtacaaattgattgtaaaacgtgtgtttgaacaatatgaaatcagtgaaccttgaaaaagaagagaataacagcgatttttagggaacaaggaaagacaaccataaggtgtgactgcctgcggggtcgggcaaaaagagccatatttttcttgttgcagagagcctataaatggatatgcaagtaggagagatatcactaaattcttttcctagcaaggaatattaatattaataccctgggaaaggaatgcattcctggggggaggtctataaacggccgctctgggaatgtctgtcttatgcatttgagataaggactgagataagccctggtctcctgcagtacccttaggcttactagggttgggaaactctgccctggtaattttgtggtcagatcggttctctgcacttgaaccctgttttctgttgtttaaaatgtttatccagacaatatatgcaccactgaacatagccctttatcagtagttctgctttgccctttgctttgtgatttttgttggacccttatcggtagttctgctttttgccctttgaagcatgtgatatttgtacctactccgtgtgcttacactgcctccccttttcaaacccttaataaaaacttgctggttttgaggctcaggtgggcatcacggtcctaccgatatgtgatgtcacccctggcagcccagctgtaaaattcctctctttgtactatctctctttatttcccagctggccaacacttatggaaaatagacagaacctatgttgaaatattgggggtgggttcccccagtaagagactttcagtcttatacaagtcatagttgtgttcaaaataatagctttaagtagaattgctactatacactacatttgtctgctcaagctgctataacaaattaccaccaagtaggtgactttaacagcatcattttaatttttcacagttctggaggctagaaatcttttatgccagctcaaaatcagcaggtttagtttctcctcaagcctcccttcttggcttgcagatgaccaccttcttgctgtgttctcacatgctctttactctgcttatccctggtgtccctttgtgtgtctaaatttcctaataagggcaataatcagataggattagagcccagcctaacagcctcattttatttttctttttggtataaattcatgtggtacaggtgtaattttgttacatgcatagattgtgtggtggtgaagtcagggcttttagggtatccttcacctgaataatatacattgtacccattaagtaatttctcatcatccacctacctcctaccctcttacccttctgaatctccattgtctatcatttcactctttaccttcatatagagtttagctcccacttatatgatagaacatgaagtatttcttttctgtgtcagataattatccttcaaaagccttatccccaaatataaccacattaggaggtcctgggggatagggctttaccgtataaattaggggaggacataacatacactacaagtaatatgactacatcatctgtttccctcaaaaaaagggcttcctctttgccctctgctatttacccaagagcttcttgttctcttcaataactttgaaacttgatcacattcaaattccaaccactaacagtaaacaaaaaaaaaaaaaaataggccaggcacagtggctcatgcctgtaatcccagcactttgggaggcagaggtgggcggatcacaaggtcaggagtttgagaccagcctagccaatatggtgaaaccccatctctactaaaaatataaacattagccaggtgtggtggtggatgcctatagtcccagctactcaggaggcagaggcaggggaatcgcttgaacctgggaggaggaagttgcagtgagatgagatcacaccactacactccagcctgggtgacagagtgagaatccatctcaaaaaaataaataaaaataacaaaataaaaataaaataacccttgtaaacagttccctgtctgcaattatgatattccaagtgctctgaaaactggtttattttttcctcaaagggaggctcaagctagtttgatggtaaaaacctgtcctaaactaaaagacctacttacggtttttgtttttttttcacttcacatgaacatttatatgttttgctgcagaaacatcaaagtgttttgtacagcctgctgctccaaaccttactggggatatttttaaaatgtggtaaatgctctgtattattatctgataatcaaagtaattctgaattaccagatacatttgaccttcagaatgttagataaggaattgtaggactgtggcaagatacatttcactctgaacactagaaaaacagggtcctgtctcttcgccataaaaaatgagttagcatttactatgtgcttatcatgggccaggtgttgttgtaagcactttacacatattcaatcatttaattctccagtaaactttagaaatagtcacgattattctcattttaatacagaagaaatgaaatcagaaagtgtttgaataactttcccgaagtcatagttagtaagcccaggaagccagaattcaaagctagaaaatatgtctccagtgtaaaacttaaacaatacactatgacttataaggagagaaattaatagacataccacaactgaataattctggactaatggcattccttgagagcattaactaatctccacttaactaaacacttctattctctctccctctttttctactctttcccatggtctgtctatcttgcctacctattcattgcctataggtgttatctcatccaagacatgactataactactattttgatgtgctttggaattgttggattacaaagaatagaaacttatgtgtcaggtgcatccatttggtcttggtctctgtcttttggaaaatggacagttatttattctatttctcttttctcaaattccacaccactgtactctgtgcaagctagatagcctctttactttttttgtttgtactttgtcctccatgataacctccaaatgatggtatcagctatctactctatagatgaattataacttctaattattgacaatgtggtataattttcccaggttcagctacatgattcaatcaaatatagccgtgtgccacagaatgacattttgcccaaggatagactgcatagatgacagtggtttcataagactgtaatggggctaccctatactggtgtattttttttatctttgataacatattttcactgtagcttttctctgtttagatatgcttagatacacaaatatttaacactgtgttacagttgtctacagtattgagtctaataacatgctgtacatgtttgtagcctgagaacaataggctataccgcatagcctaggtgtatagtagcctatgccatctaggtttgtgtaagtcgaatctttgatgttcacacaataataaaatcacctgacaatgcatttcttttttcatttgagacagagccccgctctgtcacccaggctggagtgcagtggcgtgatcttggctcactgcaacctccacctcccaggttcaagtgattctcctgcctcagcctcctgagtatctgggactgcaggcgcatgctaccacgcctggctaatttttttgtatttttagtagagatggggtttcaccatgtgagtcaggatggtctgaatctcctgacctcgtgatccacccgccttggcctcccatagtgctgggattacaggcatcaatgcatttcttagaatgtattcccttggttaagcaatgcatgatggtaattatgctttagtaacaggaatttgtttaagaaaaaggcattttctttttctctttttttttttttttttgatgtttgaaaagaagaaaaaattcgaatgataaaagcaccatttagcctatcttttacatttaccaccagtaatataatagaagattctcatgatctggaaatattgtgtgtgggaaagacattaaggcactgtggttagggaagttatgtcagtaatagcccttctagaattaaggttgggcagtgctgggctaccatttccattttcttttgttattttttgatcagtagggattgagtgaggaaaataagaaatttgcctgaaacaagcagtttgtagactctatcagcttttccttttgattttctcttgatttctgccataccgatgtcctgaccatcattgaaaagttagcttctcagttatccaagtagacatccaagtctatttcagtgaagtgaggtgaaagtcttatctttcattgattaaaagcaactaaccctatgaagagagacaaatgttaacaatatagtaaattaaaacagttctctatatattactgatccaatgtatatctaatccattgtatttcttaaatcaaatcattgccaatatgtgattcctgattgtggcctgtaaatctcttttgtaagctatagagacagggatcagataatattctgcaaatgaaaattcacaatatatttgcttgtccatttctatatggcattggggtagatagtcacaaatagaactttgaagagtatcctctaaaatggttgagagaaaatatatggcttattcgaatttgtatttttatttgtaattactcagaatgttagattaaaaatgagcaagttaatgaaatacagcaattttaactcatctgcctattaactgataccattgtcaaaccaaatcataagtgttctcctatgctttatataaaaataaattgaaatgcagatttactttatactctgacgtatagtacttaaaaaatttaacatatttgttgaaacacaagcagtcaattttaaggttctgtgcatactgtatacaacctgttagcctcttttttatcaaaaatagacaagtgtttctttattcatttcttgcttccaatggtggcctatcaaaactgttgctttctcctctgacaagttatatttagtaactgtgatggttaattttaggtgtcaacttgactagatcaaggaatacgaagatagctggtaaagtattatttttgggtatgtctgcgagggtgtttctagagaagattggcatttgaatcagtagactgaataaggaagatctgccctcacccagtgtgggtgggcaccatcaaatcagctgaggactcagatagaatgaaaaggcagaagaaaggcagatttgctttctctgttccggagctggggcacccttcttctcttgccttggacatcagaactccagattctctggcccttggactctgacttgtagcaacacccccaccccattcttaggcatttagccttggactgagagttacagcatccatttccctagtcctgaggcctttggactaggactgagccatactattggcttcccttattctccaggtcacagacagactagcaagggtcttctcaagctcgatgatttcttcagctagttcccctaatatatcccctctcatctatctatctattgattgatgtatcaatctatcatgtatctacctacctacctttctacctacccaccaccttatctaacctgtctcctaaatgttctatctctccagagaaacctaactaatacagtaacttattagccctagtatattttctggaagcaaaggtcccaaagattattgagggtaggtagtcctaagttaaaaaaaaaaagtgtcaaaagtgtagagagatcaaaagcattaagtaaagcaaattatcttccaattttgccttgaaaagaatatgacttttttaatgaatgacttttgatggaataaaacaggtgatagtcatgttgaaaataatagttcaagagttggcaacaagaaaatgaatgtgaaaagtgtatttaagaatatggcaaataaaggaatttaaaacaactagatgctacctggagaatatagtaacttcaatattcatttcagagtaattcataaatgttttaatgtagaactccagtcaaataaaactgctaagatttaggcattaatggagcccatggtttcacaaagggtcataaaataatttattagaattttgtatatgttgtattgtttttcagacaaagacatctatgacacaaaaattcattaaattatctcaaaaccaaagaatgattatataatagaaggcaggatagtatattaaactttttatatagcacgtattttggagcttcttatacaagttctgccctttgcttagattaaaactaagcaaattaaagaaatttagcaattttaactcatctacctgttatctgacaccattgccaaaccatatcatcagtgttgtcctatgcttggttatgtaaaaacttagtgaaatgtagatttactttatattctagaaaaatggaatttaaaaaaaaattaacacatttgttgagacacatggagtcagtgagcaatgtgatgttgaacaagttgcctatcttttcatatttcagttgtttcttcactaggaaaaaaataaacttagtgcttgctccttataggattgttatgaatagataaaataaaattgcctataaaaatgatgacctcaatatctggtaccaataaaaatactcactaggaaagttttaaatactgttgtttctgttacttcactttgaattaataagacagtagacattctactcactaagtgtaaagccacttactcaacaccacatcccacactgaatagtggcctattcacggagaaacttctcaggaattactagttgcaaaaatagtacttgacacttatttctgtaatattgtgcttatcacattgtactgtgactttttgtttatctctgtcagtctgtcaaatagactatgagttcctagagaacaatgttttattcaacttatattcataaaacctagtatggcttctaatatgtagtaagtacccaataaatgtttgttgagttgaatgttgtttcttctttaagatcattaagagttgggtttacagcaaatgatactggtttctttctgcatacatagatcattcattcttcttttttttccttttgcctttcatatattatattttggggtcatttagaaataaatagagcagtaaaagttggtaagtatatttaatttaatttcttcccataatatcctacttaaatatatagatgatgataatagttggcacttcttaggtgtatttgagttattaaaattaaaatttgatatagtgagaaaaataagtatatagcctgattttatgggaaccatttttaaatgtggttgaattttttttaatttgacaagtttcataattttaaagctggtgattcaagtgaattttaaagcatgtttatgctgttgcattatggggcaaactcagctggttaaattacccgttatcctttgtcaaaattaaattatacaaggtctgcagacactcatcacttttatctaatgtgaccaccttgaactgtaattcccttttgaataaataaggctgattcaggtggaaagaagattaactgattgcctgaagttatgtaatgcatgtggatttagtacataggttttaaaatgacattgttaaatggtatttaaactaatgtgtaataattaaggaaggacactctttaaaatgacacaaaagtgatatatgaatatgaggaccaagaaactgtgcattggcatatagaaaatattagtcattggacaatacaattaattgatagaacaagtatttttcataatttctgctaacataggaggtgacataaaagggagtaatttgaattttaaaaataaaataaagattgtatatattttaggaggtcataaatttgtaggtattaagtagcatgaataactcttcttttccatcctgaaaactctaccaatgtagagttaatactctataattcatgaggtagtctgtaataataaaacattaaaccaactgggctcttttcccgggaatcactgaagcaagaaatactgtatcaggagaaaggaaaagagaaaaagagagaaagaagaagacaataaaacagaaaaaaaaaaaaaaggaaagaaaactagatggccaaatttaatagggtaaatggaaaagctgtccattttatatgcagtcaaataaaattttctttctaaccttggaagggctactcttaaagcataaaccagttttatgttatgaaaggacattcaaatatgccttatttcatgtaactgtggggaaagcactttatagctctgcctttaaaccttaaagtcagctttaacgtgtttctaaaagttatattccggtattgctgagatattcctatcacaaagctatttccaaagccatgtttgtggtctaagcatgtatctgtaacttactaagagatcgtcctgaaaaattgaggacaagtccagtttttatttttgctcattgaataatgacgtttcctaaagatctttgtcttgtaggccttccttttttgacacttttttttctttttctgagtaatctcataccttaagtgattataaagtttgactgtgttctgacggttcttaagtttttatctaatacagctttatctccagacctatgtatttatttacttgttggatattttgacctaactattctgtaagttttaaaaatttgtacagagacagtgaattgataatctttattatctttgttctttcctccttcatacacaagttctttctgcttagttttctatttcatttaatgtattactacttaagggtcactcattgcagaaaacattgaatcaaccatacttctttctctcttatactccctgttctcaaggtcattatgcagtctctacttcaatctcagttttatttcttcctgtttatctcaattcgtgttgaatgagtttgtgtcttcatcatctctgaaggaaattatgatcataacttcttaattgtttctccatcctctgtcctcttccatcttcagcctctcttctatattgttattggaatataattacaagacattttcatggaagaatattactaccttcccatcacacaaagataagggctaaacttcatcaactgagactttagcaaagaggccttaacttaccattttagaaatatccaaattttctcatctcttcttcagctaagacgtaatgagggaattttagtttttctttaagacccagtacaaatggcatctcattcagcagaagaagttacctattctgtggcatatttgcacttgttatagctgcggctatagaaattattacatttttaaatattaattgccttacatgtgtctgttttactaaatcaagagatcttctagggtagggattgtgtcttttatatctttacaatcttcagaacctgatttaagagacttaagtacaggaagtgtttattaaacatttgttgatacaacaaacgcatgacattgtgttgggaggctctgagttgcaagggagaccttcttgagatttgcaggaattaccactagatgtcactagcacatttctgatagcaatttctcaatcaagaacaactaacctttactgaggacctactgtgtgccaagactttttaaataattctgcaaagcaggtattatcatcacaaatccaccctggagacttacgttttgagtgattagtaggtcatacagctagtatgatgtagaggtgggatttaaatttctgccatcaagcccgtggttttcccacaatccaagctacattctgtttcttttgtgataactgagcctctggcctccgtatgataaatagcatatgctacctttcccaatggattaaatctttattgacaaaataagctattattgagctatctaggcactcacacataccctttgagttaagagtcagtgactttgtttctataagcttttactaaacataaagcaatttatcattcatagaaatcttttaaacatataaatatagattttgaaaaggagcagatagatttttattctcagttatttatgttttttgcaatttagcatttgatatctacatttttttttttttcttttttgatacggagtctcgctctgtcgctcaggctggagtgcagtggcgcgatctcggctcactgcaagctccgcctcctgagttcacgccgttctcctgcctcagcctcccgagtagttgggaccacaggcgcccactaccacgcccggctaattttttgtatttttagtagagacggggtttcatcgtgttagccaggatggtctcgatctcctgacctcgtgatccgcccgtctcggcctcccgaagtgctgggattacaggcttgagccaccatgcccagccaatagctactattaagatagagttgttaattagtgatggacatatccatgaaatacagacactacctccaagcagcttataagcttatgatgtttccttgattcaaagtcaagaaacatcataatactcttactgtagggtgtatttactctgagactttggaatccaaagagcatctatagataccaattatgttgataatgtgacttccattatcaacacttggatcttaaacacttagaagcacattcctaagtatgctaaaggcccactatgttcctgcctgctcagtcaagatgtcatcgtatttttagacctaactctgcttttggagagtcccaataaagacccagaacttgaggagaggtatcactgtagaaaccctttctaatcagaagaaaacactgtcagaaagaatgatgagagggtgcttaggcctgaatgcgtgcatttgaatggacctcatcctgcttcctgctctttgcagttggtggcacaaaagcagttagcaattatacaaatgaaagaaagatgagagggagggagacggctcccgcttctccttatattttacagcttctcttcagtttagtcaatttcagtatctcatcagactaacctttctgccaaactcattggttgttagtatttttgcttctgttattgttaattattaaaaggagttaaatctcattaactgatttaaaattgtacacttatatacaacatgataattttctccacagattttaaaatgtaagaaattaatgtagtcatggaaacagtttatctccttctcttaatattttatacatgccgtgagtttttattttatgggaaattaaattatataaattggaaagttagcaaaataaaagaataatatatttccagtttatttcaaaaattagaaatagttttaacttctaatattaaatatgtataaataatagcataatgtcaaagttgaagggccaattgaataataaattatgttatttctacaaagggatgtctttttagaaagtaagtgaaaatagttaccaactttgtcaatatttgcattgaattatgagttttcaactaagtgagatcattagcaatacatttctcaaataaaatgtacccagtttgtactcctgtcttatcagaaaagaacatcaaatctttttttctttcttttttttctttttgagatggagtcttgctctgttgcccaggctggagtgcagtggcctgatctcggctcaccgcaacctccatctcccacattcaagagattttcctgcctcagactaccaagtggttgggactacaggtgtgcgccaccatgcccggctaatttttgtatttttagtagagatggagtttcactatgttggccaggctggtctccaactcctgacctcgtgatctgcccgccttggtcaactctttttttatactgataaagactagagaaatgttctctgttatgtacgccttccatcttttgctttctacttttgcctggctcagggtacatactaaaaaaaatttcaatggaatgttgaatgcatgagtaaataagttggatatataacgaaagttggagaaagatttggtaatcactcagtggcttcctcctcttgctccctgcctatcctagctttttctttttttttttttttttttcaaatttccattcttttatatatatatatatatatttttttttattatactttaagttctagggtacatgtgcacaaagtgcaggcttattacatatgtatacatgtgccatcttggtgtgctgcagccattaacttgtcatttacattaggtatatctcctaatgctatccctcccccctgtccccaccccacaacaggccctggtgtgtgatgttctccttcctgtgtccaagtgttctcattgttcagttcccacctatgagtgagaatatgcagtgtttggttttttgcccttgcgacagtttgctgagaatgattcacaatagcaaagacttggaaccaacccaaatgttcaacaatgatagactggattaagaaaatgtggcacatacacaccatggaatactatgcagccataaaaaatgacgagttcatgtcctttgtagggacatggatgaagctggaaatccctggctttttctagtgagaaaccaccatggaaaatccaggaactcacagtgtgccgcttgcaagctctgatttagtaaaagagtaacaggagagcctagtgatgagagggcatgctctttggaaccagaatgcccgcgaacaaatccctgctaggtaatttactagctcttgtaataacaacagcaaagaattagaaacagtaatgagcctcagttttctcctccttaaaatgggagacagttgtggtatctacttcatagagttattatgagaattaaatgggccaaaatatgcaaagccattagaacatacataacattttgtaaatgctttggagatggtggttgttgttgctgctggtggtggtgctactgctgtttttgttgttaaagaaaattgcagtttaggaaggataggaataaactatctaacaggctgccttgtttggtctccaagtgataaacaaaaaacagggatcattttttttacttcaacctgcatgaagaattagttttaccgagtgggaagtttgggaattatatattttttctttcataattctaagagggaagaatgggtttaaaaattacttaaatgagagactggtgattttttaaatgttcatcatatttagtaggctactttactagtcaaatttttatatttgtttgctagaaataaatttgcatataaagcctgcttttgagcctctcaatgaatcatacctaaagaaacctccatgcaggttttgagccataaagaaggcaccacctaatggcagaatgttttaattgctagtacaaagctaaacagaaacaatcagcctttaatgttaagcttgcaaatggaaataaaaagatagcattcattacagcaacatccatttatatatgtaaaccttggttccatgtaaatgagccttgaggcttagcaggactagaaaacaattgcagattatgaatatgatcattgaatgtgaggaccttcctgagacatcatagtgttaataccagaatccagtctgccagggttcaaatctagactttacctcttattagctgttgagttggccttaagcaagctatctaactttatgccacacattccttgtctgggacctatgtcagggttattgtagattaagtagcttataacattcttagaatagtatctgatgtagaataagtactatgtaaatgcttattaagtggatgaatagaattactttatgtacttcaattcaatgaagttcataagaagaaaccaaaaccatcttttaaaaatgtattagtgatttactgcgtgtttcaaagtcaaggcttcgaaaggtacctcagttttgtacctttgcgttgtaaggtgtgactttatgttgtcccaaaagccaatgccataggcagaaaaaaaaatgattaagagcatcagttttgtggtgtcaaccacactttaaaaaccctggctttgctactcaacagttacatgaccatagacatattcttatgtttatatgttacttatattatttaaacctattttcttattttcattcatttgtaaacactggaaaatattatcccttactttaatcatccttttttactttctagcaaattcactgtcttcttttccattacccaagtgactaagtgttgccatctttgatattttaaaatataggcccaaaatctattgtaaattgttttgtattaaatagttctaaattttattatgtattaaacagcaaaatgctaacattatgtatgtctggtaaatattttattttcttgtttttgttatccctgattcaatattttcttctaatcgttgatactatgttaaggaaagatgcatgcaattttatgtaaaatgagtgctctaaaaacagaagtacaactttgagaaaatattaaataataatctaactctttttcaccttctttgtggtactctctttctggaagaagtaacaactgtagttatggagactttttttttttttttttttgagacgaggtctcgttctgttgctcaggctagagtgtaatggctcactacagcctcaaggtcccgggctcaagcaatcttcacacgtcagcctcctgagtacctaggactacaggtacacaccactgcacttggctaatttttaaattttctgtggagacaggggctcactatgttgccctggttggtctctaactcctggactcaagcattcctcctgccctggcctcctaacgtgctgggattacaagaatgagccactgtgcctggctgagcctagtcatgaagtctcatttagattggttaacttcataggaaattaaaacactgaagagaaagtaagcttttatgaataaacacatattttatacatcccaaaagaatgccttctgtttatatgaacaaaagcttcattcctaattatacttcagtgctctttctgtctcttttgcataatatctaacttgcaactttctcaatgacataagtgttagactgtgtcattttgaaaatgggtactatgatcaactcttaccagtagtttttgtagaagatgtttctgtggtgaaatttgggtaaattgttcaaatttagaaaccttgataatatagcctcatttcttccacaggcagtctgggtaaggaaaatctgctttgggattctcagtgaatgtgcaagttagtgtttaaaagacaacttaaatttccttccttaaaagaggtgtgaaggagtgagttattgaagttgcaatctgcagttttgatattcatgtataaaaaggggcagatgttcttttctggtaaatcattcccataatacatttgccctgtattcagagatgcatatgcttactgctaagtcatggcagagatttcaggaaaacattgattaaactccactggtgagcaaaggagaaaaaagattagtcacttagaatagagtattattctttcaatcttcttttagcctctcttcttttacaaactgtgtttaattcatactattaagcctaaaatgaactgccattgtaatgtgttttcagatatgcaaaattatatatatataaaatatatctaggaatgttcttagggatttgatacagacaaacccctgagaacatttctagaccacatttttaacatttaacttcactcatatttttagattctcataacttctatatactgtatatttctttgagatgttaaaaagaaaataatagttaacagattcaaaatatgcttttataaccaaaacacagttgagtcaattttttcaaactgaagttaactgtagatgtagtctgagaagtcatttgtactgattagctgtgtataaatagaaaaaaattgaaatgtagggctatttactatgtatataagtatatagggaattaacaggactgtcttcaaaatgaatagagattagtatattactaagtaggcatatgacaagtatgtagatagatgaatagataattgaaaaaattatgcatatattgtgtagtgtgcattttatatgtataaatatgtgtgtaaagcatattttttaaaagagaattcttattttgtataggattttaaaaagcagttaggaagatttgccatggatggggacagtttggaaaagtggagggtttacaaccctatggagttttataaattatctagttctacctccataattttaaagataataaaactgacatgtacaattgagttatatgtgatgactaaaatagtttgattttaatatagagctattaagccatagagagtggggtatggagattagaatacttcgattgtttaataataatttgcataatagtgatttgtatatctcatttaagagtcaatgatcataccagttcccattcattaattcaatattaagttcttgaaaagagctctaaaagagttaaataaactttgaaacatgatacttaactagaataaagcatagttggagcaaagtgtggctgtggtttatggaagtaattgcatgagacaaagagacagaggttctgctatataattacgtggtcttatatcagcatcatgatgatgatggatactgaaagacaatgaggtcagagttaatataaaggatgattttccacctcttagagattacttcagtattacttgaaagaaaaatcaaagattattgcaaggttttaagtctgagtggaagggctaactgtataagaataaggaatctcagaggaaagctaaaacatgggatgatactttagctttaaagttttttttgaaagattacaggttgagtacttgtgaaaattcttcctacttaattcatgagaggaatctatgtcatgaggcgtaaaaatttgagggattattctgggaagtcatctacagacagagggtagttgaatccaggagggaaaattatcttcaaggtgtagagaaaatgggccagattactttggctggggcctgggctatgtttataagtccgaggtgatcaagaagaggaatctgagatggaggtagaaaaatgatatccagaaactaacaaaataaaaccaggaaaatcaggggatgtgtttcaagaaagaggggatgacaagttgtcttacaaaggagtgaatgagtacttcaaaaacacctgctctttttcatattctagataaacacctctcttctctctccctcctgctttctattctgatttggaaaagggtcatatagaaatggatgtttaataaaaaacattttgacagtttcaattggaaaatttaggctttcttgagtaaattctttatatatgttacataaactgtttgctgacatctttttttttttctcatgtggggattttaaatattcatccctcccctgctccccattggagatttatattgtcgttgaactcagtcatataaagtatttcttgtaacattttccttctcttaccaatttaattattagtttcataatggcaaaataataatgaaaaatgatttatttttgtccctgattcacagttttgaatattaataatactgttagtatacttcaagagatttgtcaaagttctgacacttactgcagtttaccattaagaatctatctactgtgtaaggaaaagaagttgtctaagaggaaactgttcctattttctgttctttatagtagaagtgtatggccgttaattagtgatatcattgtaaagaaaaattacattgaggtaatgcccaatgtaaataaagtgaaaaattttacttcagtatgtgctatgttgttgttaattgaataacatatctcttccaggtttttcaaatatgcactattaacttagtatctaatcataaatatgtattttgggccaaaatattatttatttttgacttttagataaatctataccaagaaataattttttaaaatgtaatactttcctttaaaaagaaagtattataaaatagttaatgtatgctagcactatagttatcatttatttattgagaaacttttggttatagtgtctaccccacctaaaataatttctacttaatttcttttgacatccataatttctatagaaatatagataaatattgataaattatctatggatgtcaaaagaaattaagtagaaattatatatgtgtcactccattttaacatataaaaagtcattttgggcagaagattctgacttatttcagaatgaatgaagaagaaattacttttgtgatttgtttctcctccaaaaataattttgaagttatttggtgacatttttgaaatatccagctttggtacctgacatggaatatggattctaagggactaagcttgactcaggaaaagatgcttgtctttaaaagttattttaacaagtgatccctgattggtcaagatttgcattaaaaaatcaacagtaaatagtgatggttccttgatactatcaattattcttagcctactatctattaactttgtagactcgtagatacagaaataattcttggtcaaacctaagataatttactattgatactcatttgttgagcttaatagtcaataattctttgaaagtatatcattcattactcatgtataacatgtttcagcaacttgacattttttttctgacccttccacatattttgttgcctcagtaatatacaacctgaaaaactatatgcaaatatcaaacatgttttcccttcaacatgattctcccgcaaaatcctatttttaaaatgatgcaaacaaccaaaactagaaaaaggaaaaacctattaaatactgatccaaggcaaacaataaccccaactcatcactataaatatagatcatattccgttggaagtgttttttgctttatcattccaaagatatactagcacattgaactcattatgaagaaggtcaaaaacaaagaatactttttctaatgcctgcccttgacttagcatgttaggaaaatgagcctatacaaaagggatgaggagctgatcacaatgcctacctctcctgaaggcatacaaccaccaaatacaagagtggacatgtgaataaacaaatttcatcttgaaggaagacggtgttaattaacatcttacaatgtataattttctgaatcaattctattgcattacttcaaatgattttatttaaatgtgagcagaaaattcaggggacctaaccaaattttcatatagggcagaatactatttcattgaataaatattaggggaacagtgggataaaaatagagttgggcctttattatgctgcaatcatgcttgttcaatgataccttttttaaagaaagtgtatttcatctcagctattttattatatctgttccaaggagcatacccatgaagtttattaacaaattgattttctttcaaatagcatagttttcatttaatctttctcattttgtctcattatttgcagttcgattagtcagattcattatagcactgtaacttagaaacatgtttcattcaaagaaaagcttatgataagaaatacaaaagaatcagtaaaatatttacccaaatagtctactttttttccattctaagtgcttttcagggaatgagaaaattagtgtagtagtttctaatataggaaattatttaatattaaaaaagatagtcatctttgtatttaattgattaagatacttaaaggctccatgttatagctgctaaagcatggggtcaggaaacctaagccttaactcaaaagtctggaattacaaaacatgacgaaatatttctccattttgtaaattctgactttgattctgggcaaattgcttaacctctcagtgatggtggtttcttatcacttaccgcatttgtgtgaatagagactttcttttagaacaactatgtgatacccataattctaattctttacacttggttttgcattagttgaagggagtttaagttcagtatttaattttgtcactataacaatttacaagaaaaagaataatttttttctgtatgtaactgagacagatttatatatttatgaaattgaagttggtgttttggagctaacaatgatatagtgtcatcctaatttaattaaacctagtactagtctgctggcattctatcagtattttctgccatccattcttttgtttatctaattatatgtcattattaagagctcatatccactgtgagcaggacacactagcacaaattaagttcagtgatagaattgccttatatgattgtatgttttttatgacccctgtggattttattgctggactatgtgactaaagtataaaacttgtattaaaataaaattaatgtatttttccctgatgcataacctatatactaattgttaattattttttcttttctaaatattggtaaactatacaagaatattactgtcataaaaatttcaaatattgtcattagttctctttagaagagagttacatctgtgcaaccaaacatagtgtaaataaaacaagagaaattctgcattatattaaaaactacatctgatttgaaaaaccgatgcacatctttggttgagactctctacaaacctgaatatataatttctcatacctaatgcctttacatattatttttttcccaaagtgtagtgtatttatcctcatgaacagtttccatctagctaactctgaggaagacaggacttgattcaagcttccccatctccctcatcccattcagactgacttagctgctgcttctctgtgttcccaactcctctatactgttgtctcaattgtggtacctactacgatatatgaatgtacctgttttagtttattatcttttcataatttgataaactctttgaatatggaaccatgtcttattcatttttatattccagtgcctagaacaatgtttgctatagaagcagacactcattaaatgtgtgtgaaaggatgaatgaataaatcaacaaagatttttatggttgttttattaagtcttagtaatcagagtttggaagtgttagcatcatgagctgagagagtcaaagtctttttcctagatgaatttaaattttatgatattgaagcttgatctactttaatttttttcactgacttctcttaaacaagagagcagcttcttttgaactttctttccctacatgttacttgtgtaagtgaaagcaagattaacataccttttaacttcttggatgtaagtcctataaggattgaaaatatacatagaaataaatttatgattttatttcttttatactttaaaactattacatgggattaaaacttgcttctacttcaatcagtatatcaaatttgtatatatatttaggtatattttaaaaaatgaattacatcaggatttatgaaataattactacttgtatacaattagcatgacacatgttgtgtgataatgtatatatggggaataaattctcattaaaactgattaatatagagaagctcacttaacagtaaaatctaatataattgctactaaaaacattgcatggcaattttatttttagtagtatggaagatttttataaacattacatatcaagaattcccacagtgaatagtaaaatttatccctcattagagatccatgtctagtctgcattaaaaattggcagtatatgaacattcatgtttataaggcagattaattaagatgtgtttgctttacaagaggatgttttgtgctttagaagatatttcttacctatctaaattccctaatgcctttacaaaacacatggattttgtttgaaataccacacacaaaaatttcagatatccatctgttgtatcacaaagatgcatgatttaacatagcccaggagattcatccaaaataggcctattttatttcttgaaaatagatatgaagtagaaaaagggtatacattttcaactttaacaccgaaaaaaatgagaattattgtacataattgtaaaattttaaaactaccaacataaaccaaaaaaagtgtatttaacacaggcacaagaattagttttttaaaaaacttatttcaatttcacaggtttaataaatcactacaggcctagtgaaagactgggtttaatccaagaatatattaaatatacatctccatttaaaaaaatttgctttcatggaaattttatgtagcaaatatactgaatgtatattccaatatacggactcttgatttacactcattgttattactcacaggggaaaaaagttatagataagttagtatgagacttatgtatatatttctatctaagataaattttttgtatataaagttttaaggctgtcattttctaataataaaagtaatgtcaatttatcattcataagtttaggaaatgcataagatttaacaactaaagatgcctctgttaactccctgatgagtaggaggctacttttcaattttctattttacttacacaagaaaattagtaaatttagaagaggaaacacaaccataacctcaacaaacaaggcaaacttaatgactgtccacctttcagaaacttttatgctttcttctgtctctccatttgtctatgtatgtgtgtaatacaggctcataatatatggatttttatgattctctaatgataagaatttccaaatatgtgtcagtgttcacattaaattagaaaaaatatttctgcagcttatttatcataaaataaataatcatagaagtcagagaatgttgcaagaatgaagttatatggtctataaattagataaaattcatgtgatttgatttgttacaagatagtaatagtttagaatggcagcatataaattatttaaagatgttttacatattctgttaaagaatagagtagatgagaatagacattttcatgtgaattttattgaagaaaagcttagtcaattgaggtaagagcaactattctgtcacaagtttgggatgatcagatatgctacatttgttgtttactatgtaacactatgtacttaacagcaagcactcaacaaaaatctatattaaaataaagaaaaaaataaacctgggattgaagatacagggcctggatgcagaaacttgaagtggacaggattggtttttcaggattttttttttccacccaggaggcaagtagaaccacaaaagcaacaatgtctaagaaaatgccttatgacaaagacaatttattttctgttgggaaacagctctttgtatttgactcagtccctgtttctatcatcatccctggacagcaacaaacagaactatgtatcatcgcatacaaagtacaatcagagaaatatggttggccaaagagctctgtgctttagaatttgaatctgtaaatactccacaaatccctgtgatagtggtggaattctgaatgcctatgattcagaaattaccaagggcactatatggataaaataagtccaggaaatatgtgaaaaaaattgagagatcctgaaaaatataatcagttctactattcaggagattgtacttctacttcaaaacaggttcctgtaaccgtagagaccatgtgccaaataatcacctcccctcgtttgtcattctgctgcaggtgcatttcctcagaaaggccacaagcttaagtattatcattcacacagagatcaatttattttgacagcaaagtgttgcaggcacaaatttgcatttgcagtatggtaattttttaaaaactctatgaattggagattttgagtgccctcactatttttactaccttttatgcttgttgctcctgaaaaaataaaaaatacaagagaaatgtcctcaattcctttattaagtattatacagttatatttattttgcaaaattgctttatagttaatacaatattttccaactcagaatgtttctacctcctggaaggataaccaagaatgtactgactggtcatgactaatcgaagaattaggcacatttatttggttcaatctagcaaatagttattgcatgcctactgggtgtaaggcactgttatagatgagttggaatatggatgcatctcaaatggcaaaaatgctattgcttctggggacaaataaggtcacattagcatacatgctcaaatttccattgcactgggacactcccagatctcagtccttttcaaaagtcccctataatgtatttctggcatgctcaggggagtctaaagtgttcaaccatgaatcttatcctgttagtcctgctgctgctcccccacatgccactgtggatgtcagccatgccatgtctgttatcaggagtctgctgcaggaatttcacactctcattgttactttccacttaaatctgcttctacccaggcccacgtgttcttttctaatcttttccttcagtttctgcctctaactcctctctctgcagtgtcagcaaagacaaaacaaacaaactaaacccattacaccctccttttataatcattacagcttccctcattccaagtggttattacattaaatttcattctcttcttcaactttaaaaggaaataatttgcacagttttcaaagacagataggtgtaaacccctcattttatcagtcacttcttgaattttcttccctctcaactaaaacgacccccattaaacaaaaagaatttataatctagtggtctgattggagaacacaacaggtgtatgcatgatgtaattgctaagattatacatacatagtttgttttggaaattaatacaaaacaaaacaaaatcaggaaattatgattgttcctaatcctaacggcaaaatcagagaatatgggttggccaaagagctcggagtgaggaaagtgagttggcaggcatggttcactcaggttacaatacagaagacacatagaagtgaaagggcctgtgactctgagtttatgaatgttctctgtgacagcaggctaaggggaaagtggtcacgtgaaaatacagttagactagagcaaggctgatcattcaagatgacttacattctacgccaaatattgtgaattttctcaggtgggtaactagggacaacattgggaaatctgaatagtgtaatttatttatgcatcaactaacagaagacctaactgaaagaaaaattaggacatccattatctcacgtaacaagaaggtatagcgatataaggtggattcagggatggtgaattcaatcactcagtgaaagcatggctttaactctatttctctgcatttgtttctccttataatttctagatggccgaatttcaagcatcacattttcaaacagtacccaaaggaaggatcaaagcttttttcctgtgttttttattaagagctttgcctagaaattttacccagtaaaaaacttctgtctgtgttagtttgctgaggatactggcacctgtatcccaaaacttaaaaataataagtaaataaataagaaaatatatgtttcaatgaccgaaatccttccataaacccactcagaaatgaatcatgattcctagaatccccccaacatgaggctaccacctgatacctgaacaaaatcagggttgtgttagaaagaagttggggaaagagctagatagctaattctgacagaaagtaacaaggtaagatctgaaatttagatatttaactatgaaataggatttggcataagttagatggcataagatagagactgggagcaaagaaataagaaaaatttaatgcaataatatgtaagatataatggaaacttaaactaagccatgggaccaaaataagaatgtctatagagagagacgagttaaagaatttgaaatgaaacacagccattaccaaaggactcttggacacgaagagtgggaaaaagacagagataactacagtgttggaaacaaatttagcaacactattaactgagccaataaattattctattctgtaaaaatagaaattatttctatcagcacagtaatatgctggtgtttaccttgagaaaataaatgattttgtttcattccatccaggtggcaaaatgtacccaggccctgtattgattaggaattttcaagttctggacataaagttttctctaagaagtgaatttcttctgtatatgttgtccttttttcaacatgtctccaaattggttgaagaaatatgttatgaattactgtattaaaggctgtggatcacataaatagagctctgtctcttcttaggtatacattttaatatacaattttaaatatgtattatttaagaaaaacaagctctaatataaagggaatgtctgcagtaaggggtactgtagctgtgtccattatatttaaattcaatttcaatcaattaaaataattatcagaccctatgtcagcagatttggagaaaaagtatttaaaaaagtaaactctaaatgacttatttttatatattattttaaaaacattaattaatgtttcaggagcaaagtatagcttatttcaattgactatttttaagtgtaataaccaacatttacattatctttcaatttgaatttataaactctccaacttacacctaaatgtattgtattctctgtgtgtctggataatgaaggaaattgttttttacctgaccaggtccttctcagttctaagtatatgtgatagtgatctgttttattcaccactatactttgtagtttctctccttcttcatcctcatggtaatcttttcctctcttatatagcctttcttctttatatagtaaaatattttatgtaatgaaaagttacatatatggcatactagccacaaaatatatttgatatatttgatgatctcaattaactcatatgtctcagctccttttaagggcttgtgtggtttatgactaagtatctgattttttttaaaaaagtgttacatatagtgagagaagtaattaccaactgttccactatcaggaaggaaataaccaattatcttacataaaatgcaatgttaataataacgagttcaagatctgtacataagacaaattttgaattactttcacttatttttaattaaatatattatttaggttaaaatatttgtatatgtattttttcccattactacatctaaaactttgatacctagtaaaaacagctataggagttcacatactatatttataaaaataataaaaacatataattcatgtggatctgtatatgtttgcatgtatattagagaaaacttaaaaatataattctgtggatctcaatatgtatacacagattttagagaaaacagtgttccagagacacttattatttttgttctaaaaaacaattgtgtaaataatagatgactgatatctaatatgctacccatatttacattttcccaactgttctgaaaatgtcattcatagatggttttattttattttattccttcaatataggatcaaattaagggtgatgtactgtctttagttttcaggtaattttgtctcctttaatctagaacagttctcccctctttttttttttttttgattctatgatgttaatattttgcaagattccacactgttgttgtatagaacacacactgacctggttgtatctgatagtttcctcattgcttcaatcaggctaaacatttgtagcaagactgctacatgggtgatgtgtgtacaagcagtatataatacctttgtgatcaggagacacatactgcattatttaattgtgaagtgtcaaatgtgtaaaactaatttcagatagttcattaaaagaaaaaatctatgtgtatacatatttatatatattaatctattcatcaatctgttgatctagataggtagatagatagatagatagatcttgcattataaaaagaaacagatgcagagaaacagataaagcaaacagtatcaactggtgaatctagatgaagaatctatcaatactcattggactagtctttcaacttttctgatctatttcaaagtaaaaagctggggagaacaatggggtgaaatagtgaaaggcacgtgacacggagtttgatacacagaggtagagtagccattctactgcttgctggctgtatgattttggatgaatcatcgaaaatctctgagcttatacaccttaacttcaaaatgaagatgataatatctagattatatattgttttaaagattagaaaagataaaagttacctgaggttttcagacagcatagctagatttagaataacaaaacaactccagattcctctcaaattgaaggcccagtgcactctgatatcttacacatagacatggaaaatgaataaagaatatattcatcatttttgaaaatgacagaagtttaaattggcttgttgttctattaaagaaatgagtttttcatagttcagatgaccttggtgactataaataagatagagttcaagggtgactagtgcagagttaattaatttaggaaagcaataaaaacccatacaagtataagatgaataaggactgtgaaggtgtacaaaaggtcacagagggcattaacgtaaacacatgaaaaaatgcagcactgcatctaaattaggaaatcgacactgggatatgcaagtgctaatatcacagcattggaaaactctctctggaccccagatttatttcacaattgccctgcaattaaaatgagatctgaagaatgtattcgttaattctgcaggtacaattaccaagcatgttttattttccaagctctctgctggttgcaatacaaaaatgaatgagatgaacatccctcccttcaaggagttcacagtcaagtgaagcagacatatgtaagcaattacagtctgtcttcccttgggttaactactagatttggatgcttattttaaaacagcatctaaacatttatgaagtattagaaaagttttataaaagtagtaacatttaagctgaaacataactttcagtttagaagaaacaatttcaaatgtaagagaggaataaaaaacctatccttgatcttaaaatatatgacctcttagagacttatgattccttactctgcattttcataacgtcaacaagcaatatgaaatatttaccacaataatttttcttcctaacagactgtagatctgacttcttggggatataatccttgctacttgattttgtcagggctttatttatgtttgaaacaaattcattagcatagggaagctaaatgacacatttttgcttagtatttaaaagactgaagagtcttgaacgttgttttccaactaagactttgttttagtgtgttcttttccttgtcttttattctcaccttctcttctttaaataatattcattggttcccttctcttctcttttcttcccttcccttctcttcctaccccctcctcttccctttcctttactttcttttgctttttcttgttttctttcctttttctttcattcctttgaagtagggtctggcgaggcaggaacagaagaattcaggtgtcagaaagtgctaagattgtctgtgggacagaggagtcattcgggtgaggaagcggttcatgaagtcagatattgatcacataggaagtcagcgaatgagtaaatatatttaccataatgggcatctgattactccctgttagagaagaaattttaaaatatggaagtagtgaaggtagattgacgcctctggtattgaactggacttagaggcattggtataaacttttgatttttgatagatgataggtagatagatgagataatgtgtatgtgtgggtgctcataacacatatatttcctaaccatgtcttttgagagggacaagaagcaatatcatcccagaaacagtgattccaccaagcacccaaattttaaagaccattatttactaaaaaacaacagggctcttggaataatttctggttacagggatggggcaatgaaagtttaagataagcctgaagtattttgttttataaagtagtgcttgccgggcatgctggctcactcctgtaatctcagccctttgggaggccgaggcaggcggatcatgaggtcaggagttcaagaccagcctgaccaacatagtgaaaccccgtctctactaaaaatacaaaaattagccaggcaaggtggcgcatgcctataatcccagctactctggaggctggggcagaagaattgcttgaacccgggaggcagagtttgcagtgagccgagatcgtgccactgcactccagcctgggtgacagagcaagattctgtctcaaaaaaagagtagtgctcaaaaaattaaacttggaatccagctttcagaatcttcacccagagttaggaggatcccttgaggccaggagttagagaccagcctgggtagcatagccagatgctgtctctacaaaagaaatttaaaaagattattggggtgtagtggcccatgcctgtagtcctagctacttgggaggctgaggtgaaaggatcacttgagcccaggattctaggttacagtgagctttgatcatgccactcacaccactgcactcctgcaacatttcactccagtcagggcaacacagcaagaccctgtctacaaaaaaaaaacaaaaacaaacaaaaaaacaaaataatcttcagataatctgggataatttgagcatcaagttaaatactggcaataacaaattaaacagattctaacatactgaataaaataggaattcttgagttcctactgatacaaagagacaaatattaggcaaataaatggggagattggaaaattattccttatagtaaagtttcaactaataaatgtagaaacaagaaaatcaccatttagcagtcatcacaacaataattgatgcagacaacaatcttcaatgaatgttaaaattagacactgaaaatttgttgagaaaggaatattttcagtcttaaaatactcctcctggccaggcgcggtggctcacgcctgtaatcccagcactttgggaggccggggcagacagaccacaaggtcaagagattgagaccatcctggccaacatggtgaaaccccatctctactaaaaatacaaaaattagctggatgtggtggcgcatgcttgtagtcccagctactcgggaggctgaggcaggagaatcgcgtgaacccaggaggcagagcttgcactgagctgagattgcaccactccactccagcctggcgacagagagagactctgtctcaaagaaaaaaaaaaaaactattcttacttaattttccccccacttactgactacaaaagaaaaaacagtaactttgcagtgatggttgaagccataatcttaatgaaatatcactagtaattggacaagtcaacatatttttaatatctgtgatgaagtacagaatctaaaactaattgtaaagaaatattagataaatctaaactgaagggcattctgtaaactaactggccatgctcttaaagaagtattacagtcacaaaggaaaggtaagatttaggaactgcttacagttgaaaaaggctaaaaagacatgaccaaaaaagtggatcctagaccagaagaaaaaactgtccacaaagggaattattggaataattgttaaaatttgaatggagtcaatgtgataaatggtattctagatggtggaattgtttttgatgttcatttgctgatttagatgatttattgcagtatggcagagtatccttttaacttaggaaattcacacaaatttttaggggtggtacgaacttatctgcaacttacattcaactgattcattaagaaatattagatgcacagacacctacacatgcacacacatgaagacatatacacaaaagaaaaagcagagagacagaagaagaaaagttgggtgagagagagggaaggaaaggaaaaatgttaaacatacatggctaagatattcacaagtagggaacctgggtgcagcatgaagggagttggttgtattattttcacaacttcgctataagtttattttttaaaaatatcttctaactaatctatatttgatggtcctgtgaatcatgagtatatttgtataaacctgaatcatatatgcaaataattgaatgacttaactgctggggtaatgacatacatacattatgttgccagacatgaaaattttattcttatcacctgtatttattgacgtacaaaagtatgtggtgttatactggtcacagtaaaaaattttagtttccaaatccttattttcttgcatatcaaatccaaatgttttgtcatccaaaattcctcatctgatgtccctgaaccttccagtccagtcacctacctctatctcacatcaacttctcacagcagctacaccaaacatcttgcagttcatcaattaaaacactactcttcacacctcatacatttgccagtgttttttcctttatctacaatgtcctctccttcctcatcctcatcctaccgtctttattggggttgtttccttcaaagatgtgtggactgacagttaatattctgtgtttacctctgttagcaattacagtcatctgttttaattgcctgtttactttgctgtgttatcatcaacctgtgagcatctgtaaattcttttacccagaattctactctaatcttttccatctcccatcctgacctacaatggataccctaaagtctttcttttcaatactatttaatttataagtatatataaaaagtaagctccccaacattgggagaattctttgtgttttccgaatgtaatggatatcttatatttaaactgtgagatagtataagatgtatgtagaaaaaatgaaaagtatgaatttattcaaactttacccaatatgaaatatcactgataattgataaagataggttttatcaaaatctatttattcattttgagttattttatttttacgaaactacttgtgaatcatggttcttatttttttgtaactgtgtcaacttatacaatatgagaaaaactgaggttccctcttcatttttactggctatgacacacacatttgtgctgaaataatttgattttataatataaaaatttaaacttggtagctttctctaaaactaaaaaccctaacttaatagggaattcaaaaattcactttagtgattatagaaatgtttataaaaattctttttttttttattatactttaagttttagggtacatgtgcacattgtgcaggttagttacatatgtatacatgggccatgctggtgcgctgcacccactaactcgtcatctagccttaggtatatctcccaatgctatccctcccccctccccccaccccaccacagtccccagagtgtgatattccccttcatgtgtccatgtgatctcattgttcaattcccacctatgagtgagaatatgcggtgtttggttttttgttcttgcgatagtttactgagaatgatgatttccaatttcatccatgtccctacaaaggacatgaaatcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtcaaagtgttcctatttctccacatcctctccagcacctgttgtttcctgactttttaatgattgccattctaactggtgtgagatgatatctcatagtggttttgatttgcacaaaatcaatgtacaaaaatcacaagcattcttatacaccaacaacagacaaacagagagccaaatcatgagtgaaatcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgccgaaggtaatttacagattcagtgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacaccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaaggtggattaaagatttaaacgttaaacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagaaaaattctttttaaaaaaataagttctacctttattttagattctggggttacattgcaggtttgttacatgggcatatggcatgatgctgaggtttgggctatgaatgatctgtcacccaggtggtgagcatagtacatcataggtagcttttcaaaccttgcccctctcccttcctctttgctcaagcagtccctagtgtctgttgttgccatctttatgtccctgagtactcagtgtttagctcctgcttacaagtaaaaacatgtggtatttggttttctgctcttgggttaattcatttagaagaatgaattcctgctgaatccatgttgctgtaaggtacatgatgttttcattcttttttatggctgcatagtattccaaggtgtatatgtaccacattttttttttatccagtctccagtccaccattgatgggaaactagattggttccctatctttactatttaaataccacttatcgtctattttgtgctgagcattgtgctacatccttcttcagaacaacaatttgaggactcatttttctcaatttataaaagaatcatattagaataagaggctttattatttctaagtgcgctgcgatttgcatttttctcttagcagatattgaacaaaaagaaaaaagatacaagaggtagtgtgatgcagagaaggggacaaatgtagtcattgtagttaggaactttgcaggaatagagtgttggagtcctgaagtgttctgattaataaaagctatctttcaagacccatagcaaaatgcatataaaatatcataaatatttgtgttaacatttaagagtagagctgatatgtgaaatctagaaaattaaattttggaaattatgttaaacacttatctagtgtctaatatacatttgtaatcaacaaaaagaacagtgtttaaaaataagagcaataccaattgcttctctgaaaaccttttgtatagatatgccaagtactttttttcagccagtccattgagactagtttgctttacagcttcttattttgaaaaagtacaaagaaagtacttgttcatgagaaaaagttaactgaggagaaattacatgtaccttgggagtaagttaaatatttcttgtttaattttcttagatgattcttattaaatagttcttttatagatgcacagaaataatgaaaaatgatctcattgacattgtgctttattcctaatgactggttagataattattaggaataaaggtagagtgtatgaaattatttttagatttaaacttcaggctcttaatatatattagaaaaattgttcccttccttgaaccacaccatttatatttggtaatatagtataatgatgagaaaaagataatagaaaagcagaaaataaaaggattttaattcatttttgtgtgattattatagctgcataaattatactaaaatattaaatatattttacttttaagatatcaatttattggtaatattgcttaataatagtcctttaaaactccaattataaaactgttttctaagctcttggtcttccagatttagaataacttttaaaagctgttttttaaaaaatacttaatattttggctattagaatatatttacattcttcttttctgagtctataaaaagtataaaacacaatctttaccatttggaattcaagaaagtattaattcattatgttttattaaaaaggaaatttcttccatacaacctgtacatttctcctagtaaaaattaattactcagctggagtgacatgatttttgcaataaaaattagtagttggaaatcatgttttttcactgattgcttttgatgcctaaattccattcccacatggtatttgaatatagcctgatattaaggaagacatctgattcagttttcttgtcttttcttttattactttttaaatttcaactttattttggcttcagggggtacttgtccagttttgatgcaggcatatattgcacaatgctgaggtttgtgatatgattggacctgtcacccaagtagtgagaagagcatccaataggtagtttctcaaccctggcacccctccttccctcccagtttttatagtacccagtgtctactgttgccatgtttatggtcatgtatgtccaatgtttagctcccacttaaaagtgaaaatgtggtatttggttttctgtttctacattaatttactttttacttaggataatggcctccagctccatccatgttgctgcaaaggatatgatttcattcttttttttttttttctttttgagacagagtctcactgtcacccaggctggagtgaagtggcacaatctcggctcactgcaacctctacctcttgagttcaagtgattctcctgcctcagcctcctgagtagttggaattacaggcacctgccaccacctgactaatttttgtatttttaatagagactggttttcaccatgttggccagggtggtctcgaactcctgacctcaggtgatctgcccgccttggcctcccaaagtgctgggattataggcatgaaccaccatgcctggcccaatttcattctttttttatgatggtgtagtgtctcatggtgtatatgtaccacattttctttatccaatccactactgatgagcacctacgttgattccatgtctttgctattgtgaatagtgctgcaatggacatatgagtgcttgtgtctttttggtagaacaatttttttttcctttgggtaaatactgagtaatgtgactgctgggttgagtggtagttctatttttagttctttgagaaatctctaaactgctttctacagtggctgaattaagttacatcccaaccaacagtgtataagcattcccatttctctgcagcctcaccaacagttgtttttggcccttttaataaaagccattctgactcagatggtatttcattgttgttttgatttgcatttatttgattagagattttgagcattttttcctatgtttgttagctgcttgcatgtcttcttttgagaagtgtctgttcatatcttttaatgatgttacttgttttttatttgttgatttaagttccttatagattctggatattagacctttgtcagattcaaaatttgtgaatattttctccaattctgcagattgtctgcttaccctgtgatatggttttgttgtgtccccacccatatttcaccttgaattgtaataatccccacgtgtcaagggtgggggacaggtggagataattgaatcatgggggcaatttcccccatactgttcttgtggtagtgaataagtgtcacaagatctcatggttttataaaggagagttcccctgaacaagctctctcttgcctgccaccatgtaagatgtgcctttgactgtctcttgctttctgccatgattgtgaggtctccctagccatgtggaactgtgaatccattaaacctctttcctttataaattacccagtgttgggtatgtctttattagcaacatgagaacagactaatatactctgttagtttcttttgctgtgcaaaactctatactttaattagatccacttggtaatttttgtttttgttgtgattgcttttgaggacttaatcatcaattatttgccaaggctgatgtccaacatggtgtttcctcagttttcttacaggattttcatagttcaaggtcctgcttttaaatctttaatccacctagagttaattcttgtatatgtacaagtatacgagaattgaaaagtaggagtttagtttctttcttctgcatgtagttagccagttattgcaacatcatttattgaatcgagagtcctttccttatagtgtatttctgtagactttgtaagagattaggtggctgtagttgtgtggcttttttctgcattctctattctcttccattggactttgtgtctgtttttttaccagcaccatgctattttggttactgtaactttgtagggtagtttgaatttgggtaatgtaatccctcctgctttgttctttttgcttagggttaatttggctatttgaactcttttttggttctatctgaattttagaatagtttttcttaatactgtgaaaaatgatgtcgctaattttataggaacagtgttgaatctgtagattgctttgggcagtagggccattttaaggacattgattcttccaatccatgaacatggagtatttttttcatttgtttatgtcatcactgatctctttcagcagttttttgtagttttccttgtagagatctttcacctccttggttagatgtgtttctaggtatttttttgtgtgtgcggctattgtgaatttgattttttttttttatttggctctcaacttgaacattattggcgtatagaaatgttaaagatttttgtatatttactttgtatcctgaaactttactgaagttgtttatcagctctgggtaccttttggcagattatgtagcattttctaggtataagattatgtcatcagtgaagagagataatttgacttctttttctatttgtatgctttttatttatttatcttgcctgattgctctaattaggacttccagtactatgttgaataggagtgatgtgagtgggcatctttgtcttatcccagggggaatgcctctagcttttgcccattcagtataaagttggctaagggtttgtcatagatggctcttattattttaaagtatgttacttcaatgcctagtttctttagtatttttttaatcatgaagtggtgttgtattttattgaaagctttttcttcatctattgagattatcatatggtttttgttttcaattctgtttatgtggtaaatcacacttattgatttgtgcatgttgaacccacattgcatcccaggaataaagcctacttgattgtgttgaattaactgctttatgtgctgctgggtttggcttggcagtattttattaaggctttttgtatctatgttcatcagggatattagcctatagtttcctttttttattgtgtctttgtcagattttggtatcaagacaatgctaactttgtacaatgtgttagagataagtccctcctttttggtttttttggaatagtctcagtagcttttgtaccagctcttctttgtttatctggcagaatatacaaagggtttttattctttggtaggtattttaaatcactgactcaattttagaactcattattggtctgttcagggttttaatttcttcttgattcaatatttgttggtcatgtgtttccaggaatttatccattttttttctagattttctagttgatgtgcatataggtgttcataatggtctctgaggatcttttgcatttctatgggattgattatagtgtcatttttgttgtttctgatttgcatatttggatctctctttttttctctgtgagtctagataacattctatagacctcatttattctttcaaagaaccaatttttatttttgttgatcttttgtatgaatttttgggtctcaatttcgtttagttctatttggattttagttatttattttcttatggtacctttggggctagtttgttgtcattttctctagtttccaggttgatgttcttttcttaatttgacatctttctatcttcttgatgtaagcatttagcactataacctgtcctcttaaagcttttttttaatgcattctggagattttggtatattgtgtctttgttttttttttatttccaacaagttttggatttctgccttaatttcattgtttttacaaagggcattcagaaacaagttatttagtttctgtgtaattgcatggtttttcagatgctcttcatattgatttctagttttttttctactgtggttctagaacatgcttgataggattttgatttttaaaaaatttgttgagacttgctttatggcccagactgttgtcagtcttaaagtatgtactgtgtgcagatgagaacatacattgtttgattttaggtggaatactctgttgatgtctattaggtctaattggtcaagttttgaatttaagttcagtatttctttgttagttttctgccttgatgatctgtctaacactgttagtggggtgtcaaaatatcccctattattctgtgtctgtctaagtctttttgtaggtctggaaatacttgtttatgaatctgggtcctccaaaactgggtacatatgtgtataaaatagttcagtctttttgttcaattgaaactaatatcgttatgtaatgctcttcattgtcttttgttattgccattggtttaaagtatgttttatctaatacatgaatagtgttccctactctttttttgttatccatttgcataatagttcttctctgtccctttactttgagcctattggtgtcataacatgtgagatgttctcttgaaggcagaaaaaggttaggtcttgttttctttccagcttgtcactctgccttttaagtagggtgtttagaccattcacatttaagcttaatattgatatgtgaggttttgatcctgctgtcgtgttgttagctggttgctttgaagtcttgatagtgtagttacattttagggtctgtgggctatgtacttaagtgtgtttctgtggtagtgagtatttttctttcatttctatctttaaatctctcttcggcgtcactgtaatgcttgtatagtggtaatagactctcttattgcttgcatgcctgacaaatattttatttctcctttgcttatgcagcttagtttggcaggatatgaaattgttgtttgggatgttttttctttaaggatactggaaatggactcctaatctcttctggcttttaaggttcaagccaaggtgtcaactgttagcctaatatgtttccctttgaaagtgatatgacccttttgtttagcttcaattaacattttttcttgcacattgaccttcaaaagtctgatgactatgtgtcttggggatgttcgtctgatataatatcttgcaaatattctctgaatttcttgaatttgcatgctatcctctctagaaaatatgttttccaagtggcctactactctctcctcttctctctcaggaatgccaatgaatcatagatttggtctctctgtacaatcacatatttcttggaggctttgttcattttttaaaattattatttttatgttcatctaactgtactgattcaaagaactggtctttgagttcttaaattctttcctcagcttggtctattctgttgctaagacttccaaatatattttgaaatttctgtagtgaatttttcaattccagaatttcagtgggttccttcttaatatggtgatattggctttccagtctggattcattttttggctttctttcgatttcagcgtttggatttcaacattctcttgaatcttgttgatcttctttgtcaccctgattctgaattttatgtctgtcatttcagacatttcaatctggttaggatccaccagggagctaatgcaatttttgcaggtaaggaatcactcaggctttttgaactgttggcgtttttgtgctgattctttctcatctgagggtgccagtgtttctttgtttctttctttatcttcttcttttttttttgaaattgctgttgtttgtatagggcttttgtttttatattctttttttcccttgagattttcattgtggtgtatgttgtttatagtcaattggctttatttcttcgagctttcagagggccaaggctctgtatgggttttttacgttgatagtttccttcatgggctttcacaggtgttgtaggtgaaggaatttatttttgtttggtggtgtagtttagactgtgacttagtaaatggcacttaagagtaagggtaggctcttagctgcgtgcctgttttgcatttcagtgtgtatgcagcaatgctctgggaaagggagacagagggcaggagaggactccttcaccaagtctgttcctgggccttggtggagcccctttcaattactggcactgtgcttatgtttccttagcctcaaggcaggctttggcaggctgtgcttttctctccattaagaacagttcaagatgaaagtcaggtaaccaggagacccataattccccagggttccactggtcctttgagcttggcagaatcagtgagttttgggatatgtctgcagttggtctggtgatgcggtaggtcaagagtgagggaacgccaggcagggcggtggtttcatgggtgtgcaactggtgtggcactaacagcctggtatttttagcccagttgacagctgtggggcttgcccagctcattctcccccaatccagtgagtctctccagcacctgccccaggagccggcccagccagctacgtttttccacagacttctcttgccagatggctgtgctcttccaggtgttcagagccatggggctgtctgggtaaaaagctgttgctggctaacacgcataccctcctgcaccagtctttcagagggagagattccccgctcccatgccagcacatgaacccactccacattcttgtcagttttctgatagtgggggctcctcctccaatagagatcagctcaatactcttaggcagtgtgcttgaattccctcggggttggagccaggtctacagttttattttctggccccttagggtggagcaccagctgtgctgggagtgatgggggcgggctctctcctgctcccaggcagccagcaaaactctattttaattgttcaccaaaaattcaaatgaaaattaggtaatgtaccatgaaatagttaaatatattcatgataaaaatgtactgtctgttaggagagaaaaaatgatacacttaaaacactgaaaacattaattgaaggaatattttaagattttacagctacagtaactgcctaggcaggaaattctcacatacaacttcttcatttcttaagatgtaatgtttttaatatgctctatatatttctttagtagatatagattttatttaagaatacaaacaaaaatgtatctacctagaattcaagattattttatttgcttgattttaccatagataggttgactagagtagtaacatggaatagagaatcaaaacggctcctatagtgtctttcataatttaagaaaatttatgataatgcaatatatgtagtgcaaaacctttatcatagcaacccttaaagataatttttacattagtgatgggacattgcatcttacaatgcggtctaatccatttttatatacctttaattgttctaaattactctcttcaattgagactcatttattcattgaacaaaagttcattgagctcttaagatataccacgcagagttttcgaagctggaactctattaatgagacaaacggacttgattcttgtgggaatagattaaaaaaataaaataaattccctccttcatttaattagtatttcttgaaagcttactaagtaccagacattcttatttatttatttatttatttttattattatactttaagttccagggttcatgtgcgcaacgtgcaggtttgttacatatgtatacatatgccatgttggtgtgctgcacccattaactcatcatttacattaggtatatctcctgatgctatccatcccccatcccaccaccccatgacaggccccggtgtgtgatgttccgcatcctgtgtccaaatgttctcattgttcaaatcccacctatgagtgagaacatgtggtgtttggttttctattcttacgatagtttgctgagaatgatggtttctagcttcatccatgtccctacaaaggacatgaactcatccttttttatggctgcatagtattccatggtgcatatgtgccacattttcttaatccagtctatcattgatggacatttgggttggttccaaatctttgctattgtgaatagtgccacaataaacatacgtgtgcatgtgtctttatagcagcatgatttataatcctttgggtatatacccagcagtgggatggctgggtcaaatatttctagatctagatccttgaggaattgccacactgccttccacaatggttgaactagtttacagtcccaccaacagtgcaaaagtgttcctattcctccacatcctctccagcacctgttgtttcctgactttttaatgatcaccattctaactggtgtgagatggtgtctcattatggttttgatttgcatttctctgatggccagtgatgatgagcatttgttcatgtgtctgttggctgcataaatgtcttctttggagaagtgtctgttcatatcctttgctcacttgttgatggggttgattttttctcataaatttgtttaagttctttgtagattctggaaattagccctttgtcagatgggtagattgcaaaaattttctcccattctgtaggttgcctattcactctgatggtagtttcttttgctgtgcagaagctctttagtataattagatcccatttgtcaattctggcttttgttgccattgcttttggtgttttagacatgaagaccttgcccatgcctatgtcctgaatggtattgcctaggttttctgctagagtttttatcgttttaggtctgacattgaagtctttaattcatcttgaattaatttttgtataaggtgtaaggaagggatccagtttcagctttctgcatatgactagccagttttcccagcagctttttaaaaatagggaatcctttccccatttcttgtttttgtcagatttgtcaaagatcaggtggtagtagatgtgtgatatgatttctgagggctctgttctgttccattggtctatatctctgttttggtaccagtaccatgctgttttggttactgtagccttgtagtatagtttgaagtcaggtagcatgatgcctccagctttgttcttgtggcttaggattgtcttggcaatgcaggcttttttttggttccatgtgaactttaaagtagttttttccaattctgtggagaaagtcattggtagcttgatggggatggcattgaatctataaattaccttgggcagtatgaccattttcatgatattgattcttcctatccatgagcatggaatgttcctccatttgtttgtatcctcttttatttcgttgagcagtggtttgtaattctccttgaagaagtccttcacatcccttgtaagttggattcctaagtattttattctctgtgaagaaattgtgattgagagttcacttatgatttggctctctgtttgtctgttgttgctgtataaaaatgcctgtgatttttgcacattgattttgtatcctgagactttgctgaagttgcttatcagcttaaagagactttgggctgggatgatggggttttctaaatatacaatcatgtcatctgcaaacagggacaatttgactccctcttttcctaattgaatacgctttatttctttctcctgcctgattgccctggctagaacatccaacactatgttgaataggagtggtgagagagggcatccctgtcttgtgtgccagttttcaaagggagtgattccagtttttgcccattcagtatgttactggctgtgggtttgtcataaaatagctcttattattttgagatatgtcccatcaatacctaatttattgagagtttttagcatgaagggttgttgaattttgtagaaggccttttctgcatcatgtggtttttgtctttggttctgtttatatgatggattacatttattgatttgcatatgttgaaccagccttgcatctcagagatgaagcccacttgatcatggtggataagctttttgatgtgccgctggatttgatttgccagtattttattgaggaattttgcattgatgttcatcagggatattggtctaaaattctctttttttgttgtgtctctgccaggctttggtatcaggatgatgctggcctcccaaaatgagttagggaggattccctctttttttattgattgaatagtttcagaaggaatggtagcagctcctctttgtacctctggtagaattttgctgtgaatctatctggtcctggactttttttggttggtaggctattaattattgcctcaatttcagagtctgttagtgatctactcagggattcaacttcttcctggtttagtcttgggagggtgcatttgtcgaggaatttatccatttcttctagattttctagtttatttgcatagaggtgcttatagtattctctgatggtagtttgtatctctgtgggatcagtggtgatatccactctatcattttttattgcatctattttgttcttctcttttttcttcttcattagtcttgctagtggcctatcaattttgttgatcttttcaaaaaaccagctcctggattcattgattttttgaagggtttcttgtgtctctatttccttcagttctgctctgatcttagttaactatttcttaccttctgctcgcttttgaatgtatttgctcttgcttctctagttgttttaattgtgatgttagggtgtcaattttagatcttccctgctttctcttgtgggcatttagtgctataaatttccctctacacactgctttaactgtgtcccagagattctggtatgttgtgtctttgttctcattggtttcaaagaacgtctttgtttctgccttaatttctttatgtacccagtagtcattcaagagcaggttgttcagtttccatgtagttgaggggttttgagttagtttctcaatcttgagttctaatttgattccactgtggtctgagaaacagtttgttataatttctgttcttttccatttgctgaggagtgcttcacttccacctatgtggtcaattttggaataagtgtgatgtggtgctgagaagaatgtatattctgttgatttgggatggagagttctgtagatgtctattaggtccacttagtgcagagctgagttcaattcctggatatctttgttaaccttctgtctcgttgatctgtctcatgttgacagtggggtgttaaagtttcccattactattgtgtaggagtctaagtctctttgtaggtctctaaggacttcctttatgaatctgggtgctcctgtattaggttcatatatatttaggatagttagctcttcttgttgaattgatccctttaccattatgtaatagcctcccttgtctcttttgatctttgttcttttaaagtctgttttattagagactaggattgcaacccctgctcccctttgttttccatttgcttggcagatcttcctccatccccttattttgagcctatgtgtgtctctgcacatgagataggtctcctgaatacagcacactgatgggtcttgactctttatccaatctttatctttacctttacctttatgtttatctttatctttctctttgccagtctgtatcttttaattggagcattcagcccatttacatttaaggttaatattgttatgtgtgaatttgatcctgtcattacaatgtcagctggtcattttgctcattagttgatgcagtttcttcctagcatcaatggtcttcacaatttggcatgtttttgcagtggctggtaccagttgttcctttccatgtttagtgcttccttcaggagctcctgtaaggcaggccttgtagtgacaaaatctctcagcatttgcttgtctgtaaaggattttgtttctccttcccttatgaagcttagtttggctggttatgaaattctgagttgaagattcttttctttaagaatgttgaatattagcccccactctcttctggcttgtagagtttctgccgagggatccgctgttaggcttccctatttgggtaacccatcctttctctctcattgccctcaacattttttccttcatttctactttggtgaatctaacaattatgtgtcttggagttgctcttctcaaggagtatctttgtggcgttctctgtatttcctgaatttgaatgttggcctgcttgctaatttggggaagttctcctggataatatcccgcagagtgttttccaacttggttccattctccccatcactttcagatataccaatcagatgtagatttagtcttttcacatagtcccatatttcttagaggctttgttcatttcttgttactgttttttctctaaacctctcttctcacttcatttcattcatttgatcttcaattactgataccctttcttccacttgatcgaatcggctcttgaagcttgtgcatgcatcacgtagttctcatgccatggttttcagctccatcaggtcatttaaggtcttctctacgctgtttattctagttagccatcgtctaatcttttttcaatgtttttagcttctttgcaatgggttcagacatcttcctttagcttagagaagtttgttattaccgatcttctgaagccttcttctctcaacttgtcaaagtcattctccatccagctttgtcctgttgctggcaaggagctgcattcctttgaaggcactctgatttttagagttttcagcttttttgctctggtttctccccatctttgtggttttatctaccattggtctttgatgattgtgacataccgatggtgttttggtgtggatgtcctttctgtttgttgattttccttctaacagtgaagaccgtcagctgcaggtctgttggagtttgctggaggtccactccagaccctgtttgcctgggtatcaccagcggaggctgcagaactgcaaatattacagaacggcatatattgctgcctgatgcttcctctggaagctttgtctcagaggggcccccggctgtatgaggtgtcagtcggcccctactgggaggtgcctcccagttaggctactcatgggtcagggacccacttgaggaggcagtctgtccatcctcagatctcaaactctgtgctgggagaaccactactctcttcaaagctgtcagactgggacatttaagtctgcagaagtttctgctaccttttgttcagctatgccctgcccccagaggtggagtctacagaggcaggcaggcctccttgagctgtggtgggctccacccagttgaagcttccctggctgctttgtttacctactcaagcctcaggtatggcaaacgcccctcccccagccttgctgccaccttgcagtttgatctcagactgctgtgctagcagtgagcaaggctccatgggtgtgggaccctctgagccaggcacgggatataatctcctggtatgccatttgctaagaccgtgggaaaagtgcagtattactgtgggagtgacctgaatttcctggtgccatttgttacggcttcccttggtttggaaagggaattccctgaccacttgcgcttcctgggtgaggcaatgccaatgcgttgccctgctcctgctcctgctcctggtccttgggttgcacccactgtcctgcacccactgtccaacaagctccagtgagatgaacctggtacctcagttgaaaatgcaggaatcacccatcttctgcatcactcacgctgggagctgtagactggagctcttcctatttggccatcttggaacctttttcccagacattctttttaaaatgatagaaagaagtaaaccagtaactatgcatatgagatgaatactggataatgataagagctttacagaaaattaaaattgggtcatttaaaaatattgatgcctgattttatgttactctatatcaggcgcagttttaagtgctcatttaatcttttgaactgctacatgtactatattaaggcaatctcccatttacagatgaggaagtaggggcacagagaaggatgccacctttctaaaatcacatagctattaagtagaaaaggcagaattcaatctcaagcaattttcttccaaggccaatgtttattattaaagtaacataggcttttctggccttaaaaaaaaaaatcctaaaacctagaggcttaaaagaatatcccataattctttgggcttgtcataatgattttgagatgcctattaggtatctatttggaaatgtgatatggtttggctctgtgtctccaaccaaatctcaccttgaattgtaataatccccacgtttcatgggagggacctgctaggaggtaattgaattataggggtagattttgcccatgctgttcttgtgatactgaatggttttataagggggagttcccctgcatatgccctcttccctgctgccatgtaagatggctttttgctctttcttcatcttcctccatgattgtgagccctccccagccatgtggaactgtgagtccattaaacctctttcctttataaattacccagtgttgagtatgtctttattagcagcatgagaacggactaatacaagatatcaagaagaactttggaaataggagcctgtagctctattgagatgtcagaaataaaatacaatttgggagtcatgaacaagtagagagggtcaactttccatatcattttcatctaatgattctaattttgtcttatgaatgatatagaatgaattacttctctcttttacttgctatatcttcacatatttgaaaatacatggttaattatatctccctttattctattaatctcttgcagaaactatcaaaaaaattgtaagatagaaaagataacaggatattgaaggggatggagaaacagtaaaaattaatgtaacatcgatatatacagtttagaatggttgacagttttccattaaagggattcaagaacaagaccatatttggttagaatcatagaaacttgtgttttatcacatccttaaaaactgaacactgatattaagaaatactaagtattttaatataatttacattattattattttaactgtggcaagaaaagtgttattaagaccctatgttttagaaataatgctgagatattcatggatgagtgaatgtaatatctgagacttgcttcaaaatagagggggtagatacttggggacataagtatataatattgtttatgttgataatatatgatattgataattgttgaagggaggtgatggccaaataggggttcattatatctactattgtatgtacttgaagtatcccattacaataattagagtatattacagataaaacactaacaaataataaatgaaataatccttggactttacctagtgtggtcaaccattagatgcttatttctactccacaaaatcactattacaccatcatttgctctgtccttcactttaataatgaaaaactccctacttttaaaaaaattttacaactgttctgatccttagaaatttactttttatgttgtcataaatgttgtctccccagaatttctcatatttattctccttgtttttcaaataacttttagggtcatcaaaagaattaaattattagaattaaattattaaattaaaaattaaaattattaagttaaaagaattaaattttaatttaagaaaagctttaaaatattcaaaaattttgagcaatgatgagggtccaactgagatgactaaccataaataaaagctgtaaaacaggaacttcttcatctttctgaaatcaaatccgtaaatctttcttcatttgcatgttttctgtcttctctccttttaaatgccagacaccttccttctcttgtcacaacagtttcttcacttatgccctagatttcatttgctgccaccttttctgggatgtattttgggttattattccttttcctgcattttcaccttattcctgctaataatttcttctcattgggacatactcttatagcagtgatacttacaaaaaaagaaatccttccatctctatattttcttccatgtacgacgttactgatggtcaatttactcttcaatctcattgatctggcttcagtttcaattgtttattgtagtggattctttcaaggacatttaatctgtgctagagtcttgtgcagttaacctaacactagctcagatctctctataattattgtataatttgccctctagaaaaataaactactctagatagaatgatcctaaattcatctgtttgtgttgatgtctttcagcagccaaaacttatgttgttgttattcgaaatcagacttatttaccagaacttaaatactaatagtcattttaagaaaattttgagaaagtgcttaatactgtaagttgaaattaagaagtaacaacataggaggaaaagtaacaagaagaggaaaatggttttattcttcttttcagatgagtaagacagccttataaggcatttctctttatctaattattttgttattagagtcacaatttttccaatagtatctttcttttattttctcttaggatttaaatgtgttatttgatatataatgatactttctttttgtactttgatattcaatgtgcggaaatcttaaactgtctgaacatcaaatacaatgtgattcaacaagtgatagtatgcttcatgtatatttatatctccatctatatggtaatgccagggacagcacttagagtacctgttcctacttggctggatcttgtctttccagaatttgtaagttttattgcaaatgaaatgtcaaacctgatgccctaagtacagcagcgaatctgggaaccctatccccctggcatattaatgttctcctttacaggtagcataataaatggccaaacatctttttgattgtccatgctcctttttcaaagtcttcttatgtttagtagagaataggcaaaggagatctcctaaagttgttaaatcatttcttcaggcaataagagggtcttattcttcatttctacatggatttgtactaaattacagagtaggggttgaaagcagtatattctacttctcagaaagccaaatttggtaaaacaaaatgttgattctgatacttatatctaatgagcctactgtctttgtgatttgaaaggatttgtgctacatcagatgaagtttcagtgttagatttcatggcatcagtattgaatgcttctcactcaaagcaggaaaagaacagtattttgcactttcagatcacttgaatatctctcagttagtattaaatatgctatttgaaggttaaaatataccaatagcactattttatgctttctttttgcctaatcatataaatgtttttacttcatgagggttattcttgttggcatggagtgccctgcaaggcagcatccttttgaggctcaagggaaaaggattatagccctggaatccttctcagaaaaatcagcaactattgtcttcaaatttattcactttatccctattccaaaaatgttttccctcttttgtcattaaaggaaattttgctccactatcataaaatcatatactatatcctctctactgtatggcgcatagtataattttgtggttagtttacaaaaacttttctacgatattcaatgggaaaattgggaaatttaaaacatttctctctccctctctttctgtgtgtgtgtgtgtgtgtgtgtgtgtctcactgggatggacacacaaacgtgcaggcaaacgcacatgcacgcacacacacacggccttgtaagactttagttttgttcactaagggtctcagtaagtctagtttgcacctcaaagtggaacagtgacttccttatttctggctcaatcaggtgaatcacacaaaataacaaataccattgaaacaatgaattggagagtcagaagataattaggacataggcattaccagaagcgaatccatattggcttgctatctcaaaaacatcactccctttaaacatcttaccaaaagtacagcttttaacttttcttattgcctccttattctctcactctaggtcttcctgcaatttaagctttctacagtacagctcggatcatatttctcccctccttaagatttccagtgatttcccattgctcattaaattaaggacttatctgaattttaacatttgagatgttactaacatgcccctcactatctttaattttgtctttttccccacatgttctccgggcttcagcaacttatagttttcatactttggataatactatttcttctgattagaatgagtcctcttataactccgtctgtcaaaatctcaaccattgttaatgcctatattaaatcaatgccatgctgaaaacttttgaccccagtagattggaaaccatattaattatttcattctgtgttccatattgacacttgccttactctcctatattcttgtcatagtgttttccgataaaaatatctccaaaaattagataaatgccagtattaaaaacaagatggcattatgtctgttagtagtatacatgtccttttaagataaatttggaaacataaatattaattattaatatacattaggtattattggatcacagttgagaagcatttttgtcctttaagagtggaaggattcttcccattaatattattttctaattgggaataaatattttccttacattctttagtagtttgtcagaaagaatgtgcagcagataattatttttaaaaattagaatcagtgaatacattcagaaatttactgttgtgtgtgaatataaacagaatttcaaatgcaactgagaaaatttttgatgaacaaaaacataattttaaatataactcaaaatttttgaggatacctaatcaaattctaagatatttttaataccatgaataaatatattatgaaatcatgatttttaggcaataactaaagctaacttttttttattatactttaagttctagggtacaagtgcacaatgtgcaggtttgttacctaggtatacatgtgccatgttggtttgctgcacccattaactcatcatttacattacgtatttctcctaatgctatccctccccctgcccccaccccatgacaggcccccatgtgtgatgtttccaccctgtgtccaagtgttctcattgttcagttcccacctatgagtgagaacatgtggtgtttggttttctgtcgttgtgacagtttgctcagaatgatggtttccagcttcatccatgtccctacaaaggacatgaactcatccattttcatggctgcatagtattccatgatgtatatgtgccacattttcttaatccagtctgtaattgatggacatttcagttggttccaagtttttgctattgtgaatagtgccacagtaaacatacttgtacatgtgtctttatagtaccatgatttataatcctttgggtatataccaggcaatgacatggctgggtcaaatggtatttctagttctagatcattgaggaattgccacactgtcttctacagtggttgaactagtttacagtcccaccaacagtgcaaaagtgttcctatttctccacatcctctccagcacctgttgtgtcctgactttttaatgatctccattctaactggtgtgagatggtatctcattgtggttttgatttgcatttctctgatgaccagtgatgatgagcatgttttcatatgtcgattggctgcataaatgccttcttttgagaagtgtctgtacatatcctttgcccactttttgatgttgttgttgttgttgttgttttttttgtaaatttgtttaagttctttgtagattctggatattagccctttgtcagatgggtagattgccaaaatattttccaattctgtaggttgcctattcactctgatggtagtttcttttgctgtgcaggagccctttagtttaattaaatcccatttatctattttggtttctgttgccattgcttttggtgttttagtcatgaagttctttcccatgcctatgtcttgaatggtattgcctaggttttcttctagggtttttatgattttaggtttaacatttaactctttaatccatcttgaattaattttagtataaggtgtaaggaagggatccagtttcagctttccacatatggctaaccagttttcccagcaccatttattaaatagggaatcctttccccacttcttctttttgtcagatttgtcaaaaatcagatggtactagatgtgtggtgttatttccaaggcctctgtttagttgcattggtctatatctctgttttggtactagtaccctgctgttttgattactgtagccttgtagtatagtttgaagtcaggtagggtgatgcttccagctttgttctttttgcttagggttgtcttggcaatgtgggctcttttttggttccatatgaactttaaagtagttttttccaattctgtgaggaaagtcattggtagcttggtggggatggcattgaatctataaattaccttgggcagtatggccattttcatgatattgattcttgctgtacatgagcatggaatattcttccatttgtttgtgtcctcttttatttcgttgagcagtagtttgtagttctctttgaagaggtccttcacatcccttgtaagttggattcctaggtattttattttctttgtagcaattgtgaaagggagttcactcatgatttggctctctgtttgtctgttattggtgtgtaggaatgcgtgtgatttttgcacattgattttctatcctgagacataataagcaacatgaagcaataagacataagcaacatgaagttgcttatcagcttaaggagattttgggctgagatgatggggttttctaaatacacaatcatgtcatctgcaaacagtgacaatttgacttcctcttttgctaattgaataccctgtatttttttcttttcctgattgccctggcgagaacttccaacactatgttgaataggagtggtgagagaggcatccttgtctggtgccagatttcaaagggaatgcttgcagtttttgcccattcagtatgttattggctgtgggtttgtcataaatatctcttattttgagatacattccatcaatacctagtttattgagagtttttagcatgaagcactgttgaattttgtcaaaggccttttctgcatctactgagataatcatgtggtttttgtctttggttctgtttatgtgatggattatgtttattgatttgcatatgttgaaacagccttgcatcccagggatgaagtcgacttcatagtggtggataagcttttagatgtgctgcctgattcggtttccagtattttattgaggatttttagattaatgttcatcagggatactcatctaaaattctcttttttggttgtggctctgtcaggctttggtatcaggatgatgctggcctcataaaatgagttagagaggaattcctctttttctattgattggaatattttcagaaggaatggtaccagctcctccttgtacctctggtagaatttggctgtgaatccgtctggtcccggactttttttggttgctaggctcttaattattgcctcaatttcagagcctgttactggtctattcagatattcaacttcttcctggtttagtcttgggagggtgtatgtgtccaggaatctatccatttcttctaggttttgtagtttatttgcatagaggtgtttatagtatcctctgatggtagtttgtatttctgtgggattggtggtcatatcccctttatcattttttattgtgtctatttgattattctcttttttcttctttattagtctggctagtggactatcaattttgttgatcttttcaaaaaaccagctcctggattcattgatttttttgaagggttttttgtgtctctatctccttcagttctgctctgatcttagttattttttgccttctgctcgcttttgaatgtgtttgctcttgcctctctacttctttttattgtgatgttaggctgtcaattttacatattccctgctttctcttgtgggcatttagtgctataaatttccctttacacacagttttaaatgtgtcccagagattctggtatgttgtgtctttgttctcattggtttcaaagaacatctttatttctgccttcatttattatttaaccaatagtcattcaagagcagattgttcagtttccatgtacttgagtggttttgagtgagtttcttaatcctgagttctagtttgagtacactatggtcttagagacagtttgttgtgatgtctgttcttttacattggctgaggagtgctttacttccacctatgtggtcaattttggaataagtgtgatgtggtgctgacaagaatgtatattctgttgatttggggtggagagttctgtagatgtctattaggtctgcttggtgcagagctgagttcaattcctggatatccttgttaaccttctgtcttgttgatctgcctaatagtgacagtggggtgttaaagtttcccattattattgtttgggagtctaagtctctttgtaggtctctaaggacttggtttatgaatctagatgcttctgtgttgggtacatatatatttaggatagttagctcttctcgttgaattgattcctttacccttatgtaatggccttccttgtctcttttgatctttgttggtttaaagtctgttttttcagagactaggattgcaatccctgcttttttttgctttgcatttgcttggtagatcttcctctatccctttattttgagcctatgtgtgtctctgcaagtgagatgggtttcctgaatacagcacactgatgggtcttgactctatccaatttgggagtctgtgtcttttaatcagggcatttagcccatttacatttaaggttaatattgttatgtgtgaatttgatcctgtcattatgatgttagctgattattttgctcgttagttgatgcagtttcttccaagcatcgatggcctttaccttttggcatgtttttgcagtggctggtaccagttgttcctttccatatttagtgcttccttcaggagctcttgtaaggcaggcctggtggtgacaaaatctctcagcatttgcttgtctgtaaagaattttatttctccttcacttatgaagcttagtttggctggatatgaaattctgggttgaaaattctttcctttaagaatgttgaatattgacccccacttttttctggcttgcagggtttctgctgagggatctactgttagtctgatgggcttccctttgtgggtaacccgacctttctctctggctgcccttaatattttttccttcatttcaaccttggtgaatctgacaattatgtgtcttggggttgctcttcttgaggaggatctttgtggtattctctgtatttcctgaatttgaatgttggcctaccttgctaggttggggaagttctcctggataatatcctggagagtgtttttcaacttggttccattctccccgtcactttgaagtataccaatcaaatgtagacttggtcttttcacatagtcccatatttcttgtaggctttgttcatttctttctattcttttttctctaaacttctcttctcacttcatttcattcatttgatcttccatcactgataccctttcttccacttgattgaattggcttttgaaggttgtgcatgcatcatgtatttcttgcgccatgattttcagctccatcaggtcatttaaggtcttctccacactgttcattctagttagccattcgtctaattattttcaatgtttttagcttctttgcaatgggttcaaacgtcttcctttagctcgaagaagtttgttattaccgaccttctgaagtctacttctgtcagctcgtcaaagtcattctccgtccaccttttttccattgctggcgaggagctgtgatcctttgaaggagaagaggtgctctaatttttagaattttcagcttttctgctctggtttctccccatctttgtggttttatctacctttggtctttgatgctggtgtcctacagatgtggttttggttcggatgtcctttttgttgatcttgatgctattcctttctgtttgttagttttccttctaagagtcaggtccctcagctgcaggtctgttgcagtttgctggaggtccactccagaccctgtttgcctgggtatgaccagcggaggttgcagaacagcaaatatttcagaacagcaaatactgctgcctgatccttcctctggaagctttgtcccagaggggtgcctgcctgtatcaggtgtcagttggcccctactgggaagtgtcagggacccacttgaggagtcagtctgtccttcttagagctcaaacactgagctgggtgaactactgctctcttcagaactgtcagacagggacgtttaagtctgcagaagtttctgctgcctcttgttcagccatgccctgctcccagtggtggggtctacagaggcagcaggccttgcagagctgaggtgggctccatccagtgtgagcttcccaggctgctttgtttacctactcaagcctcagcaatggcagacgcccctccccctgccaggctgctgcctcgcaagtcaatctcagactgctgcgctagcagtcagcaaggctccatgggcatggcacccgccaaaccaggcgtgggatataatctcctggtatgtcatttgctaagaccattggaagagtgcattatttgtgcaggattgtcccaatgttccagatatcatctgtcatggcttcccttggctcggaaagggaaatcccccaacccattgtgcttcctgggagaggtggtatcctgcccagctttggctcaccctccatgggctgcacctactgttcaaccagtcccagtgagatgaaccaggtacctcagtaggaaatgcagaaatcaccgttttctgcgttgatcacgctgggatctgtagatcggatctgttcctatttggccatcttgaaatggaatgcaattatagctaacattttaagatttttaaaaagttacagttttatgagttacatcagatacagaagtgaggcaatctttaataattaaatgtaataatgaaatttggttgtatctaattgataaatgatatttcaagaggcatattggttgacacaagaattactaaatttttaaaaatctaaattttgtcttataagttgtcatttattattccatttgttcattaattcagcaaatatttgttgaacaccaactatgtgtcagtcactgtactatatactggtgattaaaaaaaagtgatccaaatagatgtgctctttcccattacccaaatgttcattttaaccaatgttagttgctctaatcaagaagatagccaaatagaaagtctaattacctgtcaatgggccatgagtaaataagtaataatgacaccgtctaagcatctactttttaaaatgttgtttaagatgaggcttataaaacaatataccaagcaaacttaattgagcattctgatttataagtcagtttttatatttcagaataatatgtttagatattttaactttttcctctctttattttgtggcaagtcattagtagtataaagttagatgagaaaatatttttagtgaaaatgtagttgttgttgtttttttaaccacaaaactagctccaagtaaagagaactttgaaagatttacgtgtaaacaattaatgctttcatttatttgctttaatttttcatttttgttctcacttcattctactgggcagaaataattttttttaaacctggaaaaccctgttttgaatagttttctgatagaatttacaaagataagctaaaatgttaaagcagaggaaattatagatattaaatggtgcaaataaaaaatgacagataataaaatagtgttaagaatacttgtatggtatgttaagatagcttttactccctaaagtacaaagacaaatatctatgaaatacatattgtcccctaagtaaatgtatttttgccattacttttaatttactaatatattgtttattgtttatcagatttgaataagtataaaaattaaatacatgacaagaattgcaatactttttttttttttttttttgagacggcttctcacgctgtcacacagactagagtgcattggcgcgatctcggctcactgtaacctttgcctcgtgggttcaagcaattccctgcctcagcctcccgagtagctgggattacaagtgcctgccaccatgcccagctaatttttgtattttcagtagagacagggtttcaccatcttggccaggctggtcttgaactcctgacctagtgatccacccgtctcagcctcccaaagtgctgggattacaggcatgagccactgcacccggccaagaattgcaatacttaaacttaagtgcaatatcttatttttgtgttattaaacacaaagcaatctgtaatatacaacttactttatgtaaatccgtaaattgaattgtgattacacatgcatttttttggacagtttgagtgtgttttcaattatgcaactgtttgcttaatgtttataggtagaaggggtgacttctagaactgaggaaactgtggctcagggaatatatatgatttacctaaatttacacagctgatttacagtggagcctaggttaaaatttgagtctctttctaccttgccatgtttatcattatgtgtttaataacataatataacctaacaaataaataatacgcttttacaaacaaattatggctgctcaccccatctgggaactgaggagtgcctctgcccggccgccaccccgtctgggaagtcgggagcacctctgcccggccaccaccccgtctgggaagtggggagcgcctctgcccggctgccccatttgggaagtggggagcgcctctgcccggccgccccatctgggaagtgaggggcacctctgcccagccgccctgtctgggaggaagtgaggagcgcctctgcccagcccccccgtctgggaggtgaggaacgtctctgcccggccgccccatctgggaattgaggagcgcctctgcccggccgcccatcgtctgggaagtgagtagcgcctctgcccggccgccccgtctgggaggtgaggagtgcctctgcccggctgcccatcatctgggaagtgaggagcgcctctgcccggccgccccttctgggatgtgaggagcgcctctgcccggccaccccctctgggaagtgaggagcgcctctgcccagccaccccatctgggatgtgaggagtgcctctgcctggccgccccgtctgggaagtggggagtgcctctgcccggccgccctgtctgggaagcagggagcacctctgcccagcagccgccccgtctgggaagcagggagtgcttctgcctggccgccccatctgggaggtgaggagtgcctctgcccggctgcccatcatctgggaattgaggagcgcctctgcccggccaccccatctgggaagtgaggagcatctctgcccacctgcccatcttctgggaagtgaggagtgcctctgcccgaccgccccatctgggaggtgtacccaacagctccgaagagacagcgaccatcgagaatgggccatgatgacgatggtggttttgttgaaaagaaaagggggaaatgtggggaaaagaaagagagatcagattgttactgtgtctgtgtagaaagaagtagacataggagactccattttgttctgtagtaagaaaaattcttctgccttgggatgctgttaatctataaccttacccccaaccccgtgctctctgaaacgtgctgtgtcaactcagggttaaatggattaagggcggtgcaagatgtgctttgttaaacagatgcttgaaggcagcatgctccttaagagtcatcaccactccctaatctcaagtacctagggacacaaacactgtggaaggccacagggacctctgcctaggaaaaccagagacctttgttcatgtgtttatctgctgaccttgtctccactattatcctatgaccctgccacatccccctctccgagaaacacccaagaatgatcaataaatactaaaaaaaaaaaaaaaaaaagattggtcactgagatgagttgttgctagcccaatccacatgtcctctaatttctcttttcacctagttacttccttcagtttttgctttatatattttgaagactaaacttgtatttggccaggcatggtgtctcacgcctataatcccagcactttgggaggccgaggcgggtggatcatttgaggtcaggagtttgaaaccagcctggccaccgtggcgaagcccattctgtactaaaaatacaaaaattagccaggcatggtggcgggtgcctgtaatcccagctactcaggaggctgaggcacaagaattgcttgaacccaggatgcagacattgcagttagttgagatcacaccactgcactctagcctggggaatagaatgagtctccatttcaaaaaataaataagtaaacttgtatttaaatacaagtattcaaaacttgtattagacagtgttaagtttagaattgttaaaatgctacattttcttggtgcattaagctgtatatcaacaagaaataaaactttctggtaattaaaaaaaaaaaattatggctgctcttcttgcaaacttacctgttcatagttggtcctgtggcagaaactgctagttgcctatcccattttcttgcatgatagaattcaattgtattgataaagtcaatatgctcaatgaaaaattccatatctaggcctactttcaattagtgttggatttgtcccactgttgtagtcactatgggtcaaatacaagttgaaacctcttttaaaaagaaagcacatttcactgactgacctgtgtcctttttgactttcatatatccatctgcttctgtaggaagcagacataatgtctaaagctgcaggagctgtcttaaaaatataaaagctgggaggagctaaaagatctgacatcttaagtcattaccttagacctaaatgcctacttcctgatgtaaggttatgtaagagaaaaaaatacctctattatgtgtgataccctgttatttgaatattttgttacatcaagacaaacccaatccttaaattaatccttaaattaaatatgcagctactcatacttataacagatgcatgataaatcatgcactgtatacaaatctaataaaaaggagcaggaaaagcatatgccaatgaagcaaaaaatgacagagacaaagaaatgcagaagaagttgtacttcttctgaaaacacgtgactgtgttatttgttactaaaatgagaaacatcatgaataacctctcatagaaagggagataagtgtgactgggtgtgaaattttcttgagggtaatagaacccgattcaaggcagctctaggcttgaaccacttttgacagtttatgtaaattgatattttgaagtttattattcatgttttctccttaaaagtagaagaaactcaaaaatcatttttagtagaaactcattgtataagattacacacccactatattatccataaatgacctttattagtgagttggagaaattcataccacttaattgtcccctgattttgcaacacatgcctggaacctaccaaccagcaaggaacccaccatattattatctgggaaatgattaaccattttctaaggcagctgctgatactatacagcttattgtacatggtaaagttatatgatctttatcttcctatgcacaacccagcctcagcacccttggatgccatgcctgagcaaaatgagaagctgctggccacatgtcctctcctgattcataaatgatttctgagtactgctatataaacatgcacatgttgtagtctttgcaagagtggatatcaaatctatttatgtctaggacaaactttttttttccaaaatagaatagaaacatatttgcaaagtaatcagtataataacattatcacattcaaaacagggctctaaagctagaaagaaactctaaatatggacatatattaaatattttttcatccctaagtagttcctcttttcctctgacaggaaaatagggctgcatgtttcagctataaaattatgcctagaaatctaaaagtctaagttattgtttacacaaattcaactaattgtttgttataaataattacttagcaaacgatatcagcagacatctgtttgcttaattttagagaggtttctcttgagtagtctagcttcctaaattaatgctgaaacttggctgagtcacaaagtaagcattgagtcagaagtcacagaaatattaaaagtcacagaaatgtttctgaaatggactttaattatcagcataacttatgttttacatactcaacatataaatacacagtatcctgcaatttccatttccatagttttgtctaaactattatagtaccccaggcctcacataatttgattccattgagctcaatttttcattcctaggaatatgacacttctctatactatttttttacctaaattgtgtatctcatataaaagagtggaatatctaggcaaaatttgaatgtgatattcacctgacaattggatataataaaataatctagtatacataattattttgttaacctatgattcataaaactgtcaccatgaaaaataataattttgaataggacaggtttcatgcatgctaatattgttttttattatttcaatctatttaaacttttatgatgttctcttttaaatattcagggtccaactttagctatttggttcatttttccccaaagatattctgatcttctttatattcaataaaaaaaatcctattattcaataacattatacattgcaaagcaccttgcattgttttaccttttataaaagcccattgatataaatggatattaatataaaatcccatataaaatgatgatataagaaaacctatgacccttgcaacgtcatatcacatattactaataaatgggagtttagaaatcagaactctagattctatcatcttatttcattatgtaatctcttaaagtgtcaaaataaactggaagagtagggatatacatattgttaaaagaaattttgttcaaccagagtgttacagagagaaaaaaggagagcttaataataaaactgtgtcttcatggaatttttcatgtggatgcattgatggaaaggcattctaggaaaaggcaacaacatgagtgaaggcccagaaacctgaaagctctgggaaatgttgcttagtccatgtctagaggctaggtaggtgaaaggatgaagacatgagactatgaaagaaggctctggctcgctctccaaggactttggaagcaatgattaatattcattctacatcatctcacatgccgggtgctttgctgagtgcagtatacgtgatgcctcattttgtcatcacaccaccctagtcagactcttctgatcaacagacacataacacgcgaggcagaagcaatatttctacacttccaggctactttattttcatccaggggttttcctcctagaagagtagtgggggatgaagaaaataaaatctttatgtgacacatctttgattggtttgggcttaatgcaatctaacataataaataaactgtgttaatgtaaaaaaatacaaatattgctaatctaaactcatagaagaaacatattaaacatactgatatctaaaaatatatttaaaatacaaaagtggaaaaaaaagttgttttatctttaaatctccagaatgcactttgcatgtcattaatagcacatttgatgtgctattctagtattacatttagactattgaaaaaccatagtgattaaatcgaaagaacatctgatttacatttatcttttggccctgttgatcatcaagatgaaatgtttatggaatcaacatatacttattgacttttgactatgtttaagagctatgctaagtaattatatgtgaggttaagatgaagattttgattaatttattcagaatgtctttaaaacaatagagcaaatgtttgcccaaatgatttcagtcttgtaggtcatagaaattagtaaaggaaaaattcagaaagacattaagaaaagtcataagaggggccaggcgcagtggttcacaccggtaatcccagcactttgggagacccaggtgtgcggatcacgaggtcaggagatcgagaccatcttggctaacacggtgaaaccccgtctctactgaaaatacaaaaaattagctgggcgtggtggcatgcgcctatagccccagctactcaggaggctgaggcaggagaattgcttgaacccgggaggtggaggttgaagtgatcctagatcatgccactgcactccagcctgggcgacagagtgagactccgtctcaaaaaaaaaaaaaaaaaaaaaaaaaagtgataagagtctctcagaggcattcagagattttgctacattccaggaaaagactggagtatgcatgtcactactctctccaggaagcctggaattagccattttaatgctctacttcctgagtgtatgagaggctacctctactttaactttttattttgtttcttcactaaaaaaggatgaaaacagaagaacaaatgggagaaaataacccaatagacctatgttatattcactattctccaacagacctttaatgaattagagccaataagcaaaacaaggatagctaaatgtacattggattttgtcaattttccaatagtcttaaaaattgtagtttttatatatatatttgaacaaactttacataagtacacatatctattgaagataaattagaagaataaacaagacaaaactacctttaatgacaaatatatttcccattaactgaagggatcttgaagcttaagaatttgaaaagagtaagtactattgagaattctgaacaacattaacatcccatcactttgaaaaactgtttaaagagttaaatcaactgacagcttaaataacacattctattttggatggcagtcttttctttccttcttattttttaaacatagtttgaaggctatgctcctcatattttaagacatttattttgtattattataatattaatatactgtacatttttaacacctcagtatgctattcctgatttgtgatatagatttcttgatgcaagagtataattataactaatttccaaaaaacatgacagagattttgatggacaaacattttttaatataaattttaatttttattttactataagttctgggaagcatgtgcaggacatgcaggtttgttacataggtatacatgtgccatggtgctttgctgcacccatcaacccgtaatctaggttttcagccccacatgcattaggtatttggacaaacatttttaccaagctactatactttaaaatttgcataatttgtactactaaaaataaatgttttaaaaagattatccaactatctaatgtttaatgtgttataccattgataaaaatcagatcatctgagttaatttctatgatgattcttcaagtatgtattcatttcatattatttattaagctcctcctaggccccatgctagttttctttgtttttcttttctttttttttttttattatactttaatttctagggtacatgtgcacgacatgcagatttgttacatatgtatacatgtgccatgttggagtgccatacacattaactagtcatttacaataggtatatctcctaatgctatctctccctgctccccccaccccacaacaggccccagtgtgtgatgttccccatcctgtgtccgagtgttctcattggtcaattcccacctatgagtgagaacatgtggtgtttggttttctgtccttgtgatagtttgctgagaatgatggtttccagcttcatccatgtccctataaaggacatgaactcatccttttttatggctgtatagtgttccatggtgtatatgtaccatattttcttaatccagtctattgttgatggacatttgggttggttccaggtctttgctattgtgaatagtgccgtaataaacatatgtatgcatgtgactttatagcagcatgatttataatcctttgggtgtatatccagtaatgggatcactggctcaaatggtatttctagttccagatccttgaggaatcgccacactgccttccacaatggttgaactagtttacagtcccaccaacagtgcaaaagtgtttctatttctccacaccctctccagcacctgttgtttcctgactttttaatgatcaccattctaactggtgtgagatggtatctcattgtggttttgatttgcatttctctgatgggcagtgatgatgagcattttttcatgtgtctgttggctgcataaatgtcttcttttgagaagtgtctgttcatatcctttgcctgctttttgatggcgttgtttcatttttttcttgtaaatttgcttaagttctttgtagattctggatattagccctttgtcagatgggtagatggtaaaaattttctcccattctgtaggttgcctattcactctgatggtggtttcttttgctgtgcagaagctctttagtttaattagatcccatttgtcaattttggcttttgttgccattgcttttggtgttttagtcatgaagttcttgcccatgcctatgtcctgaatgttattgcctaggttttacttctggggtttttatggcttaggtctaacatttaatctttaatccatcttgaattaatttttgtttaaggtgtaaggaagggatccagtttcagctttctacatatggctagccagttttcccagcaccatttgtttagatagggaatcctttccccatttctgatttttgacaggtttgtcacagatcagatggttgtagatgtgtggtattacttatgagggctctgttctgttccattggtctatatctctgttttggtaccagtacctgctgttttggttactgtagtcttgcagtacagtttgaagtcaggtagcgtgatgcctccagctttgttcttttggcttaggattttcttggcaatgtggtctcttttttggttccatatgtactttgaagtatttttttccaattctgtgaagaaagtcattggtagcttgatggagatggcatttaatctataaattaccttgggcagtgtggccattttcacgatattgattcttcctatccataattatgtaacattcttccatttgtttgtgtcctctttaatttcattgagcagtggtttgtaatttgaagaggtccttcacatcccttgtaagttggattcctaggtattttattctctttgaagcaattgtgaaagggagttcactcatgatttggctctctgtttgtctgttattggtgtataagaatgcttgtgatttttgcacattgattttgtatcctgagactttgctgaagttgcttatcagcttaaggagattttgggctgagacaatgggattttctaaatatacaatcatatcatctgcaaacagggacaatttgacttcctcttttcctaattgaataccctttatttctttctcctgcctgattgccctggccagaacttccaacactatgttgaatagaagtggtgagagagggcatcccggtcttgtgccagttttcaaagggaatctttccagtttttgcctatttagtatgatattggctgtgggtttgtcataaatagctcttattattttgagatacgtcccatcaatactagtttattgagagtttttagcatgaagggctgttgaattttgtcgaaggccttttctgcatctattgagataatcatgtggtttttgtcttcggttctgtttatatgatggattatgtttattgatttgcatatgttgaaccagccttgcatcccagggatgaagccaacttgatcatggtggataagctttttgatgtgctgctggattcggtttgccagtattttattgaggaattttgcattgatgttcatcagggatattggtctaaaattctctttttctgctgtgtctctgccaggctttggtatcaggatgatgctggcctcataaaatgagtaatggaggattccctctttttctgttcattggaatagtttcagaaggaatggcacaagctcctctttgtacgtctggtagaatttggctgtgaatccatctggtcctggactttttttggttggtaggctaccaattgttgcctcaatttcagagcctgttattggtctattcagggattcaacttcttcctggtttagtcttgggagggtgtatgtgtccaggaatttttccatttcttttagattttctagtttatttacgtagaggtgtttctagtattctctgatagtagtttgtatttctgtcagatcagtggtgatatcccctttaacatttttaatacatctatttgattcttctctcttttcttctttattagtcttagcagtctgtcgattttgttgatcttttcaaaaaacaatctcctggattcattgattttttgaagtgtttcttgcatctctatctccttcagttctgctctgatgttatttcttgccttctcctagcttttgaaggtgtttgctcttgcttctctagttctttaattgtgatgttagggtgtcaattttagatctttcctgccttctgttgtgggcatttagtgctataaatttccctctacataccgctttaaatgtgtcccagagattctggtatgttgtgtctttgttctcattggtttcaaagaacatctttatatctgccttccttttgttatgtacccagtagtcattcaggagcaggttgttcagtttccatgtagttgagcggttttgagtgagtttcttaatcttgagttctagtttgtttgccctgtggtctcagacacaatttgttataatttctgttattttacatttgctgaggagtgctttacctccaactatgtggtcggttttggaataggtgtggtgtggtgctgagaagaatgtagattctgttgatttggggtggagagttctgtagatgtctattaggtctgcttggtgcagagctgagttcaattcctggatatccttgttaacattctgtctcgttgatctgtctaatgttgacagtggggtaaagtctcccattattattgtgtgagagtctaagtctctttgtaggtcactaaggacttgctttatgaatctgggtgctcctgtattgggtgcatatatatttaggatagttagctcttcttgttgaattgatccctttaccattatgtaatggccttccttctcttttgatctttgttggtttaaagtctgttgtatcagagactaggattgcaaaccctacctttttttattttccatttgcttggttgatcttcctccatccctttattttgagcctatgtgtgtctctgcatgtgagatgggtctcctgtatacagctcactgatgggtcttgactctttatctaatttgccagtctgtttcttttaatgagggcatttagtccatttaaggttaatattgttatgtgtgaatttgatcctgtcattatgatgttagctggatattttgctcattatttgatgcagtttcttccttgcattgatggtttttacaatttgtcatgtttttgcagtggctggtaccagttgttcctttccatttttagtgcttccttaaggagctcttgcaaggcaggcctggtggtgacaaaatctctcagcatttgcttgtctgtaaagaattttatttctccttcttttatgaagcttagtttggctggacatgaaattctgggctgaaaattcttttctttatgaatggtgaatattggcccccactctcttctggctttatagagtttctgccaagagatacactgttggtctgattggcttccctttgtgggtaacccaacctttctgtctggctgcccttaaaattttttccttcatttcaactttggtgaatctgacagttatgtgtcttggggttactcttcttgaggagtatctttgtggcattctctgcatttcctgaatttgaatgttggcctaccttgctaggttggggaagttctcatggataatatcctgaagagtgttttccaacttggttccattctccccgccactttcaggtacaccagtcagacataagtttggtcttttcacatagtcccatatttcttggaggctttgttcatttctttttactgttttttctctaaacttctcctctcgcttcatttcattcatttggtcttcgttcattgatacactttcttccacttgatcgaatcagctactgaagcttgtgcatgcatcaggtaattctcatgccatggctttcagctccacgaggtcatttaatgtcttctgtatgctttttattctagttagccattcatctaatctttttcaaggtttttagcttctttgcgatgggtttgaacatcctcctttagcacggagaagtttgttattacagattgtctgaagccttcttctctgaactcgtcaaagtcattctctgtctagccttgttccattgctggcgaggagctacattcctttggaggagaagaggcgctctgatttttagaattttcagcttttctgctctggtttctcctcatctttttggttttatctacctttggtgtttgatgatggtgatgtacagatggggttttggtgtggatgtcctttctgtttattagttttccttctaatagtcaggatccccagctgcaggtctattggagtttgctggaggtccactctagaccctctttgcctgggtatcaccagtggagcctgcagaacagcgaatattgcagaacagcagttgttgctgcctcatccttcctctgaaagcttcgtctcagaggggcacccggctgtatgaggtgtcagtcagctgctactgggagttgtctcccagttaggctactcaggggtcagggactgacttgaggaggcaatctgtccattctcagatttcagactctgtgctaggagaaccactactctcttcaaagctgtcagacagggacgttgaagtctgcagaagtttctgctgccttttgttcagttatgtcctgcccccagaggtggagtctacagaggcaggcaggccttcttgagctgtggtgggctccacctagttcgagcttccttgccactttgtctacctactcaagcctcagcaatggcggacgccccttccccagcctggctgctgccttgcagtttgacctcagactgctgtgctagtagtgagtgaggctctgtgggcttgggaccatctgagccaggcacaggatttaatctcctggtgtgccatttgctaagaccattggaaaagtgcagtattagggtgttagtgtgctgagaggagctcagtcagggagaccctaactcagcggcactagaggaattaaagacacacacacagaaatatagaggtgtgaaatgggaaatcaggggtctcacaaccttcagagctgagagcccctaacagggatttacccacatatttattaacagcaaaccagtcattagcattgtttctatagatattaaattaactgaaagtatcccttaagggaaacaagagatgggccaaattaaagcaatagattgggctagttaactgcagcaggagcatgtccttaaggcacagatcactcatgcaattgtttgtggcttaagaatgactttaagtggttttccgccctgggagggccagatgttcattgccctcattcccataaacccacagtcttccagcatgggcattagggccattatgaacatgttacagtgctgcagagattttgtttatggtcagttttggggccagtttatggccagattttggggggcctgctcccaccatgtcccccttctttgatttgcaaattgataaatgcaaaggcaactttgtcacagtgagctacttctcacaggagtcaggatccacatctgcagactacccaaagacaatacagattaaaagcacaatcatcattgaaatcacagaacttccaggtgtttttatctattttaatgggttactagctgctaatctgtctgtaactccttcaagcactccagttcctggcattaaggtcaggtgtgcctgggatgctttaaatatttgttcttttaattttaaatccttatgtcaagctcctagagtaggccatatcatttgaggttgaggtgccactataccacagtggttccagataataggaacttttgccatacttctcatcatttctaccatctgaccatttttctcagatcatctgaacatagtgtggccatggcacgcagactgagaggtgcaagtcaagctaaacatccccttaggggaccaattaataatgattccataggaattgttgtgcagcacctctgtctgttctgcaatgcgatcttcctaaacaagtacgttcattttttctaactgggtccaagcctgtttacaaataggtttttgagggcgatatgcctcaattataggagcagatttattatggtaaatactgagatcagaaagcatgtgtaactgtgtcatagagtgattgcatccaggcattattgccagccaagattgatcaatatgcccgataagtataattgttctctgtgtcagtccttattgaaggaatactcatggcagtggtgataaccgctgtcatagctaccattaaattattcattgtgactggttgtcccacttttgttaggttgtctttcaccatctgtgacagcttcttgatctgtccccagatgggtggctgtgttcgatgggtgttgctcatgacagttggggtcctcctcagtgtcagtctcaacatgctgcaaccgaagggtccttgggatccttctggaatctcttcctcagcatctggctcatgataagttttcaggtgtcttgatggtatccaaattggctgttgattttggcctggagaaatacaagcataatctctaccccaagttattattttacctatttcccaaattttgttaacggatctctccaccaaatcagttgttctgcttctgtctttgcagttggtttctgtacgtgctgtacagctgctgataacatctggcctttgggcaggctcaaaaaatttaaagttaataatgctagattcagttgcatctgcggtcttccatattttatctccccctttctgcttttgcaactgctgttttagggagagattcattctttcctctgtggcttgtccttgagaattgtatgggataccagtaatgtgtttaatattccacatagagaaaaatatagctagagcttggctattatagcctggggcattatctgttttaatagaagctggaatgcccatcaccacaaaactgcaaaagatgacacttaacacaggcggaagactctcctatttgatgtgtagcccaaagtgagaaaaggtgtccacacattacatgtacataaactagtctcccaaatgagggaacatgtgtgacatccatttgccaaagtgtgttaggttccagtcctcgaggattaactcctcctgtaaaagatgaggcatgtaccatttggtaagttgggcatccctgtataatagctttagcttctttccaggtaatgctgtatctgtgtttgagaccagaggcattaacatgggttaaattgtgaaagtgtctagcattagatattgcattagcaactaggtggtcagccttttgaatccctttagtcaaaggtcctggaagagatgtatgagccctaatgtgagtgatgtaaaatgggtgcattctacttctaactgctgtttgcaattcggtaaataaagtcatcagttgttcatctgtatgtaatagtaactgagcattttcaattaactgtgtgggatgaaccacatatgaagaatcagaaatcacattaataggcatagcaaaagaagtcaatatctcaattacagctacaagctccgtttttgagctgaaggataggacgtctggaaaactttactttttgagccagaataagaagctttaccattactagacctatctgtaaaaaacattttcagcaccttcaattggtttaaatttagttattttagggagaatccaattagttaatttcaaaaactgaaacagcttcgttttaggaaaattatcagcaatacccacaaagctttataaaagctttctgtatttatgccttcgtgagagggacaataatttttccaggatcatatccatgtaatttaacaatccgagttctcccaatccctatcatagtagcgatttgatataaataaggagttagagtccgtgaattagtatgtggaagaaaaagctactctactaagtcctgttcttggacaataacaccagtaggtgaatgctgagttgaaaaaattagcaaatctggagtctgctctggatctattctatttatttgaggcttatggacttgcttttcaattggttgtaacttgacctcagcctcctttgttaattgccgagggctagtaaggctaggatttcctctaaggatagaaagcagattactcatggcataggcaggaatgcctagagcaggtcatatccaattaatgtcccctactaatttttgaaagtcatttaatgtttttaattgatccctacgtatggttactttctgtggcacaatggtagtgtcatttactaaggtccccaagtaggagtaaggagtgcagcagtatgaattttgtcaggagctataattaaaccagcacaagaaatcgaattttgcaagtgatcataacattggagtaatatttcttgagtggggcagcacaaaatatatcatccatatagtgaataatgtaacactgtgaaaattttttaggagtaggttcaattgcttggcccacatacgactggcaaattgtgggactgtttaacatgccctgtggcaacactttccaatgataacacttagcaggctgcaggttgtttactgcaggaattgtaaatgcaaaccattcacagtcttgctcagctaaaggggtagtaaagaaacagtcttttaaatctatgactattaaaggccaattttttggaattatagcaggagaaggcaatcctggctttaatgctcccataggttgtataactgaattgatagctcttaaatcagttagcattctccatttacttgatttttcttaggaaaactggagaattccaagggaaaatgttggagctatgtgcccattttctaatttttcagtaactaatttctctaaagcctccagtttctctttacttagcagccattgttctatccaaattggcttatctgttaaccattttaaaggtataggttctggaggcttaacaatggccgccatcaaaaattatttcctaatctttggcaggaactttgtttttccccttgacttggttttttcaaatcttgcaaatttttttctagttccataccagggacatacctcatttcatgcattgtatgttgatttttagggctatataattgttctgggattagaacttgtgctcctcattgttgtaataaatctcttccccataaatttataggtacagaagttataattggttgaatagtaccaggttgtccatcgggcccttcacaatgcaaaatataacttctttgatatacttcagggcctttaccaactccaactatgttaaattgagcaggttgaattgtccatgtggacagccagtgctgtagagaaatgattgaaatgtccactcctgtatctaccaaacctctaaatttctttccctgaatagttattgcacaggtagggtgtttatcagtaatttgatttacccaataagctgctttgccttgtttatttgtgcttccaaatcctcctgtgtgtttaatttcactttttcccatttccacatatggcacaattaggagctgtgccatgtgctctcctggctctgctttccagggaacagaagtagatataacgatttgaatttccccattataatctgaatcaatgactcctgtatgtatttgtacactttttaaacttaaactagaccttcctaaaagtaatcctattgtccctgctggcaagggtcctccacagactcctgttagggaccttttgtgggggttccccaggcagaaggctcacagcttttgtgcagcataaatctactgcagtgctaccggctgtggcgggagacagacattgtatggggatgagggaatggcctgagctggaaatgcccaggtttagaatggggcccaggacaggcccctcatggcatttcccaaaatcaggttcccttctttatcaaacttagggtgacattgattagcccaatgttttccttttctacattttggacatatttcaggatcagcagttttcttttttcccctatctggcggcctgactctctgaatttttctacattcctttttagtatgaccatgcttcccacagttaaaacaagctccaggaaatggagtatttcctttatccactctcagtcttgccattgcctgtactagccaagtagctttatgcagattacctctgataccatcacaggccttgatataataaactaaatgtgctttcctgaatttaaaagcaataggctcaaatgtagccataatatttccctgttgatctggggggtgtattctaacatggaactgccaagcctctaaatcaccctctcgtctagcttgctgaattcctgcctgaatagaactaagagcgatcgctcgaggcgctgcttgaacagtcactggggcaactacttttcacccagtgtcctccagaaaagaaagatctggagggtctttttcttcaaaataataaggaggggttacagaagggtagggatgaacctctccttcctttgctgctttagctggtaaataaacatgctctgtaacctcttctgttacttcactatactctccttcctcctcctcatcagtgtgaaaaagttccatggtagaatggaccagaccccacacttgtcccatgattaacctgatgcttccgagctccccttcttactcaccacagggattgctttaagagtacttgggtgtcctccagcttagttttccattccaaccatcgctccggcaatccttcgacctggattcgagcccccgtgatggacgccacttgctgagaccagctcagtcagggagaccctaactcagcggcgctagaggaattaaagacacacacacagaaatatagaggtgcgcagtgggaaatcaggggtctcacaaccttcagagctgagagccccaaacagagatttacccacatatttattaacaacaaaccagtcattagcattgtttctatagatattaaattaactaaaagtatcccttatgggaaatgaagggatgggctgaattaaaggaataggttgggctagttaactgcagcaggtgcatctccttaaggcacagattgctcatgctattgtttgtggcttaagaatgcctttaagcagttttctgccctgggagggccaggtgttccttgccctcattcctgtaaacccacaatcttccagcatgggcattagggccattatgaacatgttacagtgctgcagagattttgtttatggccagttttggagctagtttatggccagattttggggggcctgctcccaacaggagtgtcctgattttccaggtagcatctgtcacagcttcccttggctaggaaagggaattctctgaccccttgtgcttcccaggtgaggtgatgccccaccttgctttggctcacactctgtgggctgcacccactgtctgacaagccccagtgaaatgaaacccgtacctcagttggaaatgcagaaatcacccacttctgcgttgctcacactggaagctgtagactggagctgttcctattcggccatcttggcacctctctctgctagttttcttactgaatacatatctgtccatttctttttacctgggtagtattaatcataggattttaagtctggaagagattttcaaaattgccgtccaaataaaatttctcattttttaaataaacataagtaagtaaataaaaacaaagtatgaaataacttaagatgtttccccagagggttgtttggtaatacaaactctgtgaaataaaagtaaattatgaatgtagaaatcaataaatttgttttttttttaattttttatttttgagacggagttttgctcttatcgcccatgctggagtgcagtgatgcgatctcggctcactgcaacctctgcctcttgggttcaagagattctccttcctcagcctcatgagaagctggtgttacaagcgtgctgctaccatgaccggctaatttttgtgtttttagtagagctgtggtttcaccacattggccaggctggtctcaaactcctgacctcaagtgatgcacccgccttggcctcccaaagtgctgggattacaggcgtgagtcaccgtgcccagctgaaatttggttatttttataaaattaaaatgaaatttatccaagtaggcaaaggaaggaaaattttatgtaatagatgttttgaatcatgagaagtttttttttgttaaatgttgctatgatagtaaccttatgatttcccaatgcagaattatcttagtatatttacagcagttccagagtccaagattaaaagaaaattgtttagctaagctttaaaaaggaacaattataaataatatttataaaaattttattaaaaatatctaccacgattcttcatctgtagctaccagctagggtaaactttgcataaaacttatcacttgtctcctatttcaagtgctttgtaaaacttgaaaatgttctgttttaatacttcaattataggacttaccaatgtctattctcttctcagttttcaggaaacattgtctataacaatactatatgaggttcatagtagtagtcatttttcagtattgatgttacggcgttttaattttcttgggcaattgtatcctaaatttattttaaactaagttattcaaaacttctgctactgttattattttattttgcgaaatttttcaaagctgtaagatcttgtttggaagcactgagggcaaatatgataaagttgacctcttacaattattacacattttcaggaatagctagtgctcagtaaattgttattattgtgcttttcataattagtgataaatattttttaatgccatttagtgtaccctggaacttaatgtagaatagcagcaggtctcagtcatgttcgctggtatgtcctaggtcattagctgatgttgagtaggtattctggaaatactctaaaaatattacttaaccaaatgaatgatctgactacttgtatgcttgatacttttgtgattcaagcattatactcatactgagaaaatgtagacatagcaaaatgttaactgggctatatgcctgtcagaaaaatcataatatacccataattattaagattgtgatagttagtgctagcatacctatttatatgtcctccagaaagaaagatctgttacttaatcatgacaaaaagagtctaggaattaccagagaaatagaaaaaaagagttataaatagaattaattctaatctgctagaattctaatatgttaaaatttcaattttctaggtctctgcaaacctcccgaacggtatatataatgattttagacttataggtagggtttctagagagcctaaatgttaatggatttttttttaaagaaagtaaacattttggtaatttgcaggtaaaaggtggttcctaaaacttaccatagccttagctcaatatcaggtcattcattacaatttgtcttcatcatcaaaaaatgtttatgtttataactgttaccttttctttatttgatttaggtagaatccaagtattctaagaggtattgtgccctggatctaaaaaatcaggtttagagtacatgaatgtacttattttgatgctggtgtattcattcttaattaggacaggagatgctgaaaatttacttagtgataaagctaataattctcctcctgtagcatctggtctccagtggcctggagtcattgtctaacctgaatttgggaatagttgagaaagttattctgtatgacctcatttgaattaaagttgttggtgtaggaagtgtttaaattcaactgaaaattttctgaatatcctggtgtccttggcccaatatttctgtgaaaccaaatgaaatatctgagaaccatggagaaatacaatctggctagtactgttttgtttttcttttttcaacttataatttgtttcttcccaaaggattatatatatattgtatataaaggcatatatattacatatataaccttaccatttataggtatatggatttttttaatgtatggaaaacaaattgaacatttatttgaattttaatttttgaataataatttaacatttgcatttaattgagagatttgagtttataaatttaaattattttgattattaaaacagtgagtatttcttatagcagcagaggagtctgctgcaaggattttactcttctgtcctatgagcaagtcactgagttgctaatgcagtcagtgcatgttgcagtacctgtctagtcttgtggatttctctttggcaccactgttgaaatctgtagccctggctatagccttaatttactagatgcctgcactccatgatttccttatcctaatccaaatcctcttcctgcccattggttcatgtagaacatgtttccctcaccaggatctcttagatgactaggatggacaagcggtacaatctcagggaaactttctcagttagatacaaaaccagatacatgttatttggttttatctccaattattaggtttcttttttagagttttagttaccccagagaatctagcagcatcttatccctgctctaatgtcttccaattctcagcaatctctttcaaaccaaagtggcttttcctcttcccatgtggcaaaagcttacttatcttcttatatatcatatcctctatcctttctatactgtgtcttataacaaaactgcaaatgcagacaatctaagccttgctcttgatatgtaaaggaaattttttgaacttaagaatttttttttccacaaagcctgactttcaggatgatgtattttaaggactttaaaaaagaatcaaatttggaggaagaattcagattcaaagctaaggaatgacctctctgagactgtatgcatatgcctttcctacagaaataaatgccattgtgttaaaaggtgagaaagtgtaggtcaatgtgatttacagagaataaaaagtacattgtcttacggtttcaaaatattattcccctgaattgtctattagtagcttattttcacagcttccatttcctctaaatgtctgttaatttacttattattttatccttaaaaggaatcttggaattaggtaaaacttggtttgaacttaacttcatggatatgtaggaagactttactacctcagttttctcacctgtaaaatgtcaataacactgcccacctggttgttatcaggattaaatgagttaatcagaataatgtctgaaacataatggatgctttataacatatgctattaacattttaatttggatagtatgtaatgtctaatacttaatagtattgtttgatgaataaatgtaaaactataggtaaatgccaagcatcatagttcatttagaaagctctgtacaaaagttaattacccttctcttgctttcctttcttttcaaagctaactgccttacctgtgctctgagtagcataatttcctgattatacataggcccagtgtcattaactatctgctatttctgttgtatcttcaatttctccctttccactgactgttcttatatttaaaccttctctgttctaaagaaattgttgatttctgcatcaagctttcttctttctggggccaaactgttggatgaatattgaacatgtgtatacttataactgcccaaccttcgaacctgcttattaacttttcagaattaccttactttatgaattttgataagtgatgctctatgtattagagcatctcccattttcactagataagctgaaaatgccagatactcactttcctagcctcctttattactagggtggggacacatgacccagtctccatcaatctgatgtacattttccagagacacagtcggttccaaggcaggttccacagtttcagggaaattcaggggcagctgtgacaatagtaataacagtgctatcccttgttcagagctggctggcttgaaagtgctaactttattatctggtgctgaaatgtgatggcagtgtgtctttgttgcatccgtaccatggtgtgcgtggccctgaactggttacccagtcttttcaattctgataactactcaatcttcttttagtaaattccttttctacttcaatcagccagagttgctttccattgcttgcagcctagaaccttggctgaaataagaaaaagtagcctattttcactgcttcatctcctctccttctgttctgcctttaacttggtgccatctaggtttcttctgcacttgaagctgttttcttctacagcaaattgacttaactataccaaataaaaaagcttactgctaatcctgctgagaccctttgtgacacaggacattggtcattctttcctgtgagacattatctttctctcctgaatcttttcctacctctgactactgccttccagttttatgcccccacttttccccccatggacttgccttttaattgtggttgttttccttgattcttcctttggctattttctcaccataatcttacaatattccttaagaaaattcccctacttccacatatttaatttcttcagatttccaacatcaaatctcaagccatgtttgtttgttttttaagtttgataccatgctcagatttcaaagtccttgcaggataactctgtcgattgaatgtacccttgagacttagtatgtaaattgagcttgtccaccctacctgctccacctaggaaattatctattttacttgatgttatgttctcatttactgagagttgtcaaatgctctctttccttttttgcccacacatcttattagtaacaaaacttgtttctgtctctgaaatctcccatatcatttcctctttgcccctctccttggaagaaccttgatttagccctcattatatttggattgcttctgttgacaaagattctgtcttcttttaatccatttattttctttctaaagcaaagctgtgctgattttttttcctagtcaaaattttggtttttacaaaataaaatccagattatttattttttaatttctaaccttaatttttgtaatgtctacaatagactcagtgtctctgctatattggtaaaatttatatcctaaaaatgatattgctatctagccctcatcttttgatcaagctgtttttcctgactgaaatgtcatttccctcatgtcaacctcccacagcctttacatttccaaaagcttagctaacttcctcctttgtctacgatccttcctcaaactatacatgcaaaactcccattttctttccctgtactgacatgtgttttgtaatgaatatttgtgtcttttttttcaaccctactgcattttatccttagctcatctataatacctaaaacagagccttttacctcagtgttgcttggttatttgaatctaagtaagtttctgtccagagaggcatatgcctcttttccttgctgccctatctttgcaaaaagttataatccacagcaaaagtttcccacaatgatttggttccatggtaactaaattctccttaaaatgttggaagtaggacctatgttgtatatcacttattcacaggaaattaaaattaactttgttcctgttcataatattgtgaacatcataaaggctggatgaaaagggaaaatgaagagttccacttcccagtattgaaagaaccctggattagtcctagctgtgcactctgttataatcttagataaattacgtaatctcctcatactaaatatatttataataataatgggggcatatttatcagcattactgtaaagtacaaaaatactaaaagcaaaagcactatgaaagctacacaaatattacatgaatataaaatacaacacttattgtggttattattgttcgatcttgtcatttccaccagtcaaagcttgtaaagattcttctaagtccctattttaaactctatgtcattcttttcatgtcctgactcttatatggacacaatgaatgcccattgcttatatgtctttacttctaattcaaatcttcctgtttgttttattgattttttttttcaaatgctatggcctgatgtcccttatgattgctatgttttgggtaagaggggttttaaaattgtgttttagtttgagacaatatttcgttgactcaacaagaacccacatatatgattcctattcttatttatttatttatatttattgtttttgagacgtagtctcactctgttgcccaggctggagtacagtggcatgatctcagctcactgcaacccctgtctcccgaatccaagtgattctcctgcctcagcctcccaagtagctgggattgcaggcatgcaccaccacaccgagctaatttttgtatttttagtagagacggagtttcaccacatggctcaggcttgtctcgaactcccgacctcaggtgatctgcctgccttggcctcctagagtgcatgagccactgcacctggaccctattcttattttaaagtaatgttgactctaaatcaatttatacagtacatattaaaattaacatcatgaaaggttttattctaggcactgtagatgacagtccttataaaattaaggataagccaaaatataattctagttcaaaggagaatttagtagatgccaataagaagtaaaaatagatacaataatggttcagagtagaagaatttcaaatctgagttaataataacattcataaaagttttcatatgaaagaggtggcatttgggatgggaaaattgagaaaaaaaattattgattgtcatagcattgctccacagtcaatcatgtcacataaatgtgaaacagaaataaatttcaccaacattccaagtttcctttgtttcattataccaaatgcacatggtagagaacacacacacacacacacacaaatgcacgcagaaagagagaggttgtttgcaaatggactacagtttcatggtgaaaagtaatttgtgatgcatcatattatgaggtttcatgatatttgtcaggataaggtcaaatgtgcaatccacactgtaaaaagcatagcttacttctatttatgtaattaattggagtctttaacagaggaaaatctttaagtgtttttgttgccttaaaaaatagctcacatgccctatttacaaaaagtaattgggttatctgagaacttacaacacttgagtatcattatatgaaggaagaaagtgatcctgaagaagctatatttattttctttattataaaacttgaactattttaaaataaattgttagctgttgaagtctgtgtttttgagcatcagtaaatggccagtagtaataatgattttcacgaatagaaataggttgtccatgctgagagctagtaacacttcactttgatgcaaatgtttaagtgattcaaaacattgaaatgccaattagtaaaaatggagttcaaatttttacaaaatgtgtgcatggggaggcagctatcattggatgtgctctgccgaaacttgtagtcaacattaaaatgttttaaaaacatttgagagctcctgttggtaaattctaatttgtgtataagtctaatgtataaagtattggtaatttagaaaccacaatgctggattaagagacctgttaggagacgggaggtaagcaaactttgctaacttaatgggaaattttgtggaatagtgttatgacattacagaaccttcctcagggtctacttgaatcataccaatataattcgcaattaactgatggaaggaattggtttcatgagacgctgtattctgaaatcagaagaggcttaaccttcttgaaactgcttttatttgccatgtgccctgctactcaagattttcataatgcttcaattttagttattcttattagtttaaaaaaacaaaactacttttaatcttcatacttaatataagaaaaatattcaaagattgtctttctcatatctatctctcacatcattctgcgtggattactgagggccacacgatcatgcagtcttcagacgcctttgttgctccactgcagactttttttcttactctgcagtgattcacaccgttccctttcttacaactcttcatgactccaccttgccattaagacaaagcccccgtgttagccaggatggtctcgatctcctgacctcgtgatccgcccacctcggcctcccaaggtgctaggattacaggcgtgacacggtgaaaccccgtctctactaaaaataaaaaaattagtcgggttcggtggcgggcgcctgtagtcccagctacgcgggaggctgaggcaggagaatggcatgaacccgggaggcggagcttgcagtgagcagagattgctccacagcagtccggcctgggccaaacagcgagacaaaaaaaaaaaaaaaaaaagacaaagccccatttctttaaatggatcctcaaagactgcatttctcttctagcccaagaaggtcaatgcagcttcagaatgaatgttccaattttctaaattcaccaaatttgccaatttactaaaaacttaagagacactcttcttgattatagttgatgtattcaataaggaagagtaaaaaaaaaatgctcaatttgttaaacaaaacagaacaccacaagagtcagaaattgaatttgtttctttaaaaacagcatgttctttttatgaatatgttctttgtaaaaagaaaggaaagcaggaaaaagataattaaattctgtaaagaaaaatccgcagtcatgacaacccccctgcccatactctgttaatccatgtattaggcattactgtaagctttataaattactacaagaaacagatgttggtaagtatataaatttgataaattgatcatttggtgatttgttcctttcagtgaattgctcattttgtgaggtggctttcaatgcattgagctagagtcatcgaattcaggttgatctcaccatttccttgctattctaaccatacataactcttttggctcctgtaaccagcattcactcttacttagcagcatacctaaatatttcctgttatctaaaatctactgcctatcactattctacagacaactattactctttagatataggcttaaagttagttatctgagaagacttctttagtgcctatattggtcagggagctagctccaaaagagaaatctactcctacaattttacacagaaacagatttattaaagtagtaataaccctttaaaatgtgggatttgctgaagttgctgactctagactgaccttttgaggatacctcccagaaacacatgaaagaactacattgccaagggggcagtgtcgttcagcaatattgaaaaatctgtattatcaggaaacaccaccaaagctgctggcctcagaaccacacaacctctcccatgatccatgacagctaaacatctgccagatgcccttgctttctccccatataaggcttttctcaattgaagccttatgtgaatatatctaattggtaggacccatcctagcatcttggaagacatggaaatagaattttaagctttttcacttctgctttacagaaaggcattctggaacggatttaagatatttaattcaaagaatcccctgaacctgccctatatgttagtagtgtggagccgcatgtgactgttgggcacttaaatgtagctcgtgtgcctgagaaactgaatttcttactttatttagttttagtttgtttaaatttaaaagctgaagtagtgtaaaaatttttgttaactacaactgtactgccttggaagactatatttcatttcagctgttgaattgtataagatgttactgcttaatcctagtatgtatttacattttactttttaaaatttggctactataaatttaaaaattacaaatatattacatattctatttctattggacagcagcactctaacccctagattgggctagacctcactatacgtgcccccatggtatctcatcttttcttagtcttgacattcacacagctttttggttataattgcttctgtatttgacttttctcctagcttgtaaaattaatgaatggaaatgctatatcttttttttttgtcaccattgttttccatagcacaatgctcacatattataggcaataaaattatactaaataaatgagtgaataattcttaaaaatggacgttaaagagctaatattccgtaaagcttagtctaaactgtctttacaatttcattttaaaagatcaattcaagccattacttttaaataagttattgagttttaccattaattttcatagttccttaatttacaaatgacagataattgaacatatttttactttatacattatttcattttgcattactttcctttcttaagcagagacagtgaaaagaaaaagagcttcttgggattttttattagagatgacacaccagaaatataattttaaaaatagattttcacataggtgcaacaatgtgacataactcactgccacacactgtgtctcagtgagtttgaaataaaattttctgtttcaataaaaaaaaagtatggtgttaattttagaacaaatgagattaaagcagttatttcatcagggttgcaaaacataaagattaaaaaatgatttattcaaatggaaagttgcaataaatgagagggttctgtagaatatagtatttcagagttttcatgcttcaatgaaaatgagggaagaggctatttcttagaaacttaggaaagagtagtaacggggatagaatctgtgatatatacatcacataatcatagagctgcatgatccatagggatgaaaaaagaaagtagggatgtcagaagtcaggggatacatatagtactaaaagatgtatcaatttatttttcaaagttttgaggacgtggtggaaaattagccccagatataaaataaatccacttaaaatgagatgccaattaagacttttagtttacaagaactctagcctgagtttaagcaaaagggtttttatttgctgacgtaataatgaaaaagcccagagataatgctgatttcagttgtgaacgtgtatttaagtgtgctaatgatcttatcaaaagtttctctttccctttctctttctattctgttttccattggctccatcttcatacacactcttccctccgaagagcaagacggctgcagcatctccagtctcacagcctacaaagtttaagttgaaaaagaattgccatgaaattctgaaattcactctaattagatccatttggttgtaagccaaaccctcaaccaatcactgaggccagaggaataacaagtgtttattagctctagcctatatcacatgttccacacttgcaggaaatgatggcttgtcacccaaagcacagaaactgaaaatgaaagtcgcatagatactcccttctcctgaaaaaataattgaagctgttactggaagcatggtaattagaaggtggccagttaaaaagaaatgtccgttgcaaacagggagcaaaatttaagtataaagatgtaaatatatttgactgtattttatcttgaaaagtgaatctaatgtagatgactatatttcttagtttctaatttcaagaaagtgttaattcttagaataagcagttagcacgaatgcatttttgaccttgtatttctgacaaaactgtaggattatatgattgacattaaaggtaaaattaaaattaatatataaaataaaactcaaaattttcaagccatttggagcttgtcttgagctaatgaggtaaagctcatgtcctcaagaaaaatgttttactctgctgtttttaagggtgcttctatagaaagagtttgagaatcattaatatggattatagaaaattaataatgcttcatttaaaaataaatgtatttaatcctaaagattagctttacttaaaatgtttattgttgcagacaagaaatctatcttatttgaaaaatcagaaattggacatgtcagtgattataggtttttttttaaaatctgaacatgaaaaagttttccacagttttaagataatttaccatgctattcaagtcagcctaaaatcttaaaaagctgctacataataaggtagggattgaaaaaagaaatatttcagattcagagaattgtctttttttagtactaattaaaacattcaaaaaactatatttaatgatgtcattctaaattgactcaataatattaagtgaggaatttatgttccagcaaacagtggatgaatgtgtctatggagagcattgtttcaaaatgttttgacaaatatatccttgaagttcttgctattttattcagtttcagccactattctttttagttgattttttttgtcaatcttaaattttcaaaagaaagattgttttcaaattattttatatttaacaaataaagttatatgttattgattatttaaattgactgttaccacaaattttttttggatggatcatttggacaatatacctttgtgaagtgaataaaacacatttctacagaaacaattcagaagccattccctttccattcaaagtggtattcacctttcaactttacccagacctaggtggcagaaaagaatgcattttggaaaaaccaatagctgacttgtagtggggggccacatcttagaagtcttcagcatttacgtggatttgtaactcaatacatagaagccttcaaagctagagttttaattaaaaattgttactgaaaacttggtactttaatgtattaaaattgaccaattaaagaaaagtttattttttgcaatcagtaagtaatctatgatacgtaattttactatcctgatgtgaaacaagtagagtggatgatttgtacgcgtttggaacagaggcaaggaataagcatttaacagactccaatgccaaataaaaagcctctatatagatgttaaattctctttaataccagattcatattgtggttatgtagatacattaattatactcatatctataatgtatttgattgtgtttaattgtgtaataaatgatgcatatttcataaagttatgttgtttattaatctattattgtagtcttttacaaaatctagttgaaaaatctctcaggtatttagaaatatctggttggctaaatggagaggaaaagtagtatcaagaacaatttacaaccaacattttctgacagtttactatgtatctgactgtgttaaaccctataggtaccagtctcatggaatctttatcacaatttcctcatgtggctgttctccagcatcctcatatataatggtgctccctacataactatttctatttggacatgacacacattgcaagaattcaacttatttgtatttctagggaaatgctaagcaagttactatttaatagtactggagctggctggcttaggcctgcatcttgatcacaactgagtgagaatagatcttccactttgtatgtagaaataacctataagctcagtttccatgaataaatgaatgaaagaagcctataagctcaacttctatgaataaatgaatgaaagattcatgttaacatgctgaagtatatgggattgaaggctgggtcacacaacctacaactatttcagatgtaaatgaaggagatgaattaaatgaattaaatgaacatttatacaggtcttaaattcaggtttaaatttacagattgcactagggtgtcaaatcttggagtacaataaatactagaattgtattttacactgcaaaaatatatccagtgtttactattagttggactattgttgtaaacctcagaaaggcaatatcgtgggattacagatgtgattacgtctgaatttctgatattcttagtgtattggttggtggcatatgtatgtaaggggaatggtattgttgactggtataagtgctatgatgcaaataagtatttcttttcaaaatgacatcagtagaataagcactttctttaggataatgaaattccagcatagttgtcataatgactcaaatataaaaacaataaggagccaaatatggttattaacaataggccattatggtttatcaaatcatgaatttataatttttaatgatacattacactctgctaaagttgctgaagttggtcttcacaagttatacttcatttggttcatcaggacacagttccaatgctattccaatatcacttttagcacttttttgtctcataaatgcaatcaatagaaatatgcctaatgtagatattaatctttataggtgcctacttacattaattaggttatttgtttggctgttctgacagtgatctaaaataactgtcaaaaaaaaaaaaaaaggccaaagtgttggggagaatctgccctataaaataatcaagcttcgtatttcttatcttgctactctgctgggctgagggattgcccccatttgcatggtgcaagatggcattgtagcacactcacacaaaagggaagttaaacacgtcctttccacctccctcttttagtccacgtcttagaatcatggccactccttgctgcaatggaagctaggaaatgtagtctttactctgtacctctaggaacctctatgaaaaagtatatattccatgactctaagacaggacagtatggctaatgggaagcaactagtagcctttgtcacaatgtcaaggatttttattgattgccgaaagaggcaggatagtatttaaagattttatgttgttgttaaagaatatcttaaaatctcaaagcattattaccagaaagggcaatggaccttgaatttgatgttgaccttcataaaaatgtagtcactgtccgtagaccaagaaatcaaagaaattgagagtatgttaaataatacaaacacacacacatatatgcacgtacacatatacacactcatatatatgtgtgcatatatatgtgtgtgtgtatagatatacacactgtctttttattcattataaattctgttttcattggcaattagcacttgtgatgaaacatccaacattgtttttcaggatttatgatttctttttcatcttattaatatgttctttaaagtatttaaagattttatgttgttgttaaagaatatcttaaaatctcaaagcattattacaagaaagggcaatggaccttgaatttgatgttgaccttcataaaaatgtagtcactgtccgtagaccaagaaatcaaagaaattgattgaaatatggttgaactagtttacagtcccaccaacagtgtaaaagtgttcctatttctccacatcctctccagcacctgttgtttcctgactttttaatgatccccattctaactggtgtgagatggtatctcaatgtggttttgatttccatttctctgatggccagtgatgctgagctttttttcatgtggcagactactatcttttatcaaataaggaaagattttttttcaaagagttttaaaaataaatgttgctaggaaatattactgtttgaaacaaatttaaaagtttattgtaaccagtatttatttaacaaatgtgtattgattgcctaatactactcttctgttccaggtattggactatagcaagaaaaaaaatggcctcatggaggttatattctagaggaattagatagataataaacacacacacacacatacatgtgtctgtatgtgtatatgtaaaacatagattagtaaaatagatctgtatatacatgcataaacacacatgtatacacacaggaatgctctgctaaagcatgaatgcatatatactatgttaaaaaaaaacagggtaaaaggagaaccaagtttctgggtggaagagtaaagacctttgtgataaagtgatatctgagaagaaacctgatgaaaatgtagatattttgaatcaagtggcatatttggtgagattctgaagaatcaatactagtttctatagtctacagtgttttgaccatactgattactgtctgttgaatctacagttcattagatctgagagtttaatagtgattagtagtaaaagattagtgtctaatcatagaatatatgtttatgaagtaatagtgtttgataactttaaactgcatagaaagccttctgggcattttataatattttaatatatagttagtgactcaggacattaaatgtttcctgagatataatttttataactattgttagataactaaatatttgaaccagaaataacatggttgccaagacaggtttattattaccactctctacaacataagacaatttagtcatttattgtttttataaagcttaggaatggtctctgtcctcaacggggtgacttaaaaaataagtgcagtaaagcattgctacaataacaatagaaggctgtacagggcacaatgtagacacaaatgtgggggaatgtaattctgtctgggagaggtgatcagagaccttttggctgacttttgacctcatcaaggagcttgcataaatggcgaatgaaattgattaagccatgaaagaacataaagcccttaacttcagcatgctttgctatatgttctggagtttcattttgatgtgctactttggggaaatcccaccccccaaaatatgtatgtatttgttactgtcttttcaactgaaaccaaatataacaatttcagttagtatctcaaacatctactctggctaatttcctcttaatcaagcctttaaaactatcttgcaagatataaatgttttgctttatactaggtttttgtgcaagtaaataaactgaaaaaaaatcactattttaatcattaacatgttcccttaaaattaagacattatgctgtttgtagaatttactttttcttcaactgaacatcatttaaccatataccttctcctgcaatatttcttattattagttgccagaaatattttcttaatgaaaaaggttagcatgggttgtcttgatacaaatcataactaaagaaaaatattgaaattacatattaatattttctttggaaataacttgcttttgtgaatgaaattaaacatttttatgatctttaagtaacaataaaatgcagcacttaaaaagttatatatggatgtaacatttctttatattgcttactctattattattaactcattaaattttccacacagataaattaaaacaatagttattattatacataaacatgtttcaaaattaactgtgatttataagatcatttactttgaaatccaatatgcaaatatttattaataatgaaatttgaagactcttaaataggttattgagatattctgaatatacttgacatgagttagtaattaaattttttcttcaatattaaatcaatatcaaattaaaatctttagctcacagttttggtcattaaaaagtatttaagctgtgtactgtctaatgaacacacacattgtttcaggacgaaatacgtgacctcaattattgttaataagtatcagtttctttgatatatttcaagtaccactagaaatacttataaatattatctttaattacagacaattcatgtctctttaacctggggtcagtaaaatttaagttcattttacatgagtgatgtttaaaacagctagtgacaagaaccctcatcattaccatgtaaattgatgatgggacattgaagagagtctcagttttcttcttaaattttcactaatacttttcctttaccaaaatctataccttgactgctttcttttccttcctccttccctcccttcttccctatcttccttgctttcctccctccctccctcctaccctcccttcattttctttcctccttcccttcctcattcccacctggcctccctttctactgactcatgttacattctctattttttgtcattttgaggctctggacatataaaaataaacgttttttaaaagatcattagacattttactattcaatattcaataaataacaaatatttattgagcacagctctgtacaagacgctgtgaaaagtactgagaatagagcaagaaacaagatcaacaggagccctagcaataaagacagtctttaaataaataataaaagtaaagtaacatcttacaatatgagaagtgcagagagctaagggaaaataaagcaaagatgcgtaagctaatacagacatccaagtaaagtaccttgtggaagttatgtttaaactgaaacgtgaaaaagatgaatccagaatgttcggggaagtgaacaacatatgaaaatatggaatgaagagagagcattgtccattgaataaataagataatttttctgttgctttttaacactccttgaagattaaatggtatatttttgtgtttgctccatcaagagaagaaaagactcacaagtttataaccacatccacccaagggattcagtaggcattcttgtatgcttaacaacatcctgacctctaatgaataacttggtctttgtgtttctgaaatgcaattagcctcctctgccttcaaggcgctgaaaagcgaggaaaatgttctttggagatggggtttttgtagagtaaaaaggcacagcaggttaaggccaaatctcactctcaaggccttggccagtatagagatatttgtttatttttcaaaaaatatgtattgaatacaattacaacaatatagagaaggccttgccctcttggaactgaaattctaatagtaaaacagtgtaaggggccagaagggctggggattagcaggtaactttggcagattgaaaggcactctgaaagactctagctcctgtttcaggaagccacctgcacaggtatatctatctggtcacaatgataccccatgaggcaagaaatattggtaacaaaggccatagtagacagccagactctgtcctgtttcacaagagatacgagaagtacctctactttactctgcatataccttgagagattgctgaattatttttgatttggtatatgttttgtacatgaatctctggaatcaactatttgggcattatttatatcctatcttagacattgtagtactcacctttaagttccaaacaattaattgcttgtaagaaattctggtcattcagctgtctctgtccagaaaggaaaattaggtaactgcatggatgcttacttgaaagatataagatggaccatggaaaggatgctctaaataaaggaaacaacgttatgtaaagcatggtggcataatgagtattaggaatgtaaatagtttgatatatcattggatagaagaaggtgagacagcattgactattaattatgagagaaggaacaattaagagtttcctttaaaatattttaacttttattttatgttcaggtgtacatgtgcaggtttgtaaacttgtgactcgtggacttggtgtacgaattatttcatcacccaggcattaagcataattaagcatagtacccaacagttgcttttcttttctttttttttggaacatctccatcctcctaacttcctctctgaagtaggccccattgtctgttgttcccctctttctgtccatgtgttttcgttatttagctcccacttttaagtgagaacacatggtatttggttttctcttcctgcgttactttgctaaggataatggcctccagttccatacatgttcttgtaaatgacatgatctcattctgctttatggcttcagagtattccatggtgtatatgtaccacattttctttatccagtctactaatgatgggcatttaggttgatgacatgtctttgctactgtgaatagtgctgcggtgaacatacatgtgcatgtggcttcatgggagaacaatttctattcctttgggtatatacccagtagtggtattgctgggtcaaatggtagttctgcttttaattctttgaagaattgccacactgctttccccaatggttgaactaatttccactcccaccagcagtgcataagtgttcctttttctctgaagtttgctaacatctgatatttttgactttttaataacagccgttctgactggtgcgagatggtatgtcattgtggttttgatttgcatttttctaatgatcagtgatgttgtttgtatttccatatgcttgttgaccacatgtatgtcttctttttaaaagtgtctgttcatgtcctctgttcactatttaatggggttgtgtgttttttgcttatacatttgtctaagtttcttgcagattctgggtattagaccttggtcagatatagagttcacaacaaatattttctccaattctgtaggttgcctgtttactctgttaatagtttattttgctgtgcagaagcgctttaattaggccccatttgtcaattttgcttttgttgacgattgcttttgatggttttgtcatgaaatctttgccagttcctatgtccaaaatggtatttcctagattatcttccagggtttttatacttctaggttttacatttaggtttttaatctatcctgagttgatttttgtatttggtgtaaggaagtggtcctattttactcttctacatatgatagccagttttctgagcaccacttatcgaatagggagtcttttccctattgcttgcttttgctagttttgtcaaacatcagatggttgtaggtatgtggctttatttttgggctctccattttgttccattcatctgcgtgcctgtttttgtactagtaccatgctgtttcggttactgtagtatagtttgaaatcaggtaatgtgattcctccagctttgttctttttgctaaggcgttccttagctattcaggctcttttttgttctgtatgaattttagaatagatttcttctagttctgtgaagaatggtagtttgataggcatagcattaaatctataaattgctttgggcagtatgaccattttaatgatattgattcttcctatcaatgagcatggaatgtttttccatttgtttgtgtcatctctgatttctttgagcagtgtcttgtaattgttattgtagatatttttccccttcctagtttgctgtattcctaggtattttattctttttgtggcaattgtaatggagttgcatttctcatttggctcttgccttgggtgctgttagtgtataggaatgctactaatttttgtacattaattttgtatcccaaaaccttgttgaagttgtttatcagctcacggatctttttggcagagactatggggttttctaaacatagaatcatgtcatctgcaaacagtgacagtttgactttctttatttctctttgggtgccttttatttctttcatttgcctgattgctctggccaggacttccaatactacattgattaggagtggtgagagtgggcatccttgtcttgtgccagttttcaaggggattctttcagcctttttctattcagtatgatgttggctgtgggtttttcatagatggctcttattattttgaggtatgttccttcagtgcctagtttattgaagacttttaacatgaaggtatgttgaattttattgaaagcctttcctgcatttattgagataattatgtggtttttgtctttaattctgtttatgcgatgaatcacatttattgatttgcatatattgaacccaccttgcatcccagggataaagcctacttgatcatggtggattagctttttgatgtgcagctggatttggttttctgatactttgtcaaggatattcgcatctacgttaatcaagaatattagcctgaagttttctttctttgttgtgtctctcccataacttcgtatcaggatgatgctggcctcgtagaatgaattggggaggagtcaatttcagagctcattattggtctgttcatggattcattttttttccccaattcagtctagggaggatgtatgcttccaagcaaaatatttatatagatgtgtatgtgtacaaatacacatacctacatacatatactctatattctgcctactgagaatgattagaaacagcgtgcctcagtgcaatgagcatacctaccacccagatcttagcttctaaattctattctctactaaaataaacaagggcttactgaggaaatgggctactctagggctagggtagggaaagtacgagatgaatctggaatatcttattatgtcaccaagtgaagatgtgctcaaaggatgatgaagacatatcagatgacctaaaaacctgcttgaaaagattcccacttgccaaatacggaatacattgtgcacctaaacaaatgctatttataacattataaattatatatcttcaatgggttatagtgttatatgtaaagtcctgttattatattatatataacattatttatatatataacattataacccattgaagatatgggaaaccatgaatctatgctgctatcagtaaataaaggaataaattaaaagtttgatgggggatgtcatatttacatagctttaaagtatctcccaataaaatacttattaattggacaattaataaaaaaagagttacagtactatgaagaagttaattaaatgatcaaactgacacaattggaagtgagacaaatcaaaattacctgactggatgcaggtgacagtacactgtgatttttttttttaatactccttccaaataagcataatatgaatacaataaaacataattcaaacccaaataaagggacattttacaaaataatttcaaaatcttcaaaaatgttaaggatataaaattcaagtaaaaactgaggatctactgtagattgaagaagataaaagacaaatgacaattatatgcactacaatttcctcagctgaatccatttgctgtaaagaacattatttagacagtctgtataacttgaagaggtctgaggattaggtgatagtaatgccgatgtcacataagaagttgttaatattgatgattttattgtagttacataggataatgtcttttttctgcattagaaatacacactaagtattcgggtgtgatcgggcatcaggttgacaacttattctaaaatggtttaggaaaaatattattcttagtattggacttgaagattttatgtaagtttaagtttgtttcaaaatgaataaaaaacaaattatattgggaaatgattcatgattttgctcaagtgattaaatgatctcccttatgtttgcaaacgaacacggtggctgatatgtagacaaggtactcggagtgaagatagagaatgggcaaaggtaaaaaaccaagagacaaattgagatgccatagcaataattcagaggaagatgatggtggcttgaactagggatataacggagcaagtggtgagaatctgttggatttgagttatattttgaaatgataacccacaatacttgctggatgtcgagtgtgtaggaaagacagtgtttggcttgggatgactttaagctttgagaaaggttcttagacctagaggcattgattaatatagttgtctttaacttgtacattttcctcttctggtattactgctttcatcttaatggcatgataatactgcaaaagtgttctgaaaataatctaaattattgagaaataaactattcatgagttataggactatgtcttttataaaaaccttgacaattttattacagtttacattctgtcagtacgcatgtgggaagcaacatagcatagtggttggagtaagtactatggtattagaaatgactttagctttagcttgggcaatgataattttggacaagttactttctcaatatcctcatataaaatgagggataataatatctacttcatagaattgtgaaaggattaatttaaaacaaagtgattagcactgagctaaatattgttgtagtcactattatcagtagtaaatagtgatagaaaaaacattgtgtgatacctccaaagatctctaacaaactcttaaagaaattattagtttaaaaaaatttgtggaagagaaatggaagaaatatataaaatgccaccaaggattaccattgaaatttgtggcagtggctaacaggtttttcaaatttcatcagttatgcacatttgacatagtttgcttgcattcaaaacatgaaaaaacagtaaaaatttttaatacctccttggtctgggaacattgccttaaattatgaccgtgtttctaaaattttagataaaagcatttggtacagtattcacctcagagaggtgagtgttcttgttgcttagaacagaacatactttttcaatgccttccttcctaatccaactttatattccctatttagtatgcctaatcattattctagggctcgtttgaaaacagttgttcttaattgtaaaattgagctgtgctccattaagctcctgccgagctgcttttgagatccttggtggtttggaatgtggagatgcatccacattctccccttgccagtccttttcatctttcctctctaatgccatccctcagtgtttcagctgctaagtggttctagcgtatgtctgatataattttctggtgactgatgcactgttctcactactgatatgtcagcaggaatgccacctgtgtctgggaattcaaaaccatcaggacagtgtattttaatggagcaagagggaaaaatgtagaattaaatggaaagaagcattccagttctaacttctaatatttaattttggagaaactgtgagggtaaaagaaaaagtgaatgttacatgagcttttaaattaacccacaaagaaactgaagtattttttatgaaatttttattccttttttaaataatttaaacttctattttagatgcaggaggtacatgtgcaggtttgttacatgggtatattgaatgatgctgaggtttggggatatgaatgatcccataacacaggtagtaagcatagtacccaataggtagtttttcagcccttgcccacctccttctctccctactcttatagcccccagtgtctattgttgctatctttatgtccatgtgtattcaatatttagctcccacttataagtgagaacacgtggtagtttgttttctgtttctgtgttaattttcttactataatggcctccagttgcatccatgttattgcaaatgacatgatttcattcttttttatggctacatagtattacatggcatatacgcaccacttttttaaatctaatccactgtttatgggcaccttggttgattccatgtctttgaatggaactggagatcattacgtcaagtgaatttttttttaatgtaatgtctcaacttttgatatggatgtttgtacatttatttattcactatttgtgaatatctaactttgttttgttctagggacttgtctgggtactgggaaaaacagagatgtagtgctgctttcacagaacctagagtctactttggagcatacaattttaccaaaataggtctcccagcttcaagtctacaaagttgttttatggtgatatagtaaaaaaaagttaatggtaacatccattcatgtaaacattccaaatgaactctttgctaaataatgaagaatgcttgtcctctggctaaataatgaagtatgtttgtcctctgtaaagtagacattgcactttaagtggcaggcttctagaagtccacaaggcttttgtggggaggagaatggacaaatttgatttaaggatcaactttcaactgcaaaatcaaagaagtataaaaattgtagaatgaatttacaacttggatttacaaaattaatttgacaataaagtcattgtagcaatagacacgggatcctttaataaagtcaagaaactcaagtttctaaacctgatgttgagcttcacccctattccctatatcactggtgggttggtatgtcatgttttctccaccctctggaccacgacattgttgtggattcttccatggaaaagccctaactgttattactgtgcttgttatgttgtctcatgcaacaacattcctatatttatggaaatgccagacaagttttgtctgtttgggttataaataaaacctttcctctacttagagaactagaccttatatgtgggttgaataggggtcttttctctggaattagaaaagagaacataaatttcactcctgtgccttttgcctccctcctgtcaccaaaaagattgccagagttattaaagaagagcaggtaacaaggcaagagtcagtgagaaaccacacttgaatttcttcttattcaaattattctatctgcctaaccaatgtatgaaacaatagttatctccagttcgataatctttactccacagagattaaagtgcccacataaatatgtaggtatttaatgaactcacaatttgtttttgtaataggttactttttgagatataattttaaaaaccctagacgaacaccctatatgtgatcacttaatttcagtaccttttgcccataaagagaccatcaaccaattattgtgattccttccctactttattattctctaacatattagtctgttatattatcttgatattcccgaatgctacttaaaattcttttatttctctacctattcatagttcatatttccttctctactttcactagactagaaactacttgtgagcagactctatttttcttgttcatgttgaaacaactctggttaaaacagagcttggaaaatagcatatttactattctgaatgagtaaaaaagtcagtctccataaatggaacaagattatctgttctagaagtaatcgtttttaaaagaaaatgagacatttcttcacctaccacttgctataacaagggcttattggaaagactatttatatatcaaaagtaattgtttttaaaattgttaattaaatttcagatgtcatgtcaattaaatccttttacttgaaatttcatgaattgagatattcagttaactggaactccatatgtataatatgatggaaatttaaattcacaatggaaatattgagaaattacaagactctgaaatatcttcttgtctacagaaaatgaatattgatttaataaagttttagaagttaagggatctattgttttttctttaattatcaacaacccatttatatataaagggtatccagtgtactttaattagaatatttaactaattagtagatgccatttattatgataaaatatacctttgtacctatatatggtgagccttgataaacattaccgattttctaaagttattgttattcagacacttaagagtaagactactttgaaagaaataatgatagctgataaatagtgtttgtatttttatttttccttgaaaaagtccagtggaattgataaagtacatatgcctttaaaaaagatactatacatatttattaatgtattagggttctctagagggacagaactaataggatagatgtatatataaaggggagtttattaaggagcattgactcacatgatcacaaggtgaggtcccacaatagtctgtctgcaagctaaagagcaagatagccagtctgagtcccatagctgaagaacttggagtcccatgttcaagggtaggaagcaaccagcacaggagagagatggaggccagcagactaagccagcctaatctttccatgttctactgcctgctttattctagctgtgctggcagctgattagatggtgccacgcagatttgagggtgggtctgcctttcacagtccactgacccaaatgttaatttcctttggcaacatcctcaaagacacacccaggaacaatactttgcatccttcaatccaatcaaattgacactcaatatcaaccatcatattaagtacattaattctgaagaacccaatgatgatctatgctattattaaaatccaatgataagtaaaaaacaggatttttgtgtgtgtgccttgaggatctgcaaagtggccaaactccctgaggacttgaaaactgcttaattttcccaccaccaaaatttcaaatatgagttcatctgttttgatcctctccctcttgtaacaaaagcggtctgtgttctgaatctcatacactttgtccttctcaaaacttttgcttattgggttaccaacctttatttgacatctcacctcattcccagattttctgcttgaatatttcaaacaagatgtcaacactgagcttcccaactgatgtaatttgtcagacctgcagctggtcaagaagaacctcccatacctgcctcctccaggcctgcctctgggagctggctctcttgtcagtttatcacagtgcgcataaaatgttaatcactttcttatgagtaacatgatgcattaagtagggaaacactgactttatagcatttttttgtttgtttgagacagagtctcgctctgtcgcccagtctggagtgcagtggcacgatctcggctcactgcaagctctgcctcctgggttcacgccattctcctgcctcagcctcccgaatagctgggactacaggtgcgtgccaccacacccggctaatttttttgtgtttttagtagagacggggtttcaccgtgttagccaggatggtctccatctcctgacttcgtgatccacccatctcggcctcccaaagtgctgggattacaggcgtgagccactgcgccaggcctatagcatcttattgttatttttttatgtttaagagactttcccttagcagtctttcttacacataggatacatactttcctatattattttaccctgttacattttcatagtactttttatacttcgtaactaaatctttacatgttaatttatgttaatttacccacttgtccattttaccaatgagtgaaaggggcaaataaaactgatacgcttggatttcatcttattatcttcttgctattgtttggaacacaaacaatattgatatgagaaagggagggagaaggaaattgattaagccaagatttagggggtattgtgtccggaattggtgggttcttggtctcactgacttcaagaatgaagccgcggaccctcgcggtgagtgttacagctcttaaggtggcgcgtcgcgagtctgtcccttctgatgttcagatgtgttcgtagtttcttccttctggtgggttcgtggtctcgctggctcaggagtgaagctgcagaccttcacggtgagtgttacagctcttaaaagcagcgtggacccaaagagtaagcagtagcaagagggaaagaacaaagcttccacagtgtggaaagggacccgagcgggttgccaatgctggctcaggcagcctgctttcattctcttatctggccccacccacatcctgctgattggtagagcccagtggcctgttttgtcagggcgctgattggtgcgtttacaatccctgagctagatacaaaggttctccacctccccatcagattagttagatgcagagtctcaacacacaggttctccaaggccccaccagagcagctagatacagagtgtggattggtgcattcacaaaccttgagctaaacacagggtgctgattgttgtgtttacaaaccttgagctagatacagagtgccgattggtgtatttacaatccctgagctagacataaaggttctccaaggccccaccagagcagctagatacagagtgtcgattggtgcactcacaaaccttgagttaaacacagggtgctgattggcatatttacaaaccctgagctagatacagagtgccgattggtgtatttacaatccctgagctagacataaaggttctccacatcctcaccagagcagctagatacagagtgtccattggtgcactcacaaaccttgagctaaacacagggtgctgattggtgtatttacaatccctgaactagatataaagactctccactccccaccagactcaggagcccagctggcttcacctagtggatcccgcaccggggctgcaggtggagctgcctgccagtcctgcgctgtgagctcgcattcctcagcccttgggtggtcgatgggactgggcgccgtggagcagggggtggtgcttgtcggggaggctccggccgcacaggagcccatggagtgggtgggaggctcaggcatggagggctgcaggtcccgagccctgccccgtgggaaggcagctaaggcccagcgagaaatcgagcacagcacggtgggccggcactgctgggggactcagtacacccttggcagccactggcccgggtgctaagtcccccattgcccggggccagaagggttggctggctgctccgagagcggggcccaccaagcccacacccacccggaactccagctggcccgcaagggccgcacgcagccccggttcctgctcgtgcctctccctccacacctccctgcaagctgagggagtgggctccagccttggccagcccagaaaggggctcccacagtgcagtgggggcactgaagggctcctcaaatgccgccaaagtgggagcccaggcaggggaggtgccgagagcaagtgagggctctgacgactgccagcatgctgtcacctctcagtatgactaaaagttgatgaaactgatttttatagaagcttactatttagaacttaatgatacataacactagtgtactttgaggaaatttcattgaattgttgggcacaactgttgttcttgtatacttagcactttcccctttgttgtgaagacagagcccttctcttgctttaggacactatactttgcatcgatccttcacccacagtaagaatatcgataatattgccttgcttatattaccataagtgaccaacactggcctatctgtttatcacctactcctggaaactgtgattgattcagaactaacaggtataccaaccagggtgattagaatcctattcttggtaattgacgtaatgtcaacactaaatacgatacaaacctaaagcaactgtggccattttgctaccacaaagagaacacctgattaagtattaaacatacacagagaaagacaaaagacagaacatggagggagaaagagttccaataatctcctccccacacatagattcaggcaagcctaaatattcctgaatttttcagtagtataaatatttttggtttaagctaatttgaattgatgggctgtaatacaaagtttcttaaatttattctaatcattcctcaaaaacacatctcaaaattcattttcaaatataattgttataaaagccagtatgtgtccaatctcacagatgatttttacactggccaattttctttgggcaaataaaagtgaatagtcaatatttacagtttggcttttttttttttttttttttttttaaaacagtctctctctgtcaccccagctggagtgcagtggtgcaatctcggctcactgcaacttctgcctcctgggatcaaatgattctcctgcctcagcctctcaaatagctgggtctgcagtcgcctgccaccacacctggctatttttgtagagatggggtttcaccatgttggccaggctggtctcgaactcctgacctcaagtgatctgaccaccttggcctcccagagttctgggattacaggcataagccaccatgcccagcccagtttgaatttaaattgtaacatttatgtatttaagcttttggtagaaggaagttaggaagagattcacaagaactttctctgagctacattcacttagggcaaaagattcctgttggtaacatgatatttttatcaggattactgcttctaaaatagtacaatatatttataaaaattatggagaatatatatttttaccaacctaaatccattaattttaatcacaaacctatgattgttaggattagtatctgtctctcatatctgtcttaaagaaacaaatttatatagatagaaatttctatgtagagtatttcccatactttcatttgaccagtgtttttagaacctctcttaaaatgtaaatttactcaaaacgtcatatataaatcagttaaacctagagttcttctagttcaagtgagaatgggagatccacagtttatcccttttgaccacttccctcccgagtcacttttgggaagagcatagggtttaatgaaactgttgaactatactgggcatgttaaaacgtaggccaaaggtagcaagtgacagatagattattattgtacacaggtagtgtatttttatccccatcacattgcttgttaactactgtctttttaaatgtcataaattgagaagaagtttttgttttgttattctagtaagaattgcccctggaaatgtatgctcgtttcttgcatgctgctgtgctcgttgaaaaggtggcaatgacctgacagatgggacaaggaatttattttgcctgaacaatcatatagttaatggaacatttaaaaattgactttttatgattatgtgattaacaggaataattcctttaaatacactgtttgctaagagctagaatacaatgaaggtttggaatagctgtcttctgtgtcaaaaagagtgacaattcagaaacagctgaaataagtgatatgggttaaagggaattggtacatggaattttctttgtgtaagtagtttactgttcagtgagcaatttactagttcaacaacggtagcagtgtctttctctttttttatttttggcctacttcacataaccctgcaagcagttgtgctgagggatgtgctgaaaatagatttgccaaaagagtaggttttaggtacacttactgaaaaaaaaggaaagaaaagaaggaaaatttaaaaagataactatatgagatgatacatatgttaatttgcttgactgtagtaagcacttcactatatatacatatatatcaaaatatcatgttttacaccttaaatacatacaatttaaaaaacaaaatgtgaaaaagtcatatgtacggaaaatgtaggataaatggtgtagttgaaaaattaactgacgtattcaatacagatatattaatttagttaaataaactaaaatctctagggattaagctacctttatgataatttagaatcctaaaattctgtgagataaaaatatataacattttggaaggatggcctcatgttattttacatagcatcatatataacctttcaaactcatatcagtctttagtaattaccttaccagtagttcttatttatatttgtcttgtattttttctatcataacatagttgttttcctctaacatctcactatccacaaaatgcagtcaatttatttgattatgtgtaagaaataagtaaatgctattttactataaatatgatttctttaaataagttatcatgaatttccttattgaaaacagtctaatcctctgtttggctgtgcatagttagtaactcagattttcctgtatttctattattatagtacatagatagtattgatcaagatacacatttattaaagagtgttataatattaagagctttaaaaggttatgcacattttctgagaaaaattaatatttgtgtattttcaatggaatgaataacccataggcatggattggaaaataaaaaatatgcttatctgttaataaaattataataacttcatcaggtcaaacacatatagttcgaactgatctttaaagtaattactcccttttaataggtatttcagtcataagtttaaaattgaggttaaaagatgttcaggttcactgccaagcattgtgggtatagagatgagcaagttgtacacagtcccggcactcatatatatgctctaatgctggaaacagtccattaataaatagctagagtccagtgtgataaggttatgctcagaaaaatggggtatactatggataattacttataagagcaaattatggcaaaaacatattgtccgaaagggaaattgttaaataaataaattataatgaataattgtgttttactataactgaatattctgaatctattaaatatattctctaatgcatgttctatgaagaaaatatgcacaataatgttgttacaaagaaaaggaggaaaaatacattaattctgtgttatctccatcacatatacacatatataaagagagagagagaaaatgtgggggagggaaagtgtggctgctactgtgaactgattttcagggctgaatgaagaagcacggattatgctctgcaagacaagcagaaggaggcagcatatgcaggaaggtgagcacagccgagagaggcgtattccagactgaaacaaagtctgagagtgtagtaggcatccaacagccataatcgccacccttgagttctgtaaaacctctttgaatcttaaaatgccccccttttacttagctcaatttattttctataatttgtagccaaaagagctttaagtaagagaggtaaaaatgttcaataaatacaagattagaaattagtattctataagaacttatctattcctcatactataccttttggtgcctgagaattgtgtgcagatgagcttgcttaacgatctcaaataagcttcccattataatatttatgctttcccaggtaaggcctccctttctatattcaactttaaagccaaattactgggtttttttagtatctaagatggctgaagtaataggtgttaggggaaactgccttgcattgcagaaccattcattgagcactgctgtccaacaaaattgtatgtgataatggaaatattcattctgtgctgtccagtatgatagccattagacatcagtgactattgggcactggaaatgtagttagtacaactgggaaactgactttaaatgttaattaattttaatgaatataaaataaatagccacatgtggctggtggctactatatcagagagcaaagccttagagtgtacctatgaaaaatagagatattatcaatgttatcttggtgtaaaaaaatcacaactatctcttattttcttatggacactggatatcttcctgatttataagatattagttgacatcactaactgaatctttaaaataatgtttttttcttattttattgaatactcaaaaaaatggaaaacttaaaaaaattcaaattatgccttcagtctcaaatcttatgagttttgctaaacaaaacaaaatgaaagaaaaagcaagcaaacaggaaagaaaatgtaaaaatatatcaaggagcaggcaatagatagtgagttcgtattatttccttagagaaatattatttgtttagaaatcaaataaattttgaagacatgtctgaaaagtgcattgtagacaatacactatcatcgtcaaaacacataaacatgtagacactttgagccaatgtatctacagaaaaaaaaacatgtaggcaatctttttggtctctagaagtcggtttaaaaggtacataagtataataaagaattaataattttagcatatgataggaagaaatcagtaagtgcttaaaaatgagtaagtgctgtaataattccaaagggggaaaaatcactctggcacagatggcctcagaatacataactgaaatttaggtagggcccagataatttgcaaggtgaaaaaatagtttttaggagggaaaacatagctgaggatgggtagtgagaaggtatataggtctatacaagggcaaatggtgggaagatttgagaaggaagattggagacacataatggatttattgaggatgtccaaagagtttggatttcattattaataaaataggataaatctgactgagttatagagaaaatccttaagaaactcataatatagacaccaatcacgtctgcatctgttaaatgagcaaccacagatgtattggctaattcaatctatcattttctggaacgcactttgtctatgcaatgaagttcatcctttcaaaaatgaaatatttattgagtataaaaattaatagtaaggtacctttttataactaaaagattatttccaaacaatattcatatttggaaggaaggcttaaattcaggcacttcagaagttgctcaaagtggctttttttttttttggcagaaatagtgcggtgactgagctgttcttgaaaatattaataactcccgcgcttaatgtgagaggaaaagcaaaccaaaaccttacttggcttagaaagcaaattcgctaaagcatgcaagttagcattgctgcaaatccactcgcatcggtctacctttatctactgtgctgcttacatatatttaacgaaatggtaatttatacaaaagtatgcagcactttaacaagaagaaagaaaacaaaattgtaagtaaactgtgggaggcaaagagatgaggtccttgtttaatgttcattctttaagtctgtgactaaaagcaaaaacgaaaacatttttccatattcttcttagatttgtccaatgtctttgtgtgacaatggaaatattttatatctgcacttttcgtatgtgctattagtcatatgtggttactgagcacttgaaatatgactacgtgactaactgaaattttaattttattgtttgaattaaatttaataaggcaggttatttaatcttatctatatggacagctaattcatatcacataggacaaaaatatcaataattaggaaacctaaagggtcaagtgtaagttttgaacattacattccaaatatacactaacatctccctttataaatgtgtccagcctatgctaaaataatttgggcattaaacatgagaatatttcctttccaaattcctatcatttcttctcattgttactattttttttaaccatgaataaattccttgtgagagactacagtgagaaaacaaatttaacaatagatttgatgttgactcacagggattaagaatgaaaaaatgtgtattaggtaaatgttagaagaggcaatattaaatatctgcaaatttatccattgaattccaatttaacaagatgctacccctgaaaatactttttatatcaaatcaatattttaaacatatataaaatttcataattttatttataaaaatagcaatgttttagaatttcttatcacagtaaggtagaattcttgaaataaaatgttactgtgatagagttttacctggaaacaagaaatatgatatatatatgtgtgtgtgtatatatgtatataattatatataatatatataatatataattgtatacagttatatacatgtataattatatacatatacatgtatataattatatacattttatatatgtaatatatatgtatatatattatatatgtaatatatatgtatatatattatatatgtaatatatatgtatatatattatatatgtaatatatatgatataatatatatattcatatatattatatatatgaaaatatacagtatttcttaaatttaagactgcaaattataaactcaggtgtaattatgatggatagatacctacatattttttccataggaataaaaggacaggtaatatattcctggatgtgaaaagagtaaacagattattcaattttaaaaatatttttgatgtagattaaaaccttttaactaaatattgttaagaacccacaaaggaaggcagaatttgtgtattctgtttctctatgccattgacctgctgcatgttttgttgccataaccttaattttcagtctctcatgtattcatgcacaacctttatcctcagagtttggtttaaatcctgattttgatggtttcaatctgtgcgacattgggtaaattgtcttacattgcatactcagaaaaaacctttaaaaggggttagaatgggttaggagcagaggtgattcttatggtagaatctgagtaactaaacctgagctcagactgctattgcaagcatgccacaaaagggaggtaacatatggtctgaataagggaagtagaaataatttgtaagttgacagacaaaaacattagcagaattaaattcctttttttaaaattatactttaagttttagggtacatgtacacaatgtgcaggttagttacatatgtatacaagtgcgatgttggtgtgctgcacccattaactcgtcatttaacattaggtatatctcctaagcagaattaaattcctaaaattaatgactcagagaaaaggactaaaagaagacaatgaaagatatattaaagaagtggtcaaggaaaaatgcaaggcagcaaatgatggtgattcagaaagagatttgataaaacatatggaaaggtagatcagttaatttggaagaatatatttattggtgtttattacatttgaatttctaagatacttatttgtgcaacacagctatgataaatcattggaatttgcaagaaaaataagagtttgaaaatctgaaaatgagtaacagagaaagttttatgctaatgatttaaatgaaaagttatcttcttaaatacaaatagggcagaattttatagcgtttaatatatctttatgggggcatgtgaagtgaatggataaatctaaagacatttggattggactctggaaagtgtctctttaatggaatcgtatatgctaaataattttgtagtgattaaagatgtgggtgtactttgaagtaagacgcttaaatattatttcagcacttacgtattatgaaacttcaagtaaaattctatgcatttgtctctttctctttttcttagggtggggttgttggataaacttgtacatttcatttgcacaatggagtttgctctttaaatacaggaaatcattgtgtggtccaatggtttagagcattatatactttcagttgagattatttcagtttgaatatcacttcaatagttactagccatgtgagtttaagtaaatatatcacagtctcagttgcatcatctgtaaaatggtcataaattatcataatatttagagttaaaggattatgaggattacatgaattgatccacatctattagcacagtgcctgacataactgcacactcaaaagctgttctctatcattattacgtaatatatagctagttacccaatagtttatctttgtattattagttagctatgtcattgcataagaaaccttgacttattaatgaactgcttcctacaatttaattttagttagttatctaaaacatataatgcattaatgctagttttatataatagttcataaatattcttataccataaaggagttgaaaaatagctacaacttaaaacaacagacaatatttagttaaaaaaaaaggaaaccagcaaataaaggagatcagcaagcataaaatagagtacaaaaatgacactcagtgatttctcttggctggaatctacacattgactcatagaaaccgtcaagagcattctaattttaataacattataatgtgtgtgtgtgtttgtgtgtgtgtatgtgtatgaagacaaaactattttgcaatgatatttagcaaagaaacagtgtttattttaatttttttttagattcatggggtacatgtactggtttttttttttacccaagtatattgcataatgctggggtttgggtatctagtgaaaccatcacccaaatattgaacatagtatacaataagatagtttttcaattcttttcccctccctcccttccccttttggagtccacagtgtccattgtttccatcttcatgtccacgtgtacccatttaggtctcacttatatgtgaaaacaggaaaggcattacataacatttaaattatgaattaccaaatagggtccatgaaattttgtgtttggttctttaagttgaaattttgtcagttttgagaaaaaatatctcaattgcctctgtgtcaaaaagtgcaggctgtttgtaagtgaagaaaaagaaataaaaagagaatttgtagattcatcctctatttggtttttattttttgcatgtaaatattgagccagtcagaattctcctctcagcatgcagttctgtgactttattttatttcattgctttaaccactcttgtacttgaccacatttactcacctaccaagggaaattttctgcttcttctcccattattaaagaaatcctagattgagtgaggaaaggaacagaaaatattttgagaagaccgacaattgtcatgatttgagtaaacatatgtatcctgctactcggtttcttaaagtacaattttgaatataataattattcagtgttcttgaaaactaacaaacacatttttctaaagaagtacgtatctagtttttagaagcagacacctgtttctttggtgaagaaaacatattttcaagattgtttataaggaagcacatacacataaatactaaaaaatttaaatataattttcaatttcttgcataagttataccaacattaaattttacagaaatgcagaatgagattagttacatatatcaatctgaaaataaacaaaaaaattttaaagaaatatactcttattttaaatatattctattagtgttatatttccagcataaaacacatatataatccattaaacagcagaaagaataagatcattttgaaatttaaatttaaagaagtattttgatcttaatctatttcatgaaattaaagcctggactataaacacttttgtattgtttgatttctgattacagatggaataaatggaatctgccaccttcacctcatagcaaaaaaataagaacaagaaaaaatatttacaaatatgtataaaatatagtctgtgtgtatcaatgaaccagaacatacgaggaaggctgagaaatgccttgatagttacacagggttctggggatagcattcagctggccccaggatactgatcacagataaaactaccagagcacagttatataatatatgttacatatcttgtaacggaaagacaacaatcctttatttgtaacatcagtaatctgagcaagatagctttgggagcattctataaccagtttggcaacagcaagctgtagagcgggccaatgataaatcacattgaatcatcatttgtgtggccaatgcaaggagtctgcagtatgagcagcatgcagctgccaatttgtgatgaacgaggaaaggtaaaggttaaaagaacacattcgcacacaaaaccttgtgttttacaggcaacttcaaaataaattaggaagatgggctgctaatgggcaatatgactctaacctgagacctctatcaaaaaaaccccaaaaaacaaaaacctgcaaaaaaaaaaaaaaggtactcaagtgaagaaacataagtatattacttctagatatgttttgaattaaaaaaaaaacagagtactctttggggaatttgcggagaattctccagtcatctgagggataaaaaattatgttagtcttaaacttctcccaatgacattaaattctagaactcagaggattaattcttgcaaagtttaaaaaatttgatttctcattctactgtaaagacacatgcacatgtatgtttattgcggcactattcacaatagcaaagactcagaaccaacccaaatgcccatcaatgatagactagataaagaaaatgtggcacatatacaccatggaatactatgcacctgtaaaaaagaatgagttcatttcctgtgcagggacatggatgaagctggaagcctcattctcagcaaactaacacaggaacaggaaaccaaacaccgcatgttctcactcattagtgggagttaaacaatgagaacgcatggacacaggcaggggaacatcacatactggggcttgtcgggggttgaggggaaaagggagggagagcattagacaaaatacctaatgcacacagggctcaaagcctagatgattggttgacaggcgcagcaaaccaccatggcatatgtatacctatgtaacaaatttgcccattctgcacatgaatcccagaacttaaagttaaaaaaaattaatttcttttgtaccccaccaaatattcattcgagtactaaagcaacagataagagtttttgaacattaaaaattcaaggaattatttgctatgagatgaaacaaaagtcctccaaaataaactttagccacaaactttagccataaacttttctatatatagaaaaactataccacataaccgaataaatggcacaaaagttgaatccatttaactgtagagtaaggattacaacaattatgtaattataaaatactcataaatacacagatacttcagtgaaaaaattataccactagcaagagtttggaaagaaagggacgaggaaagttggaggcagctccttcctttacaatcaaaataaataactgcatagataaaatataagggttgattgagtttgcttatagatgtaaggtcgacactaacaaaactatatgctcaactaaaaacaagtgtatgatgaggtagaccagaataggatagttggaaataaatgaacactaattagagatttttaattgctcattgtagagatttttaaaattactttttaagaaatagaagtcataatatatacatgatttgtgcctatctatttctgtgtcatgggtgtggaggaaaaaaaacacacaaaacaaaggaaagcaagcacagcccattaggtaaaagataatacaatatttttatattattcaaaatttaaaatatagatttaagatcaaatttcgaatattaaatgaataaaatccttaatcagaagacaatgaatcacaagttaaaacacaattataactctttaaaatatacaaaataatgatcaaatgaccaaaaattatacttaaagtcattaggtttcgaataaaacacataaacaatgaaattttaccacaaatccatcagattggcagaaattcaaaagaattttagaataatgttagtaatataatattaatatgtctgttagggtacaaagaaaataaaacactcacatattcctagtaagaatataaggtgttttagcctttttggaaaaattctggcaatatcttataaaataaagatttgatttagctaccatattaatgagaatccttatcaaaattaaaaacacatattcataaatatatacgcacgacggtattcattgtggcattaatcacaatggcatacataaaataaggggaaacaaagtgaatggtcgttgaaagggatatagttgaataaaagatggcttagctccacaatggaatataattaacagtattttaaaaattaattcatagatatgtccattgactcaaggtcatgagatattttgtgggaaaattaaaagataaaaaatgtgagtataggataattccatttgtaaaacaatggtcaaaaatgaaacacctacacacacatacacatatgttttttcatatacatatgaaacacagagaggtgtggtgggggaattaacatgtttgagtaatatggaagaaaatccattatacgtataggttgttcacacagatgacttaagagtagagaaggtgttgtagatgaaatttattgtgaggaaaagatagatgacaggaaattcaattaaaaagaaaaaagataaagactcctctttcaaagacattttgcatgatacatcatttatgaattcatgtaaagttatatatggatagttatatatataaagttacgtatatttatgaattcatgtaaaagacatatgtatctgtatttaacattaaaatcacaataatatccaggtatcaaagtcataccaagcagatacaaacgaaaaagaaggcaggacttctagttcaatatacttcagtaggagaccatgatggtactgaactggactttatgcaggtaaaatccaaatcaatattcacaaatgtaaataaatgcatcctaagttgagggactgttgaatttagagcaaaaacatttgggactttacaaatagatctaaatatatcagaaattgccaacttcacatgcaattaaaacaaatgacaaaaatatggagagaaatagcactttagttcaggttagcaaaaactaaaaagttttataatttactattttggcaaggatatagaacacactataaaagcttaaattgctacaacttatacagagggcaagtaaataatatttttcaaaattaaaaatgcccctgccattcaattcagcaattacatttctaggactttatacttcaggaattgtttcacacctgtgaaataatgtatatataagaatattcagtgttgtgtttatctacaatagcgaaagcttaaaaacaatctcaatatccactgacaggggactttttcaacaaattgtgtttatatctatacagtagaattccctgagttgttagaacaaatcagatgactcatatatattgatgtgaaactatccataagatatattaaggggaaaagatacagcatagtgtatataatatactatcatttggatagaaagtaaacaaacggaaatacaactatgcctataataactagttgctcagaatatgaaacgtttgtggctggagaacaggaataggaaagaaacatatttttcatggtatgtaaatttataactgttgaattttatatcacatatatacaatgtataaattatataatctgtatttatattgaattacttagaacccaaataaaatacttgtataaagacaaaattttaatgttaaaattaaaatgtatctctgtgtgtattccaatatttggatatatctgagcacttgtccttttaagaaaggattgcttttaaagtggaattttatttggtgttagaaaattgaggtaaaactctattaccgatatggggaaaaaattaagatgcagaagggaaggcagggttttgtgctgtgtgaaaatgtagacatatacatgggtagatatgtataaaagcttcaagaagggtactcaagaaagtattaacaatggcaatctctggggagtggaactcttagctacttaggattgaggggattggagagatcatttactggttactttatatgcttctctgtttggagttttaaaaaatgggccttattttatgaaagagaaagagagaaagagaggaagggaggaagggaaaggggcaataaatgatcctgctccaaaacaatgagaaagcactcttctccaagcgactagagttctgaaagagattaattttgtactcacttattgattaaactctctcagtagtctttgttaaagaaaaaaatcattttattttaataaaaatgtgccatagagataacacctttggaaagtgaagtgaaagtgaaagacctaatgagataataatttgcagatacgtaccttcactacaggacatctccttggaattcaagaagagtcactgagtgtgaattttatttaagttattgaatagaacacactcctccagtctctcaggcacaaaacctaatgcctaatttaaaagataagtttctgtaaaatgctgattaggtcattaacaagataaaccattaaattgctactaaggtttttctgtttgcttactttcccttttactaatttgaaacatccaacaatattgtcttacacaaaggttgataatttgaacttcagctttttattcaagtagtaaaataaaaatctatcctacaaactaaacaaaggaaaaattagaaaatatatctctgctcacaacagatggtctatttagtatataaattcagtttaatgaccagcatgcatcatttaaagtacatgttaaggatttttttttaaccttcctttatagatgtgacatttggcaactacaaacgaataaaaaatataagtcttcaacaacagtgtataatttagtaaagcaattactaatatattcaaaataaaccatgtcaattacctgcattttgggtttatcatttacttctgtcaggcatttagtgaactcttctagaaatgcaaatatagtatgttttctcacttatgttactaaaaaagtatttcccaacagtagacaaaaagtattaagattagaagcattatataagaagataatagaatgaaaatctaaacaaaaatggaaaacaccttgaatttttgattgcgtaaaatccatttgtcagaagagccctcagagtttcaactttgcattagttttccagtcaggtctccttgttcgcttcagtctcatctttcttcttccattagctttgataaacaagcattgtaaacctttaaaattcaatcttgccattcaacatttactctgattctaatgtaattctttgaagatactcatcaatttgctttttttccccttcttattccaccatggctctaatagatgtttcaattaaaataaatcctggggtctgagcagatagctcaattagaggttaactaacaaaaccgaacaattttaaccccagaggaaagattgtagaatgacctaaaagccagaaatatttatattttgcagaatgcaggatagaatttatcttgttagaaagcataaactaaatttgaataccataaaataatatgtgggatatgagactatacagttttgtaggtataacttgcactttttgccatttatagtccagatggaaatttgagaatttatagcaagaaaatgaaaatatttattgtagtgacatttcactttgagtaaatctaatctttcttctactattctttcttcaaatttgtgaaagctttaaataatttctccctggggttcttcctttataaatctacatgttcccatttctttgactatgcagttgtcatggtttctagactttttagcacacatctttagaaactcacgttatcattgcctcttgttaaattatggaacatggaattcaacaatcatttgtggtatgattagtttcatcaaagcagtctattcctttgagaggcaatatagcctagaggttaagagtgccaactctccagtcaggctttgaatcttggttccgtcctatctagttgtgccttattaatgtgcaaaatgaaaaaaacaaagaacacccttgtgattcaacataagtcaagcacttagaacaatatatagtacagagaaagcactatataaattcttattttcctcttttgtctgagatattgtattcctaaaatctaggttaacataatgttacttgtttccccctattggaagagaggtatacatagcaaattcatatggattcatgagacacttgtaataaggaaggtaaaattgttagtatagttttatgtaagttactggcaaaccaagtatcctttcttcaactgtatacaggagttcttgaaaatacactaaagttatattttttaatgcactcagaagaaatagaaaaccttcaatttatattcacttagagtgcctgaggcatttttactctagcctaaatttgataattatgcatttttgaatttttataaaattgtggacaaagtaaattttattttgtttgttcttatttgtctagcaccattctatcttcatgatatattagatttaaattgggacaaaaatcaacgtatctttttatagtttaaaatcaagttttatgttctgtacttatccaaaatagggcagcctcatttttttttaaataggagacaggccttgtgtaggagctacgtaaggtcaattagaagtaatcaggccaattagaaggcgttcttttgaattctgtgtgaatgtgtgttcatttgatgactaggtaatatttaactatagaaaataaatataattatgttttccctaagtatagaatgatcagaaatattagaaaagagattctttcaggtgctgctggattaaaaaataactgaattatatggtgagtgaatcataattactattaataggatgattacttctgttgccatgacagcaattatcagctttaactgagttagacacattttgattggcattattaaaccaaggatcaaaacaatcaaaatgggttaaattttttattaaaatcatatttagaggtgttgagaattgatgcaagtactcttcaagtaatgcacacgtctcttacaaatatcacttagaattagcacatttcatactaatttctactttgtccaaatggctaattgtcatctatcccagcctcattgtacatataaaaaaatactttcagccgggcgcagtggctcacgcctgtaatcccagcactttgggaggccgaggcaggtggatcatgaggtcaagagatcaagaccatcctggccaacatggtgaaaccccgtctctactaaaaatacaaaaattagctgggtgtggcggccacttgtagtctcagctactcgggaggctgaggcaaaagaatcgcttgaacccgggaggtggaggttgcagtgagccgagatcacaccactgcactccagcctgggtgacagagcaagactccgtctcagaaacaaaacaaaaagaaaaaaaaattggtaactttgtgggtaaatgttagcctatgcagtgttctataattttgaggtcaaggaaatggaatactgtatttaaaattttatttcatacctaataaatggtggctccttaatatctatttgtatgatcaatgcataaataaaatattaagacatactctctaattttctagtttccaagaaacaaagcatagacaaatacttaaatttaaaaagcttatatatggttcttatttcagaggcaagataaaaactgatatagaagttcaaagaataggagaaggcttctaactcagtagacattgggaaggttttgtgaaagcagtggatagaagctagattgaaatccagtgttgtgtttaaataaaggagtgaatactccagataatcagctgtaccttttcaatgtcactgacatgagcaagaccagacatattaggcccaattttgtaggatattgaatgtggagttaaagatttttaactttattctggaatatttttatttggacctaaacatactattcaatctttgtaaagttatcactgaatctgttttaaattcaaggtttttactttctttgtaggttatatgcccattatatttatacaatcaatcatcttttttcattgcaataaaatcaatgaatattatatgtccattctttctttcctgactatttttatacctgtcaattcttgtgcatgaactaatttatttatatttcaacataaattagatgttttttagagtttaagaaagatacttagacatctgttataatcagtgaaagaagggttactgatttattacttatttatctcaaaaaaacaaaaacttgagaatgcattaccaaagataaaatttgcctttatatatatatataaagtttatatatattgtcatatatataaacttggtttactcacccccatgcaagtcctgtcctgcagtcagaaattttgtcaaaatcaggcaaaaagagcctaattttttaacttctttttctctcaaaattatttcaacctctaaaaatatgtagcatgtaatatctcactgatatctactttatttcacttaactcattcgtctctattcttatttggggttttgaaggtagagactaagatagaacaaatttatttgtcagtaaaggtatttgaaggttcagggcaaactctagattggggagagagagagagacagagactgacagaggagagagaaagagagcacaagtgccaagggaaatgtagaaagaaattttaagtggttcactgtaaagtgtgaaataaaaatggtctctttcttctctccctagaatctttagtaaattcgagtttgctgagcagtgcttgtctgtgagtgaatttatttgagagcactaaaagtattccaaaaggaaccaactaacatttgagtggattttaatatgatcaaaaattctcttttgaatttatattatgtgtcaggaagcctctggggatagagagtccattaaaatgagcagtgtgctcttttgcatagtgggataggcagagtttaaagatgacccccaatgacccattctttatatcattccgctcttctttagtgtcaacaggatttcactcccttgattgggttactaatcagttgactttgacgttatcaaaagagacataattctgggtggatcttacccaatcagaagaacgtttaaaagagatgaagcacttcctaaaagagattcaaagcataaaaaggtccatggaggaaccacatagtaagtgcctgagagtggcatgtcagagctaagagcagttctgggacaatagatagagaagaaatggggacctcagtcatgtcgctgcaaaaaaaaatgaattttcccaaagacatgaggatgtaaatgcacttggctgatattttgatttcagctgtgtgaaaaccttagcagagaacccaatatactatagccagactcttgatctatggaaactgtgagataataacttttttattttataagcctctaaaatggtggtagtttgttcacagaaataaaaatctaacacaaggagtccactgccttctcttagtgtctttgtttatctgtgttgttactcttattattattattattttaatttaaggtcatcaatgaagataatccaattggttggccagtaattatccagtattgagtacccattagtggatctctgcagccatgccatttcaaaagctggtgatctatagttaggtagaccagaaaattcataaaaacggtttgcatttactcagtattactaagtgttagatactattttaagcatttttttttttttgagacggagtctcgcatggtcacccaggctagagtgcagtggcaggacctcagctcaccgcaacctctgcctccagagttcaagcaattctcctgcctcagcctcccaagtagctgggactacaggtgcccaccaccgtgcctggctaatttttttgtatttttagtagagacaggttttcaccactttagccaggatggtctcgatcttctgaccacgtgatcccccccacctcagcctcccaaagtgctggtattacaagcgtgagccactgcgcccggcctattttaagcatttgtaatgcattaattcatctaatcatcacaaccattataatcaacttcatcttatggatgggataactcaagtataaggaagttaaataatttcccctagatcacacagctagtaagcaacaaaactagggttcgaatatctaggcagtctcattttagaatgtgcgaatttaactacatactgcctcttctgacagaccgttgacgactattacctgtgaaggtcccagccacatttgcacatgtcatattgtgaagtcatagcttccttagttttctgataagttgcagaggttgcaatgtgggagattttcttgctacttaagaaatactttgtaaatctcacaatgattaagaagtctgagaagctctgacagctctcagcaaaattttagaaatccaggtgaaaaatcagtgtttttgaaaatgtatgtttatattacagatgactataaaaaattgcaaatccttaaattatgaatgaccaatatctaaaatttcacatcaacaagaagaaatatattaaacattcagatggattggctttttacaagattttcaatatttggaatttttgtcataagtaaaatctaatgttaatacgtatgtgattcatggtagttcctattttagaactttctaacctgtcattatgagatatttttatctgtcttgctcccatgcttttctgtgcatgtcactgactaaaataatttacataagaaaaaattcaatttgtaaagaaaggacacattcagagaataatttttattaatattatcttcatgataacatatcaatttgtttataaataaagccgtgtggcctcattactgacttagagaatacttggcaggtactcatttttgtctctcttggctaatggttaatgcagtgcacctgttttagaacactgaaatctctactcataaaatacattttttttttttttttttgagacagagtcttgctctgtcgcccaggctggagtgcagtggcacgatcttggctcactgcaagctccgcctcccaggttcacgccattctcttgcctcagcctcccgagtagctgggactacatacgccagccaccacgcccggctaatttttctgtatttttaatagagacggggtttccctgtgttagccaggatggtctcgatcttctgaccacgtgatcccccccacctcagcctcccaaagtgctggtattacaagcgtgagccactgcgcccggcctattttaagcatttgtaatgcattaattcatctaatcatcacaaccattataatcaacttcatcttatggatgggataactcaagtataaggaagttaaataatttcccctagatcacacagctagtaagcaacaaaactagggttcgaatatctaggcagtctcattttagaatgtgcgaatttaactacatactgcctcttctgacagaccgttgacgactattacctgtgaaggtcccagccacatttgcacatgtcatattgtgaagtcatagcttccttagttttctgataagttgcagaggttgcaatgtgggagattttcttgctacttaagaaatactttgtaaatctcacaatgattaagaagtctgagaagctctgacagctctcagcaaaattttagaaatccaggtgaaaaatcagtgtttttgaaaatgtatgtttatattacagatgactataaaaaattgcaaatccttaaattatgaatgaccaatatctaaaatttcacatcaacaagaagaaatatattaaacattcagatggattggctttttacaagattttcaatatttggaatttttgtcataagtaaaatctaatgttaatacgtatgtgattcatggtagttcctattttagaactttctaacctgtcattatgagatatttttatctgtcttgctcccatgcttttctgtgcatgtcactgactaaaataatttacataagaaaaaattcaatttgtaaagaaaggacacattcagagaataatttttattaatattatcttcatgataacatatcaatttgtttataaataaagccgtgtggcctcattactgacttagagaatacttggcaggtactcatttttgtctctcttggctaatggttaatgcagtgcacctgttttagaacactgaaatctctactcataaaatacattttttttttttttttgagacggagtcttgctctgtcgcccaggctggagtgcagtggcacgatcttggctcactgcaagctccgcctcccaggttcacgccattctcttgcctcagcctcccgagtagctgggactacatacgccagccaccacgcccggctaatttttctgtatttttaatagagacggggtttccctgtgttagccaggatggtctcgatctcctgacctcttgatccacccgcctcagcctcccaaagtgctgggattacagacatgaggcaccgtgcctggccagccataaaatactttttatatattttggtataattactattataactatacatgtgttttcatatccatttaatatccataatctgtcaccacattttacttttaaaattttatttacacattaatgttccatttacattttgtaaaataagatgcaaattaactaaagtattataccaaaatgaattgcagctctagcatgtgttagatattgtgctaaggaggggatatatggtaataaaaatgcttaatccataacaccatgcatattttaacttaaaaaccctaatatctctatatatttttgtttctgcatatattacacacacaactgtgtgcgtatatatatatatttatgtgcatatatatgtatgcaattttacattttggtaaatgacaaaagaaaaacaacaaagttaatgaaagatagtaagaggaaaacctctttaaactaaagggtagaaggttaggggagatctttaagcagaggtaaaaatttaacatgaaaccagatatttggaaaaaaaaaggaaatgtgtttgagaaagaagatatggaatgtgccaagattctgaggtgggaaactcctggagcctagtaaagtggacggtgtgattggaagggagtaatgaacaaggcagagaataccaggaaatagacatggagaggtaggaaatcccattcatggagaatgcactgtacctgttgtagtacaggttttagaggctttattttcattattgtagaaaagcaaacactaaaatgactcaagtttctcttctatctaataattaccttcatctgagtttacttctaaaattgtgttatagtgttctgcacagaccttacatctttcataaaaattatctcaaaatggattataagtataaatgtaaaatgcagaactttaaaaattctgcaagaaaacatatgagaaaatatacatgaccttaaatttgttgatgagttttagatacaataccaaaaaccttattcatgaaagaaaaatcttgacaagttggacttcattgaaattaaaaatatctactctgcaaaataaagttaaataataaaaatattagccatggactgggataaaatattcataaaatacatacttgaaaagcacttatatccaaactacataaaagaactcttaaaactcaagaaaacaacccagttgaaaaatggacaaaagatctaaaggttgggggtcaaagcaagacggtggaatagaagcctacgttgtttgtccctgccactggaacaccaaattttataaattctctgcacacagagaagctctaccacaagaataaaaaatcagataaccaatcacagtacctgattttaacttcatatggctaaaagaggcagtgaagagggtcagagacagtcttgaattcccagtgcctctcccctctcccagtggtagccatgtagcatggagagagaatctgtgtactttggagagggagactgtggtgaccagaggactttacattgaactcagtgctgccctgtcacagtggaaaataaagccaagctgggcttagccagtgcccgcacctggagggagcatttcaaccagccctaaccagaggggaatttcccactccagcattcagaacttgagtttgttggcaagcctcaccactttgggctgaagtgctctgtgttcctagattaacttgaaaggcagtctagcacgcaagaactgcaatttctaggcaacttgtagtgctagtctgggattagagccagtggactggggtagcactgacctagggagacaccagctgctggcacagctaagggagtgcttgtgccatccatccatcaactccaggcagtccagctcacagcaatgaaagtgactcattccttctgattaaggagaggaggtcaaagagtaaagaggactttgtcttatgtgttagataccagctcagcggtagtaggacggggcactgggtagaatagggaggcccccattccaaaccctagctcccagatgacatttctagacattccctgggtcaaaagcaacctctgctttgaagggaagaacccattctctccaggattcatcatatactgactaaagagcccttggtccctgaataaccagcagtaatacccacggagtatgtggtgggcctttgcctctgagacatgctggcttcaagggtgacctagcacgttcccacctgtgggcactatggtgaaagactccttctgtttaagaaaagcagagggaaaagtaaagaggactttgtcttgaaccttatgtaccagcttggctatagtagggtagagcaataagcaagctcttggggtccctaagtccaggcctaggctcttagaaagcatttcctgaccttccctgggctacaggagagtccactgccctgaagggtgagtcccagacatggctgcattcaccgcaaactgatagaagagtccttgagttttaaatgaacatttgtggtggcctggcagaacccccatggagtggttttggtgatggccccaaagagaggctcctatgcctgtggaaaggggaaggaaaagtgggaaggacttcgtattgtagtgtaagtgccagcttagccactgtagtctagaacatcaggtatactgttaaggttacagactctaagccctggttcacagacagcatctctggacatgctccaagcctgggggaacttactaccttgaagggaagggccttgggcagcacccagtgctgtgttggcttcaggtctgacccagcacagtcccagtagtggtggtcacaggggtgcttgcatcaccacatccccaggtccaggtgtctaagtgcagagagagaaagtctctgcttatttgggagaaagtcagagaaaagaacaaaagtctctgcctggtaatccagagaattattctggatcttatccatgtccaccaaggtggtacctctacaagtctgcaaaattcacagcattatagggcttggtacccaagtcccttcaactcctggaaagccttcccaaggagggcaagcccagaatgtgaagatgataataaatatctaactcttcaatgcccagataccaatgaacatctacaagtatcagcatcatccaggaaaatatggcctcacaaaaagaattaaataaggcaccaaggaccaatgctggagaaacagagataaatgacctttaagacagataattcaaaatggctgttttgaggaaactcaaggaaattcaagataacacagagaaaatttcagtatcctatcagataaatttaacaaggagattgaaataatttaaaagaatcaagcataaattttggagttgaaaaatgcaattggcatactgaagaatgcattagagtctcttaatagcagaaatgatcaagcagaagaaagaattcgtgagctttgaccacaggccatttggaaatacatggtcagaggaggcaaaagaaaaaagaatagaaaacaataaagcacacctgcaagatctggaaaatagcctcaaacaggcaaatgtaagagtaattggttttaaagaggaggtagagaaagatatagtggtataaagcttgttcaaagggataataacagagaacttttgaaacctagaaaaagatatcaacattcaagtgtaagaagattataaaacacaaagcaggtttaactcgaagaagactacctctaggcattgaataatcaaactcccaaaggtcaaggataaagaaatgatactaaaaacagcaagagaaaataaacaaataacgtacaatgaaactccaaaacatctaatagcagacttttagtggaaaccttacaggccaggagagagtgatatgacatgttaaaattgctgaaggaaaaaactgttaccctagaatgatacaaccaatggaaatatactcaagaagaaagagaaataaaggtcttcccaagacaaacaaaaacttagggatttcatcaacaggagacctgtcctacaataaatgctaaagggagtatttcaatctgaaagaaaactatatatacacgtgtatatatatatattttgtttgtttgtttgagatggagtttcgctcttgttgcccaggctggagtgcaatggcatgatctcagctcactgtaacctctgcctcccaggttcaaacgattctcctgcctcagcctcctgagtagctgggattacaggcatgtgccacgacgtccggttagttttgtatttttagtagagatggggtttcttcatgttggtcaggctggtctggaactcccaacctcaggtgatccacccacctcggcctcccaaagtgttgggattacaggtgtgagccaccatgcctggccagaaaatgatattaatgagcaagaagaaatcatctgaaggtacaaaactaattggtagtagtaagcacatagaaaagcactggaccagtggtgtgtaggctattcttacctgaagtagaaaaactaactgaataataaatcaaaaataaccacaacaacatttcaagacataaacagtacaattaaaatataaagagagaaaacagaaagttaaaaagcagggtgacaaagttaaagtgtagattttcaattagttttctttttgcatgtctgtttgtatacagaatcagtgttgtcatcagtttaaaataatgggttataaggaggtatttgcaagcctcattttagcctcaaattgagaaacgtacaacagatacacaaaaaattaaaaagcgagaaattaaagcatatcacctgagaaaataatcttcactgaagggaagacaggacggaaggaaggaaagacaggcaagaagactggagattcctcaaaaaaactaaaaagtgagctaccatatgatccagcaatcccaatgctgggtatatacccaaaagaaaggaaatcagtatatcaaacagatatctgcactcctatgtttgttgcagcactgtttacaatagctaagatctggaagcaacctaagtgtccatcaacaacaaatgaatggataaagaaaatgtggtacatatacaaaatggagtagcattccatgatgcggttattacatattgcatgtctatattaaaatatctcatgtaccccattagtatatacaactactgtgtactcagaaaatttaaaaaaaggcatctcatacacacatacacacatacacacacacacacacacacacacacacacggatagcaagtaagcatatgaagagactcaacaatatttgcattagggccatacaaattcaacaataattacatatctctcagcacctattagaatggctaaagtccaaaacctgatagtacaatagctgacaagaatatagagtttaaaaatactggaattggcccggtgcagtggctcacacctgtaatcccagcactttgggaggccgaggcgggtggatcacgaggtcaggagatcaagactatcctggctaacacggtgaaaccctgtctctattaaaaatacaaaaatattagccgggtgtggtggtgggcgcctgtagtcccagctactcaggaggctgaggcaggagaatggcatgaacccgggaggcggagcttgcagtgagccgagattgtgccactgcactccagcctgggcgacagagcaagactccgtctcaaaaaaaaaaaaaaagcctggaattaaagaattaagtagatggttggttaatgatggaagccaggattgaaatgataggccagggatgatcctggaacaatccaggtatttacagattagagttaggacagcactatgaatttatgtttagctaagtgggttattagacacacatatatttcctcggtctctcaactgagaggacctagaggcaatgacacactaacaagcacactagagctcaggtcttggtttttaatattattctccaatgaaaggaaccagggccgggcatggtggctcatgcctgtaatcccggcactttgggaggttgaggccagtgatcacttgaggccaggagttcgagatcagcatggccaacatggcgaaaccctgtctctactgaaaatataaaaaattagccgggtgtggtggtgcgtgtctgcagtcccagctacttgggagctgagacaggagaatcactcaaacctggcagttggaggttgcagtgagttgagatcacacaactgtgctccagcctaggcgacagagtgagactctgtctcaaaaaaaacaacaacagaaaacaaaacaataacaacaaaaaacacgaaccgggactccttggataaatgtctgattctaagacttaggcaggaagtatacaagataatcttggagcattatgtgttatagtgccagaaactaagggcgtgttctgagagacaacagcaagaaaaaagaaaagaaaacaaaacaacacacatattgtagtaagtcaaaaaggcaactgaaagagctccagtgttcaatgctagaacaatttaaacaacaagataaacaaaatagtattggattataatccaaagtataagataaatacccacatatgcactcatatataaaggaataaacaaataaatgaggcaaatctcagcataaaattgcaactaatttatttaggtatttatccctcaaggagatacaacataatccctacaccttaggtttaagtataagctgcacacagggattttctcctagagtgtggcaagaggagaaaaactaactttatagcagagaaactggaaaaacactacctcagtcaggtgagcaatgtcaacataaacaacgttgagtcatgttgatagtgtgaatccttggataagattggcacttcacctcgatggtttttctcagaaaaactcataacttcagaatctaatcttataaaaacatcatataaatcccaagtaagctacaatctgcaaaatacctcaacagtacccctcaaaactatcaaagtcattcaaaaacaaggattgtctgagaaactgtcacagcttaagaggaccttaggagacatgatggtcaaatgtaatgtggtatcctggatgggtttctgaaacagaaaaaggatattaggtaaaaactaagaaaaatatgaaaaaagatatcgactttagttaataatgtatcaatattaattattattacaaatgcactatacaaatataagatattattgtggatactggaactggtatgcatggggattctatactacctttacaattttttggtaactctattctaaaataaaaattattagaaaaaattaagtgcttaatgaaaatgaaaaggttccctgacattctctgtagaggtgggtacacactttgccatagagctctttatgatatcaattttctcttttgctcttgcttctgtctactctatagaattttaaaagctgggttgaatttaatcactgtataaatcacataaatcaagtagaaattattgctaaaatttttctgtgaatcagaaactattctaaaataaaacatctgaaaattcggggtgtagttttatattttttctaaaatttgaaggcttgatttggttcacattttaagccatttctatgtttttagttgtcacatgttttgaaagactgtgacagtactattattttaaccaagggggaggaaaaagtcctttttcttttcccaatagtttaagtttacttactaagaagggctacgagagatgtgactacaaaagaaaatacgttttcagtttaatcttagaaagtttcaagaacaaaagttggaggaaccctagagctctaggattcactttcgatgaccattcctagaaggttcacttttttggatcacctgactttcaatattgcctcactttctgtctctaaagggataacagctttattctacctcacacttatcactgttagcagaccaatcagcttattgtaggttttctgttctaggcctttacttaagttactccttaagtctagaaatctcttcttttctttaaaaatcagttttcatcttttccagaaagtcttttctgagtcctaaagtttgtttataatactttctgctgtcttggtagtttccatataaccaacattcattaagtaagaaaatatctattaagtttctcctgggtatcagatactcaatatgctgggcacctattcatggtttctcagctggaactgtcagctccttgagggcagagatcatttcctattaatcttaactccaagaacttggcaaattcttgacacatagtaagtgttctggggggaaagaaaagattgtagtcctgaataataaaaaaaaaaaacagctttctcagaatgcaagatgttcaaaactaaaatgtcgttcagggatttattcatttccatgatttcatgacatgtaattttctttaggactatgatttcccttaaactctttctgcttagaaatgtccttcaccggctcctgaaggacctttagatgaatttgacttatgtgatagaataagtggttgcccacacctttcacacatctgtgaactgatcaagaattcagattatttctatcatctgtccagatggcttgaaaaaaaaatgcaaatttctttcttattgttttaaatggattggatttctgtttcttaaaggcagtttacaacagatactactctgtgttttattatatggagcacttatttatgcaagtatgtgtgtgtatatgtatgtttattgctttacttagcagagctaaaaaagaacattaaataaaattaaaatgtagttaagatatgattttcctaacatttcctgtttaattttacagatattataattgtgagaggtagagaaatgactaggcaaataggtatatttcattcatttggattcccctaaatttagaattgtgttttaggcatgcatgcaaattaaaaaatatatatatatttgtattgtatagtgtggctttgtaaagtttctttcaatagatggcaaactaggcattacttgcatcctagatatttaaatgatgccttttttttggtagttctgttctcagagtatcttccaaagtgataaaattgaacttgaagaatttttttaaaaaacacaatgcaaacctatgttggtgagtggtattggaaattattaatattgcttttcttccaaaatctctagcaattctaaagtattgtgtttttaaaaaaacagaaggaaatatcaagtaaaccaccagcaggatactccaaaattccatttataactcagaaaatctaaataaaaatatataatatctcattaaaaattacgacaatagtgacatagagaatgaactgtgttgtgcataatgctgagcattttacacatagatttgctccttttactttcccaacaaacctctgaagtaggtatacccattgtcctcactatagagaggaagaacactgaaacaatgagaatctgtcaaaggtcactgtcgttgctcaggctgttataacaaataccatagactaggtagcttaaaacccagaaatttattttgtacagttttggaggctagaagtccaagatcagggtgccagcatggttgggttctagtgagggccttgctcctggcttgttgattgccactttcttgctgtatcttcacatggtggagagaaagatcatttcccttattatgcaggcactaattctattcatgaaggctctaccctcatgacctaattacctcccaaagtctccacctccaaataccaaaacactagggataaaggacttaatatttaaatttgtggggaggggacacaagtattcagtctatagtagtcacatagcagataatgagggcagaattcaatcctggaagtgctatacttcctcaagagataaagttaatcatgtagttatctggcatatatatatatgtaaaataatctgcatgtcctatgcctacacacatttgtgggttctcacataacagtttagtaatatttgaaattagtggttatgtccaattatctaatttaagcaagcatatttacgacataaaagtttctcaattacatttgttcatttaaatcaattaaaattatggaatattacatacgtatatagaatagggccatatgcacatatatgccacataataatatgttaaacataatggtcctattttcagttgtaattaatgagagtttttaatatagttggcgttgtcactcagcagttgccatcgaatctgtgtgagtaacagaagaggtatggttagggtagagagaatatttgaggaaagaatgggtgaaaatttctcaaatttgatgaaggacatgaatataaccatccaagaagctcaataaactacaagtaagaagaactcaaagacacatacacattataatcaaacttttcgaagacagacaaaatcttgaaagcatcaagagaaaagcaatttattacatatgtgggatcttcaataaaattatcaacagatttctcatcagaatctttgggagacagaggacagtgggccaatatattcaaagtgctgaaaggaaaaaaaaattgttgtcaacaaataattctatatctggcaaaactatccttcaaaagtgagggaggaaatttagacattcccagataaaaactgagggagtttcttatcactatacctacttactctgtgagaaatactcagtgaagtcctgcatagtaaaatagaaggacacaaaataataacttaaaaataagatgtgtgaaaaaataaagatttaaataaagataagtacatggacaatcataaaaagtggtattattgtaacaatggtttgtaactccacttttgtttgctacatgatttcagagactacatagattcagaaataccaatgtgaaaactaacattattgtaactttggtttgcagctccacgttttatttctacataagtttaatgactaatgcatttagaagaattattttttaatatgttggtcatgtaatgcataaagacacaattctgtgaccttgccaaccaaaatggatgtgaatgtagctgaaaagaagcagggtttgtgtatgttattgaagtttagctagaataaattcaaattagaatgatataactttaggacattaaatgtatacaaaaaaggaaatgagaaatttctttctcattttaaaaaaaatgtttcactaccaaaacccaactgaacacaaaggaagatagtaatgcaggaaatgagggacaagtaagcataaggcatatcaaaagatacaaatagtaaaatgacataaagaaatacctccttattagtaactatgttaagtgtaaatgaattaaacacctgaatcaaaggagagattggcagaatggactaaaaaaaaaaagagggtgatcgagctacagttgacccttgaacagcatgggcttgaactgcatgggttcacttacatgcagattttcttctacctctgccacttctgagacagcaagaccaactgttcctctttctcctcctgctcagcctactcaaaagtgaagacaatgaggataaagacctatatgatgatctactgccactcaaagagtggtaaatgttttctcttctttatgattttctgaataacgttttcttttctctggcttactttaagaatacattatataatttatataatatacaaaatatgtgttaatcaattgtctgtgctattggtaaactttcgtcaaaagtaagctattagttaagtgtgtggggagtcaagattcatatgcagattttcaactgtgtggggttcagcacccctataccctgcactgttcgtgggtaaaatgtatatgctatctataaaggaatcactttagaaccaaagacacaaatagatacttatgaaagtcaaaggattaaaaatatattctaaggatttagtacccaaaagggagcaggggtggctgctatactaatattagacaaaatagacttaacaataagatataaaaatttaaacaagatataacaattataagcatttatgcacatagtaactgtattagttcattgtttcattgctataaagaaatacacctcatggttcttcaggcctataggaagcatagcagcttctgcttctggggaggcctcaggaaacctccagtcatggcagaaggcaaagtgggagtgagacgtcacacatggtgcaagaaggagcaagagaggagtggggggaggtgctacacactttaaaataaccagatctcatgagaactcactatcacgaggacagtattaagggggacggtgctaaaccatttgtgagaaactgcccccatgatccaatcacctcccaccaggccccacctccaacattggggattgcaattcaacatgagatttggtcagggacacagattgaaactatatcagtaacagactatcaaaatatatgaaacaaaaacacagaatttaagggagaaataaatacttcagtactcttctctcaatcaaggatagaacaaccaaacagaagataagcagggaaatgttagaatcaacacaataaaccaaatagatctaacagacgtatacacagaagactttactcgacaacagcaaacacattcttctcaattgcacatgggatattttccaagatagactacaaatctatccttagaatacaaattaagtcaaattttggtgtatatatgtatacgatggaatattattcagatatatagagaaattctgatgtgcttcagcatggatcaatctagacaacatcatgctatgtgaaataagccaatcataaaatgacaagtactatctgattctacttatattagatacttggagtaaaattataaaggctggaaacagaatggtggttgtaagagactgaatgaaaagggaaaagagggagttgttcttcaatggctacaaatcttcagttttacaagattcattatggagttggatgggggcaatagttgtacaacattatgaatgtatttaatagcactgaactgcatactcaaaagtggtaaagatgctaaattttatgtcatgtgtaccttaacagtattttttttaattttgggggaaaacatagttaactttttgagctttctgcattttaaaatgttataggtaataattccaagaataatttaaaaatcatttctattttctaataatttcaatatttgactggaagtagcatattatagcatcgctagaacacagatacattactaagtaatgtaaaaacaatattttccttctttccctcagtctctggcaaccatcattctattatctctatgatttttactactgtgattacttcatataagtagaattttacagtatttgtcatttagtgaccagcctattcatatctgccttgttttaaagcaaacactgtcaagcagaaagataaaatagtctgtaatattaatgttgatgttaataagcattgtggaatattaatggtcatattgataagttctctgtaagcattctggcacatagaggtcaagggcatagtttctgggacagaatacctaggcttgatgacagcctttaccatttatttttctgagtcaatttcttcacctgaaaaaagaatataataaaaatatataactcacagacctcttataaccatagagtgtattaaaagtgcttacaataatgtctcacatgttagatctatatgtgtctaataaccttattactattattattgagggaatgtcacagttgatagtgagttttcaaaagtgcagtgtctaaccattagcattacagaatgataaactacttttagcattttaagagcaaatccatcacccttgtgggcagactcacaaaaactgagttcatgagactgaggtataaattcaggattctgatttattcaagttattagaacaatactacaccagagtgttgcaggaagtcagggacaccgaaaggagggacctgctgaagctgtgacagaagaacataaattgtgaagatttcatggacatttgttagttctccaaattaatacttttataatttcttatgcctgtctttactgcaatctctgaacataaattgtgaagatttcatggacatttatcacttccccaatcaatactcttatatttcctatgcctgtctttactttaatctcttaatcccattatcttcataaactgaggatgtatgtcacctcaggaccctgtgatgattgtgttaactgcacaaattgttcgtaaagcatgtgtgtttgaacaatatgagatctgggcaccttgaaaaaggaacaggataacagagatgttcagggaacaagggagataaccattaagtctgacttcctgggagcagtaacaagagtcatatttctcttattaccaaaaatgagtaagagaaatatcgctcaattctttccccagtaaggaatattaataattaacagccttgggaaaagaatgcattcctggttgggtgggggggccctctaaaatggccgctcttggagtgtctgccttatgcagttgcagatagggatgaaagaagccctggtctcctgcagggcccccagccttgctaggattaggaaattccagcctggcgaattctagtcagaccggttctctgctctcgaaccctgttaagatgtttatcaatgacaatgcatacacagtgggacatgaagcttcatcagcaattctagttttgccctggcctagtgaccttgtcctacccatttgccttgtgatattttattgcccttgaagcatgtgatctctgtgacccacaccctattcatacactccctcccctttgaaaatcgctaataaaaacttgctggttttgtggctcagggggcatcacagaacctgctgacatgtgatgtctcccaaggctttaaaatttctcccttttttagtctttccctttatttctcagaccggccgacacttagggaaatagaaaagaacctgtgctgaaatattaggggctggttcccctgataccagagaagcagttaaattattcaactttattgccatgtaggtggcacaaaaaaagccacattataataaaattggcatagcaagcatgttaattagtgaaataatcagttgtttcattttgatgttaagtaacattataatgaaaataaacctacaaggcaatattcttgaaacagaacctcttcttcttgggaagaaatcatatctttcctcatgtcatgcttcttgggttaaacaagctcccttctggctgacatattctttctttagttatgctaatagtatcgtcattcataacatactcctaaaagcctagaaattattctgtcactttatgaagacttgtcattatttttttatacattttaagagataaatcttgtttcactctttctaaattcatgtgtgggtagaaagcatcactgtcacccccaaatactaacagaatttaccttagatgaaatgaggagtggcattgttagtaaaaacatagaataagaaaatgtattagcatatgtttagatatgttacgttagaaaacaaacgatttctcattggcttttattttattctaataagttatatcacgtcccaaagtagtccactaacaaagtaaagttcacaagatacaatgaaatatttgttttatttttcaaaaagaaagttcagacagtaattaatcctaattttttttaatatcaagctaaactcaacatgaaaaaatacattttaatattcatggtttgacttgcgtactctgtttaaattatgtgtattcagtaaagttggaatacatacctacacacacacacacacacacacacacacacccatttctgtatatctagaaacatatcctaatgtaaaatgggcaactaactgtttattccaaagcgtttaaatggcttcttaaaattaaacaaaggaacaaaaattttgttaaaaattatcttaattaagaatgaaaaatactaagggcacataatgaaaataaacttgtttattgttgtaaccactcaatgaacttaaatttagttatttgtgaagaaaacattcagcatgttctgaattagaatggttcaccttagtattaaatgccctctgtggaaaaggatatgcagatgtttcttccacatgagctacaaatgtgccaagagaccacaagttaaatatttaatgttaacattaagatggaaatatgtcttccttattgagctataactttactcataaatatttgtgggaagaaaagatttattttaatacttaagcatttaactggaggctgttaacgattaacgacttcactttagtaagacatcattctccacaagtaagagaaagagcaaagaaatagatgaaattttcagtgggaagtgagacttcatacccaatattttaaatatatacatgtcaataatctagttattttatgctgaacaaatgctgtggttgtttaattagttttacaaatttagatttcactaattcagaatttgtgatcatttcgagtcagctgagtagaaatgtatttttttcacaatgtgagaatcaaaggtagactacacacaaaattttaatgcactaaaaattacttaaggcaacccttttaaaaactggatggctaatattttgtgtgcaataagatacaataggatccaatttttcaaattatcagcaatattttcagaaatttccttggtacagaacaccctcttcctgggaagagctcatatctttcccaaagctatgcttcctgcattaagcaaactcttttctgcttgacacataaaaatacattatcagataagttgagttagtgtcaatatttcataacctgcattagtaaagcactttaaacatcagttgactgattgtcactgcaattctgtgacacaaactaagttttattatctttgtgtttaaggctaagttatgaagcttaaagatattgtgattatttgagtttgtacaaataattagttgtgaatataactgagtgatttcagatttattcatttcctgcttattagatgtcaagtcctatgctaatatgcaaaaataaatccattatgcttatttttatagacttactaaataccagacaataatctaaatgctttataaatattattcatttaatcaatttgcaggtgaaaaatgaagcagagagaatttaagtaacttgtccatggtcatcaatgtactgaaggtggggccagaaaaatagtacttaattacagtactatgtttcttccttttcatacatctatgaagtaggaacctgagagcgattgctcaaaaatgactttaaattctgataatagtataaaaatgaaatctaaattcagcttgccacaaaaacaattgtacactgtaggaaagagatttggaaaaataaagaaaaaacttttaaataaatacaaacataaggataattgaaaaataaaatgacattgaaaaagagtctagatagaagcaagatttgaaagcatcttaatggaagtgaaatgctccatatgaaagttgccttaaagatgcatattcaggggatttagcagatttgtcgcttcattccattctttataaaccaaaacattagtttcatgaattattttaacaaaatattttgtatgaaatgggatgcatatttgttctcaaagcattagtgtgaacctgttttctgacattcattttccttatagttctaaaagaagctgaaataatcatgaaaggatatcaactcatacaaacatgaacaagaccttggtagtcatatatatatatatacacacttctggggtacatgtgcagaacatgcaggtttgttacatagatatacacgtgccatggtggtttgctgcacccatcaacctgccatcttcattaggtatttctcctaatgctctccctcccctagccccccaccctccaacaggccccaatatgtgatgttcccctccctgtgtccatgtgttctcattgttcaactcccacttatgagtgagaacatgcagtgtttgattttctgtccctgtgttagtttgctgagaatgaaggcttccagcttcatccatgtccctgcagaggacattaactcatcttttttatggccgcatagcattccatggtgtatatgtgccacattttctttattcatctctcattgatgggcatttgggttggttccaagtctttgctattgtgaatagtgctgcaataaacatacatgtgcatgtaagaccttggtattcttacaaaagaaagtttgttcaatttgggaaaggaatctgttgcaataagattaaaaacaaagaacaatgatagctgaatgtttgagtatgtttatactttcctgttattattgcctgttggattcacagagggacaaaagtcaaaattaattcaattcacagcagtattaacattcggggttactgtggatatatagctgggtgcttataaccttggattctctatactattaattttaattaccttggtgagcttacactttctccttaaaaataatagcacactgattaagcaatagaaagctgaggagaaaaagaagacagtaattatccaacagcataacacactgttcttcccatacaccacttccccaatatacacatacacacccatgcatgggcttggagataggggaaaaagtgctccacagtactttctacctcactggaattaatcatacaagtaataactactgtttcatagatgttgtgcctgatcttttattaatcctcttaactagcctgtaaggggagaaatgttagtatcccactgtatagatgaagcaaccaaaccatagacagattagctggcagacacagaattacattctgtttgatcccaaatatgtaaactactgtgtgatggaagatggtcttctgttaaacaccaatttccaaaaccgctgttgttcgtggttctatgaaatttgagtcttcttacggcaaaagactctaaagagtgatatacactttacaggacttattgtcttgttgtcaaattttgctaaatgttagaaccacttacctaggaagttttttatttatttatttatttatttttttattttttttgagagggagtctcactcagtcgcccaggctagcgtgcaatggcgcgatctcggctcactgcaagctccacctcccgggttcacgccattctcctgcctcagcctcctgagtagctgggactacaggcgcccgctaccacgccaggctaatttctttttgtatttttagtagagacagggtttcatcatgttagccatgatggtctcgatctcctgacctggtgatccgccctcctcagcctcccaaagtgctgagattacaggcgtgggccaccacgcccggcttccctaggaagttttaaaatatcctcttgccttggctgcaccttataccaatttagtcagaatagatggaagtggtaccaacacatggcaatttttttctaatttttcagatgatatccaaatatagccatggttgagagccagtgttctaaatgccttgctccttaccattagtgcttgtatagtctttccatcatccccagtggtgactcagtctctacccaaacacacctagcattagctttgactgtcgatcaagttcttaggtcaattccaaatctgtcacttttctcttcagaataatctctttatttcttttaattgcttctcttatgacatgattttaaatctcctcattatcccagtagcattcttctaactagactagttgtcaatatggtatcttggaaagaatctggattttggagtcatagtacctttcatttacacttcatatctgctgtgtacgtaataatcttgtgaactcgagcaaactattcaatattctcagcttccctccttccacaaataatgctacctcttgtaacttttgtgaatattaaatgagatatacagaataggagtaagacttttagaagctctgagcatggaaaactgtagtgtcttatcactgccacttcacccctccacatgtaactcaaatgaaaacaacaacagtgaaccagataaaaggaacaaaggaatacaattatgttatagtttttgtcttcactatgttgatttttaaaattattaagcagcaaatatactatttttgaagtacatatgtccattttttgtacctttatttggctactgtccaaaatatatgcttaatcttctcctgagtaatctagtagtaaacagcctgaatataactgtgcatggtagatttgagagtaagacagaaatgtataacttgagacaaatttttaacctctttcataagcttcaatttcctgaattataaaatgaaggtaatatttgccccggatgattaaagtaaaaattgtaataaataatatataaaaagtacttataagttataaaaaagtagatacagtgtgtggtgaagaacaagggtctgttaccaaactatttgggttcgaatcttagcttacaggttgtggctctgaaaccttgggctctcaaaccttggaagatgaggataaaaataaatctacctcttaagtttcttgtgagtttacaataattaatgttctttatacatttaggacaaaatagactctcaatacatgttagtaactatcattattattgaaataataatttttattagacacgaaaatgtctggtacctcataggcactcaaggtatgtggtataattttcttttctttttaactgagttgcccatagctgaatatgttactgaaatatagaatggtgcctgaaaatactcatagatactcaatgaatatatactaaattaacaaataaatgaataagtatggtctgattacaaagtatagaaggggattatagctttataactttcctcaatataggtttagattcatagtaaaaacacatttctattacattcttaccaaaggacctaaattccaattaaatttagaatttttaaaagatcataaagctctttaattatttttgatgagtttctagccagtgacatttttaccatacctgaataggacaatactgaaggagataattttcaaaaatatgtataatctaactcaacattatacgagtataattacatttcgatctctgtgatttaaacatgaggctcttatcatatgaaaaaaaaaacaaacatattcagaagcacttaattgctcagcttaactcaggttagcgcagcctgactcactttacctttagattcccttgctctggtaattaacacttaggtcttctccaaattatgtaaccattctgggccttaatatcatcatctgtaaaataggagtaatattacctagcccacgggaattttgtaagaagcaaataaaatgggatatgtgaaaatatactgaaacatgcatatatatgacaactgtttatgtgtgtatagttaaatttgctgcttgctcaagcatatcctagaaaaaagcaatcaaaatagctatgcctggtgttcagagatttgcctcaataaactcgactaaccatctagcagtgactattttaaatgcttattttgctagaaatgtaacaagtatgagaataaagtgcttacgttttctacttgatatggttctgaagaggttaattttaatcacgacattctgcacttaaatttttgtagcctactgccaaattttaacattcaagtttattcatttttctttatctgtctacagaaagatctcaaattattgattttcctaaatatatatcacttgaaagttacattacaaaatgagcacacggactgcaaattcagaggatgctgagttctataaaataactgacccacattttcctagctattaccctagcctacatctctgacagagtcctttagatatctaaggcaaaatttgcttccaattttctgctttatatgccaagatgatgacatttgatatatattgaaattattttaaatattgggcattaggagatttcaaagccagtatccataaagagaaagtaaaaaacctgggatagtgtgatctatagagcaacattttatggaaaaataataataattaaaattggaaaatcttttttaaataaatggatgctggaaaaattctcctacttcaatattaagagtttccaaagatgtaagctacttttttgctttgccataatatgtataagatatgtaaccaatatttaaaaatctatgtggtttgtcaaaataaaaagacaacttgaagtttcttccaaaactacccatttcacaagaatattgcttattcacaataagattatatttctatgttttaaatgttgacaaaagaaggaaacagagaaataattacactaccatgtacccgaaccataaatatgtgttctgctgacttttaacaaaccaggatgaaacatttatgatgaatgaggaagagactgttgtaatttttctaaagcacttttatattgcatgaatgactatcttcctcaggagagcacaaattaatttttattaacaaagaactgtaaagaagtgctgccatctttgcttgagtttaaatgtttcccacaattttatcattttaatggataatgggaaaataaatagttgcttgcacaataaaaaaatcatggttgtagttagtattaggtaggtacttcataatctttctcatttctaatattttagatatagggcattttctccataagtggctttgtattgttgtttccctaaagtcattccaaattagcttgttctttaataaaacagagaatttttggaaaagaattatccaactcttctctgatgcttaaagcttcctttatgttttctttttaagagcacaatcctggatatttttcccatgaaacactctcgcactacaattgtgagacctatattttataaagcataatgaatttttaaaattttacattaccactgttatgtgtggagaacactaaaaacagtttttaagtttaaggcattccatccaagtactaaccaagtctgaccctgcttagcttctgagatagagatcaggtgcattcagggtagtatggctatagactaaaaagatttcttaactagttttatctctgtcctcatgattgtggtttgtgaaagaaaaatctgattataagtaggagggtaaatccctgattaagaaataattttattaaaatattatgaagatattaaaatatttatctgattatatatgactaatgaatagatttcaaatattatttgtctacatttgtttttctttctgttgtttggctaaaatgacttaaggcacaattagcattcattgtgtataaagaattttttatattgattttataaaccataagaaagaaatatctgaagtaactcaattacatttccttagatatctcactagaattttcaatagccaatgacttcaacttttagcctatgagagaaattatagactaatgtcccttaccaaatactaaaatttgatatcagtatttgaaatcattctttggaactttgattaatttagaactgtttcagtaaacaatttaattaaaaattaagctcctgaataaagtatgatttatacaatcataaactattatatattaatacaaaaccccattaagttaacaacataagggtgtgagctatagtgaattaggttaattttctggataactgaagattatcatataaatataagaaaataatttttgataacatatgttcctgtcaaactttaggcctatattaaaaaaataagctctgaacaaagtgtaacattcatttgattattacagattataggaaaactctagttaaccttctcactggattaattcaaatgccagttgtattctgtagagccatgatgctgaaggtgataggtaccacttccattggtctgttcacttctgttccattaattgtttccttcatactttttttattgtagttgtaatggttattttaaattgtattgttattaagtgaactagttcaatattaggtaaagagataaaataagcaagtggaaagaatgagcaaaactatgttgaatactttaggaagtattttgaacactgaaaaattttgggaaaacgagtaaatacaaagaaagtgttttagtgcattttcacactactgataaagacatacccaagactgggaagaaaagtaggtttaatggtctcacagtttcacgtggctggggaggccttacaatcatgagggaaggcaaaaggcacttcttacatggcagcagcaagagggaaagagaaagaagagaaagtagaagccccttgtaaaaccatgagatcttatgagatttattcactaccatgagaacagtatgggggaaactgccctcatgatgcaattatctcccactgggtccctgctacaacacgtggaaattatggaaactacaatgcaagatgagatttgggtggggacacagagcaaaaccatgtaagattgttttgcaaggaattttaagccctaagaccactttaacttaagctggttgttttttttgtttgttggtttgttttgttttttttttgagacagagtctcactctgttggcccaggctggtgtgcagtggcatgatctcggctcactgcaagctccgcctcctgggttcacgccattctcctgcctcagcctccgagtagctgggactacaggtgcccgccaccatgccctgctaattttttgtatttttagtagagacggggtttcaccatgttagccaggatggtctcgatctcctgatgtcgtgatctgcccacctcggcctcccaaagtgctgggattacagacgtgagccacagcgcccggccttaagctggaatttgaggaagacgctttcctgtgtgactatgcaagaaagaggaagagaggcagaagacactaactcaaagaaaagggcttggtctcatgttaaaatacgcatgactgaatggatttccacttattttaagttaaaatgaaatgcttaacatatggaaatatattattaaaaattatttctggttttgcatactttagtagctggctgatccttatcttaccggataagtggacactgattgaatatattttattatatatctggcctaaggaaggctatattctatgactatggaatatttggtattatcattcttactacttttgaaccatttcactttcagtttcacgtttttttcctgctcctgaatattttgcatgcctgattccagataattggaaaattgctgcaccttcaatataaaacttactcaaatatagttgagatttaaccggtcaagacaaactttgcagatttatctccttccttcccacatcccacattctacctatttttccattttctatttaacaaccagtctgaatgttaattggagaagtggtaggtaaagttaaaaagtaggtaaaggcaggcttgtagcacacctgtggatccagcaaatcttgaattctgccatttttggggaattattgatggatatttctatatgtcaggtgtgtgttttagaatgattcaattcatctcttagttctttgttttttattagttttttgggggggttcttttctctgtcctttttctctgaaaagtatatcataatcataatttatcataattggcatatctatatcaaataggaaaaaaataactttaagaaaaatgtttctctctgcttttacagaaaaaagagtcctcaatagacattgcttagtattaacttattttccctgcttctgtagtgtggagtactgacatttaaaagactttaatttctattgataataaatgaatgcacagccagagaagagaactctaaaataattagagggatgcatgtcaagtctttcaggccctcatattaatacacagtgcatgctgcttcttattgttgcaaatgtcaaccttcttttagataagtgtcttttgggaaatggtttactacacttcaaagggatataataaaagaaaagggcttggggcaatatttaagcaatgaaagaaacacaggacatttatgactagctgagaggaactgattgcctttggctgtgccttgggaaatccccaggaaacacagtaagttgtgattactattgtaagttaaaatgatataaagcatgcagaggaatttgtgtttttcttatgggtgatactgcatttcatattctcagcataccatcagagttcatatctacctctgtgtttcttactgaagtactagcaggagatgtattattgaaaattgccaaagaataattttcaagaggatcaatttaagaaaatgaaaagaatgtaaagctaagtctatctcagaaaacatatgtgttttcgcatacctcaattaaatgtttctcattaaactagacattttgaaattaatcataccaaaatttgtactgagaatgtttgttaaaatttgcatggtaaatttctactatgtgtataactatggcaaataacattagaggtaaataaaaaagaagggcatacatttaattttatcagtgcatgttcacagtggttatttccttaatagacatagaaatgtttagatctggcagcattattggggggatgtgaggatgtgatttattattacccttataggttttcacttctgagtttctaccaggctgttgagaatataaaggaaattatctcacaaatctgttatttttttctttattcatttcatgtagtttcccttttctggtagttaagagatctaacaccaaattttaatcactttatggtctcagttttcactgcactaccttcaaattcaaaacatggctgaagaattatgtcacgcgcttcccagtgaagacaccaccaaacaggctttgtgtgagcaacaaggctgtttatttcacctgggtgcaggctggctgagtccgtaaagacagtcagcaaagggagataggggtggggctgttttataggatttgggtgggtagtggaaaattacagtcaaagggggtttttctcttacaggcaggggcggggtcacaaggtgctcagcaggggaggttctgagccaggagaaggaatttcacaaggttaatcaatcagttaaggtggggcaggaacaaatcacaatggtggaatgtcatcagttaaggcaggaaccagccattttcacttcttttgtgattcttcacttgcttcaggccatctggacgtatacgtgcaggcttgggctcagaggcctgacaaattattcttgaaatgaggtctgaaatgctaacaataaaattcagcctgattatcactatttttggtcatgcaaagataacaaactgggtaaaaaattgtagtctatttaaaggcactttggccttgcaaattctgtacactgtctggtttgattaatgagcaagtgactttatcactgtatgtcaaccaaagcaacagattgaaggcatgccttgggcaggtctatgctccaaaagggattttaagagagctaatactttaatgtgtttaatttggatgttttaattaagggttaatataaatatcaaagcaaaaatctaaataagcacaaaactagtagccatttcttgtataagtacctaaaatgcacacatctgaatactttcaaatttcggggaatcgccaagcattttacagactacgtgtttcctgaactgttaacccaggtcttctaattaacccttgaagatagttctgggtgctacataaaagcttgaaggattactcatataagcttaaatagaaattccaccaaaatgcattaaagaatatgagaatacttatatgtttatcagaaatatcttgttattatttaaaattttatcattctacaacatttacaatgattatattaactaaatcctacatttccacatgtatataccatgatgggaccaaggtcaaatttttattttacttgtgaatgataatttcagaagttgagcattcttctgtaaatgctgctcttatataactcagatattttcttgaacgactgcttcttaaactatttaaatatcaagagaactttaacttccagagggtgtaagataatacaattaaaactctacttaaaaaaaattcatacccctttagattccaattgtgtacttttaaaataatattacagctctttagtcacacacttatctgcaattctgagatccaaaacacaaataagcaaaccaaatcccctgataagtgaaagttcttttatgaattatatggtaacaaaatcttacctgaattgaaaagaagctatttacagtttttaaaaatcaaagtgtgattatacttttgccgcagagatattaatgtctttgattacaccagctccagatgtagctaagggtgctttttgtaaattctgaataattctgaattctgaaaaatcacttggcctcaagcttttggataaagagttacttaagaattttcttatgtttatatttccattccatgtctaacactgttttgctttttgatgtgtgtgcctgaggccagggaataagtgctgaattcttattcaattatagttcaggtattattttaacatttttcctaggtaaaaatggtgttgactcttactctaacaagatggtatgttactcttttctatacctatgttctgagctacaccaagaatctctctttagtaaccacttccagaggagtaggaaggtattaacaacgttcatcacatttttttttgttctttttaaggcatttctttttcctttctttcatggatttctgttctttacattcattctctgtgacagactcatgtgcttattacaggtctaatttacagtgaagacagtttataacagaaatcacaatactcataattcacaaagcagtctctaattggctcagtcctcatactcatcctgattatacagactcagaatctggtggagaagctcctgggatgcagaggccaaaagaattcagttcaaggctgtcagtgccactttccagctttgtagccatggaaatttactttgctacttctccctctttcctatttgtggtaatggaaggctattatatagtatggagataatatatgcttcagataattttgtcattgctaatataataaagcattttaaataagtacatggtgtgctatgaaacactgaaaaaaatagttaaataaatgtaatgatattcatgaactacaggttgtgtgtggggaaaaaagcccagaagtgcaggagttctctactggatttattaagctcctatggttaagctgaacactaacttattcttaaatatgtcttgcatgaataagttctatatctggatttagatatattaatatattaaatattgttgttttaattcattgtcttaagtaatagatagattttttaaaatcaatattttagaaagaaaacagtagaaggaaaattatgtgggtaaattgaataatctaggctttgtcatcatatctccttaaatgttttcttttaactggtcataagttacttatgctaagcagttttctgtagcatagtactttttttttccccataggttattggggaacaggtggtgtttggttacaataataagttctttagtggtgatttgtgagattttggtgcattcatcacccaagcagtttacactgcacccagtttgtagtctttcatctctcacccccttcccaccctttcctcctgagtccctgaggtccattgtgtcattcttatgcctttgcatcctcatagcttagctcccacttatgagtgagaacatatgaacatacaatgtttggttttccattcctgagttacttcacttagaatagcagtctccaatctcatccaggtcgctgcaaatgccatttactaattcccttttatggctgagtagtattccatcatatatatgatatacatatatacacacatatatatatgatatatatacacacacatatatatgatatacatatatacatacacatatacatatgatacacatatatatatcacagtttccttttgtttgtttttgagacggagtttcgctcttgttgcccaggcttgagtgcaatggcaccatctcagctaactgcaacctctgcctcctgggttcaagtgattctcctgcctcatcctcccgagtagccaggattacaggcacatgccaccactcctggctaattttgtatttttagtaaagacagggtttcaccatgttggccaagctggtctcaaactcctgataccacagtttctttatctacacattgattgactggcagttgggttggttccacatttttgcaattgcaaattgtgctgctataaacgtgtgtacaagtatctttttcatataatgacttatttttctctgggtagatagccaatactgggatcaaatgatagttctacttttagttctttaaggattctccacactgttttccatagtggttgtactagtttacattcccaccagcagtgtaaaaatgtttcctgttcactgcattcacaccaatatctattatgttttgattttttgattatggccattcttgcaggataaggtggtgtcccattgtgattctgatgttcatttccctggtcattagtgatgagcattttttcatatatttattagccatttgtatatcttcttttgagaattgtctattcatgtccttagcccactttttgatggaattggttttttttcttgctaataagtttgagtttgttgtagattctgggtatttgtcctttgtcagatatatagattgtgaagattttctcccactctgtgggttgtctgtttactctgctggcagttccttttgctgtgcaaaacctctttagtttaattaagtcccggctatttatctttgtttttattgcatttggttttgtgtcttggtcatgaactctttgcctaagccatgcccgaagggtttttccaatgttatcttctagaatttttatagtttcaggtcttagatttaagtccttgattcatcttgagtttatttttgaataaggtgaaagatgaggatccagtttcattctcctacatgtggcttgccaattatcccaacaccattttttgaatagtgtgtgctttgcccactttatattcttgtttgctttgtcaaggattggttggctgtaagtatttggttttatttctgggttctctattctgttccttccatctgtgtgcctatttttatatcagtatcatgctgttttggtgactatggccttatagtatagtttgaaatcgggtaatgtgatgcctccagatatgttctttttgcttagtcttgctttggctatgctggctctttttttggttctatatgaattttaggattttttttttctaattctgtgaagactgattgtggtatttttatgggaattgtgctgaatttgtagattgcttttgacagtatagtcattttcacaatattgattctacccatccgtgagcataggatgggtttccatttgtttgggtcatctgtgatttctttcagcagtgttttgtagttttccttgtagaggtcttttaactccttggttaggtgtaatcctaagtgtttgtttgtttttttgttttttcagctattgtaaaaggggttgagttcttgatttgattctctgcttggttgctgtttgtgtatagaagatctactgatttgtgtgcattaattttgtatccggaaactttgctgaattcttttatcagttctaggagttttctggaggagtctttagggttttctaggaaaacaatcatatcatcagcagacagtgacagtttgacttcctctttaccgatttgaatgccctttatttcattttcttgtctgattgctctggctaggacttccagtactgtattgaagaggagtggtgagagtgggcatccttgtcttgccagctctcagatggagtgctttaaacttttctctattcagtattatgttggctgtgggtttgtcatagatggcttttattacactgaggtatgtccctatatgccaattttgctgagagttttaatcataaaaggatgctagattttgttgaatgccttgtcttcatctattgagatgatcatgtgatttttgtttttgattctgtttctgtggtgtatcaccaaagcacagtacttttaaaagcaataattaggcttcttatggtaatatctgattatttgtcactccaacacaagtatcacttggaaaaaaatagttaggttaactctcctttatttttaactaatatacatattataccaataagaaagtctaaaataaagtttataaagtctgggttcagtaaatgagcactttggtaatacactatcttagatttggcatcttattaaaaaataaatttggctattttgtctttatgctgatgtgatgactttttaattttttttatttttattgatacatactatttttacatatgtatggggtacatgtgatattttattacatgcatagaatgtgtaatgatcaagccagagtgtttaagatatccttgccttaagtatttatcctttccttgtgtcagaacatttccagtcctttctttcagctattttaaaatatacgaaacactgttgtttactatagtcaccctactctgctattgaacattagggcttatttcttctttctaactgtatgtttatacccattaaccaccctctgttcatcacaccacccacccacccatttttcccaggccctagtatttatcattctactctctacctccatgagattaatgtttttagctcccacatgagtgagaacatgcactatttgtttttctgtgcctggcttatttcacctgaaataatgacctctagttcatccatcttgctgcaaatgacatgagttattcttttttatggccaaatagtattctcttgtgtatgtataccacttttctttattcgtttgaccattaatggacactgaggtccattccatatttttgctattgtgaataatgctgcaataaacatatgggtgcaagtatctttttgaaatactaatttattggcctggcgcagtggctcatgcctgtaatcccagcactttgggaggctgaggcgggcggatcacgaggtcaggagatcgagaccatcctggctaacacagtgaaaccccgtccctactaaaaatacaaaaaaaatagctgggagtggtggcaggcgcttgtagtcccagctacttgggaggctgaggcaggagaatggtgtgagcccgggaggcagagcttgcagtgagccgagatcgcgccactgcactccagcctgggtgacagagcgagactccgtctaaaaaaaaaaaagaaacactaatttattttcctctgcctaagtgcccagtaggggattgctgcatcatgtggtagttctatttatcgtttttcaagaaatattcatactgttttccatagtgcatgtattaatttacatttccacccacaatgtataagagttcccttttctttgcatccttgccagcatctgtttttttttgtttgtttttgttttttgtttttgtttttgtttttgtctttttaataatagctactctaactgggttaaaatgatatttcaatttgtttttgatttgcacctccctgatgattcgtgatgttgagcattttttcaactacctgttggccatttttatgtcttcttctgacaaatgtatattaagataatttgtccaacttttagtgggtttatttagcttttcttttccgttaaattgtttaggttctttgtatattctgcatattagtttcttgtttgatgaatagtttgcaaatattttctctcattctataggttgtctcttcagtctgttgactgtttcttttgctgtgcagaagctttttagtgtaatagaatctcatttgcctacttgtgtttttgaggtcttagccataaaacctttgcccagagcaatgtcctgaattgtttcttctatgttttcttttagcagttttatagtttcagcttttagatttaagtctttaaaccgtcttgagttgatttttgtagatggtgagagatacggtttcagtttcattctgttgcatatagatgtccaatttacccagcaccatttattgaagggactcctttactccaatttatttttttggtgtttttgtcaaaattagttaactataaaaacatggatttatctggggttctctattctattccatcagtctatgtgtcttgtttttgtaccaataccattctattgttattactctaggcttgtaataaattttgaaatcagttagtatgttgcctctggtttcattcttttggttcagaattgccttgtctattccagctcttttttggttccatacacattttaggatttttttttctatttctgtgaaaaatgacattggtattttattaaggattgcactgaatttgtagatttctttgggtagtatagttacattaatgatgttaattctgctgggatgtctttccttttttttttttttttttgtcctcaacttctttcatcagaattttgtagttttccttgagtaggtctttcatctccttgaatacatttatttctaggtaatttttgtagctattgaaaaatgagattaccttcttcatttctttttcaaccagtttatgattagtatataacactactgatttttgtatgttggtttttgtatccttcaactttactgaatttatttatcaaatctaagagtttttggtggagtctttagctctttctgtaatagaaataagatcatgtcatctccaaacagggataattttacttccattttttcaatttggaatgccttttctttctttctcttacctgattgttctggctatgtctgccagtactgtgttgagtaggagagataaaagtggatatccttgttttgttccagttcttagagaaaagattttccagtttttcccattgtgtccaaggttagctgtaggtttatcatatatggcatttgttatcttaaggtatgttccttttatgcctataaggcagtttttttgagtttttatcataaaggaatgttgaatttttccaaatgcttttttacaactattgagatgatcatatggtttctattcttcatactgttgaggtgatacatgacatttattgatttgcataggttgaactagtcttgcactgctgggataaatgtcacttgatcatggtgtattatatttttgatatactcttagatttgatttgctggtattttgttgaggatttttgcatctatgtttatcagggatattggactgtagttttcttgttgcacttttttctgcctttggtatcagggtaatactgccctcatagaatgagttagcaagaattcccttcttgtaaatatttttgaatagtttcagaagaattggtataagttcttagaaagtttcgtacatttcaccagtgaagctattggatcctgacttcatgagactgatgtattcaattctggacttcttttggcggggcttggcggagactttttattactgcttcaatcttattatgtgttactgatctgttcagattttctatttcttcctgtttcagtcttgttaggttgtatgtgtcctggtatttatccattttgtttaagttttccagtttgttagtatatatttgtccataatagtctctgattattttttgttattgtggtatccattttgtccttttttttttttttttggcttctgattttatttgttttttttcctctttttcttggttagtctagctagtggtttatctatttacttatcttttttaaaaaacaactttttgtttcattgatcctttatatatattttttgagtctcaattttgtttagttctgctatgacttttattatttcatttttctctactaattttgggtttggtttgttcttgcttttctaatttcttgaggtgcatcattgcatgcttagaaatctttctatttttttgatctagggttttgttgttacaaacttgcattttaacattgcttttgctgtattccataggttttgatatgttgtgtctcaattttcatcttttcaataaattattttatttctttcttaattgcttccttgacccaatggttattcaggagcatgttgtttaatttccatttatttgtacagcttctaaagttcctatagttattgatttctagttttattctatggtggcctgagaggatacttgatatatttcaatttttaaaaatttgttggggcttgttttgtgtcctaacatatggcctggagaatgttccatatgctaaggagaagaacgtttattctgctgttctcagatgaaataatccgtaaatgtctgctaggtccatttggtctaaaatgcagtttaaatccaatgtttctttgttgattttctgtgtagatgattggtctaatgctgacagtagggcgttgaagtccctaactattactattattgtattggaatctgttcttccctttacatctggtaatgtttgctttatgtatctggtgctcctctatcaggtgcatatatgtttagaaatgtaataccctctcactgaattgatcctttaatcattatataatgagcctttttgtcttgactgaaaagtctgttttacctgaagtaagtatagctactcctgatcattttggtttctgtttgcatggagtatctttttccgtctctttattttctgtctgtatgtgtctttgtagatgcagtgagtttcttacaggcattgtatagttgggtcctgtttgtgttttgttttgttttgtttttgcctttagccagtctatatcttttaagtggaaagtttaatccatttaccttcaaggttaatgttgatatgtgaggtttttttcttgtcattttattaattagtttctcatttctctatccttatttatttctccttcttattgtttatcattcatgttgggtggttttctgtggtggtaatatttgagtcctttgtttttctcatttgtgtgtgtactgtaccactgagtttcatatttttgtgtgtttgcctgatggtagatattatattttcattcccacgtgtagaactcccttaagcatttcctgtatgaccagtctagtggttatgaattccctcagcttttgctgacctgggaaagactatctcttcttcgtttatgaaggataaatttgctgtatagcatgtccttggccgccaggtttatttttttttttttctttcagcactgaatatatcactccattctctcctggcctgtgaggtttctgttaagaaatctgctgttagtctgatggaattgccttagaagtgagtcgatgcttttctgttgctgtttttaaaaatccctttgtctttgacttttgacaatttgactataatgtcttgggaaggcctttttgagcttcctgtatctgaatgtctcaatctcttgctagagttggaaagttttcagttattatttcaataagtgtgttttgtattccttttattttccctccacctttgagagacccccaaaattagaatatttggtggacttatggtatcctatatgtctcatagattttgttcatttatttttattttttttcctttatctttgtctgactgagttatttcaaaagaactgtcttcaagttctgaaactttttcttctgcttgatctagtcctttgtcaaagctttgagcattttgtatttcattcaaggaattcatcagtttaacagtttctatttggttcttttttgtgatatctatctctttggtaaattgctcattcatatcctgaattgcttttctgatttctttgtattgattttctgaattatcttgtttctaagtgagcttcttaaataacactactttgaattatttttctggaatttcacaaatttcttcattggaattgttgcttgagaatgattgtgttttttgggaggtgtcttctttccttgctttttcatgtctcttgtgcccttatattgatatttgcacacctggtgtactagtcacttctttctattttttgaatattttttaataagaaaggacttttttcctgaagatgtatctgtggtgttcgttggataaggtgctttggctttaattctggtcatgtgccgtagtatagtctctatatgatttattggctgtaaacagtgtcagtagtgtctatgatttccacactggctgagagtgtgtttgtttgtgcagactgtggtaaagttttactggagatgaagacattaaacaggccagtcatttggccacagtacaggagtggcaggacaagcatgcctgtccttgagccccaaagcagtaatgctggcaccagtgttagtgggtttaggcagagtgattcttgggcctccagtcagcttgcttgagtgctggtagtgacaacaatgggtcaggtaggtgggaagtttcttgggcctctggagaccacccaagttggtattgcatgggtgatagcagtagcagtggtgagacaatcatctggcccccaagaagtccactccactgttagtggtgattgcagtggactggatggattagttccaatgctctcaagtggcacatacaggtgggtgccagctgtgatggtagttatcaggttgtgtttgcccatcctcaggcctctggaataagtacacaggtgctgagagaggtggataggacagggcgatccccagaaccctggtgaaatgcttgggtgggggcagcagtgattacactgtggctctgctgctgtagagagtggcgttgttttcctttgcagcagacataaacaagtggtttaggagtgagagcatcggccacaggtggtgtctataagtggggtataatatttcctcagggcatttttaaatgaacagagaccctgctactgaaggagactgggttgctgccaatggctcacacttgggctctgacagcagccagcagcagtacctggctgtgggaagggaatgtcagtggtgctccagagatgtggagatgcagggactgttgcttcccagggaaggatgcagttggtgggtcgttaggctctcaaaatggtgtggtgctatatttgcttaggactcagggcaagtgtggccccagtgtgagctccctctatgaagcaatgtcattgggtggtctctgaaaatctctgtatgttagtcttagggcttgtgtgagttgaggggctcttctgtggctagaattgcagaaatccaccatggaaatgtagaccactggtagtcagtaacttacccttcccttgttttggggaatctctccaggctcccagctgttcccagttgagctggctgcctcacattcctttccttccatgtcttaggcatttcttgtcatttttcattgcatttcagcattttctttcttatgggatctattcaaaatgtgattatctattcactcttttggttcttatctgtggagggatcaagtatcacatgcctctagtcagctatcttgaagcccctccctgatggaatttctcattgtaaaagatttcattgagcataaacatataactaaattaaatgactctgacagtgtaatgaaaaaacacaaatacaaggcagccacatgtacaaagtgcaatcaaaaagaaacttaattgatacagaagtaggtaactgtaggggagaactgtgatctggggagacaactcaggatgtcgaccatatgacatcagatttttcattagaatgaaagaagtatcatgtagtaaatgcctcggaaccagttagataaaaatgtaaagccaaggtcttcttcagcagaattttgtttagctattctggacttacttaattgtgactttcctgtgatttatctcaacaacttgaagtttttgatattaggagactagcttctccagtcagtgtattataaatatattactttctcatagtttacatttttctttgtaagtaagtttgttccttgtttgttataggaatgcattgtagtattcctctttccctagttaaatctctaatgaagatcagtcctaacatattacaggcctcagaaatatttttcaaataaatagaaaacatgtgtttttagtttgtattttgatatttaataatagagcttttaaaaaatattggtttttgttatttttagcttttaattacttagacttgatgtaacttacaaagttaaaaaaaacttgaatgtttttgtcgcaaatattggtgagtctttgccttaaataatgataactttttaaaaaaatcagccttgtatagtgaatattgtgctgtagattcaaataaacctatgtgtgcatatcccagtttagaatcttccagatttaggcagatctcctttctgatctagatctttcttgacttctaaatcatgaattatacaggtgtgactttattccatctcaaatgcaatgctgaaacagtgcttagataacctgccatgatttctgcccttagactcaaagtagtaaacattagtctattcaagattctgtcttatgtcattcaatgcttgttcggggcgaatgactgatggggttggtgctaacaacctacacttgggtctgtacagcaattttatagattattatgctttcttctatgtggaggttgtaatcatttcatcaaatttactcacaagtcgctcttcagagcaaaatgtatttaaacctaccccagggaaattccaatagaccataacctctccctaaatagattagagacagaaacatattcttagacaaaggaaatttaagcatggatttgcacgtcttatttatcatcctttaatgcaatcgtgcaaatatttgacaagataagctccctctttagtatgtctttataggtccaaggccttaatattaggatttgctattctttattagaagtaaggttcattaaaatttggcaacagggattattttgtggatccaccactttaactatttagctatccttaaaaacttaatggttctttaactgattctgaaccaaatctaaaattacttaatcctaaaaagaatttttctgtcagcaaaaatggaaataataataaaagaaaataaatgagatcatacttttcgtgtgctaagcataagagctttacagagtaaatgttcaatacatattatttaatcttttaaagatattcttgtcatttctaagttattatatttataatgaattattgattcactgagatttttatttacttaatgttttaaaacatgtccttgagtatattataatataattctgtgacagaggtcattgctaggaataaaaatatataatttaaattgcaatatgtgtttgtacagctctcttttaactggagggatgtagaaactatttagatgtgttcattctaacttttatgcccttcatacacaattaatattttcatgtaataacttttttccctttattaaataatgctgctttttctatgcttttgttgatgcatagattagggccattttattgaagtcttcatctttcctttctatagtatttgaggtagaaaaagaaaagagcaactactaatgcactgcttagtttaaaagattttgagaaaatgtttgcatcagctaaggaattggtgcaagggaacctactttttaaggaggccacttcataaatatcatgtgtgttctacttttcacaaaacttcctgtcaaatttaaatgttcccatcttttgctgtaatttttattttactttcatgttttggtgtgttatatatattttttacttaatttcctacaaacattaatatatatttgtctgccaaaaataggaactcataggacttatttgataaaagcagcctcttaagccacctttatttattttgatttctattcatttctccaccattttctactgttactaatgctgacatcatttgctccaaaaaaaaaaatttgttttatttacagggcacagcttatggaagtgctcctgtaccttctcgcaggcaattatgtgagtctcttaaattcagctctgtgttgtaaacatgactgtgttcctgtgctgtagcatggcatgctgattgagaccaaatgcccaaaggtcaatatgcaatccccagtgttgtatattacctataatatgtttgtagtaaatggttccctttgcctcttccttatctgtttgtcattatccagcccatttaagaaaactgcattgcaatgtggccaactgcattgagactaatggctcaaagtctggggcaaagaaagaagtgactcttacttaagtttattttcatttagcaacaatattagcactctctctctcaactcagtaaggtttcttaagttctaactccttttacttattggttcaaagacttcttatatcatgcacagttgtgtttttgccacagctaatgagaactttcctagaaaaggaaatccattaaaagaaatacttcttctagtgaatttaaagcaaacttgacattgtaacaatgttggttttttttcccaaagtcatcacatttagaaaattgaaattaatctataaatgtttagatagaaagcccagagtttacaaccttgctcagctgtgttataaatatatgcacctcggcagagtcagatacctgcatttcagttcgggagatttctgtgacagcttgtctgctttaacatgtactttttgtcaatgagaaatgtatatgtaaattgaatatgtaggctctccaaagtgccatcagactttgagaaagagctattttcattgcccattccatccatgtctttcctcttttcccacaccagcatccgtcagataatcatggttgtttacctccattatagactgctacagcaagacacccatgtgactctaattgtcatgcctagcaataaatgccaagtaaatccatcttaatatgatgttaaaggtgattcaaaggtacagtcctgtttgcataatgcttttcttcactattggcagaaaaaaacatatgagttgatgacattcactgagaaggatccgtgaatcacttcaacaaaaaatgcaggactttccaccatgataaagctgccccaacaatgaacaaaaaaatatgtactttactatctcctttctaatgaaaaaattttgaaagtttgggttcttatgaatatagttgcagcagacagaactgctaatgtgaacagaagatggggtttagatatattaaaactccacctaaagttaaataatctctcaaacatctcaaattgtcctttgctcttatttcttttcataggtctctctatcgtctacatttctaatgtacactaaagatatggcttcttaaatataggcattacggcagtattaattaatgaaaattgaaaaccatagcaaaaacttcaatgggtttttttttttttttttaagatgtgtctctttttaaagaaaaaagtccttgtgctatatgttatatttcattgaatataggaaatgctgttatggagatagagaagatatttttactagagatttggggaactgtgaatttattatatgtgctatgaagccataagcggaaatataaagggtatggaattattatccttaatttgaattaaacttaccttttgctttcacgaaatcaaagtgtatttatatgtaaataaaaatactggatatttgagattttcgatcactggttccagttaagtgagttaatcctactaaaaatagaaagaaaaacaaaaagatgtatgatttctgtaagtctgagggtcttaagttgcaatatttaccaatatgtaccacgataaaatggatattaccttcctaaatatgctgacttggcacagataagcatgtaagattcatgaatttggaatgcttattatcacattttcttttagtcaaatgcaaattttaggatctctgcattacacattagaagaatctccttgagtatttgtaattgtggtgcttatcaaagttgttatgtagaaggaatgaatgctttttttctatacacaaatgttagaatattaatagtaaacatttttgtttctcccctacttcctgtgaatacctatctagaaattttatagttggttcttgattctagcgtgtttgttttgttttttttttccatttctacctacatcacaaggtgtgatgaatactttcctgaagttacaattaaagtttagttttttttttaattcagttttaaggactttgttttatggttgccattttaactatttcaaaaatataatcagtcaagaaattttccttaacaataatttgaaatggaatttagcaacagagagggattgcctagatgatgatatgattagaaaggctgtgaatctacaatgacaggattcactctctatcttggaaagcactgtatagcttttaattaacaggcccacacaaatatgcatttatttgttgctaataatttatcaacgttaaattggaaatagtataggtttggttagtattttccactttcagagaaaacgcttgatgaaggttcactaagttggataatgtggagtcttggaaagttatttgaatgctactagtacatttttatttaaataccaaaatgatgcatcatttattcagatacagttctcttctcaatttccgatgggtttatgttttaaaattgtaatcagtattgttacatgaaactctatcatgtgttggtataaccttatctacatgtgatatgaatggagatctttaacatttggataaaatttggcaaagatgtgacccatagattattgcctcaacattcaaaatacaagaactgatttcaatttggttattgttttccattttgtgaccataattactactttaagagttccaaattacagaagcatgtaactctaaaatttaataaaccataaatatgtgttctctagaaaaaaatagtaaacatcaagtttcgtaatgtattcaacaattcaaaaccaatttggttaaaaaaattaaatgtaggtcacatgctttcatattttataacatggcttctttatttctcagtatatgaatgaaaggagcaccaaatgtttgtaagttgtctattcaggagtagttacctaatttagctgaatcattcatcagatagttcaatgttaacccaactgaactgaatatacatgaaaataatactgccttgctattcagaatcagatagcagttattttatagcacaaatgggactgaaattatatatttaaagtggggtaccttaaaaacatacctaccctaatttccagtcaagtttttttcctactaaagagcaatttttaaattcagaattcatgaacacaaaaaattcaagaaaaaagtcaggaaaacaatgtatttactgaaaataatactaacctcaaagtcagaaaaaatagttctaataagtgtctgtaagaacagatgtttctgactagtttttgtactgtgccttctgatttattcccttttcttttcaattaatcagtttatttcctgtcatttcccttttttctgtatctactgttccacacaatgtatttgcattatttatcattctattttagatatagctttgattttatttgttttcttcattctttgccaggcttataaacaggataggaccaagcttccacagtagtgaggactaacataacttttcctgtaactgtgtttgaaatatatcttcagataatctgtctggtaaggttgcttcaaacctgagtaaaccaatgcctacttgactgtgcattcttagggaacaaaagaaagtgcattgtgtctataacttcacatgtaagtgcacatatgtatttaggattaaagaagctctaatcttcagaaggtaggcttcagtcagagagtgaagagcagggaaaagttttaagtggcatgataaaatcatccacataccacaggaagaggctaagctaatacaatagatagctagaaagagggaaaggcacaaaggaaaaatgcaatatgtgttataatcctgtggaaggcaaattctgaatattgcctttcttttgagaccacagtaatgattttacatgtaattgagctgaccatttttgagctactaaagagtaaaagttatgctctgttctggtaaaagaaaaaaaataaatgacattttctttgatatataaacaacagtaattactattctaggctattgagtttatttaggatatatatatatatacactcatatatatataggatatatatataggatatatatatatacacactcatgtatatatatatacactcgtatatatatatatacatacacacacacatatacacatacatacacatatgtacacacacaccttctggttttagcgtaggatgtagaaagctgtaaagaacattgttcatacccttataataacaacacaaaatctggagaaaattcaaattcacaatttttctttaaccatcagagagttaaagtcacacggcaaccaactaacctgtacataagtaaagatagatactgacaaggtgagaccagttgtagcagacacagccagaacatagaattttgcaaaaacaacaacaacaacaaaaaggttaatgaatcaatgagtcaagtgtgagataggaaggaaatataaatatggtgagaatttgcacctgcttacaggctctttatagacctcactgaatgctcacataaaaataatagcaagattcctgagaagctgtcccttgtgctaaaggcttgaagaagggaacaacagctactgcaagaaaggcacaaaactctattctgttgcttccttcctttatccattcaaaacaaaagcctaaaatgcaggggaaagagcaacaacacagtcactcttaggaccctggtgaaaatccattgcagctaggggaagggagcagaaaaagatcatttattcttgggacagatacaaaaatacatgatgggcctagaaccacaggtggaggagaggctgtagtactgagaaggccacatcagtgacagccaggaacgtagtgcctgctttaagacttagagttgatcagagaaagagagaatgcctcccttcttgttttatagactaataacgattgagtcataaataacaatgggatatgactaggaaagtcacaagagtgtggaaagagattttctctgaaacacagtgcaaaggagagacctaaagccaaaggagggacttacatcaggaaaaaccctatgacaaaccagtcactattctaaatgcaaggtactgttagagaaaatttaagcttgggggtaaccatagcaacaataacaaacccagctcaacacctgcctttattgacctagactcccacactaaaggcttcatagaaggaaaagcatgctcatttctgggcatacagctgatttattaaagtctataatgtcctacataaaatgtctgctttccacagaatttctggggcattcagagaagcaagagaaagcaaagcactgcctagtgataaaagaatcaacagaatcagattcagatattatgaagatattggaactattaacaaggggaattaaaataattacaattattgtgttaaatattttaatggaagagtttgacagcatgaaagaacagatgtctaattactgagttagagctgtaagaatgaattgagtggaaattcaattcattaaaagctcagtaacagagatgaggaatgcctgtgatggtctcatctgtaaactcaacacagccaaggagagaattatgaacttgaagagagaggtcaatagaaattgcccaactgaaacacaaaaggaaaaaaatatgtggtgggattatgggatgggggaagaacattaaggagctgtggaaaaatatcaagtcatctaatttatttgtaattgaaatcccaatggaagaagagagaaaacaataaagaagaaatgtttgagaaaaatggccacaaattttctaaaataatggcacataccaaattatagatccaagaagcttaaagaacaaacagataaaaaacaataacaacaacaaaacacaatcaggcatattatattcaaaatgtagaaaatcagacaagaaaaagtctgaaggtaatctgaagagggagaaatacatgctatctacaaagaaacaaagacaggattatagtagacttctcatcaggtactctgtaagctatgaagtggcatctttaaagttttgagagggataaactaacaagctagctacaaaacattctatagtcagtaactatatcatccaaaaatggaagggaaattgaagtttttctcagacaaataaatactgagaaacgtattgccagcaaacctgcactatgagaaatgttaagggaagaaattaacactgggagtggaatgaatgaaatgaaaactttgctttaaaaatatttacataaatatctgtgctatatttatatataatttatgacatgttgtgatttaatgtgtggccttatttaaattatatttgctgctaagatattaccaaaatgaccatattcccagtgtttttgtagtttatgcctctaacctctacagtagctgtcttgcagacatttctttttatttgtgtatatgtgtacatttatctgtcaatacagttttataatatattaaaagttaatgatgaaacagaaaatatgcacccagtatggtacagaggagaggcaggaaccaatactgaactattaaaatatgaatgatctagtacttcttttactatcccatacctctatacctcaatgattatagtatgtatttcatgttgttacagttttgtcttaccaaaattaacatattctttttctatagaaaacatattcaaatgtttgaactgtttgaaactcaacattaattttacattgtcatatgtgctaactaaacttttcattactcaaagaacatttgcctattatgaaattattctaaaacagaataacatttaaagattgaaaattgaataaataaatttaatagataagacatgttgtgggctaatcctaaaacaaaataaaagaatgtcttgattttatattttccttttaaataattaatgagctaactagtaaattaagttaccatttttaataattaggaataatcagaatactctcttagaactttgactttttgattattaaattagcacctcttattaaaatcaattttttcttttatatatattattttataaatattttacctttcacagtattaataaatatctgtaagcacccaagacggtgctggcgttattaaagtgttggatccttccttattaaagcttgcagataggtaataagatcactgataacataaattaaagtcaagattaaggcaacatattgaagaaatgtattagtaaatataatttagatttagcagttagggcccattgatatcatggattttgagggtaaatttaatttgatctgttattacttttctagaatgtgtaaaatgtttcaaaggctctgtatttgttagttctcgcactgctacgaagaaacacccgagactggggaatttataaagaaaagaggtttaattggctcatggttgtacaaaccgtacaggaagcatgatgctagcatctgctgggcttctggggattcctcaggaaacttacagtcacgacagaagcaaagggggcgcacacatatcacatggctggagcaggagcaagagagagaagggaggtgccaaagagttttaaacagccagatctcatgaagaactcgcttgctatcacgagaacagcaccaaggggacggtgctaaaccattcactagaaagtgcccctatgattcagtcccctcccaccaggccccacctccaacagtggggattacaatttgccatgggatttggcggggacacagattcaaagcatgtgaggctctgagtaaagaaaagcatgagaaattgccatgagctgacaatacataattgtaaatgttcctagagattcttgattccagtccatccacatcacagataaattattgaaagattaattggtttacccaacatccaagactttgtgataaacgcagacttctaactcatttgtcccatttttttcttccaaggttgttttctttaatatttctgttaaagcatcatgtcctcttccccctaaatttggaaagttttcctctatcaaactagcaagcgatgcctgagtaactcttgaaaggcgaatagaagttagttgttgaatgtgaacaagagcaagtccaggagcatgtggaaggcctggcagaacccagaacacagcttgtttgaggagctgtatgtacatggtccacagagctagagaactgggtatttgtacaactgaaagattcccttgcagtgtgtgaaaaagacagtgtctgttataaatcaaacaaaattcatgaatattgctgttatttctcttgtttgaataagctttgtatcattttaaggcaaaagacactgaatttttattaaaattcagggttctgttttttttaagttgtccaaaattatgttcaaataatttgaacttaattatgcttacgctagattactcagacaacccaaaataagctattttaagtccattcttcaatttgtttgtgaaatgaggtaaatattacttatgatctaatctttatatcaaataattagatataattggaaataaatatagataatttttgttttgttttgctttgcttcttaaagaacaagcagatcagggacttcaactcattgcagaagtctgatatgaatggcaagcccttaaattgtagctgtattaggcctcaatgtattacaatatgtaaagaaagaaggcatccatcagaagtggagcatttaagaatcattaaaacagagcaaaaataaattttaaaaaagtcaggaggtgaatcatttttatttattgtggaaatgaaggtattggttaactgagctcaatgcttgagtatccacttgtctatactattccatgctccatatgtacccctctcattatgatctgttatctcctctcccatatgacatctacagagagaatataaggctgggacctgggacccttaagtatacggttccttcagcagtgacaattcagattagaaactgataaattaacattgaattttagacatctttcacatgaacttgtttagataagcctgtctataaaaaataatttgcctgtttttaaatttgaaaagaataaatgtaaaatctggagacaaaaaaaatgcactgagatcagatttcatgggagaccctcacaggaacattccttagagttcctttcccactcagcaccatccactacaacccttgttgtaccggccaactgtcatttagaatcacgtgtacatatataaatagatcttttattttcttaatgtctgtcgtttgggtatttatagcatttggaaactcggtacacatagatgtacagcaaccacttaattgagggtcttttgttattatcaatgttgtaaaatttaacttgaacagattaaggtaagtccttctattaagagtctttttctaatgtattatttttatgcataaaatgtaaattagtacaccaaatgaataacatgttatttgtttaccactgcttttgtttcaattgacatgggaaaggaaaataaatcatcccttataagtaaatatgcattgaacattgaggttattctataaaaacttgttggtgagaatgcattcaatgcacgttttgaagtagttctacattttattctgtatgtctttttaaaattttgttttctgcaagatgttgtttaagttagaaagtgggatctatggtgatttttttttaacttttatttattataaaccagagaatgagtttctttgttctcatgtcaaggaatagccaaaagaggcaaaacattaaaaagaatagcaaaagatattatgtggtcaggctgtcaagtttaaaagcctttaaaaattacattatatttgtttgatctgcaaaaatttaaggctataattgcttttcaagttatgtactctgaaagctttcctctggcctttcaggagttaagagcttagagtcttccttttcatcctccccagccctctttttttttattccttcattctacatttcatgttgaggtcgctcatttattgtgggtagctgtaatggaatggtcaagaagtcaagcattcagggaagaaaatgaaaattgtgtgtctgacttcttgatattacaagtaatttaaatttcttaaagaaactatagttccttaataatatttgctgcatttagttgaatttttatgatactcatttctaaatcatcagcaatatagaaatatatgtgaaaatttccttttaatgggttatagtttgtgcaaacttgtacaaattatatgtgtacaccttactaacagaagcatgttttggacaagatcatttgggaaattctagtggagacttaatacgttatttaatcttcctgatagatccgaaaagtgaaaccttgtcccattttaaaataatatgtcgaactctcttattgactatctgcttgtcttagtttcctaggcctgcctaacaagttaccacaaactcagtggcttaaaacaacacaaatacattctcttctggaggcctgaaatgcaaaatcaggatggcaacagggtttgttccttctggaggtttgaaggagagtctgttttgagcccatctgttagctctagaggctgtcaggggttcctgatgtttcttggcttgtgaacactactctagtctctccccctgtttccgcatggctcttcctgtgtatacctccaacttcccttgtttttaatttcataaactcattggatttaggattcatccaagataatctcatcttatctaaacatccttagcctaattacattgtacagatcctattttcaaatgagtccaactaaggtatcaagggctccaagttgtacatatattttgggagtgtgtattcagcatgctacagacagagtacaatgccagagtcagaattcaaatttcttttcctgactttattgcacaaattattttcattgttctactccaactcaataacaacaaatatggttcaggtatcatattaggtagaagacgatactcttaacaagatgactaaaacacagttcttgccttaggtgcttgcttacacagtagtggaatatggcaaaccctttaatttccaaaaagctagcaatgttatctcaatataatgacagtgagaaaatatgatttaagctatctaatgaaatatatgaccaatactacctttttggttagagatttttctgtattgtttataattttgaaaatggcaaaatgaaataattcaagtaaatgcagtggatcttagtttttataggatataaatagaattacaaatttcttcttgtatcagaaagtgagatagacaaaatatacaagaaattaatttttaaagaaatacagtattgtttgtaaagaggcaaaatttttactacagttagtctccaaaaataccataaagattttgagtacaaaatttattagaaagtaagtctgttatctaaatggttatatatttttttctgaagaaacgttaatatttaattactgaaatatgggaaagtaaatattttgaaaaattaaaatatcaattttattattttacaaagatcatgaacaattattttagaaaacatagaaatctgagagttataaagatgtatttatattcatgcatatgtgatattgcataatgcatacaaagagaaacctctaggtttgtttgttctggttgttgctctttttgtcattattctagagaagagtggctcatgatgatagcacatcacagttttcctatttgctctttggtgttacgcatcataccatgaatcagcctcctgtgtttttatgtatgtctcagtaatttgatataaatagctgttttaaaagccatttgagtatattttgtattaggatattttatgcagaaaaaaatacaaattaaaacaaaaaatctttaacctagggactttatagtaactaaataaagatgtatgccttctataagtatagcggtctatcaaagtatttccatgataatgtggctttttgaaatgaaatattgaagtcattcctcaaaatcttaatttgaaatcagatttgaagtcacacaaattttcaggtagtttgtctcaagtctgagtgtataatgcctttctaaaacaaagtaatcataagtgaagtgtatacaaagtacaaatggttttgggtaactaagattaacaaagaatgtggcttaagtttctggcagccaaaaaaagagaaagctcattttattagaaaaagctttctaagtttttccatagaacaccactcccttagaaacataaccttaaagggagggagaagaagttagaatcaaatcactttggggaatcccatatactataatttttccctcctagagacttacagtgtataaaagcatagtaaagtcttcatatttttctggtgtaaacagaagtgtctaacattatatatatatatatatgtatatatatatatatatattttaattaaatatacagttatctgtataattatagatatagatataaaaataacaatataactatagatgctttatatgttaatatatagttaacatatagttatgtgtataatagttgaatatataggtatatatagttgtgtgtatatatataagtatgtaagataaatatatatgtacttcttcccaaatagtatcatctcttttattttaagaactttaaatactatcccagacaatttcaattcaatgtattctatacattgtaaatcactgacaaggttagagggaatttattaccagactgggattttttaaaatctaccaaaaaccacaaataatgacacagtatgcaagtttatttactgcacccatcttttttacttagcacagtttttaaaaaggaatttttatctggtttctttttcaaattataatgaatattatattttttaaaaaatacatcaaaatgttgtgaagattttgggttaaaaaaaaacaggacaagatattgccagcaatccttaaagaggactagtggttgctatagagatgagtgtatcccaggcagaagacaaaattaagcaaagaatgtaaaggaatgttcagggttaaatgaggcttggaaagtaagttttggttaggcagtgaagagtcttggctaaagagtgtatatcctctgagaaatttcttagcatttcattttacctttttcttctcctctcttttaataaacttatgttatgtttgtaaaaaagacagatacattttaaaaacaggctgcagaaacagcaagagcaggatagcagtaaacagtttccccaaagaaaaaagtaaaaagccaagaatgttctgctcacctgaggagaatggatgcttgtgtgtgtgtgtgtgtgtatgtgtgtgtgtgtgtgtgtgtgtgtgtgtgtgtgtgtgttagggagacagatgtggataaggagggagaaaaaatcttctagtatgatgagagtaggtgagataattgtatatgaagtaaaagatttagatttctgagtttaatattttgtagaataagcaatttcagacaatgacaggatccaggttgcacccatgggcatggaagactgaatgaagtagggccaaaagtcacacaagggaaaagttcaaggttagactggaaaataggaggtaaaatcacctagatgacagcaggaattgccaaaggatagaaaacttttgatcatgtggtgaaattctcaatagaaataaggacagtatgtaagcagacagccaaccaacaaatgaaaaaaggaaaataccatgtataaaggaaaaaccattttaaaggagaattggggtacttgaggaaaagtggtaaaaacagtattttttgaataagcagtttgtagccacaatgatgttaaatctagagcctgaccttgaaagacgtgcatgagaattgcatggatgtggataaaatagataaaaatttgttcacttaattaggaaactcaaggaattcacaaagcataataataggtagtgttaagaaggaaaaaatcctacatggagaagcataagtagggaactgatgaatttgatgttgaatgaaaatggctgggatgacaaataataaagagttttactattaactgtgattatgagatacagtaaaggggctatcaagtagaaataagtattagaaaagtggatcagtcagatttccgtgcaagtattagatactacttaaattggaaattacaaaattgttggaagtgctgctgaattggaaatcaggacacctgtcattgttcattcttgccaccacaggcaagatgcagttgctggaagctgcagaaaaccactgtgaacatcacagctgcccagagctcaaatgaccacatagcagaatatgatgccgtatgtgggagcctatgtgtcagccaccattcctgctaaaggaggcctgcccttggccttttgccttccttttaccttcaaaattttatttcatccttggcagagtctaaaacacatgctgtactctgatggcaagggaaaatggtgaatgtggtttccaggattcaggccaattcaaaaaagcacttagaacatacaagagcgtgggaatggagactaactaagaagggcaaaatatttatgaaagtaagagtaaaaatatcataggaaaaaaaccttctttacagttttaagttaaactttggcaagttcttttgttgagcatggaggcatcctggcctgtaagactacaatatgtagtcctaatatacagaaccaaataaacagagagatcacagacaaacttaatgctctcacatattaccagcttttacaaaatcctccacaagtgctgggtaatagctgactacatagttcccaaaacccaaaagggggaaaatcaaccatatgttttagcacagtggttctctaagtgtggtgtctagacgagcagcagcaccagcagcagcagcatctgtgaactggtgagaaaggcaaatactttggacctctacccagacctactaaataaaaaatgttgtgggtggggttctgcattctatgtttaacaggctatgttaaacattctatgtttatacatgctagagtttgtgaaccactgctttaaataaaagaacagtggttataggcatatattaaaatattaaatattatggtaaaatttaagctccataatgcccttttaagagtgaggcagacacaaatttgatgagattacactgaattaaagcatacttgtttttcttaatatgctacatttgtgaggtacaaatggtatatctgtggatttttaagttaaactgtcttttaaaaaaatgcaaacattatctcacttgagaaattattgtttgacttcatttactaaaggcccaactatacctttttggtagtcaaaataataatagccgacattcatctagtacttgcaatatgtcaaggacttatctgtgcatcatacttacactaatttatttagtacttacctatgggatagttgtcagtattattatcatcccctttttttgcagatgaaaaagtagaggtagtgacaactgagatttcaaagctaactagtttgattccagtcttttatttggtaccagccatacagcgtaaataagaaaatagtactacaaggatatttccatactctatgcatctttctaacaaataaaaactgattttttatatgcatgtgcaaaattgacaaatggtacctttctgtaaaagtcacaataaaaaattttagcagggactttttctacctgaaagttttttttttttttaaatacatatattagtcctcataatgttgttaaatgctgttactaagttaaaattggctttaaaatcatactgccataaataatttttgctttaaatgaacgacttgctactctgatatctaatttctagtggaagacaccgtgcgagaagtaaaagagaaacacacacaaaaaaacaaaacattgccaagttagcagctcggaattatgttttaccttagtgtggcttccacctcttttgaagtaatgggccattttgttgccttgactttggagtacttttcagactcaggaagtcaataatccttttggaagagagaattaatgagtctttcagtgtaaccaatttcagggatatcagggaggcctgttataaaattattacaagcaatatttatatgatcacatatatgaactataattatttgcaattttatgtttctgttatctgctgtgggaacagctttttgataatgggaattttataaaaatggtttattaaaatgtctagttttggtatctactcattattttagatgaattacaactctgaataagactcgaaggcaccatttcttagtgccaaggaaataaaagtaatgtgtgttcatggcagtgaaaatgaagccactatcagtactgttagggaaatatataaaagagttaattgctttcagaggctgagacatatgcctcaggtagatactaatttaatgttcttccttaaaatatagtcaattattcaaacacaacaactaaattactccaatattttaaaaatgatttccaccagtccatatttggagggatactatttaaaaatacattttatttcatatatcaccaagaaaggtgatatttttaggatacttctgaaagattttaactaagtactgctggcaactgaaaaaaaatgggagaagttataattggtgttaagaagtaaagttgattattatgagaaatgtttatcgccaaagagaattttcaaaattatataacatgaatgatatatgatatatttgataactaggttagcattaagcctctttgattcaaactgtgttccaaccagtgtttcagatacattccagaagtttacttttacctttgattgtaaaggtagtttttaaagggtgagtcattagggaggtttttaaaaatatacagttgctactcactttatcctaaaaggaaaggaagattaaatttagctgagaggaaatacttttacattatattctcagtaatactagggcaagatggctttgcgtggcatttgtacattatgcatacataatatgcacaatttacagatgggtattgataaatatactattactggataatgaaatgaaaagtaaaagttatgcagagtatgggagaaggtcataattgtctgattaccacacagttgcatgggttctttatagatattctccttttatataaacagtatgtgtattttaattaatacattgtctactgaaataatagaaaatctacctttacttctgaatttataatcataactcagctttaaaacaattgcaatattaaaaaggagaattaatacatggattatctactataacatgactgtcatatattccaagtggaaaaaaatgtgttcacctaataagcattttgatgctgagtttatacaaagtaaattgtttctcattataggtgtgtttaggtggagtcattatttgcctctctgtctatgtatatataaaatatagtatatatatatatatatgtacaaaatagaacagagggatatattaagtaagaactttgtgctcccttgtggtttaacaactgatatgtttttctctatgcaaacctatgtcctttaatggcagttatcttcacttttcgggttgctactttttagagaaagtcacattcaccaatggataagaatcattttaaaacaaagcaccaaggtttagatcgtagcacatccaccaccacaacaaaaagaaatagaaagtaaattaagccaccaacaatgatgaggcaaacagggctctgtgaatggtgaaaatcaatgaggtcaaaatggaccactttcttctcattgatttttctcttttgcttgtttcttggagctggattcaattactcagttactctatgtccttccttcctttcttctttccttctttccttccttccttccttcgtttatttcctttttcccttgtttatttctttcttaaatggtgctctgacacatattgcttaataataactcagttccaacaaaggacaataatgtccctgtgaaaatcaaatttgaatcaccagtactgacctcttcccaaactctaggcatatattgaactgccacactgatatcttcatttgcatttagatgcaatcatctaaaatgcatggtggtcaaaataaaatcctcacttctgacctttgaatatattcctctgcatggtttgccttggtaaatagctacctgttttcacgccaagagatctaggaaaactctctggttcctctttttctcttcactgcaacgttgttttaagcagcaaatcttgttagctctactttcaaaagacattctcagtccttccacttctgtttatttctactgcatctactttcatccaaggcaaaaccattttttttctataatcacttcttgactgatcatctatttttgactcttggtttcctccagatcaaatcttcacaggacaggggcattatatttttaaaacataaatcagatcagataagccttctacataaactctctctatttgaaattctcctatggcttatttattgtgatataaatccaaacttctcaccatggcttaaaaggccttattattctagtgtggcctttattacttctctgacttccagccactttcccttttctctgccatcacatccttccacactagactgattcctaaactttcttatcccttaaaactttatatctgctattctctatgcctgtaatttttttcccctagatcttttttttttttgtcatttgtaaatcggtgcaaattttatagtttattttttcacagcatttatcaatatctgaaattatgttattaaattatctaatttttgacgttttgccctaactagggtataaactcaatgacaacaaggactttttctggtttactcatcaccgtatattcaatgccacaagagtgtctagcacttagcaatcactcagtaatgaccacttgaataaatagccataaatttatcaataaaaaagtttgaagtaagtactgtcagtcatgccagatgttgtgggaggacataaaatgatcccagtagtctagttcatgttaagaatgatgcccagtcacctgatgcatgacaagatacaagtgatttattagggactttcaaaatgcctacctgaaagcagtcttatgaagttaaattgataagttcagtcattgctattgcctcagggatacatgatggtgggtgttaagccaatcttatattaaagaattttctaaaaaatccatgtcacagccacaaagagcctaaggaaacctgacaagtaaatgtaatgtagtattttggatggaatactggaacataggcaaaaagtaaggaaatctaaataaattatgaactttagttactagtaatgaatcaatgttggttccttacttctaaaaattgtaccatataggccaggcacagttgttcacacttgtaatcccagcactttgggaggctgaagtgggaggatcacttgagtccaggagttcaagaccggccttggcaacatagcaagaccccatctctacaaaaagaataataataataataattagctaggtgcagtggtgcatgcctgtaatccaggttactggagatgctgaggtgggaggatcacctgagtctgggaggtcaaggttgcagtgagctgtgatcctgccactgcgctccaacctggacaatggactgagatcctgtctccaaaaacaaacaaacaacaacaacaaaacaacaaaactaaaactaactacccaggataaaataaaaattgtatcatgtaaatataaacagttaataagggaaactgtggagcagggtgggaggatatatagagtctaatacagatctgaaaatatagtctgttaattaaataatatatattattcacacatttgttgagaaaagccttaagggaaagaaaaaatgttcccttataaatattgtggtagcacccttcctgagtcaattgcattctatattaaaccatcttttgctattttaactgaaggaaaaatttactagtgatcttgccgactaaattgcatatttcaaaatccttaatgttctaaaaaacttttattgatggcaactctctggaaatagtgaattaaaatgaaattcaaaattttattgaaagctagttgattaaatagaactgtttaaaagataacaaaaccacaaaaaaatctataattttagtattatgtttatttacatttaaaggaaaggtttaatttggtaaatattaggtttaataagaatgcaaggcaattgccttaaattttcctttctattgagttattttttgatacattagttaactttgtcaggctaatttaaattatctgccataatatgcatgtctatagtctgtgaggtttatcccttgactcatcattttatacactgagatcatcaaaaatatcttaccttagcgacccaatattagttccaggacttagtaatctactttaatttgcacattttcacacatcacatacgttcctcttttataatggagggcagccagaatttaattagatcgcagagttcacaccacaggatatactgtcctttaattagtagcatatattgtttcagatgcttacttggacacactgttaacactatgaatgaatcacaatacaatccccgaatgttaatggaaacatatgtatttattattttattgttttcatttataaaactacgtatgccttctaagtgattagggagatattaaaagaatgttacttaaattaaatatcttctagaactaatactaaagtagaaaattcaattatatggtgaatcatatgtttttcttatttccgtagaaagcagggcaaaattttctcaccctcttccttttaaactagattatttttctttgtcacagccaggcatcatgcttgatttacctttaatgctatataaaacatctgaaacctcaaacacataggaataatttgaatcttttcattctccctaagaaaaaattaacagacagctcatatgatttctatctcagtgtatgtcttatttttcatgatcaaattacttcttttcaagttattagattgtttatagaatcattcaaaagtttgtttttacttgtaaaaaaggctatcacaatttaacatttcattcattttataaaatgcaaaaaaaagaattttacaattgaagcccctgaacattcctgtaaccaaaataaaatgactataacagtaaatgggatccatttggtatgcaaaatatttgtagaaaagttcaaaagccattatttgcaattgtaaggtgcagaaattttttttataaaatatgtatctttgcatgtctcaacttggaattaattgtaaagcatgaaaacacaaataacttgagacaacattacataggaaaggctataaaatgtaatcaatattttggacattgtgtaaaatacttcccacactgtaattaatgattgattcatacatttcatttatttttggtcttctgctcataaattatttgaaagtagaccaattgaattattttctgtttttgtcagtgtgtatgtatgtgtgtgtgtgtgtgtgcatgtgtgtattagtctgttctcatgctgctaataaatacctacccaagagtgggtaatttataaagaaaaagaggttcaatggactcatagttccacatgactggggaggcctcacaatcatggcagaaggcgaaggaggagcaaggcgcctcttacacggcagcaggcagaagagcgtgttcaggggaactgccatttataaaaccgtcagatcttgtgagaccccccctcactatcacgagaacagcatgggagaacatgcccccatgattcagttatctcccaccaggtccctctcataacacatgggaattatgggagctacaattcaagatgagatttgtttgggtggggacacaaccaaaccatatcagtgtgtttgtgtgtgtgtgtgtgtgtgtgtgtgtgtgtgtgtgtatacgaaaaaaatccataacagaaatttttttcatgaacatcattgccaacctttcatatatgattactttttcttttctttgtttcatagagaagtcaaatttaagagttatcagctacattaatacttccttccagagtagtaggaaaaggtgaaggcatgagaagaaaaaatcctcatatgtttatttgtttcaaatgcttggatcatatttgaagacttaaattgctttagctttttgttttggtttgctttggctttctctaaaacagattcttcttctgaaaaaaatataaagaattagtacattctgcttgtttttaagcatttgctttttgaaagcataagaaagtaaatagcaaatgttttcctcagtgattctttttaaacctctatacttgtcagcttcccttttactagcatataccaatagtaaaagtgtcatctgtaagcagaagctcctcatcttaatacctaaacacgttaattctttattcatgagtatattctttaaggaagtctgaaacttggttcattcaaagctggaaagaaaaaaatcaagatgattgtctaattctaaaatatttgtcaacattttactatatttcaatgttttagaaatattttaatgttccactgttctcacaatgaagtgtaagcatgccattttccaagtaacagagatacaaattgaccacagctattaatttaggttaactgttaaatcaacttttacaaaacttttagttaggcaagtcattttattccttttgttttttttctgctgcactctgaggaaggtgtctgactttttattaaaggcacataatgactgagatgctggtgtcatctaaagaacattcagataatttgtaatagtaattagaagagactacaattattcttggttgaaatactttagggctaaagatttttctttagggtatgatgttttataagatatcaaaatttcattcttaagtatcacaacaatctatgatttttcaaatgaacatgattttaggtacccaatgatttttgaaagagttgtggttatatccattatgtattaactcttaataaaatatttctgtgttttcatagaatatatccccatataacctctctgtgtagtaatttttcatgaagaaaagttatgaaacaataaaaaaaaggattctgaacagatctaatatataactgtctttgtaatcctctctagtcttatcttgctatttcctttcaagaactttttctatgatgcttttttttctttagtccctagagaattattttctaactcattatttgagttttttagcccaatatcattatactattaaattttaagcaaattgttacagctgtaagcaaatttttacaactgtaagcaaattgtaagcaagtttattttccctgcaacttggtatacttataccatggctgacgttttttcagatgaaacattttgccaagcaggttatatgttgtggtaaaagaatggcacaacttacaatgagtaagaagaaagtgaaacaatcttgtgtctactggaacctgaaagaccttttccttgagagaatagaaaagaacagttccttgctgaagggaaacaaagaaaacagtataactgcttaaatagaaaccataagaagttcttttggtacaatatcatttgaattgtaattgttgctgactttagtattgttctgaactttaaattcatcaagagtgctattaaaaatattggtcatttatacccgttttaatgggtccatgaagcaatgatatgctataatgctttctgtctttaaatggcccattagagtacactgtaatcttatgttttcctcatgatctgagagctacgaaatgctttagccaaggatattttatgcatctgggtgttaaacactctacttgtagatattagttcccttcactgctaaaattttggaaaataatcatcccaccccaaatctaagtttattttattcttatttccaaaaaggcatcttctttggatgggtatgcacacatttgaaagtgtagatgaacgcaaagagattttataccactgcactgttcatgtcctgtatggcttgctgtttactgaactgtggcctcttcatttatattttggtgagtgtttcatctcataatgattgataaaatatttacaagtgacagggctgactcttccctgaaggcacaaagaaaaagagtattatgctagacattaaaatgtttaggtacctggatgtactttgaaggaaatgttccataagtggaagcgtttggtgttataatggacctcataaacaaatcactaggtaggagagatttacaaacatttttaaggacattgtcagcaagcggtgttgtctgggcctactaggaactcaggacacagaaagtagaagaatctttgctaaagaacaatgcctgttatgccacatattttcatagaggctatcctttaacaacttatttgctcagtgcattctcagttctgaaaaatgtatccttgctgttgcactagcatgcacatatttggaagtgtacataaacaaaaagtttgggaattactggcccaggacattcaaatcatcattagcctattttttcaaagaatgttaatcaaccatttagtggaatgtagtcaacagtaatgtattgccaagttaatgacaccaaaaatataagggaaatatttgggagccctagattttttttaacacaggagcaaccaaataaatgtataaaacataatttgtaattttctatgactagaaatgaattaagtttacttcttaataaaatggaaaacaattgaaattatttgaatatggtcaaaaagtggttactttttaggctactggcctaaaccctatgggaaagtgagctgcctaccttttttaaggacactttttgtagttgttctcattttcatgctgagttctttcccttgcatattattctaaagtattttctcctcctcttttttaaaaatagcaacatattttcaaatacaaaaagtgagtattttaaatcttgtccgtcctttttagatgattactctattctaattttacaaccacctgtccagacattggagcacatgcagatacctcattggcttactattcttttccttctaatggcaaggctgatatttgttaatacagctatttaaaataaaaccaccaacaacaaattcttcaaggaggccactgatgattctgtaaaaatgtatgtgtgtgtgtgtttgtgtgcatgtgcacgcacgtgctcacatgaatgagctcaagtgggttcctagacagatttcattaaatagaaagaaagagagaaacatacaatccgtttgctagtatactgatgtttgcagaaaacccttatcaaaatttaatgaccctaaaggtggttatcgattttcctttttcttcagacaatatttcatttgtgatattgacttgccacaaatgaatgtttgcttaagacagtgttacatgttatagagcaatactacataaaaggcttgcagctcttgtactctacaaggaacaaccaaggcactcgtagatagcaatggaatgtaaaaccaaagccaacctgtctttttcattcttttcatgtatatataggaatatataagaatttaattttttccttaggtttatgaggaatatcttgccaatgtgaatctggatttggaagaatgatacgttagtgtattagtttcccaggcctgccataacagagggccacaaactgggtggcttaaccaacagcaatttattgtctcagatttctgaaggctagaggtccaagatcaaggtattggcagggccttcctgcctctgaaggctctagggaatgatatattccaggcctctctcttaacatctcatagttactttggcatgtggcagcaattccaatcctcacaatctccttatgtggttgtctctctccaaatttacctttttaataaaaacactagtcatattagagcccacctgctaaagcttagagtggaagcttagctagttttagacactcttatgccacatcccgtgttctgcattccatgattgtggcttgagtccttttaattgcaacattggcctgattggctgccattttattatcgtgccttgaccattgttattccctgccctgctgtgctttcttgcataatgacaatgtcttccctgggccagattggaagaagaattgtcttgggccaaacataaaatacacgaacactaacaatagctgatgagctaaaaccaatgcaaaaaaaaaaaaaaatctcataatgttttaagaaagtttacgaatttttgttgggccacattcaaaattgtctttgtcaagaagaagacaaggatatcttctccttgatgaacatggtcttcccgatgagcatgaccattccagattctctcatttctagctctggtctatctcacttccctctgaattccaagctctaattctggtattagaattaacactccttttttgttctctaccaaaatggagataaattcgctaagggtacatgttcttttgacttaatggagccatgaacccttttttccatcagaaggctgacaggaggtaatagtattgccttgaaataaaagtctaatctgatcttgtcaaatctgtggcccaggacagctttgaatgtggcccaatacaaattcataaactttcttaaaacattctgagactttttttgtgatttttttttagctcatcaggtattgttagtgttagtgtattttatgtgtggtccatgacaattcttccaatgtggcctagggaaaccaaaagattggattcccctggtctaatccattatcatctagaagaaataacttttaaaatagacctgcttatgtataactatttctgattgattaaactatttactgtaactattactttctttaataatactactgctttcatttaactattacatgattcttttgaaatgatgtatttacagaagaagatagggttcatctgacatatgttaaaatcttgtcttaagcatgtggcaatatgtatccctggctaaaaattctttaaccattagctttcaggacttttaagtacctgctaaaaagctgtgcatatgtctgctttatttaataaagtggtctgcaaacttaggtatcaaactttaagttatctgcatttagttattcctactgctattggcaagagctatcaaaattacaatgtttttctcctgccagaaaagtactagagactttttgtttttgttgctaaatgaagacactttgacatagatttttttcctaatagtagatgctaatagagacaatatttttcacaacagcagtaacgacaacaagtttacttatttcattatttcattgaacatgcctattatctttgtgcaaatgttattagaattctgtggtggaagtaaatgtaaccttaatgtatttacctttcagttctttcacccttagtagctgtctgtatttctagtaatttttttaaaaatataatctataaatcataaactgacattgaaacagtgagacttgtctataggtcttaaagccagtgccacatgctcatgtgatgaatttagcttacatatttgcaataccatataggtagaattattagttactgtttcattacaattaatccaggaatgcacatagacatcttttcaataaattttccttttgacaataatgcagagaacatgtttatttaatgaaagcatgggttgttactcaaaaccactattcactttgtcttccattgttgactgttataattctggttagtaactcctgtctaacaggactaatgatttagttttgtaggaatgaaagtgaggaggaaattattctgatttttaaaatatagaaaagctaaaaaacatcaaacatgtgaaaacttccaagatggaaggagctctggctttaagtagtaggttcagtttataacaagtatacaaatttatattgtagtgcatattctagttgcacagtaagtcatctctaaacataataatagtaatatagggctaatcatttagtattactaaaagaatgactagattacaagagttataatatataagataatatgaatttccacaggcagcactgttttattcagcaggacttataggtataaaagaatatcaaggagaaagaggcagagattccaatgtggtggtaagagtgatgagacatgtattaattttgcctggaattaagctgagtaaataatttaagctgtagacatatactgtatatctgtgataggctagacattgcacaggttgctagggatatactggtgaacgaaagttagcatcatccctgctttcatgaaacataccaaccagtggaaaatagtgtttttcaaataccataaaaatgaactccagagtacaaactaaaaaagtgccctcaagaaaaaaaggcataaagcacgcaatacagactggtggactttaaacttggattccatactcactaaaagagtttggaaaattatgtacctcttcacccatgtttaacttgtcatctaaatttttcattgtaagtcgaaatttcttaatgggtccaatgtacattattcaggtgatggatgctgtaaattgcctagtcttaccactgtgcaatctatgcatgtaaaaaaattgcacttgtaccctataaatgtatatacaatttttagaaggagataaataactaaataaattttatagagttgtaaaggctgctgattctagcatgtggtaactcccgtctagtaaaaatgttatagcattctgaaaatcataattatttgatacccctttccaagattaaaaaataagcctgctcttttttaacatttgaaaaatgtatacctttcctttttactctttgagctgatatttgttccatgacattcaaagattttcatccaagtctatacataacacatttttataattatcataccacaaatatgtatgaacattttaaaatctgtcttctcacattcataagacattaagtacttaaacatattttctatgctaacttataaattcaattaatatttttatataattagttataacatattctaattatttattttttggtcttattactagctttttctaagatttttgatgtgttaaatacttttgtctttttgaaaggcttttcacccttggcttccttggcccttctctttgtttgcattctttctatcacttctttctaaagatcttatttggctcctgatccactactaaatttgatttggttcctacttacaaagctgatactctcaagatttcaaaactcttttggagttgtctgttataatcatggcattgactaagtcacatctttctcggttgatgcctgtttaaaatgtaatgttgagccatcagccccttgactcttgtctggccttttgacttgcttaaaccattaaaacgtggcagttgtggcattgcacatggtcctgagccttggcctgaagagacatagtggcttctgcttttgcttcttgggattccaccttgagtccgagttcaccatatgaggaagctagtctggaagatgcaaggccacatggaaaagatgacccagtccaagccccctgacctatgattgaggccattttatacttcccagttctgccaggctggataaagctacagagatgagtccaagtaaacaagggaaataacttcctagacacttcatagaattggaaaatctttgctgtgttaaactactaagtttaaagtggttgtgtagtaacagatgattgatatatacttacattagaaaacctccagatctctatctctttttaccacgttactactgaacaattccctgatgtcctagagatacttcaatgtcaacatcttcaaaacggaattccttatcgtttagcttctctttcctattccataaatcaatgcctatttcatctgcagtttctgccatgtttgagaatggcacatgtacatacccagttatgaaaacaagtggtaaataagttacccaggttgttttattctcccttactgtatcttctcgccaagtgtctatagtcagtgaccatacctcagtaacatatttgtaatcactattcttgcctccatttttgctttgacttggttgctgctttccccatatcttcctcatactttgcactgttcttctgatggcctgtcttcatgtatctagggaaccttataatccttcttttctattcctgcaaatttaacttttctaaaatgcaaactatatgtcataattttactcagttgattagaaaaccaattaagtttaacttaataactcaccattgtctacaaaattaagtgtaacctcttcatcaagacaaggaagactctctctgatgtatcccagactagctctctggcttcctccctctactgcttattatgttgcagccgtgctgaaattactaacatactaacaaaagctttctcctctgtatatactcaagctccccacttttccaagagtgctccctcccttcttcactgccttctaagattctcaagataattgacatttctgggttgttatcttttttaaatctccatcataccaaatatggatatccattgtaggagcaatagctatgtctgattttttatttatgtacatgcctatttccctctattgtagttaagattccctcagaagcagggctccctaaaggtaatgattcaaatacaagtaagtaattttgtaggtaagctaaggatactattgtagaggagtgggaaagtgagagagtgagaaagtcaacaaaatgtgtaaagccagatactactgtgggcaactagagtttagtcctgcaggaaaactctgaacaatagtagaatataagcctcaggattctctctactaggggatgaggaaactgtagtatttatttacccacttcagccaatagatgagggctacttctagatagaaccgtgtgtgcaagtgtgtgtgtgtgtgtgtgtgtgtgtgtgtaagtgtgtaattattcttctggcctctcaggaggcagacaaagagtaatcttttatggcttctgaattggccctcaggaaacgagatgcaaatggaagccagccccatacattcaaatggtatggtcacagagataagagcatggtattaatagaaagcagtacacctccttgtaatatgttatgaacttctttcaggcagagacagtgctgtatttttcattatatttccactgccaaacccagcgcctggccatacattggaaccataaacacagttgttgaatgaataagttataaaatgaaaaatcactgatatcatagtagcttaacactagcatttactgagtattttctataggcaaggcactgttctatgttctttattggcattaattcattgaactgaagtggagcaagaataaacgatttatttatgctagtggaaatctgagaaaaagacacatcaatgagccaatccacttgatcagtaataatttgtaaagcataaggataaaaaattcatctaatactctacatttctaggcaatttcaattatttacaatgaatactacagcatagcagttaagacagtaggcttcataccagactgtcttggtttagttgctagttccacagcttataagccatgtgaccttgggcaagttatctgagttctctgtgaaattagtatcataattgatatggtttggctgtgtccccacccacatctcatcttgaattgtacctcccataatcaccacatgtcatgggaaggagctggtgggaggtaatttaatcataagggtgggttttttcccatgctgttctcatgataatgaataagtctcatgagatctgatggttttacatagggcagtttcactgcccatgccttcttgcctgccgccatgtaggacgtaactttgttcctgctttgctttctgccataattgtgaggcctccccagccatatggaagtgtgagtgcattaaatatctttttatttataaattactcagtcttgagtatgcctttattagcagcgtgagaatgaaataacacagtaatagtttttatattttaggtttatgagggtcatttatattagtaaattcaaagaacatggaacaatgcctggtacatcatgagcactcaataaatatgattactatcagtctttcttagaggagaattaattcatttacaaagactcgaagattgtagaactgtatatccaataataagcaagaactgtgtttgaaatgtgtgtttcatttgtaaaatttctctgatagaattcattcattacttataatggactgcaattgattgtaaagtaggatatacaatgtttattctatgacactaaatacgtacgtcctcttggacatcttgaaattattcttgacccctccatttctctaacacccaacctgtcaggaaatcccttggttctaattctattgctacttgctgggaaaaagccaccaccatctcttcaattagtaaaatattcttctactcctgtctcctatagtctgtccttaacacagtgtgatcttttaaagtgtaagtcatatcatggaaaacctctgctcaaagcatttcaaagacttcctatctccttcagtgtaaaatattttaaaaattcaagctcatagaaataaagagtggaatggtgattgccagaggctggtggcagaagatggaggtgaacggggataaaaggagatgtcactcaaagggtaacatgtttcagttgggcaagaggcataaattgtcatgctatcttacacagcatggtgactacagttaataataatgtattgtaaatttcaaaattgctaaaagagtagattttaaatgttcccaacacagagaaatgataaatgtgtggtgacatgttaattagattgatttaatcattccacaatttatacatatatcacattacattatactccataaatacatataattattatttgacaaacaaaaattaaattaaaaaaagataaagaatgtgtaacccaaccaggcttatcctctgaaatctcttcctaccagtctctcagcaatacattagccagactggcctgtttgctattattccaacacatccctatactataggacctttgaatttttcctccagatatcccgagggctaattttctcacatctttgagatctttattcaaatgtcccttctcagtgaggcaattaccctatttaaaattataagctacaccctccccattctctttcaccttgccccactcttcatatattatggaagggtagggctctctgttttctttactgaagtttgtcagctttgcctggaaaagtacctgaaacacatcttctaagactcaacaaacatttaggaaacaaagtatatacgtgtgtgtgtgtgcgtgtgtgtgtgtgtgcgcatgtgggtgtgggtgcatgcataatctaaggtcttactgaagctcataactgaagtgaactttataatggaaagaaacttaggagagacttttgagaacatgttgaccttggtacctggcaatcctttgaactgcccacttgacacgatgctttcccagaatagcactgaagaataacaagattgagaaggtttcagtcaggcaagtggaacaattgggggcttactgaaaattataatatatacaaaggtagagtgaaagctgctaatgaaaccctgggtgagagcatccagtacacccactgtgctttgctccatttggattgaagagggatgttttgaacttaatgagatggtcctcatttcataggagaagggttgtagtggttttggagaggcagatttttttgtagacagaaagtgaaacatacatttgtcctattggtgcctttaaaatacactcttgctggtcattgtacatggcccatgctctgggtggggagggatttatggagtactctgtatggatgtgaggggcacaaccttagctgcaatatactgagtaaacaaagaaaggactcctgatacttcaatagggaattattttgcaatcaaactggctgagaagtttaggcggtcactgatatttatattttatattctaattgcagtataaagtaaataatttttataagtctgtaaagtttcattattttccaatcagtttttccattaacaattattcagagcatcatcacaacataacttttcctattacctacctactgggcctgaataaataagatattggaaagaactgagtttgagtgaaattcctgggtttacattatgattctgccagttaccaacagtacaacctgggagaaagaaagttttttatagactcaattgtctccatgagcaaaacaaggataatattaaccaaataagattattgtaaggatcaaatcaggacttatgtgaaaacttcaatatcttatggcagctcagtagctaattttctttcttaaaattgtaaatgctactttaaagaatagaataagggagattatctttattcttctctatgtcataactttttatatgttgtttctgtccaaatgtccaaatacagtgaatattgaagttattggttttcttacatcatttactaagttattgagactttactatgttttaggctctactctagatttggaatacacagctgcctttttaacgttctgattgtgcatattccctcattagtttttggttttttgtttttgtttttaaaaatttcatggagaggaaaaaaaatgaggttctgtcacgcatggtcttgaccagagggagtatgccacacaggtagaagatgattttgagatgtttcctgacaatcaggaagataactttaggttcctccagtgtccatttttaatctccagaacttggtaaggaaattaacagatggtaattaagacagacggtatcagcttctggataattttttctaaagggaaaaaaataaaattagatgatgcataagtttacatgaagaatgctaaaaagaatagagtatcaccttcgaagcagaataagttaaaaagcaaaataagttattctcaaaatgtatcattattctcaaataagacgtgatttgaccatgcctcccagagaatgaagtgccaatcttctagtagcaggatgtactattgacttcccggatttggtgataactttatgaaaggaaatctttgttcaccaagagtctatcaccaatccacatgtgctattgtttccaaacaaaaggcaatgttcattatgtgtgaaggtctagccagccctatagagtttgacaaaatgactttggcattccctcatggaactttgttatggataagaaaatggctaaaatatatgaaaaattgctatcctgtgaaagaagtaaagaataagtgtcacaaagaagcaatagttggtgcagaattgcagtttttgacatattaaaaatattaacctacctaatacaaaacccagtctgtgattctcccttctccacttagtcttctgatttccctgtgtgtccctcaggtttctatagcactgggaggcagaagcaccatttgttaatcacctgtcagctgcttctcttatgctctaaagtccctctcacaaggcacagcagaattgaacagccagaaatacagtagttccccctcatctgcatttcactatccaccgtttcacttacttgtggtcacccacaatccaaaatattaaatggaaaattccagaaacaaaccaatcctgagttttaaattgcactacattcagagtagcgcgatgaaatcctgagctgtcctgttccgtctagcctgagatgtgaatcatcctttttgtccagggtattcatgctgtctgtgctacctgccctagccacttagcagctgtcttggttatcagatcagctgtctctgtatcacagtgcttgtattcagatcactgttatttgacttaataatggtcccaaagtgcaagagtagtgatgctggctttgtaaagtgcttcaaatgaaaaggtgaaggttcttggctcataaggaggaaaaaacattcatatgtcaaggttgctaagatctactgtaagaatgactcttctatttatgagaccatgaagaagaaaaaataaattagtgccagttttgcagtcacatcttaaactgccccccagataaaaggcgactactgtatatggctgagacccactgctttaattaggcatgattgtgcataattatagtagacaaatacagtgcaaattaaagaatttttcctaataaaaagactgccttttgttgtgtagctatttataggaaacacctcagcaattaccttgctgttttcattattcatgataacatgtgctgttggttcttaaacttgagtaagaagagtgctgtcatttcctttcaaacagtttgttgagaagactggtttttgtttctggctcactagagtacagtatttaatatttaaatgcactgtaaatgggtactttctgtgcaccagttacaggtgatgacttataaaatgggagggattttcacatttacaaatgaatcacctgttttaataaaaccaggaaagcacagtttcccattcttatctctggttcatctttctgccgcaattgatttttattgcttagtaaatttgccctcttgaaagataataggttcagtctatactataatcaaggtcaattttccatttttagtaataggaaagtgaatgattgaattgtttagtcatgatttttggaatcttgaaagacaaagaaaaccaaaaattaattcagtttgaaattttaaaacaggctttggaatcatgattgttttaccttgtcttatatttcagaattactttcagttgtaacttcttcctgttattttataggtcagccccagggaagttaattaatttgatttgagacccaaaattagttagaataagaggataaacttgattcttattccgtaagtgtttctacgctaaacagtctttttcaattcaggctcaaataggaatgctatgataataacaacttaacactttctcttagtaattttattctgatatctgttttggtgaattacaccactgttaatgctaactatgaatgagagaggacctataatgtgaaatcacttaagaatttatagcttgagcggccaaaatttattccatggcctgcaattgatagaagaaacattttttttagaggctcaatgtccagactagttgggaagtagaaaattccaaaaaggtgccgattgcagcttaacataagcaatcattgatttcttcaaaagcaggagtattgaaaataaacagttttgccttattatttgtagttatgctattcgaagtcagtccatttaacttatttttttattgttcatgaaatactatctttttaaaaactctctttttattaggaaatagatttatttagctttcaacttaaggttttttatttttaaaatgttttataaatgaaatcatgctcacacttagttttccaaatgtactatcttctctgcaagagcagacagaacctttgagcatgcatgccttcccatcctcccagtcttcagtcatgaacatgttcatcctttcctcaaagaagccttccaagctcccttcgatcatttaaatttatattttactctcttatcacaccaagaatttccatagtaaaagttttccttttacaagtacaatatttgtgttattatttgattaacatcagtctttgtcacaaaaatggaattcactaaggataggaaatgttgatttttaccaactgttttatccttaacattttaggataaatcaaggaggattcaaaagaggcactgaatgaatatcggatgaatgaatgaattatttaaaatgccactgaaaacagaaacatttataggaaaaacaatgctttctccaaattgtttgtctttagcagggttaaaaatccactgaattatattgatatgaacaaagcaaaatatacttcactttttatttttaataaatatttttatattctttaagaatctctcccctcactgatctgtcccttgacagagagaggtgagtggctcaatttaattttttcttgtaaattcatcccaattcaataatgtaaacaattgtaactatctgagtctctgtagattttagctcttccccatatcctctttaagttgatgtccaagtgtttaagtcaatatgattttgaaagagaatatatgaaaatttgtgaagaaattgttaataaaacaactacttctaaaagtgatttcaatacagattatactccaaactcctaaagggtgaattccaagtcttgtttttttcacttttttccttttattcaacacaataactagcacatagtagttgctcaataaaatttggttaaatgaatgaattagaaatacattatattaattaaattaaggggaaacatgaacatttaaaagtttctgctgaaaattatgtgtctaaccattattcacaatgtcttttcagtgcatgactttgcttcagtttaaaaaatagatctgaaaatctgatagcttcagtagatatgaggcctagcaaacatgccagatgaataaaagaaaacccaggtagtgtgatcaaattgcaaatctgattgtgttatataagaaaaggggctttttgatcaaatagactgtaaggatagaagtagaaatagagataaagatgttggaatccaaaacagtctttcagtctgatatcagaaaaagtaaagcagtaaagtgaggttctgttttctcttttaagatacagtaagatctgctgagagaggaaagcccaaaatttagttggagaagtgggattaagtatgaataattaatagccaaaccagtaaaagaggaatatccattagacctgagcagaaacatgcgggctggactcattgtagccaacaggaagatacccaaccaggctggaagggcaagatacctggcaatcctgaggacaggtgtttggtgacagtccaggttgccttttcagtgcagataaacagatggtctctgctctcaataggcaaagagcagtggttctcaagctttagtgtgcaacacccagaaagctcattttaaatgcagattcataggactcctccttagaggttctaattccttaggtttaggttatgcctcagaatctatgtttttatctagcacccatggaaattctgatgccctattactttttcaaaaacactgaagtacgaagaaacattagtcttttttcaagtaaattgaacttttgcttatgaatgattacctaaaatgtacataatgacataaatagaactcttgaattatagatattttaggtccttctacacttaggacacatttaagatacataggttaagatatttacctgaatttcaattttgaacgatttttctatagcaaacaaaaaagcagtttatccctcatttaaactttgaacaatctaagaagtctaagttttctttttgtcagaaactcattatggtcagtttaacataagctttctgaacataacaaggaagaccttgctagcgcaatggcctatggatgcatagttccatggggaatttcttgaatggaattcaattttccttagactggaactacttgccacactaaaatcctgcattagaggctaggaaattttctttctgtttctgcatctctgaaatatttcactagaaagcctagattaagcacaattttgtcttttgtattctccgtcattatgtagtggacttttggtaaacattctgaagaaaggcatgcatttgacatacagcgacatctaatttcacttatgataattttgacttcttacagattgttgttaaagctggagatcatcttaaagtaatttaatcaaatcttactttacaatggaaacaatttaggtagagagacatgcctaacataattctgtctaaatcaggactcctgatttatacatataaggttttattttgcatttaactgttctatctccaaaattatagtatttattcttatattatttaataggtttacttttttcataatttggaaaacatcagtctttcgggtctattttatggtaatgtactatttgtcggagtgtcaaaatgacttaattgctaactgtgctcagcaaagtgtttagaagagaattctcgagtgttgtcaacgtcaacgtgcaatacatttgttcacacgagcaaaatgttggtgacaagttttgaaaatgttggatcttttaaatttaaatttctaaagaagttttaaatttttaagcttaaagaaaaatattacatagaacaatattgtattatttaagaatacagtagtttatatttacatatattaacagatgaataacaactataaacctcataggcagtgttatcaattagtgatgtctttggctctgagtaataaacaaacaaaatatgaccctagagttgtttgaataaatacagattttatttcattctagtacaggaaatctgggaatagcaatctagagttaattgagggccttactgaaatcagcaaggtgccggactttttcttaagccttcagtgtagtattgagcatctttggggaactgctggaaaggcatgattatgttttgaaatatgagaaggacatggaatttgggaggggccaagggcagaataatatgatttggctctgtgttcccacccaaatcacatgacgaattgtaatcccctagtgttgaaggtggggcctggtgggaggtgattggatcatgaaggcagatttcccccttattgttctagtgatagtgaatggaaatgcaaaaggccatcggacctgtggggcaaggggcttggggccctaaatagcttggggctaccctttaccaagagggagtaccttatttctaattccacaggtgtcaaatgggttagcagtggtcctctttttctgtcttcttgtttcaccagcatagtaggtggctcttgccattattgtaattagatatggctgttgcacatctaagcctgtgcacatgggtcctaggcaggaagaagaaagaagagttacaaaggcttttttcccaaagaagctttacttggaaaatgaagccatttgacagaaactattgccaatatcttactgttcataagtatgccatgtgtcatctatagatgaaagggagcaaggggtaggcagaagtatttttagctagtacattatgatgctgagaaaacaatcaagagaaggaagggagaatgggtaacagataggcagctagaagaagctgccaagggaataattagatgaagaaggagaccaaatcaacataagctttgggccaaggttaatagcactgcagattttcagcacaaagatcaaatctcagcagcaagattctggtaaaataaaagtctctcctttcatccattgctccttccaatacggcacaaagcttcccagactcagaatttggctgcctgccatatgactaatatgtgaaccaattcacttatcttcacttttatactatttcagttccagtatcaatatgacttcagccttctccatcttcacaacagacaaagaaaaaagagtttggaaagtataattaaatatttataacttacactggtattttctcagaacaaaagattagttttagtttgagaaatgaaaatatttcttcattgattagaactttatgaatcaaattagaaatgaacgtccatcttcaaaattcctagagttttctttgaaagagtagctttgtttttttttttaagttgttaaatttgcttttctgagttttgaattctctaattgctagactgagaatatgtcataaatatgtacatttgtgacattttaataaaatcctgctcagtaaagttacaaaacctagattgattaaattagcacatgtagatcaaaataaaaatgagctcttctttttataaccactgcattattctgttctcacattgctataaagaactacccgagactgggtaatttatgatgaaagaggtttaattgactcacagttctgcaggctgtacagaaagcatgactgggaggcctcaggaaacttacaatcatggcagaaggtgaaggggaagtgagcatgtcttcaggccagagcaggagaaagagagtaaaaggggaagtgctacacaactttatacaaccagatcttgtgagaactcattcactatcactagaacagtaagggggaaatctgccttcatgatccaatcacctcccaccaggccctaccttcaacactgggggataacaattcatcatgtgatttgcgtgggaacacagaaccaaatcatattattctgcccttggcccctcccaaattccatgtccttctcttatttcaaaacacaatcatgcctttccagcagttccccagagtcctaactcattccatcattaagtcaaaagtccatatccaaagtctcatctgacatacagcaagtcccttctgcctatgagcctgtaaaacaaaaaacaagctagttacttccaagatacaatgggggtactggcattggttaaatgctcccattccaaaataaaggaattggccaaaaccaagggtctgcaggccccacccaagtccaaaacccagcagtgcctccattaaatcttaaagcttcaaactaacttcctctgactctatgtctcacatccaggccactctgacacaaaggatggactaccaaggccttgggcagctctgcctctgtggctctggaaggcacagcccatgcagctattttcatggactggcatagagtgcctgcaacagttccaggcacatggtacaagctgttggtggatctatcgttctggggtctagaatatggtggccctcttctcacagcttcactaatcagtgccccagtgggaactctatgtgggggctcgaaccccacatttcccctctgcacttccctagtagagtttctccgtgagggctctacccctgtagcaaacttctgcctggacatccaggtgtttccataatcctctgaaatgtaggtggaggctcccactcctcaactcttgtcttctgtgcacccacaggcccaataccacggggaagccaccaaggcttggggcttacaccctttcaagcaatggttggagctgcaccttggtcccttttagccatggctggagctggagagtctgggatgccaggcaccatgtctcaaggcagcacagagcagcagggccctaagcctggcccatgaaaccatttttccctcctaggcctccaggcctgtgatgggaggggctgccatgaaggtctctgaaatgccctgggggcattttccccattgtcttggcttttaacatttgactcctcttttcttatgcaaatttctgtagttgacttgaatttctcctgagaaaatagctttttattttctatcacatggccaggctgcaaattttccaagcttttatgctctacttcccctttaaatataagttccaaattcaggtcatttctttgtttctgcaaatgagcataggcttttagaagcagccaggccaaatcttacatgcttttgctcctttgagatttgttccagcagataccctaaatcatttctctcaatctcaaagttccacagatctctagagtgaggcacaatgccaccagtctctttgctaaagcataacaagaatgacctttactccagttcccaataagttcctcatctccatctgagaccacctcagcctggacttcattatccatgtaactatcagaattttggtcacaaccattcaacaggtctctagaatgcttcaatcttctcaatttcctgccttcttctgagccttaaaaactgtcctaacttctgcccattacccagttccaaagctgcttccacatttttaggtatctttatagcaagacccaactcctgatttcaattttctgtattagtccattttcacactgctataaagaactaccttagactgggtaatttatgaagaaaagaggtttaattgactcacagttacacaggctgtacaggaaagctgtctgagaggcctcaggaaacttacaatcatggccaaaggtaaaggggaagtaagcacatcctcacatcagagcaggaaagaaagtgtaggaggaagtagtacacatttttaaacaaccagaccttgtgaaaactcactcactatcacaagaacagcaaaggagaagtctgcccccatgatccaatcacttcctaccaggcctcaccttcaacattgcagattacaattcaacaggagagttgagtggggacagacagccaaaccatatcaaccacagaaatattttccgaaccacttggattttagatttcagtaaaacttacctgaattatttgtactcattaattaacagtgaaagtttagttaaattatgtgataaagggaccctataaaataaaataaaacacttttggcacctgggaatgtagacacaatgcatatttattttattttgtatgttattattaaagagttgatatggtttggctgtgtcctcacccaaatatcaccttgaattgtaatgatccccacatgtcaaggatgggaccacgtagagatagttgaatcatggtagcagtttcccccctactgttctcatggtagtgaataggtctcatgagatctgagggatttataagtgggagttcccctgcaaaagctctcttgcctgccgccatgtaagatgtgactttgctcctcatttgccttctgacgtgattgtgaggcctcctcagccatgtggagatgtcagtcaattaaacctctttcctttataaattacccagtctcagttttatctttattagcagaatgagaacagattaatactcttgtattagtataatatcacatagaactctaatttatcttccacacaaaaagagtagttaaaatatctgtgaaaaataatacactgaaatgtaaagggaaaaatattttgaacatattgatcttatatccagcaatgctgctaagcaattttttaaaaatcatcttttctacaaataatgacaactctaatttctgatgctgtgtgttaattttcttttacaatttactaagtagaattcacaataaaatgttaaacagaaataacacaggtacatttttcccatttctgagttcaagggaaatgctgttaaaatattatcattaagtatgagtttcccatattatttagttttatgggtgtgttagtcatgttgggatcccatgactgggtggctttaaacagcatgtatttgtcacagttttggagaacgaaaactccaagatcaaggtgctagcagatcaaggtgccaccagtgtctggtgaggaccctcttcctggttgacagatggctatgttcttgttgtgtcttcacatggcagtgtctaagtcatctctcttgtgtctcttctcattagggcactaatcccatttatgaggactctaccctcatgatctaattacctgccatgaacctcaactttaaatatttcttatgtaaaattgttagtgattcttttgtatttttttactccttgctagagttataatcatgtcctccttttaattcccaatgttatttatatttggcttctctcttttgttgttaaatttttttcccagatatttgctacttttattagtcattttgctttattgctcctcctttatttttcctttcattaacttttgctcttaagagtatgagttttcctctgctgtattctttgggtttattcttctgttttattctaacttcttattttgagtttctacttcattaattttttgcctttacttttttctaatgtaattcttcaagtgtattttacttccctctaagtactgcttttactccacgtacaggttgataagcagtaatttcattatccagagctaagaattttataattgcagaaatgttatttattcagaaatacatttaattttttctcttacttatcttttatggttattgatgcttaggaggtagtagaaaaatgggatggaaattacagagatagattaatattgaaaggaaaaaattgagactaatactcacttagctgatacttcaagtcatggtgcttcaagtcaccgatcactgtggcaaatgtggagtgagaagagagccaagaatgtctcttacagagtcttaggaaattttctatttgtctctttctattttttttccaactaacagtaatttctcttattacccctcaaaaacattaagataaccctttagctgagctaagtgagggcttgtcttccccttgcggaagcaacatccaaatgctgtaaaggctaacttatctggaaatagaaataaaaactcttcattatcttttcagttttccaatttaaaatatccctgttgcaaaacaatcaaggagaccaattgccctggagaagtagtggctcagcttttaggtactttactttctataacaagtatccttcccaatcagtgcaggtttcacttccaaattacagtagtctccccttatctgaggttttgcttttcacggtttaagttatctgtggtcagttgcagtctgaaaatattaaatgtaaagttccacaaataaatatttaataagttttaaattgcatgcagttttgggaagcatgataaattcttgtgctgtctggctttgttcagcctgggacatgaatcatccctttgtccagcttattcataacttataggctaacctgctgttattatacaggaaaaaccatagtgtgtgtagcgttcagtattatccttggtttcagacatccactgggggtcttgaaatgtatccttcaagataagggggaactactgtacatgattcatagaatgttggaaatggaaagtatcttagaaggtatccagtctaacttccttattttatatttaggacaatggcatacagaggagttgaataactcaattttttattgctatttctttaatatccttgtcagatatattttcctcatgtgttacatcccactatggacactttagttttctttaatttttcattttattacttaacatgcaaatctgaccgtcccattgtaattctagacccactcttgctcatgtaagaaacccctaaggtatctgcaagggcttaaaagatctggctccacatcatcttttagcctcatcttgtttcaagcttctactggcttgctgctctgccacagtgacgttttccttcctgacgcttgcctgcttcaagacatttgaccttaccctctttacctttctagttaattcctatttatttttcagatctagaaacttttgaataaaatcttccttaacctccctgactctgtcaagggctttttacaaatttgcataaaataataaacatagaatctccataagatgtgttttgagcgttgattttgcacatttaaaaagatgtcaattgataaatacagtgccccacccactaggcttgtaagctccatcaacacaggataacatatctttatcacaagctgcatgtaacacaacatctgacacaagatatttgttcactaaagagtactgctaggctacacttgaaactaagtaggccaactacaagacctgtatctctcaatagagactctttgcaatatatgaatacttctaaaacaaagctgttttcatcaccatcaaaattaggctgatacatatacatatcacaatgaacttcagcaatttgatgtcaatataaatgaatgataataagacattagattctcattagcttattgaaaacttcctaatttctaaaaatgtactatattggtttatttgacatgcttttcttgtgttgaaatcatttcgaatgctcattaaaaactaatttcaaattataattaatcttattttcagattcaatgttgttattttagaaataatataattatttatagcataattgaaaaattcttaaaacaaaatcatgttttctttggtaatcaaaatataattttcttcttttaatctggaaagcattgcttacattgataatattatccctctcattgtcaacattactggagtgcttacaaaccctgtgggaaaatagatcaaagtggagaaattttagatataaataataaattaacttaagtcccttaggactaggataaatataataataaatacactggaataatggaaaattgtcattaccatctaacaatgctataattatctaggtaccagagtttctagttctttttattttttatatacaatagatacatataataaattccataactttcagataaaaaaaaagggccatttaacttacctcagttgtaaggatttattacagcgctacaaaaggaggtaggaaataaaaggtaagaatattaacagttgtaacatccatcaagatcattagtagctctaataggcaaactacaggtctgtggaacgtaaggagctttgtatactgctaattcagtttatagtaacatcacctttctttctgctgctaaatatccaagtgaaatctgaacctactttttatataaaaaggccttgtcattttccctgtaaagttttaaatagctttatttcttcagggagacattctgccccattaaaaatggccacataagtaacattatttctattatgtataaaagtttattaaattcactgtctcacatgcaacttcagtttcaaaattacttgagatgaacaaacttaactctcatgggagaatgtttctccttgttcttgtgttagatttttatgcttatgagcatctaaacatccattcttgtcacaaaggcaatcttcgcgaaacatctgcagaaacatttggaatgctattgttatgagaggaattgtccaagtgtgcatgtttttataacataccattatggttggattgatagtcctgaaaaaaaagaattctgaatacagtataatgcaccatcttaatcatctaccactgtgtatcagacaaaatgacttgtttatcatagaattcttcaaaactgaaatgtaagttgcttctagatttgcaagtgttatgtcacctgaaacattattcatttgcagtcaacttatttgctgagaaaagcattgtaaactctggcaaggactctagctatctgtaaaacactcttacatttgtacttttaaggcaagaatcatgttgcccatcatattcatttgctatcccttcctctctccattatatagggctaaaacataatgacagattttcattttatgatttatctgcatattgggttgcacctcctacttctgtggaccatggctttcagatatggaagcagaataaagtagaacacctcttctggctgtaatatacaatcacaaatcaataatattaatagtgggaccatgtaaacaatacataaatataactgttttcataattaaaaaatacagtctgtatttgtataatcctgttaaatgtatttatagtttttaaaaaactgattaaagttagtactaagtaggagctgaaatctgataacatgaggtagaaggacatacaaatagcaaaagagcaagacaattacttttttggattgacttatgtctgagtgacataagtcagtgtaattcttacattcaaaacagattaacagtctctcagtttttcaaataattttttcttacaatagaagcaaaagttactgagaagttattaatgtgttttggaaaatggacatcatctatgtattttaccaaaaagcagctaaagagttaaattgaacaatttaaacactttaaaaagttatactaaaaaattcagtgttatttcaaaacatacaaatgtttacataaatggtgtaatgtattgttattccatgagattcttgagatcctaattatgtgataatagcgacaaaatcacaagttttctttgttatacagccaatctgttttacctctctacttatttcttatctaaccaaaactctcttgctcatgccttcttcaaaaccagtgttttattcagcatcatgcacttctctcaacctcgtatgcttcttgaggtatgtgtgtctggatctcattttatatccctaacattttacctaggtgttccctaattcattaaaaagttcattaaaatattcagtaaatatctactctgtatttactatgtgtcaatgtttgacacaatttgcagcgacaggtgaaaagacatgagaaaagcagttgctaccattgtaataaggtagagaaaagaaaacacacactcacacacacacattcactcacacacacagacacacccacacaccctagaaaatctataaaacatggtggtagagaacactttttcctgatcagagaaatctaaatatgtatgcatcacttagcacattttgcaaagggctgtatttgtgcattgttttccacatttaagtgagtaagtgtcatcacctatgatgtcttttctcatgggtgtggacgtctagttgagtgggacagtttccctttccaattgtatgtctatctgtgttggccattctatattaaagccatatctgctatgtgcttcctaaatctgtaaagctcacttggtgaggaagatacatttattcaggtcagtaaaaactaacatgggctgggatttaagaatgaaaaaaaaaaatcttcagtgtttgtgtgttgaattctgcctgaaggttttcttactgaaatgaaataaagcttttaaatgttttttttaattaaaagactactgttattctgagtaaaattaatatctattctttgtaatattgcagaaatgagaataggcatttctgagtggggatttttcagcctggagcctggattctccaggctctttatagattgttcgtgttgtcagccaatggtaaaccagcatctcaagtaagggaggaaaaggttagctaaagctggaaaggagccacagcatgaaactgagggcaaaatgtattttctgtttcctaccccaatccccagtgaacttgcccacgctatcacagactaagcaggatggagaaaggcatacctcctaccctgtccccacatccagacctactttctaactccctaaagcttacctgttccaggaagagaaaacagcgggaagggtggctgtgaaggaaaggagagaggaccagaaagactgagcagggttttactgagctttttctcaatgacatgaattaagtacttcactcattttacttattttattaggagaaataaggcaatgttggagaaagagactgtttttctcacggggagtgcagaggaaattctttcccttttctggacatagaaggggtattataataatatccagaacatgaataaggagagaaaacagagacttctttcagtggagctgataccatgttttataggaaaagtcagggaaatatttcaggtgaagaagatacagcattggggcagtcagatcagtgtgttattgtggaaaatggtggccatttctttagcagcatcatgaaaagacaaatcatgttgactaggattttttttagagttagagacaaaaaaaattgtttatgtgtgctcatcactgtcagtgtggaagagtaatttgagttttgtatacatttacgttttaacaacatgccttacataaagaatcacaaaaccatttttggccataatttactcttcatttgctgcactttatttttctgcttctcttatcatagctttgatcatgaattgtaaagggcaaattcagcaaagccttacttttatataactgctgagaagaaaggaggagggtatatgtacatagtaagaggaaaagttatttaaaattcaattgtaatgatatctgtgtctatgcacattcattaactgttgttgataagagaatctccatctcatcaagctacatttccatacatactgcccagcatagttatatatctgtgttgtttctatgcaccttgcatacataattacatttactctactttgattcagagtatatttgaaaattagaatccatttttaattattgtcagaattttatgagcttcaagtatttaatattctataaagctataaatcctacagaactggtcaataaagtcccttgtctttaagacttaattattaattcacaagaaggtataagcctagtatttgctacgctatgcctttcccttaatacattgctatacttggaggaataatgcatgcaaaacacatctttgataaaatgttccttctatacagtgaagatttcaaacttccactttaggaaatgtagaaaaactaacttttcagaacaaaatacataaagggctcaatgcctaaaatgattgaaattgtcatatatacaaaaataaaacagtctttcagtagtaattggataataaatatgtattgatatttattctaattagagtttattctaatagacttaagaactctctttaattatattttaacaaaaacattacttttatctgattaaaattatctgcctataaaattatagaaacataatgttaaactttactgacctccacatttatgccctcagggaaaataactgttaatttgttaatggttaggtaatatggtactttgtgttgatttgattatgaagtgatatgtataaatacatccccttataatatgtgaatgcatctttttgttaaagatgtaaataaatacaaatgcatatagaataaactaaaatggagtcagtattagacctttttcatataaatgcttacatatttacattgatgacagctcctcaaaagatataacagatgttagtttatccaacagctgctaactatgctaaagtctgcacattttcagaaagagtcaagtttagattactgatgctattgtaatgatttcagaaagggaagttagtctagagaaatttagagacatttaatgagtttatttgaactgaatgcaggttagaatgataatgcttacttataacgcatgaacatccaccataattttctaatataccatatacattagaaccaagtattacacaagagaaccatatttttctgcgttgtggtcaagtcttgcctcatcatcttctgatacaatggctgtatcagtggaataaatcctgttcagttaatctaaattggaatacagattagaacatctggcattttaagaagtgagtctgaatgtgtcacctggttctttccatattgatattccatgcattaggcatcttataaactttggactgcagcttctttacgtaacccttaatgactgtgacctgtttgtctgctgagtctttgaactcatcctgttcctagttcctcttttggagtatttctgggcctgattctggaatctgagctctagccaagtgaacatggataaaacattctctcctgttccccaaggctttttcctctcaactgtagctataacacagaccctttcaagaactagggatattctgtagacactctctgggtgaaactaacatttttatatttattaatatatcagggtttaataataaaagaatttgaattagtcatagtgggacaatcaggacactttaaagatcttatcacgtttaagttttgttactgttacaattttaaattacataaggagagaggtatgtgtggcagtggaagtgggggaaaacagtattttcagtgttttggccccagccttgtaagttcctgactatagctaatgcctttgtccttctcttcttataaaatcccttgagaatagccctgatcagattcaggattacttatccctcttgtatgtgaacactgactctttaggtagataatcgtataatcctgatgagctttttaaatccccctagattgtttgtgcactttctttctctctggcctagacattccaaacagccttgtagccatggctctcctgtcattacattatgacagttattataaaagctgagaatataaaagtggttattaattataaacctgtaaatatatagatgaatcctctgtaggaggcatcatgagaagaatatagcaacataccgtgtaaatcattctatttcagattcttaaggcacatcacaaaagtccaaagaattgtcccttggggcgtgacttctggagttaaggaaacaactctgtaattcttgaagaatcaaagatcaagtgccatcatctaatatttattaggtgagggcaatgaaaaatgaaaataatttaatacatgggttacacaaacaagttgacctgcaaacattataatgcatagatacaacttagaagaaagcacagatttttaaatctcttaaaataagataaacaatatagttaacatactaaagtgcacttaaaatgaaaatttccaagtgacaacatttttcaggtaggaattagaaaacaaattatgcacattaagtaatttacttcacatagatgtggaactcacttatatggcatttcagtatcatgtgggttaaaatttaatagcatatttcccaaaataaagactagaaaactggaatccataaaatttcctggtgatgcccacatgctgatgtagttttctctttaaatatatatatttaaaagcacagaattttttgttttaacaccacgtagcagtctcttgaaatacaggcagtttggccaaagatactgcattcatttgaagaccactgttcctttaccattcaatttctcttctgccttccctatcatatcaagtaatgagttttaaaactatctttttattcttctgacttttggtccaaaatcattgatttacttgatgcttatgaatagtctagcatatagaattgtgcctcaatgctgaaggaattttggtataggaaactccacattacatcaagtaagtatatctttgctttaagaagccttgatgtcctgggaagggaaaactgaaatgaaagataagacaattaagaatggagtctaagtgaattcttagcacttgccatactgccagacactaaatgattgtgtaataaatattatattaaaataatgaatacattaataaagttgaaagattcctatatagttcctctttttatttttgatcacttatgaatctttgtttttgaatcactttttaagtgaaagaaaaaaaaccctatagttactttatccgagttaatatgggggggtagggctgacttaaggctgttggatttagaaataaatagagctctcagtttttgacatctcttcatacttgtagctttgcttttcgctgtgtttgacttcagtctctgcttttgaatggtaacaagatggcagcatcagttgcaacattctacatcctctcagatttcagtaccacttttttctttaccaaaatcttcctcagaataatactcatgatgtacttttggttctggtagggaagatacagctctccccctcttctctgtaggggatacattccaagacccccagtagatgcctgaaagcatagatagtactgaaccctatgtatactattttttttttctttacatgaatacctacgacaaagattaatttaggccaggtgccatggcttatgcctgtaatcccagcactttgggaggctgaagcaggcagatcacgaggtcaggagttcaagaccagcctgatcaacatggtgaaaccccatctctactaaaaatacaaaaattagccaggagtggtggcacgcacctgtaatcccagcaattcagtaggctgaggcaggagaatcgcttgaacccgggaggcagaggttgcagtgagccatgatcacaccactgtactccagcctgggctacagagagagactgtctcaaaaaaaacaaaaaaagattaatttataagtttgccacagtaagagattaacaaccgtatctaataataaaataggataattataacatatattgtattaaaagttatgtgaatgtggtctaattctctcaaaatttcttattgtactacattgtgagtaactgaaacagtagaaagtgaaactacagataaggaagaattactgtctacaccaacaaatcaatcactgtcctgaattaaatatgtgatttccatcaaatgcatttagtagaatgtaaagaagaatttttttccccagagggaaatttggatataattccatgaagaatgaatagaggctagttgacaaaaacatttgctgtagcctttgagaagaatatgtatgactattttgatttatgggcttttttgttaagtaattaagtcttaatagtgtcaggaaattgtgttttcatatgaaaagaagaattgcatattaaatgtctttaatttggtatgtggtgaagttatacatgctatcttctatcatactttgataatatattatagataattacagcttataaatctaatttaatgaagattgtgtggtgtatacatctgtttaattgttagtttggacttctttttgtgattttgattttaggttatctttccattgcctgcacaggaatttctatatcaattcacagtgggcaccacaatatgaaattgtgggaacttcgttaaaatagagccagtgtttctaaatttctttaagtatctctgcctggctttaatattgcatgattaatataaaaaatcatttagcttttgtgagttagtcaggatctattggcctagtttcaaaagttggtctcctgagcataatggacataactgaaactcctgttaagtttttccattttaatgaaaatattaaatgacttgtggagtagcatggcaaatttgctgcccagatctcagaggggcaggctatgatttcattcagctgccttctgctgttttattctcaacatttagaaactttattaaaatgatttcagtcctttgactttgttttcagatcattgctttctaaggtgacttaggtttttattttattttcataattttctctttataattgaaagctacaaaagggcaccatagagaatggaaaataaaaatgcactgattaattctgtggttttgcttttctgaactgtggattgagtaaagcagtgtaatagggtgatatgcttggaactacaaaaagctttggttttagaaaaaagttctaattattagtttcagaatataactaactacaattaacattaaaagtagctttaatggttttctgatagagaaaaaaattgaatacaattgaaaatgcactttaacatttagcatgtgcatttagaataaaatgatagttttttggttgtttgttttgttttgttttttgtttttgagacagggtctcactctgtcatccaggctggagtgcagttgtgccatgtcggctcactgcctccaggttcaagctattctcccaccttagcctcccgaatagctggggctccagacatgcactaccacccctggctaatttttgtattttttggtggaaacagggtttcaccatgttggccagtctggtctcttgacctcaagtgatccgcctgcctcggtcttccgaagtgctgggattataggcatgaaccaccgcacttggcctagaataaaaatgatagttatttagtgcatttcttttacttggaaaatataaagacttttaccaggacttttggcattatgtattttacaaaattattgttaatattttcatgcatctacattaattgctgttatatataaagtaggaaagggcacagagtaagaggaaaggatgcaattaaatctaatcagagggtaaaagtttaaattctgtatttctgtcacctgttttgctgcataaaagtgaataggctaaaaatctaaaaaaataggaaacttcactacactaagcatttgaaatatattgacatttgtaatttttactacagtctataagattgttaaaattatcatacccatttctagatgaagaaggccaaaacccagagaggtttactaagttcacagtgtcccacagttaaatgagtaatagagctagaattcaaacccagatagcctgatctaaagctagacatattagccattactttatatctttaatatggacatagtaaccattactttataaccttagactttttacttagtctttggatactttggtttgtatgtaaagactaagtgctaataccttggaaagtcacaaaaatataaggattggcctactctttttaccaaagtgttaaacatgttgaaatttctcagcatattccatgtgtataataaattaggtactaatttttgtttcttttatttctggcatatcatgttctgtgtattttttcccataaaaacaaagtaaaacaaaagatagggttttcagtgtctcattttgtgttagtaactcagttctatcattgccaacatctaacaagaaattcctgactccaggaacagttttacacatacaacaataaaagtgattccatatgtccttctaaaatgtttcaattacatataggttgtatgcctattgtcaggcataggaatgtatacattccctggtcactttccccactgataaatgcagctttcttttcatttgttttatttggtttctttacagaattatgtgattcatcattttccttgagaacattcatgttaagtcattcaagctttgtgattaattcactcctttaagcaaaaaatttaaagtttattatatttttatatgtaagcaaataaatgacattcccgtactaggaatataaaaaattcagtgaagatactgatttttgaagtggttgaaatctgtgttatataatacattataaatacatgttacaaatttataataaaatatttactgttgcctacatggtagtaacaaggatcccaaataataaagattaacagtttttcctttttgcccaatttcttctgaaatttttcttatcctctattttagaatctggaagaacacttggtacatagtatgtgattaataaaaaattttaaaaatacttaaattttatttaattgtatgatgcaaaaatctttcctcattaacctgaaatgaaattccacattatatgcttgacagctttttctgctttagctacatgttttccctttgctcagaattttaacacaaattgatttgtacatcagaaaatcctttgagcaaaacagtgaaaataaacacactagacaatgacttaccatttaaaaaaatacattttctagagataaaagtaaatctttcttgcactaatctctatgctattatttccaaagtgtgaattcactaagttggattataccagaaatgattgtgggtgctctgaatttaaggaacgtttatttacagaaggagaattaaatttcctttaacagtacctactgtttcttgagatagaatttttaatcaaattttagcgtggagatgatagatctttaacaccttaatatattcaacctcttactttaagaaagagagaggaggtactagactaagcccctcatcagacaatacgatctatgtaaaatttaacaatattggtctgttttcatggtatttatttgtgatgactatagtctatagcaagtggtactggttttccacatgatactgaaatgagattttctctacacatatatgtaagttaaaatttgagtttaagaaatgtaaaaataaataataggtagtacactgatatggcctttgaaggtgatatgtggaagactgaaatttaggtaactgccatttatcattggaattagcagctactatggttggatgtttgtgatccctcaatattcatatgttgaaacctaatccctaatgtgatagtattaagaagtggggcctttagaaggtgattaagtcttaagggcttcgccagctgaatgtgattagtgtccttataaaagggatctgagagagtttgtttgccccttcctccatgtgagaacacatagaatgcaccatctctgaagaataaggcccccacttgacaccagttcttgccagtgccttgatttaagtttcccaaactccagaactgtgagaaatttttataagttacacagtctaagttattttgttacatcagccccaatggactaagacttcggcataataattataacaaagaaatatctacattctacattttaaagcataataatgatttcttccaatttctgatatggaaagaaaaagtaagtgtaatgtaatgtgtagtaatagacatggtttataagtgttttaaaataatagaaaatatagaataatgcagagcttcctgtggaaaagtaacaaaatatttaggtacagataattgtagagttgtttaataagttttttggtagctttttaacctcaaactttggagtctacaaaggaaaaaaaaaaaggaataaaagagattctatttgaagaaatagtgaatggcattaaaagtttcttgaatgatgggaaagttgctatctgggaaaaactactttaaagtaaatgtaatcacagagatactagggaaaagctagatatttataagcctctacatgaaattcatactgggggataatattacagtactcaaaataaatgaattataaaggtaaatatgtaaatatttgaaatgattattcaaagaggtcgagtatatcattagacagacttcataaatgtttatgagcaataagtatgtgccaacttaagtagaaaatattaattaacaatataatctctctgagcattgaaaagaaattaacagaagctgttaaaatattgtaagtgctatgttccttgaagaaggaagcactttcctaactgttccctggagttgttgaaaatctttattagtggcctggcacggtggctcacacctctaatcccatcactttgggaggccaaggtgtgcagatcacttgaggatcaggagttcaagactggcctggccaatatgacgaaaccctgtctctactaaaaatgcaaaattagccaggagtgagggcgggtgcttctccagctgctcaggaggctgaggcaggagaatcgcttgaacctgggaggcagaggttgcagtgagtcaagatcctgccactgcactccagcctgggagacagagtgaaactccatctcaaaaatgaagaagaagaagaaaaaaagaaactctatgagcaatatgatcaatttaaagtaaaaattattttcaatgaataagtatttatttaggtaaacctttgcaacaaattggacttttcttttttaattaatagattttattttttgtgtagttataatttatttctaaaatgagcagaaagtgcaggtcccctgtatctccttaccatgccccactgtttccctgattattgacatcttgtattagtatagtatttttgttatataattgatgaaccagtatcaatacattgttataaaccaaactccataatttatattaaggtttattctttgtgttgtgccttatatgaattttgaaatgtataataatatggatttactctcatcagagtattatgtaggacagtttcacttccctaaattgccctgtgctctcctattcatcctttcccctcatgccccacaaactcctggcaaccactgatctttttactgtgtccatagttggccttttctaaaatgacatattgttgaaatcataagagtatatatagtcttttcagattggattacttcacttagcaatatgcatttaagatacttgcatgatacttgcatatcatactggggcttgacagctctttttttttttaagacagtctcactctgtcaccaggctggagtgcagtggtgtggtcttggctcactgcaacctccacgtcccgggttcaatccattttcctgcctcagcctccttgggactacaggcgctcaccaccacacccagagaatttttgtatttttagtagagacagggtttcaccatgttggccaggatggtctcgacctcttgaccttgtgacccgcctacctcagcctcccaaagtgctgggattacaggtgtgagccacggcgcctggtcttatttctttttatcattggatgtattatattgtatggatataccacagtttgtttattcattaacctattcaagggtatcttggatggttccgaattatggcaattgtgattaaaactgcggttaatactcatgtgcaggttttgatgtgggcatacaacaattttcaactcacttaggtaaatactaaggagcacaattgctggatcctatgataagagtgtgtttaattttataaaaaattgcaaaactgtcttccaaagtggctgggctattttgcgtatccaccagcaatgaatgagatctccttttgtttcacatcttcatcagtatttgatgtcagtgttttggattttcatcattctcacaggtttaaagtggtatctgtttgttttaatttgaaattccctaatagcatacgatgttgagcattttttcatgtgcttatttgccatctgtatatctgttttagtgaggtgtctatagataacttttgcccattttaaattatattgtttgtttcttatttttgagttataagatatttttgtatattttgggtaccagtccattatcagatatgtgctttgaaaatatattttcctagtctatagtttctcctttctttctcttcacagtgtcttttgcagagcaaaagttttagttttaatgagcttcaacttatgagtttttttttgtttgtttgttttatgcatcaggctttagtgttgtatctaaaaattcatcaccaaactcaaggtcaccaagattttctcctgtggtatcatttagaagttttatatctttgtgtttacatttagatgtatggttcattttgagttaattttgtgaaaggtataacgtctgggtgtagatttattttttgcatgtggattttgagtttcagcaccacttgtgaaaagactattatatttccatttatttgactttgttcctttgtcaaacatcacttgactatatttgctattttgttccattaatctatttgtcttttacttcatcaacctcacactgtcttgattactgtaaatttatagtgtatcttgaagtttggtagtatcagtcttccaacttttttacttcttcaatattgtgttaaatattatgagtcttttgctttttcttatgaaatttagaacacattattattttttttttgcatccacaaaatgactcactgagatttcggctgggattgtgtttaatgtattgatcaagttgggaagaattgaaatcttgacaatgttaagtattcttatacatgtagatagaatatatttgtatttatttagatcttctttgatttttttcatcagaatattgtagtttttctcatacagattttatacttattttgatatatttatatctaagtattcaatttttgagatgtactaatttaaatggtattatgttttccatttcaaattccaatttttcatggctagtattaagaaaaaaattgacttttgcttattagtcttatatcctccaatattgctgtaatcacttcttagtgccagtagttttttttttgtcaattctctgcaattttctacattaataatcatgtcaccaccttaaaaagacagttttatttcttccttcccaatctgtctactttttatttccttttttgttgttcttatttcattggctggtactcccagtatgatgttgagtagaagtgtaagaacagacttccttgccttgttcctgatattagcaggaaaagcatatagtttttcactgttaagtatgatgttagctgtaagtgtttatagattttttatcaaattgagaaagttcctatttaatcttagattgctgatggttttacttatgaattatgaatgagaattggtttttttagatgcttttgctgcatctattaaaataataatataatttctcttatttagcccgttgatgtgagggattatagtaattgatttttgaatattgaatcagccttgcacacctgtcataaattccatttgatcatggtgtataattctttatatacattgttggatttaatgtgctttcttttaggatttatgcatctatgttcctgagagatattggtctataatgtttttgtcttgtaactgatttgtctggttctggattagggtaatgatggcctagaagaatgagttaggaaatattcccactacttccattttttggaggaaactagagaattgctgtaatttcatttttaaattattggtagaattcatctgagcttggtgctttcattttggaatgttattatttactgatccaattttttaaatagatgtttagattagttcttctgatgtgagttttggtagattgtgtgtctttcaaggaattgctccatttcatccaggttatcaaatgtgtgggcacatagttgttcacaatatttttttataatccttttaacatccagtggttcagtaatgatagttgcttttttatttctcatcatagcaatttgggtctctcattatttcttccttaacctggctagaggttgaaacagattttgattttgttgattttttaaaattaattaattaatttatttatttatttttgagacggagtctcactctgccccccaggctggagtgcagtggtgagatctcgactcactgcaagctccgcctcccgggttcacgccattcttctgcctcagcctcccaagtaggtgggactacaggcaccgccaccgtgcccggctaactttctgtatttttagtagagacagggtttcaccgtgttagccaggatggtctttatctcctgacctcgtgatctgcctgcctcggcctcccaaagtgctgggattacaggcgtgagacacggcgcccggccaatttttttatgttgattctcttttttcaatttatgtttttgactaagggttgggtgttttttttactgtttgctgtagctataggtgtcagaggttaaatttttccctaatttccttggttttgtcttccctgttgggtttgagttacctaagagacaaattcatctttaaataaggtctcagtcatgtacttctttcagttgtattctcctgatgtaatggttaagttgtagaaaggcaaatggtctaaagtcttacattaggcctccttctgttactgagcctgtgcaccttatagaagtcaataacccttaaagggcttccaagttctgttttgaagtctggagggggttaacgttgtatatttctcatttcccagtttgtttactttatggtaaaaccccagtaggtaaggctgtgctacaatagtttgtcttgaggtcaggcctttcaaaatggttactttttctcttcccctgctggaagcaagagagtttttctttttttttttcctctcaggttttcactgagagaacccaactgggctgtaggaggtacatttcatgaaagtttgggggcctcgtaagattgagttcccctagaattttttccacactgtgccttcagcaatttgtcaattacagtttagggtttcctaacagcattgtttcccatggaggtttctgcttctaggcttctgcttcagtaaatcgtgattctctgtatcttacctgtgtgtctctccattttagggagcaatatattgccctttgacctcacttctctgatgtatctaagaagagttattgagtttcagtttgttctgttttttcattgtagtgagaatgggagtgatgatgcccaaggttcttacatgccatattggaaactggaagtcatgaattaaacctttaatacataaattaacagtattatttttgtttgttttgcttcccatgtaaacttttatttaatcattaaaaatggcttaacatttctgtattaaattgaatttgcaaaacaaatttagatctgaatctaccagtttgcattttgtgttaattcttctgatatgtttctattctctgaaactttaaggaaaaattaattatataaagcatatacttataaattggttattatacttaccttaaaaacctgctttttggcaaaaatagagctcatttaaattattttattgttattaaaaatagtttgaagactaacatatcaaagttcctctttttagtgtcatttaaatgcattttctggcacaagcaggaaaagaacattaactgatatataacaatagggaacaactatcaccagaggaaaatgatgtatagatggcattcacagatatttttcttatattgaagagattaatttgtttattgtcacattaactacatgttactttgaatacttttgcagtttaaaaatttgactgcagaacgttgatagtttaacattgacaaatacataagaatcagtctgagatttaggaaaggtaaaaaatattaagaatattaataaatgtataatttttggcaaattctagacttaatattactgtcatttttatattttatggtattaagcacacagtaggctatatttttaatgatgttacaatggttaatttcaacaacatcaaaaaatttactttgacaggaaacaaaaaaatttagtcttaaaacatattattattttatacggggagtaaattaagcccaataaaaaatttatttatgaaattaaaagtaatagatttttgaggggctttaatttgggtcttacatgcatgtatttatttgtactctaccttgttttaaatatgatttaaagcagcttactatggtactgactaggttagatgggtttgagatgaagtttcctctgtttgtttaatttcatgtgctgaaatgaagaagggaaactatattatggggagaatatttccttcatgacactatctacacatattactttattataaaataaagctattttataaatacacatcaatgttgcacaatactcaattgtctttacatattcttttacttgtaaatacataagtaaaaagtgtgactggaaggtcactaaattgtaagcttaatttgaatccttcagagatgaaataatcctaatttcttaatatttattgataaaaaatgagattcttaatctttgagtttcttctctgggtatcacttttttatatggagatgaatacagatttcttgttttgtttaaaattattttcagtactaattattggttttctaaagcatgaaacagattctggtatacaaaaatacttacttataaaataaattttacagtatactgggacgagagttatgccaacattaaatcatgtttttattaaatcatttaagaatataaaatatggggaatatttttgccctgtggatcattttagatatgttcttatttaaaacagtttttcagatgctcttaagaatgagagagaataataataggcagaaaactattttaaattaatttttacattaatgtaaatgttatgatttttttttaattaaagaatgtcttctaccatttcaattttaaagggaaaatattcatttgtcctattttgtttttcaagttgcattcctttgtgttctccaatctgaagtttcctctttggtgaaccctccaacatagtctactgcagttattaattgtacataatataaatgatgacaacagacttctgagcgctgaaatgcaatgagaaacacagaagtaccaatggtcaaaaatcaaccaaaggggcatttgataacatttatattgtaaattgctgagaattgattgcaagtgataaaataaaaagaggctgaaaatagaaaactaaaaatcaaccaaaggcaatttgtatgattcaataatagctatataccaatttatatacctgactactttagattattctctaaagattgtcaaaacttttaatttaacaacattgctcattgtataataggcttaggaaaatttattttattttagtttagtttagttttttgaaacagggtctcactctgtcacccaggagtgcagtggcgcgatctccgctcgctacaacctccacctcctaggttcaagcaattctcctgcctcagcctcccaagtagctggaactacaggcgtgtgccaccatgcccagctaagtttttgtaattttagtagagacagcgtttcactgtgttagccaggatggtctatctcctgacttcgtgatctgcccgcctcagcatcccaaagtgctcagattacaggcgtgagccaccgtgcccggcaggaagatttatttgaaaaagcacacagaataatggttatacaggggtcatacaatttttcatataaaggttagaaataaaaagcattcttgcctatactgtataaaacctgatttcttagaccaaataatttatgcttaccgttaaaagtgacatatgtaattatgttataaggaatataatgtggaatgaagttttaaccattttagagacaatccacctaagctaacaaaatatattaagaatctgccatgtgccaaacactcttctggccattggagacacagaagtgaacaagcatatgtcatccctgtactcaggactggtgtctactgggaagatgagagggtaaactataaatgaacatagtaatatacaatcaggtaatattcagtgcaatgttgaaaaaaatagacagtgtatgggaagagggtgagagaaagctgcatcagatagggtggccaggaagttcttccaacagagacaagaatggagagaaggaatcgatgtgaaaacctgggggaactgtaatccagacagcaggacagcaaatgcaaaggacaatttcaacatcttgtagcaggataagctgcagacaaaacctctcagacactgagttgtagaaggaagggctttattcagccaggagcgtcggcaagctactgccttaaaatctgagctccccaagtgcacaatttctgtcccttttaagggctcacaacactaaagatttcacatgaaagggtcgtgattgatttgggcaagcaaggggtccgtgacgggctgcatgcaccagtggtcagagagaaacagaacagggcagggagtttcacgatgttcttctatacaatgtctgtaatctatgaataacgtcggtttctaagttatgagttgatttttaactactgggtttaggccaggcaggcccaggcctggttttgggcgtggtgctgggctgcctgtctttggttttacttccttgttgttttttcttaaaacaggtactgagtatacaacaatataaaacaatatgagagggtctctctctttcctcctttcccccctttgagactctcactttttattagtgggagttctcactcttatttttgctacttatgacttcttatgcaatagattgatagtgatttatatagtatgcttgtgctgaagcattttggtgaactaaggtagcgatgaagtttttttatcatttggagaaatacaggtatcagacaagggagcagtaagcaggttcctattactatgattacttttattataagagttttaaatcctcctattgctgggaaccaatttccaaacatggctacaggattgcatctgtgccacacttgcatgggtacatgtgccagttttgttatatctttaactatattttcaactacttcccctcatcatctatgtgtaggcaacaattagtaaggttaatttttcacaaactcctccttcagctgttagcaagtagtaagagctagtctattttgatagatagcatttctcattagagtttcttgctgggccagaatagtcaaggcttgaccagttttattagcaatgatttttaaaacagcttgtaaccgtatgattcagttgagcatgtagatgggggtttgatatcctcctgagccatcttgtgcctaagtggcaggtctataatattgtatgattttttcaggggaccatttatcatctttccaatcacttacagctatgcttcatttttcgtgggaagcatagactgggaagcccagaagtttacctgtttttatcggcagtaagaagaaagatggcttaatggtgccaattatacagctacctgtccactgatcaggcagattagcataagctctgtgtccacatatccagtataaccctgtggggccgtccagtcctggtggaattctgggtgggcccaaatagtctgcaactttggaaatttactgaatggatttctttctgtgtaattggaactccaccatgtaactgtttttgtggtaccattatacagcttttgcctaagacaactaaaccgccttacaggatgagtgaatccttttccttctttagctatgcaatactgtccaataattgagacttttaggacgaaaaatatgtcagggtggttcttttgggctgggaattcatcaggaactggatctgtaggaactaattattgggcttcccatggccattgatcttctattacagtttttccacaaacataacatgaagtgacatttagagactgggctacatgctcggctaattgcaaaaacaaatttctggtttttcctagagtctctggtactggcacatttagtttattacagaaagtctgaaatactggttctggagagcgtatttgaacctcccatttcattaggatgtttacactaggatctagtccttttccatcaatgcctaatgatacatatttttctttattttattttgggtctgaggggtttgtgattactaattttaaagggttgcagctcccactcatgcaggaggggctgccttttcctttgcagagccaaacaagatctttttttaatcctcttttcaagtagcctaaatgacacaagaccagtattgacacatctcacataaatatgatttttgacagatatactttttttttttaactgtttaacttttttttagtttacagaacggcatcttattccatgctgcttactatcaatagcagcacaagtgtcaaattttaaggttacatttttgggggcccctctttcttctgttctagctattaccttacttgtgtcacctagaaaaggaccagtccttaattttattttaaaaactgtgatcgtgggaggcttaaaatgggtcataacacacatcaggttggttatttcctgggctacataccttggatagaatagcattatacaaacgagtttcttttagagtcctggtacacttataataaccataaaataataggactgtagcaattttttgtcctacctcagtgacttgatgtatatactgggaacagttctcagtctgacgaaggttagttgacgtccttactgaaaaagtccaaattttaaggaaaatgagtcccacaatgagttttctgatgcatcggccatgcgtggaccagtcagcttccgggtgtgactggagcagggcttgtcatcttctttagagtcactttgcaggggctggcgaagctgctcccatccacgtacagctcccagtctactgatgtgtaagggtggtctcagaggttgggcctactagaataaacagagtctaacacctctacacagttaatgtttcactgggctccctgataccaggagtaaggtggtggggttagggtgttgcaaacttcaatggttatgtggggatttttgcagagcaagctttggtatctagttagtctaacattcattggctaatggtgtcctttggtatttattaaaatcaccacagcatggggacactttatgtttaggttttgcccaagagttagcttatctgtttcttgtgctaacaggtctgttgctaccagggcccttggacatgggggccagtctttggaaaccccttctagttgttttgagagataggccactggccttggccagggccctacagtctgggttaaaactccaactgccattttttctctttctgacacatagagtgtaaagagttttgtcaggtcaggtagcctcagggctggggccgacatgcgtttttctttttaacttacgaaaagctcgttgctgttggttgtaatagatgtagtttatctaatttacatttttattgactgtcatctaccaaaatattgacttaaatcttacaactatttgatttcaagctttaaattgatctggtattccttgtggggctccaattgcatctaaatagatgtgagagttgaaagacctataaggggcttctcttgctttacgatgtcttattattattttttttcctctggctgatgaaatgccagggtgaaatggatagccaaatggactaaagcacaagtgccactctagttatttggcagagtgcccagtaaaagtccaccacaataccaccacaaatccactcggggatgaacaagggctgactgattgataagctcttgaaaattcctaagatcactgcatcccttcaggtctccaaggaatgctaagtctcctcccctgccatgagagacaagaagtgaacttagtgttgggagacggaagctggatggccctcggggatgacctgcagggacttcaggatacagcagagagagcttggcatgacttattactccaggctgtagaatcctggaaaacagctaccatacagcccacgcctggtcgactgaaggaccaccttagtggaagggggacaatcagggtctctaacctgccaacctgccatgtgcacaagcataacagttgctttgtttaacgtgcggatggaatatttgatccatttcatccaggcatttgtatcttggtatgctgtcttaactgccgaagtttgttttaagtctttaactttcttgatcctctagtaaaatgaatgtttcctttagcacctatttttattagtttttagaccaaagaaagctaaacaccattttatatttaataatgcttcttgtgtgatttttatgccagataagttaaattttacctttatattagtgtgttattaatgttaaacttaattttaataaagccttgtagacatatttatccaatttttcatgtttgaccataaggtaagattttatagactctttaatcttttataatttttgttaaagagcaggttgatgctttaagaaaaacttgttgcatttttactttaatgtccagttcacagaaaaactggatgatatctttttaactttagctaatatgtttacacacagaattttctttataattaacattttaaagcttgcttaaacttttaaaacaataatttttttaaccttttaatgtaggtaaaaatctacattattatgcccctttataatctttttaccaaaggtatattttacttttcttatacacttcgcacataaactgttttttttaatggtactcaggaggccttattacttttaaattatacaacattttttgcatacaatttttataacattttttctttcatgactttcgccgacaatttttcaacatgtctcaactttctgacttattacaaacattttttttttctttaaacaaccagttaatttatttcaggacaagaatttaccatataacactctttttacctaaattctgcctgcccccccccccttttttttttttttttgaagataaccattcctttttttaaagcaaactttctttatgtctttgggactaaggccacaagattagaagttaccataatacatgttacactgttaacttttagcaaacttcacttttgttgaaaaccttgtaagtttgggatttcaattatcctttgctattaataagaccttgtttagtctaaattaacttacaattggtttagatggcctttttttctctctgctggtctttccttttctctctgctgcctctgccagctgcttatactgctgttcttttaactactgtggggaggaaagggggtctaaaaccagctgttactgtctgtgtacggaaactggtctgggtgctttggcttacaggttaccttgtgccatacctttgaaacaagggacctgtccaggcttcctcaattctttcttgaatttttttttttttaacatagttcccagtggggtgggcttactttgtgcctgacccacgttgttttttttttttttttcccgagacaaaataccacactcacaccacacataccacaagacaaagaacaggtaaagagggcacacacacacttctaccgtttataccaaaccaaaatcatgaaattcaaaatccaagtatcaaaaaattccagccaagtcaaaaccaaaaccaaagtatccagcaattcaagtcaagtcaaaaccagaacaagagtgccaatgcaggcacgctgtgggtgatcaggccacgcttccactcagatggagtgaggcaagttccaaagactagtcttaccaagtttcagatgtccggactccaagtgccagttccttcctggtgttcagccactgtgttaatcctcctcgggggcctgctatgtgcgctgctctggcgaggtgttccactggggcagtttcctacccgggagcgctctttggatcacgtcactcaggctggctggagtccccctcagggatgctccacagggcaggcttaagtcacctaaggggctgcctcagctatccatcagtcacctcgcttcccagtcagggaaccaagaaatgtagcaggacgagccgcagacaaaacctctcagacaccgagttgtagaaggaagggctttattcagctgggagcatcggcaagctactgccttaaaatccgagttccccaaatgcacaatttctgtcccttttaagggctcacaacactaaagatttcacatgaaagggtcgtgattgatttgagcaagcaggtggtatgtgacaggggctgcatgcaccagtggtcagagagatacagaacagggcagggagtttcacaatgctctactatacaatgtctgtaatctatgaataacattggtttctaagttatgagttgatttttaactactgggtttaggccaggcaggcccaggcctggtttcaggcctggcgccaggctgcctgtctttggttttacttccttgttgtttttccttaaaacaggtactgagtataaagcaacgtaaaacaatatgagagggtctctctcttacctcaatctcatgtggaaaacagtgactgataaacttatgatggcaaaagctgctacctattaaaattatatgaacataatgttattttagagtagtttaattttcatttttaggtaaattcaaactagcttgtgaggtattgcttcttattaacagaagataacaacaatatctcaagcgattagtatctcagatctcataatttggttgataaaggggtttcaggagagaaaaggatattgaaaaagggctaagcaatcttgcgttgctgtagtgaaacaaaggcaaacataattttgattttttttaagaaaattacatgatgctgagtattggtgcataatttcacgtccagcagtaatcgttaacaagagcagttgtcataggaataccagcagtggtgtggcagaggtggtggtggtaattttagtgcagatagaaagccttaaaggaacaccatctatgtgacagccacagtgccaagtgtgacttgcattatctcttttattttggcaaacagatattaaggtgagggtcaatattatccctgcaaggttaggtttacacaattataaaatttcaaagctgagattcaaactcagttgcgtctcatcccacaatccaagctatttttaaggggggaaataacattcattatgattaatggtagtgtggcaccatatagttcaaaatttgaaattgaaagagtatttagaaatcctgagttttagggttgactctgctatgctataaaattgatgtgtgggaaagatacttctgttccccgagtctgcaaatgagcataccaatgccatttttcttccagatttgttctggtaaacacatgattgcataaaaataatatgaaaaaaagatctactaaaaattgatttaaactgtgtagacattaagagagctcttataaaatgctattcactacattatgaactgggaataaaactaatagttaagacacaaaccttcaaatgtcaaaaaaaaattggggtccatacaactgtacaagaaaaaatctgagtacattatgcatccattcatgtttaatgattgtagtagacatctgtaatttttacccattaagccagcctcctagtaagagacccatctcttccccaatcccagatccctgtgttttggataggatgccttccatcctttgtgtccaaggatagaccctatagctcgagctcagccaacaagacagccataaccacagtaactgatgtagaagaaggtttatggcacaagcctaggtgaaaaaacagagagagagagaaagagagagaaaggatgctacatttgacacattttttccaacttttcttctttattggatgtctcatttatatgagccagcaaattcctgtctattgaaagctaggttgcactggttttctcttacctgtagttaagaatgcaaatcagtaataggatggaggaggttataaatgagccaggattttgaatatgccaggaagactgatttagacagtgtagttatgtgaactcctttgagataaaaagctgagcttggagtcaatgaaattcttcagctttcataagatggtaggtatttaaataaggtcttgaagagttaaatctaaatagatgaaaccaaagttatcacagagggggaggaaatggccttttttttagtctagcagatgctagaccagaaataaatatttcacatatatgttttattagctaaaggatgtgttttgttattattattcttggtcattaatttcacagaaacatatattaaggtattcattaaatctcaaaggtttaaggaattttggttccttttatggtccagcacaaattatgaagaaaggtgacatgatgtgaattttactttaggaagaaaataccaacagcagaaagatggactggaggcatgagaaagcagagaaaaagaatcagctggaagcttttaaatttagttaacttaaattttttttggacacagaaagactttctgaagtaggagatgattagagtcttaactaatgtaataataatgggaatggatgaaagtaaaacaatatgtgacaggcattgtggaggtagaatagacaggatgtgagaaataaaaagctgtaagttataatggagatgaagtagtcaatatgtttccattgggatttcaaagagtggagggagagacttattaacagagactgcaagtagagaataatcattatattagcaagtaagagcgaaatctatgaagacactaattaatttagtttgaagacatgtctttgagatacggaagtgtttttgctatgaagaccattagatatttatgcattagttcaaaaaatatgtattgaacacctaactatggcctaactactgtactagacaactttcctgcttttgtggaccctatattgtaaaagttggctgcaattaaatgaatgtatactctatatgaggtggtacaaaaatatacaaagaaaaataaaatggggagggtatttggcgctattttacaatcttggttacaaaaaacctctctgagcagatatctgaagaaactgagggagaaaaccataaggatatgtgggcaggtaaaagaaagcaatgaaggccctgcacggaagggacatatttgagagactgcaaggggtcaagtgtggctgcagagaaggaatctagggaagataaggtcagagagatagaatgccttgaaaattctagactggtggcccagaaaacgatcttgagattatggcaaagattgtagttgttttccagaaacaattcttcccctttttggtagtagtagatattttagctgagcctgtagtgtctgagagtgaagattaccttgaagccatgtggccatgtgagtaggagtatggggctgaaagctcacttaagttattgatggtctgtttcatttacccttctattccttgctctttcctcacacacatacacacacacaatgtaggatctctgagtccagatattggaagactttttttgagcacagccaccttactagtttatatatgtataagaaagaaacatattttatttaaagtccaaaatattttgctttttatattaccctttctactactcacagtttaatgctaattaatgcaggaagtatggttgtaaggcttgtaggggctaaggctatctgagtttatgtgattgctcacagagagcatatagattgagatggcatctagagtggaaactttacaagtatgcagagccgtgaatacattttcctcatcttcctcctttttttgttttttctaagtaggtaaaatctgattctctaagacctagctcaaatataactgtctttgtgaaactactagtaataaaagctcatcctgtttctcttcaaaaagcagaattacttgctttgccatgttctccctctgctctacctcttactattttgtctcatgttgtatttatgtacatgtaccactccttgaatacagggtgaactcctgaaaaagcctgttacccttaacattttaaacaaacaatccaagctcagtttcagaccctcattgtatccatcctggattgctggcttaggctcccaagggatcttcatttgcctcattttctttttcttttttgtccacaagaaactctcttacaaattttcattcgtgagtcatttcctcaaaaaacaaaaaacaaaaacaaaacaaacaaagaaacaaaaaaacagggtagataaaatactgtcatctggaccccatatttctagcgtaatgcttttgagttacaagtctataaaatcattgaagaaaagacctatagtttacgtctagcagattaattcataataaatttttgttaaattgaattggaagtagaagtaatctagattgattgaagcataggatggagatattttgtgtgtgtgtgtgtgtgtgtgtgtgtgtgtgtgagacaaaaatacagggaaaagaagacataaaatatgaagatgccaacaacagctaaggaaaaaactgttgaaacagctgattcagtaactaaactggcttgtcaaggaataactgaaacacaaggagaaggcagctgtttctactgtagtgtcctctgttttctccccttttccttctgtctgtctctaatgaagtaaagctacataaatatggcacatagcagtgtatgtcaaatagtgctcaataaaatatctccagttagagcttttggtgaacaagtcttgaaagatatttgcatcattttctttgattaaagagtcagtgattttattgaacacattaatttagatatgtgtacctattctttgatcaagatcttattactatatttatttctgtatcaggagtactttttcagttcagaaacaaccctttttcattttcaatttagggaacattacttttagtttgaggtttatatgactttggatgaagacagtgctgtcacaaatgagactctaactgtagcccatggatttggatctttagtctattgtattgattatactttccagtctccttgatgtctcagcacattttggtaaagtattgacataatttaactccatggattccaggatacacatgaccttttcagaaagtatacattattgtaagaatttacaagaactgaataattctgcagaaattatgaatgttatagtcaatggcaaaacagctattagtattaagtctttaaataattatactttgatttattgtttgattatatgttcaactttgttttaaatagcatagtgcagtagctccttgtcttcagttcaaaatgcaaagttactctaatttttttgaggtacaaaaactcttctataaatatataaaattaggcctagaaaagactaattttcatgatgggaaatacacactagatttttaaattttagtactttacataaaaatattggtgtggtactatttaattacatcataatttagtagttaaaagaattcttctcaatatctggttattgctcgatttattagcacatgagcgtttctgagattggcattcagagagatttcccataataaatgttactagttatccaacaagaaaagaacattaatgatttcacctaacatgctctcaactgtatgatattatatgaagagttaattctcatatttagtctagaaagatttttaacatgagttactgagttaatatctttaaaattttattaagtctttctctttctgatacagaagatccataattcaggttattaatctctggttacctgtcctttgtggaaagattaattattttctattattcattgcatttccaccaaattttggagatatttatcataaagttgtggatctgagctaagtttaaagacatcaaatagtaagttttaatttttccagctattactattaattctaagttttttttctctgatatgtcttctttgatgtttcttaaaaatcaagatttataaagagatagagaaggccattagtatatctctcaatgtcacaaaattaacctagccactgtaaagttaacctgtatccacaatataagtgacaaatggcagataatatctttaggaaaagtattaaatagtgcacactacttccatcaaagtatagtgttcgaggcaagtttaggtaatggtgcatttctaataaacagtctttaaaagatattagcatttctgttatttatgagaggctttcagtgtatttttcacatatgtattattagggcagtgtagaaatattattgtgatgtattaatgggctgacctgaggtaaacaataactacatccatgcgtgcatcatacatgcatacaaacttactcattttctttttaagcagactagtagttaagttccaagagagaaaggattctatatcatgaaatgccctgtacgtttttgattctctatctggaatgccaacttgaaatattactttcaataacacattacattttgtattttttagagcataatgtgcaaagtagatgatattatattttaaattaaacaaaattagagaggatctagagaaaccaatgaagtaattagtgtgttttgtttcagtggtacagaatcagactctttatagctgaactcataatgtgtacatttattaaacaaattgccaatttagtaatttataaaggaatattaatttgataaaatattttttaaaacaattaaattattttttccttatttaattcatctggaaaacatttagggagtcaatactaattgtcagtcactttgcatagggccactttgtgacagggatgaagtggcgtggtcagagggagatctgcatgaacctaagcctacaaccaataaagggagttaatgttttgaataggtaggtccatgttttggacatgaatgcattatccagtgtggagcgcagtgcctagcccatgagaagttccctatggctttgtctctggtatcaaagatttatgtaaaattagagtacaataaatctttatgtatgcatcacctatctcaacagttaacaattcatagccaataatatttcttctgaactctcaccttctttggggggtaggggtgagatggagttttgctcttgttgcccaggctggaatgcaatggcacgatcttggctcactgcaacctccgcctcccaggttcaagtgagtctcctgactcagcttcctgagtagctgggattacaggcgcaccacctccacgcccagctaattttttgtatttttagtagaaattgggtttcactatgttagccaggctggtctcgaactcctgacttcaggtggtccatccgcctcggcctcccaaagtgctgggattacaggcgtgagccactgtgcctggacctctcacctattcttcctgctaggactttgtcatattttttgagtgggctttggaaacaaatcctggcattgtaccatttatctgtaaatattttactgtgaatctctaaacaaaaatcacaatactattatcacacaaaaatagtcataatttttaatatcatcaaatattccatcaggattcatatttctcaaatattcttttaagagtaagtttgactcagagtccatttaaattagtttatatgtctcttaattctctttcagtagattgtcctgtgtctcctgattcttgaccttttgagtaaacagagctagcatgctacagcataagttcatactgatccattcaattcaaatttagaattacaggacttacacataatcttattgaacttgcatttgcatgtcctttctctcatgctggtaatcctggttgttagtaacactataccatttgctttatcccacactttgtaataatgcagtttcactatacatcatcaacaccacaataagcaatatatatttcttcctggcaatgggtttgcacacaatgaacagtataattaccaaatatagtttgtaaattttgtttgctgttgtactttttttgaaattgaaaatcacatattaattcaacaggataattagcagcaatcaaaaatttttaaaaagtcaaaatattaagagctgagcacagtggctcttgcctataatcctagcattttgggaggctgaggtgggtggattgcttgaattcaggagtttgagaccatcctgggcaacatggtgaaacaccatctctccaaaaaaaaaaaaaaaaaaaagagaaaaaaatgcaaagttcgcttgttatggtggattgaacctgtagtcgaagctacttggggggctgaggtgggaggatcacctgagcccaggaggtggaggttgcagtgagccaagattgcaccgctgcactccagcataggtgacagagtgagatcctgtctccaaaaaaaaaaaaaaaaaaaaagttaaaatattaaatatacatattaattgaattcatggttgtaaggatgagatccatggaagtttcctgggaggaagggctttcttgatttctttcttttttttttttttaacacacagatgttctgaccatggaactggagcataggcaattcttgagatagttctttatctttatctctaggtcttttctggactctctggaattctctttttatgtttgccctctttgctctttaccagtaggcatgcctagtcatagtttctatccttttgtaatcttgtctcatacaaagaacatcatgtccactctctacacattactatatcatggattttcttcttcaccttccactattcaagactttcctctctcaatactacctgattctcatcttctggttcttggctttttcatgtgatgaatatccctttgatcacatgccaaccagccatcccatctgttttttggtggaatatcacctggaattattccttacatagtttttctgattattttatgagtagctctgtgtatgtcagtcattctcaagaaatatctggcaagtttattatactttcaggaaatgttttgaataataaatgtgtcttactttttgagtgggcttggatagcatttattcttagtctctgttattacataaaatatatgggaataaatgtatacaattttcctatgtggatatttggtaaaaatataatgatagtatttttccatgggtggatgaattttaaagaaataatttcttagcttgcatgaagtattttttttttatttctgcatttcccttctattttctccctaggatgtcagaagagataactaaaacttttatgataaccatgtggtcagatccataacttacactgaagtctgttcttgttcaacagaagctaatattaaattcaatgttctcaaatatttactcacagtaatatgctccatttggtctattctgtgattttttggctcccacttaataatagttatatgccctttagcaaatataacagcaggaagaccataatgttcaaaacaacagacttgttaaatgtgtagcatattttttctttcttatttgcctttaccagctgaatattgtttctgtaattcttggcagaattatgcatttttctactacttaaaagcatacattttagttgtttctcttcttctaaaaacatataagagatatgttttatgataaatattttatcatgtttttctatacttttatatttctttgagggagcttattttagctcctctgttgtctcctggattcataattgccatacaattttatggatcaaacatttataattaacacattttagtttggtagcaatttcatttactttaatcagtcttttatactggaaaaaataactataaagttcacaaaatatttctctgcattactataaagtttacaaaaatttccctgtaaatcagtttctatattttcagaactaacaatgattttattctatataagttgccaacataatacaaatatggaattgcctaattcttgaaatgaaaaggaagcatgaacagttactattgatgaggagacatctcaatcctgctatggtaggaaaacacagaatccttctgtggtagatttctttagttattcccaacagtccttatcttttcttgtaagggttttcacactcatcatgaagtgacttccatgtgttctgtaggcagagcttttatccctgttcttttgatttttggctttggctctgtaacccagtttggacaatggaatgtgaatggatatgatttatgttacagctcagcagaggagttaatgggcattgctaggttgtttcagtacttttgttctttccctctgctttgaccatggactacccaaaggggattgctccttcagcctcggcgatgaaacaaggcaacatgtagaacagagatccagcagatgacttccgtttctaacacataatatcagataaatatttgtttttgtaagctattgagatgttggggtggtttttcacttcaggaaagctaagtaatataattctcatttttgcaatttgcaggaatttttgagcaattcttgttatctttgtctccagaattatagttccagattttaagatttttcaagctctttacatctcactttactatatgttttccacaaagtagtcgttttcataaatgttttgagagttaatgatttaatgaataaatagaagattgactatcaattagacaaacccttcaaatacattaacaaggtcccaggtccaaattaatctgtagcttttttttttttttttttttttttttttgacagtctctcactctgtcaccaggctggagtgcagtggcacgatcttggctcactgcaacctctgcctcctgtgttcaagtgattctcctgcctcagcctcccaagtagctgggactttgggagcacgcccaccacgcctagctaatttttttttttttgtatttttttttaggagagacggggtttcaccatgttggccaggatggtcttgacctcttgacctcatgatcctcccaccccagcctctcaaagtgctgggattataggcatgagccactgtgcccagccagtcagtagcttttgaatttttgattactgaacccttacttctaaactatatgatacttattgtggtttcttaaaattgatactagtctatttaaccatgtagaccttgtgctcaatcaatacctgctaacaagtctatttaatttggggatataagactttaaatatccaagttagttctgctgcagagttaagtctacacttataaagaaagactgggaaaaaattgtctcagttattgaatgttttattaaataacatttgatagacacataatacacaaattgacaatattcaaggaactatcatgaaataaaactcatgctttactggattaatattttaagtaaaccagaaaatataattgagaaatacaggaaccaaatctcaaatcatacaaaacccaaatgtgttatttcttttaaaaaaatgttttgccgggcatggtggctcacacctgtaatcccagcactttgggagattgaggtgggtggatcatgaggtcaggagttcaagaccatcctggccagtatggtgaaaccctgtctctactaaaaatatgaaaattagccaggcgtggtagcacaacatctatagtcccagatactcaggaggctgaggcaggagaattgctttaacctgggaggccgaggttgcagtgagccgagatcatgccattgcactccagcctgggcgacagaatgagactctgtctcaaaaaaaaaaaaattgttttattttgaatttgtatgggtacatagtgtttatatttatgcggcacatgagatattttgacagagacatagaatgtgtaataatcacataaggttaaatgggatgcccatcaccttaattatcatttctttgtgttacaagcattcaaattatactcttttagttatttttattttttactctgtcgcccaggttggagtgctatagtgtgatcttggctcactgcaacctccgcctcctgggttcaagtgattctcctgcctcagtctcctgagtagctgggattacaggtgcacaccaccacacccagctaatttttgtatttttagtggagaagggggtttcatcatattggccaggcttatctcgaactcctgacctcaggtgatccacctgccttggcctcccaaagtgctgggattacaggcatgagccaccacaactgccatattttagttattttttaatgtgcaataaattattattgactgtaatcactctgttgtgctatctaatactacatcatattcattctaactgtatttttgtacatccccacttaccgtgcccccaaccccaagcccccaccaccactcccaacactacctttctcagcctctgctaaccatctttctactctgtccccatgagctcagttgttttaattattagctcccataaatgaatgcaaatatttgaagttttctttttttctatttttcatgtacctggcttacttcacttaacataatgtccttcagttccatttatgttgttgcaaatgacaggttctcttattttttaattgctgaatagtatcccattgtgtatatgtggcaaattttctttattcattcatccgttcatggacacttagattgcttccaaatcttaactactgtggatagtgcttcaataaacttcagagtgctgatattttttgatatactgatttctgttcttgtccttgtgtaacagagttaataattttcattcttgacaatctctagtagcaagtaatttggagtctcataaatcaaaatacaatcacacattatgcaatatcttttgtacctaaagaagaaacctattctacctgtgaccatcaccgtaggacctaggtgatgagctttctaccctaggacctagggctgagctttctgatcccaagactttataaaaagaagaatgacacagggggcataataagatcagaacagactttacacatattcagaattctagaatgtaagggctaaattttacttttacctcaaagatgtactgacttatttgtatctacaaagtttcctactataaataaaaatgttttgtaaaaatagataaattcatttaaaattacctttgacacacttctaaaaggatctgtgtatttgtatggcttttgatcaattgagtcattgattaaaagtgtaatcatgcctctttatatgcaaagactttggtgtttatacaaaacaagcttgaacttcttttcttgtcacactgctcctacttggaaggaggataaccagcttgtactagaggtttattcttctaatcttctaaaatgcacagtatatacaagtttaaccatacataggataatctcattccactgtatgtcaacagaacaacctgatttgactcccttttccagttacccatatcctgtgaaacaaaattagaggtagctccaagatctaggtacattgtgatttagtttgttttacctttcttaataatacattttatatatattgattttcttcatataccctattacctattttcttattttctcaattctattgttctttctttttttgaaaaaaaagccctcatttttagctcattaatatttgaattctctaaatagatatgctatggtataaacagaataaagtaatcacataaaaacttacagaagttacctctgatatggctaataacatttgaaaactacttaaattcatctaattggtgattcatcataaactgatggaatataataatacaagatgaagacggtagtttattatgtcttctgtgtagcgggtgcacatgaataataatatctaaatttggaccattaaactctgagtaagagacaaaccaccacaatcatgactgtgaagtgcaacgctaaagtcatctgtcagtatgcagtcatggagtgctgaatctgctttcagaaaatctttctgttattagagttctagtatcttaatgaagcagcctacatcaggatgtggatcctcaggtaaaataagaataattatattcaagcttgaaaaaaacaattgggaaatgtattggtttgtgtttttgacctgcaggcagaaacactgaaatcatttctacttccactttaagacttctactatttgctatttggaactttatattaattcatgtttaaacatacttttttttttttgcaaataggaaactatatattataggccacatttctcccggtgccaacaatatttagctcagttacagatgatacaggatatgcaattataggcacatctcatgttattgtgcttttctttgttgcactttgcagatattgcacgtttttacatattgaaggtttgtatcaaccccgcctcgagcaagtctgttagcaccattttccaacagcatgtgatcacttcatgtctctgtgtcacattttggtaattctcccaatatttaaaactctttcattattattatatctcttatggtgatttgtgatcagcaatctttgatgctactgttttaattgttttgggacactgtcaaatatgtctatagaagacagcaaactgaatacataaatgttctgtgggttttgactgctccacggacttgcctttcctttaaatctctttatatccctgagtttcattatttcctgagacacaacaatgttgacattatgtcagttaatgaccctacaatggcctctaaattttctgacaagggaaacagtcacaggtctctcactttcaataaaaaactagtaattattaagcttagtgaagaaggcacgtcaaaagctgagtaggccaaaggtgaggtttcttgcaccagcaattagccacgttgtgaatcaaaggaaacgttcttagaggaaattaaaaatgctactccagagcacatatgaatgataagaaagtgaaacagccttattgctgatatggaaaaagttttagtggtctggataaaaaatcaaattagccacaacattctgttaagtgaaagcctaattcagagcaaggttctaactgtcttcaattttatgaaggctgagagaggtgaagaagtcacagagaaaagtttgaagctagcagaggttggttcatgaggtttatgaaaagacaccatcttcataacataaaggagcaaggtaaagcagtgatgaggatgtagaagctgcagcaagttatctagtagatgtagctaagattattttgatgaaggtggccgcatttcaaatagcatatttacaatgtagacattcaggtttgtattggaagaagatgccatctaggactttcatagctagagaggagaaatcaatgcctggctccaaggcttttaaggacggaatgactcctgttagaggctaacgcagctggtaactatacattgaagcaaatgtccatttaccattctgaaaatcatagggccattaagaattatgctatatctattctccctgtggcctataaatgaaatgtcaaagactggatgacagcactgctgtttacaacaaagatactgaatgttttaagcccattgttgagacctagtgcacagcaaacaagattcctttcaaattattactactcattgacaatgtacctagtcacctaagagctatgatggaaatgaacaagaagattaatgtttttatgcctgctaacacaacattcattctgcaactcatggatcaaggaataattttgactttcaagttttgttattttagaaatacatttaggccgggcgtgatggctcacgcctgtaatcccagaactttgggaggccgaggtgggtgaatctcttgaggtcaggagtttgagaccagcctggccaacatggtgaaatcccatctctactaaaaatacaaaaattagccaggcatggtggtgcacacctgtagtaccagctacttaggaggctgatgctggagaattgcttgaacccagtaggctgaggttgcagtgagctgagatcatctcatcactgcattccagcctgggagagagagtcttgctctgtcaaaaaaaaaattgtcattttgtaaggctatagctgccatcaatagtgattgctctgttagacatggtaaaagtaaattgaaaaccttctggaaaggactaattattctagatgtcactaagaacagtcatgattcatgggcagaggtataaatatcaacattaacaggagtttggaagatgttgattccagcctccatggatgattttgagggattcaaaagttcaggggaggaagtaattgcaaatagatttgaagtagcaagagaactagaagtggatcctgaagatatgactgaattgttaccatcttgtgatggcacgaaacattgttaaaatgaccagaagtaaattagaacattacataaacttagttgataaagcagcagcaaaatttgagaggatcggttccacttttgaaagaagctctactgtgggtaaaatgttatcaaacagcattacacactacagagaaatttttcatgaaaggaagtgtcaactgatgtgggatacttcactgttgtcttttttttttttttttaagacaactaaagccacttaaactccctttaagcacaacttttagcatttcaactacaatgcttttcatggggaaagttccacatcaccctctggttacatttttctcacttcaatgatagaaacaactttagtaaaagaatcccttttactttaggcttaacacctttacatttgtgtttaaaagtgaaacaaatagctgataaaagaaagacttatttcaacaaataacaaatacagtagcctaaatgacttaatactggtacaaaaccaaagggattactcaaaagtctagaaagagacctatgtactaatatagaattttagtatttgataaaatattgcattatacctcattggggaaaattagtctattcaaagttagatccctactttacaggtaaaatcagaataaattccaaacaaattataaattacaattatatatattaaaaagatggattaatgtttttataatctgaaggagagaaagaactttctagataaacttaactatgtggaaaacataaaactttagatcagcagaaaagtccaaaccaaacttaagggaagagaaaaataaaacacaaaaattccgataaataagtataagataaacattatgacaataggtcaaagacccaacaggaaatacagtcgtgtgtcccttaatgacagagatacgttctaagaaatgtattgttaggtgattgcatcattgtacaagcaacctaagagtgtacacaagcctagatggaatagcctactagacacctaggctatatggcatagcctattgctcttaggctatgaacctttgagcatgtgatagtgtagacaactgtaacacaatgggaagtattcgtgtatctaaacatatctaaacacaggaaaggtacagtaaaaaatatggttttataatctaataggaccactgtcacatatgtggtctatcattgaattaaaggttgttatgtggcacatgattgtacataaaccaggaaatttcaaaggtcaataaaaatatgaaatgacaagcatcaccactatcagaattatgcaaattaagcaaccagagttatgcaaattaaagaaaaaaattattcaaattaaactaagagatgaagtttttccattaatgggcaaacataaaaataataattgtatttgatgttgtgaagaaaaaggcactatcaaatatttttacaaagtaaacgtttagggtagttttttattactatactttaagttctagggtacatgtgcacaatgtgcaggtttgttacatatgtatacatgtgccatgttggtgtgctgcacccattaactcatcatttacattaggtatatctcctaatactatccctccccccacccaggacaggccccagtgtgtgatgttccccttcctgtgtccaactgtcctcattgttcaattcccacctatgagtgagaacatgtggtgtttcgttttttgtccttgcgatagtttgctgagaatgacggtttccagcttcatccatgtccctacaaaggacatgaactcatcattttttatggctgcatagtattccatggtatatatgtgtcacattttcttaatccagtctatcattgttggacatttgggttggttccaagtctttgctattgtgaatagtgccgcaataaacatacatgtgcatgtgtctttatagcaggatgacttataatcctttgggtatatacccagtaatgagacagctgggtcaaatggtatttctagttctagatccttgaggaatcgccacactgtcttccacaatggttgaactagtttacagtcccaccaacagtgtaaaagtgttcctatttctctacatcctctccagcacctgttgtttcctgactttttaatgatcaccattctaactggtgtgagatggtatctcattgtggttttgatttgcatttctctgatggccagtgatgtgagcatgttttcatgtatttgttggctgcataagtgtgttcttttgagaagtgtctgttcatatcctttgcccacgttttgatggggttgtttgtttttttcttgtaaatttgtttgagttctttggagattctggatattagccctttgttagatgagtagattgcaagaatgttctcccactctgtaggttgcctgttcactctgatggtagtttcttttgctgtgcagaagctctttagtttaattagatcccatctgcctattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcaactttctacatatggctagccagttttccaagcaccatttattaaatatagaattctttccccatttcttgtttttgtcagatttgtcaaagatcagatggttgtagatgtgtggtattatttctgagggctctgttctgttccattggtctatatctctgttgtggtaccagtgccatgctgttttggttaccgtagccttgtagtatagtttgaagtcaggtagcgtgatgcctccaactttgttcttttggcttaggattgtcttggccatgcaggctcttttgtggttccatatgaactttaaagtagatttttccaattctgtgaagaaagtcagtggtagcttgatgtggatggcattgaatctataaattaccttgggcagtgtggccattttcacgatattgattcttcttacccatgagcatggaatgttcttccatttgtttgtgtcctcttttatttcattgagcagtggtttgtagttctccttgaagaagtccttcacattccttgtaagttggattcctaagtattttattctctttgaagcaattgtaaatgggagttcactcatgatttggctctctgtttgtctgttattggtgtataagaatgcttgtgacttttgcacattgattttgtatcctgaggctttcctgaagttgcttatcagctgtaggagattttgggctgagatgatggggttttctaaatatacaatcttgtcatctgcaaagagggacaatttgacttcctcttttcctagctgaataccctttaattctttctcctgccttattgccctggccagaacttccaaccctatgttgaataggagtggtaagagagggcatccctgttttgtgccagttttcaaagggaatgcttccagtttttgcccattcagtatgatattggctgtgggtttgccatagatagctcttattattttgagatatgtcccatcaatacctaatttattgagagtttttagcatgaagggctgttgaattttgtcaaaggccttttctgcatctattgagataatcaagtggtttttgtctttggttctgtttatatgctggattatgtttattgatttgcatatgttgaaccagccttgcatcccagggatgaagcccacttgatcatggtggatgagctttttgatgtgctgctggattcagtttgccacgattttattgaggatttttgcatcgatcttcatcagggatattggtctaaaattctctttttttgttgtgtctctgtcaggctttggtatcaggatgatgctggcctcataaaatgagttagggaggattccctctttttctattgattggaatagtttcagaaggaatggtcccagctcctccttgtacctctggtagaattcggctgtgaatccgtctggtcctggacttttttttggttggtaggctcttaattattgcctcaatttcagagcctgttattggtctattcagggattcaacttcttcctggtttacccttgggagggtgtatgtgtccaggagtttatccatttcttctagattttctagtttatttgcatagaggtgtttctagtactctctgatggtagtttgtatttctgtgggattggtggtgatatcccctttatcattttttattgcatctacttgattcttctctctgctttattcatcttgctagtggtctatcatttttgttgatcttttcaaaaaaccaggtcctggattcattgatttcttgaagggatttttgtgtctctatctccttcagttctgctctgatcttagttatttcttgccttctgctagattttgaatgtgtttgctcttgctttctagttcttttaattgtgatgttagggtgtcaattttagatctttcctgctttctcttgtgggcattaagtgctataaatttccctctacacactgctttaaatgtgtcccagagattctggtatgttgtgtgtttgttcttgttggtttcaaagaacatctttatttctgccttcatttcgttatgtacccagtagtcatttaggagcaggttgttcagtttccgtgtagttgagcagttttgagtgagtttcttaatcctgagttctagtttgattgcactgtggtctgagagacagtttgttataatttctgttcttttacatttgctgaggagtgctttacttccaactatgtggtcaattttggaataagtgcgatgtggtgctgagaataatatatattctgttgatttggggtggagagttctgtagatgtctattaggtccacttagtgcagaactgacttcaattcctgaatatcctttttaactttctgtctcattgatctgtctaatgttgacagtgaggtgttaaagtctcccattattattgtgtgggagtctaagtctctttgtaggtctctaaggacttgctttatgaatatgggtgctcctgtattgggtgcatatatatttaggatagttagctctacttgttgaattgatccctttaccgttatgtaatgtccttctttgtctcttttgatctttgatggtttaaagtctgttttatcagagactaggattgcaaccctgcctttttttgttttccgtttgcttggtacatcttcctccttccctttattttgagcctttgtgtgtctctgcatgtgagatggatctcctgaatacagcacactgatgggtcttgactctttatctgatttgccagtgtgtgtcttttaattggagcatttagcccatttacatttaaggctaatattgttatgtgtgaatttgatcctgtcattatgatattagctggttattttgctccttagttgatgcagtttcttcccagcatgaatgttctttacaatttgtcatgtttttgcagtggctggtactggttgttcctttccatgtttagtgcttccttcaggagctcttataggacaggcctagtggtgacaaaatctctcagcatttgcttgtctataaaggattttatttctccttcactgatgaagcttattttggctggttatgaaattctgagttgaaaattcttttctttaagaatgttgaatattggcccccactctcttctggattatagagcttctgccatgagatccgccattactctgatgggcttccctttgtgggtaacctgacctttctctatggctgccgttaacattttttccttcatttcaactttggtgaatctgacaattatgtgtcttggggttgctcttctcgaggagtatctttgtggcattctctgggtttcctgaatctgaatgttggcctgccttgctagattggggaagttctcctggataatatcctgcagagtgttttccaacttggttccattctccccgtcactttcaggtacaccaatcagacctagatttggtcttttcacatagtcccatatttcttcgaggctttgttcatttatttttactcttttttctgtaaacttttctcacttcatttcatttatttgatcttcaatcactgataccctttcttcccattgatcaaatcggctactaaagcttgtgcattcatcaggtagttctcgtgccatggttttcagctccatcaggtcatttaaggacttctctacactgattattctagttagccattcgtctaatcttttttcaaggtttttagcttctttgtgatgggttcaagcttcctcctttgctcggagaagtttgattgtctgaagccttcttctctcaactcgtcaaagtcattctctgtccagctttgctccattgctggtgaggatctgagtttctttggagggtgactggcactctgatttttagaactttcagcttttctgctctgttttatccccatcttcatggttttatctacctttggtctttgatgatggtgatgtacagatggggttttggtgtagatgtcctttctgtttcttagttttccttctaacagtcaggaccttcagctgcaactgaaggttccaactctgttggagtttgctggaggcccattccagatcctgtttgcctgggtgtcagcagtggaggctgccgaacagtggatattgctgaacagcaaatgttgctgcctagtcgttcctctggaagctttgtctcagaggtgtacccagctgtgttcggtgtcagtctgcctctactggggggttcctcccagttaggccatgctgggagaaccactactctcttcacagctgtcagacagggacatttatgggataaggaaacctgcagaggtttctgctgccttttgttcggctatggcctgcccccatgggtagagtctacagaggcaggcaggcctccttcagctgcagtgagttccacccagtttgagtttcctggctgctttgtttacctactcaagcctcagcaatggcgggcacctggccctcagcctcgctgctgtcttgcagttcgatctcagactactgtgctagcaatgagtgaggctccatggtcatgggaccctctgagccaggcatgggatataatctcctggtgtgccatttgctaagaccattggaaaagtgcagtattagggtgagagtgacctgattttccaggtgccatctgccacagcttcccttggctaggaaagggaattccctgacccattgcgcttcttgggtgaggcgatccctcaccctcctttggctcacacttggtggactgcacccactgtcctgcacccactgtctgacaagccccagtgagatgaacctggtacctcagttagaaatgcagaaatcacccgtcttctgcgtcgctcatgctgggagctgtagactggagctcttcctatttggccgtcttggaattgctcccttgtcttattttaagaatggcccacagccacccaaactagcagcaaccacagccctgattaagttagcatccatcaatatcgaggcaggactgtccaccagaaaaaagattctgactccctgaagactcagatgatcattatcattttttttttttagcaataaaggatttttaaattaagatatctacatttttaacataatgatattacacattcagtattatcagtgtagcataaacataacttttacattcactggaaaacgaaaaaaattgtgtgattcagtttattgcaacattcacttcattgcagtcatcagctaccaaacctgcaatattgatgtatgcctgtattgtgcattaagttcaaaggccaaaaagatggtaattatatgataaaggtattgagcattttaaagacattttcttaatatgaagtatcacaatcattcattcttcaagctttcctaaccattttttcttcatgttatctcacttttttttttcaaaaaggagatcagaaggtgagagttaacaaattaaaacaatatgataacaaatatgagatgctgcttgtaactagggaaacagtactcctttaaagcctcaactttggggcaaattttttgaatttatgcttcttaataaatttaactggagttattctaagatgtaaatactagtgaaactttaagagtttaggataaatagttcaatcatattttttaggacaaactatagccacttttgtgctatagtttcaaagttgagtaattacaacagaaaacatttggcttgcaaagcctgaaatatttactatgttgctccgtatagaataaatttgctaatccccattacactttatttgtttcttattgagggtgggagggacaagattaaaatatattaagtgaagaaaaaggaatatagcctgaatatttatttttattacattacacagaattgttgacatcttgagggacaaccattaggtagcaagtagagtgttgcataaagtgttttcacttttgtaaaccacaaaaaagacaaatttttttaatggatctcagcaatagacttaattttaaaatcccaacactgctgttggaagattgtgctgaagggctgtgagcaaacctgcagtttttgttaaagaatcaactttggctcccagtgggtaatctattcctgttccagttgctgtagctaaagtgaattttttttgtgaatgtttccaactactatataatggatgtttgccctaaatattgctggttaatttaatcttcttttgtggagtaggattccaatgagtcactgtaaatgaatgatattcaagtggatctttactggaagatagaaaacctaacacctagatctacaaaatctttgtagtttggctgagtgaatccatggttgacaaaaatgtattgcagataaataagtttacattttagaaaactgttaaagtaactgggaaaacaattccaatatttaaagaaacacactgataaatgagcgtttccgttattttttattattatttatgagattaaaatgcaacatgatattagatttttcaaaagcatttttgaaatgattttaaacagtcaaaaatctttttttttaaaaaaataaatgctgttaggataacaaaatgtcatttaggataagatacaattagatatattactcacattatgtgcaagaataatataaaaatggttgagagaattaaatgtaaacaatgaaacaagttctgggtgaatgtaagggtatatcttatataatatgactatatagaaatgctttctgaattgactcaatattcagatgcaacaaaattacagattgttaaatttcactgacagacacaaaaacttttcatgacaaagtgcaccgtaggcaaagtcaaaggacaaataaaaatttagagaaaatatttacggaagatacaaataggcagtagactgttaaatagctgaaaagagattcaactttaaatgatgagaaaaacggaaaagcaaaactacactgagatacctatgatattgacaaaatctcaaaaatttgaaaatacactgttggcaaggctgtgggaaacagtcattctcatgcattgcatctgggaatgaagagtagtgaaaccctatggaagagaacttggcaatatataagaaaaactatttgtgcatttatctttgactccaggaattgcactttcaggaatttatcctgaagatacaggcccaatagtacaaaaatacaaggttattcattgaaaaatgatttatagttgtaaaatattggaaattatgaaaatatccaaacttagttgaataaactatggtaaaaacatacaatggagtattaagcatctgtaaaaagaatgaggaagatatttatgaaaggtatggggtgatttttcaaaagatgataagtgaaaaaaacaaagtgcaaaaaagaacatgtagtatgtttccttttgagtaataaagaggaggaaataacaatatgcatataccaacttatctgaataaaaagaaacagaaaagctaagctggtacacatagatgcagcatggagcaggaggaacaggggagctcctgatgcttctctgactatgcttttctgcattgttctgacttttagatggaggttaatgtttatatatttaaaaaatttaaagagataggaagtaaacaaaaaactaaaactgataagccagtgaacacaattgttttcaaatgaatagcattagtaaactgaaaggggacatagaaaaaggaaaaaaaaaagcttaatttttgtgactttggattttattgcctgccccctttgttgccacggggtaagggaaaagtggacaaaaaacttctaggagtagttttcttattttagtggtattggtaaagcaattccaaaattctacgtgtatttttggaagaagggagatacaaatgtagaatttaggaaggcaagggaaaaccccatgagatagattggaattaatgttatcagtaagaagtcatgatttcggatacatatgtgtatgtttgtttttacatacatataaatatacgtgtatatccatgtgtatttatacatacacacacacacatacatatatatgtatatgtacactcacacacacaaatgcatacatatatgcttctaggccctcttagtaaacagatattcaagctctgacacccaagaataatgagcacttttagtgccctgaatcctgttttttttttaaataccattccccagtgaatggacccagggttccaccaagaaatggctgattacagaactggggcaacaagagtccaaggtaagcctggagaaacttttgatgtcagataataaatgttgaaaaaattataggagtttatcaaaaggtcacaggggatatcttgaaggagctctcactgtaaaatctgagataatttaatctccaaataattaaggatagcaaggaataataaattgtttaacaacagaattcatgagtctatattagtattaaagagatggcaaatagatggattatttaattgaataaatacataactgtggaagaagagagggctttcccttatagtagaatatcaattgataaatgtgtagatggtactagagttggaaaatcatcactttgcaaccaccataataaaggttagtcaagagtaaggatcatcaatggatgataagtctatgggaaattatgatgcggagcatggtttaaagtgtcctcctacagactgccaataagttggaaaagaaaaaatagtaactctagactggggaagctggacggcactttatccaggtgattgtaaatgaaagcaatgaactttgtttctgcatgtgacagcctacaaagcacacagcgtctcttatgtattagccttcccacatatatacatgtatatatagcctgcatttaatcatgagcaaacaccagacaaactcaaaatgtgaaatattatattaaggaaacaaaaaagatgcataaaccctcatattcttcaaaaatgtaaatatcatgatagaaaaagaatggatgaggaaatgttccagatttatggggactaaaaagacatggcaaccaaatgtaatacataatcctcgacaggatcctgtataggaggaaaaacagcagtcttataaagaacaaaattaagatcattcataaaatgtgaatattgttgatagattaaatgaaaatattgtagtaatgttaaattttctgaagttgataatgaaactgtgattctgcaagaggatgcccttgtttataaatatataccaaaatatttattatttagggataaaaatatatacatagacatacacacaaacatacctttataaagagagagacaaatgatgcaaatagggcaaatattaacaatgggtgaatctcagtaagactacatgtttttccttgattttgcaacttttctgaaagcttgaagagattttcagctataatgtttttaaaaattagatttctgtcatttagtccctgaaatcttaataaggagacaatttaactgtaaaatacttaggacactgagaaaaaaatgatttgatcatcatttatgtctgaacatttaagaagatatatcaaaatctatgaaatattatactttagcttatgaaggaagccatatatattaaatgctcctaaatgtttaagtatctaactaattttgtgagtaagatttccttgaggctttggtctccattttcttgtctacaagatggggctactagggcctctgtacctttctgtgtattacaaggcaatgcatgatttagtaacttatagattaaggggaacaaggagttaactaaatgataaaaaaatgataagacagataagagagataagaacatactgtaaatgttcagaggtggaagtgattgcatctggatgggaaaacagttaaaagttcttgaaggagcatttaaattaaacttaaaagacaggtaattctttaataacttttctacattttgcctattgttttctataggactttagactattattcatgaaatgtagaaaaaaaatgttacttgcagtattgacagcaattctaataaagtaacactttttcattttattgtaacaattagttcaccctatcaaaataaacaatatgttttcttaactagagaaaaatatcattattgatcaattgataatgaaatggcaaaagctggtcttgaattcctgacctcaagtgatccacctgcctcaacctcccaaagtgctgagattacaggcatgaatcaccacacccagcttgatatgtttcattttgaacattggtatttattaaagcaccaagaaaagctgccataacctctgatcagagatcccctttgttaaaaatttttcttgtcttaattttataaataagtcaatagctgtataaatatatacacaccaaaatgggataatcaaattatggatatataatagatgttttaataattgtaccattatctgagtgaacgtgattttcaattcatttgggcaaagaccaaggaacacaattgctggaacatagggaaactatatgtttactttgtaagaaactgaaaaactcttccaaagtggctatataattttacattcccatcaccaatgattgagggttcctattgttccaaatttttgccaacatttagtgttgtcagtgatttcgattttggccattcttataggtgtgtagtggtatctggttgttttaatgtgcatttcctgatgacacatgatgtggaacatcttttcatgtgcttattttccaaagacagttttatttcttccttcctaacctacatatcaatcattgtctctgattactgtagctttataataggtctcaaagttaggtagtgtccgtcttctaactttgttttttttcccttcagtattgagttggttattctgggtcttttgtttctccatataaactttagaatcggtttgaaaatgcctgtgtatcttttttggtgaggtacgtgttcaggtctttggtccacgttttaattggattgttttcttattgttaaattttaagtattatttatatattttgaataacaatcttttatcagatatgccttttacaaatacttcctcacagtttgtggcttggcttccaattcttttaacattgtcttttgcagggcagagtttctgaattttaatgaagtctgatgtatgaattggtgttatatctaaaaattcaacattatacctaaggttatctaggttttgtcctcagtcatcttctagggaacttatggttttaaaatttacatttggatctatgatctattttgagttaatttttgtgaagagtgttaagatcagtgcctagattcattttttttgttttgttttttgcatgtggttgtccagtttttccagcaccatttgttgaaaagactatctttgttccattgtattgccactgctcctttgtcaaaaatcagttggctatatgtatgtgggtctatttctgggttctcttttccattccattacctatttgcttattcatttgccaatatcaatcattgtctctgattactgtagctttataataggtctcaaagttaggtagtgtccgtcttctaactttgttttttttcccttcaatattgagttggttattctgggtcttttgtttctccatataaactttagaatcagtttgtaaatatcgacaaaacaacttgctgagatttcggtggggattgtgttgaatctgtagttcaggttaataattgacatcttgacaatattgagcctttctgttcaggaacagagaatatctgttcattgatttagtttctctttgatctatttctcaaagtttatagtttgcctcatgtaaatcttgttagacatattgtattagatttttacttaagtattttatttttggggtgctaatacaaatggttatgtggttttaatttcaaatgccacttgttaattgctgtgtatagaaaagcagatgattttgtatattatttcctgtgcattgttataatcactagttccagaaattttttgtagattatttgggattttgtgaatatacaatcatgtatcttcatatatctgtgacaaagacagttttatttcttccttcctaacctacgtatgttttatttcctttccagtggtggaaagggacatccttgcctcgtttctgatcttactgagaaaattttgagtttctaaccattaagcctgatgttagctgtaggttttttgtagatttttaaaaaactcaatttgaggaagttttcctattgcttttttgataagagttttttttaaattttattttatcatggttggccattggatattgtcaaatgctttttctgcatatatttatataatctataatgatgtgatttttcctctttagcctgctgatgtgatggatgataataatttattttcaaatgttgaacctggggtaaatcacacttgatcatgctgtattataattcttttcatatattgttggattttatttgctaattatgttaaagagttttgtgtatgtgttaaagaaaggtatcactctgtggttttagttttttcaatgcatttgtctgattttggtattagggtaaaatgctgatctcatggaatgaatcaagtaccctagaacttaaagtattttatttatatatatatatatgaagtattccttatacttttatcttctgaatgatagtgtagagaatttgtataattttctccttagatgtttggtagaattcaccagtgaacccatctgggcactgtggtttctgttttggaaggttattggttaccgattcaacttctttgataaatgtaggcctagtcagattgtttattttttcttgagtgagttttggcggattatgttctccaaggaattagttcattttatttagcttatcaaatacatgggcctagagctgttcatatttattatcccttcagtttccatgaggtctgtagttatatctcctatctcacttctgattttagtaatttgtgccttctgtctttttttcttagttagcttagctagaggcttattgatattattgatcttttcaaggatcatcttttggctttgttgattttctctatttcctgttttaagttattttctactctaattttcatgttttttttaattatgcttacttaggatttaatttattaaggtggaaacttagatgattgattttagattgttcttcttttctaatatatgagttctgtgctataaattctcctctaaccactgctgcattgcattctaaaaaatttaataaattatatttcactctcatctagttcaaatatttttaaatttctccagagatttcacctatctgttatttttattttttattgagacagcatctcactctgtcacccaggctagaatgcagtggcacgatcatggctcagtgcagcctctacctcctgggctcaagtgatccttgaacctcagccatcagagcagctgggactacaggcgtgtgccaccacgcctcactaattttttatttttttgtacagatggtgtgtccctatgttgcccaggctggtcttgaattcctgggctcaagtgatctacccgccatgtcctcccaaagtgctgagattataggcataagccaccatgctcagcctcatccatttgttacctagagatatgttatttaatctctagaattttgggatttgccagcagtctgttgctaacttcttgtttagttccattgtgtctgaaagcagatattgtgtaatatatattcttttaaatttgttaagttgtgtttggtggcccagaatttggtctgttttagaaaatgttctatgtgaggctgagaagaatgtgtaatctgctatgttggccgtgatcattttcattaaatatttttcaatttaatttttcaacctctaagatcatactgatcttaggaacttgaaaagttgaaaaattattatatacatttatgcacatatgtacatatacacataaacatacatacatacaatacatatatatacacatatatagacatatagacatattattcatatgtgcccatcgatacagcaattgtactctatttgtagtatttgaaatagatactgtcacatcatagtattgagtttattaaataccatctgagtatgctaggaatgaactaatttttcaaaattgtgcattattttgcatctcagggtaaaagtattttaaaaattgacatctcgtaaaagatatctcttgaaaaatataaatttagaactgaaaatagcaggatatttctctttgcacatttttctctctctgagattaagcaaaaaagtagcagccaaataataaaactcttatattttctggtgtagacataccaaaactagttagcaatatgaaacctacacatgcacacacacacacacacacacacacacttacacattatagaaataaatgtattttcttttgtgattttttttcctatttgaactataaaataaggagtaacttcaaattgtattaaatcttagaatttcataaagattgcataatccagctaaagatgaaatttctagggataatataagcagttcatatatctgtgtgtagcagtgatgtttctgataataattgtatactggtttgggggtttttctttagagtcatatatattagctcatttgcacagttactatgtgtaaaacatgcacattttttgaatagtagttaaaatctggaaatgttgaaatgatgcatttatatttagatatttagtcatgtgtatggatgtggaaaatagcaatgatctgataagttttgatttattccaaaagtcaccatggtataaagggggttttccacatttttctgatctacttcaaggcagaatttgaatagacaagtgattctcaagagtgcctcagaatcacttgaagggcttgtgtaaagtgataaagagatggctaggccccacccctcgagtttttgataaaggaagtcagatatagggctgaggtggtgtatttttaacaagttctcagatatagctgatgctggtagtttggaatcacaccttgcaaaccaatggagtaatagataatggacaattttctaataaaatcagcacataattatttctactaagcaaatctgaatcatgaataggactgacagcctttcagatccacattaaaggaaactaactcttctgtctcggtactgatattattggtattataaatatgcagtaaataacacataatggagacatacctattctactagatctctctaggatcttaagttttgttatttaaataattgataaaaattagaaaagaatatgccaaatagttgggttcttttcctgaacaaaaagagtattttttgaaccatgcatgaaattcaaggaatgtaagtaaaaattgaaatctatattgagtgcctctgctgaactaaaatggatattttaaagtaagtgcccttgatgggatatttagatgaaaatctatattttttgtcgtattatattttgcaatgaaatccacttttatgaaactgaattcagaaaactctcatttcaaagtaacctgaagacaaatggatattcgttgtcaatcttaagatatattaaagttaatttgtgttggtaaaattttgagtgagtgtgctcttgtaaacacctgagtgctattcagcttaattgggttatagctcatcctgattgtgtttttctcctgctgtatctaatttctttttttcaatattttattgtttggtttgattttgaaggtgtatggaaattaaagaactctaattttttaagagccctaaagggaagtatgctttcgtgttagtcattcctgtgaacacctgtgcactgttgaatttaattgggttacagctggtgctgagagagagtcaactaaatgaggttttatagactggctagaaacttgacattgcatgtcattgcttcttccctcccattacttttctttctatacatttacaagatgcttggatctgaaagattttgaaggtaaattgaatgaacttatgatcggtgatacttggtagtgattacttcagaaaaagtgtacttccattatacgtttgtgcagtacctcagaataaggtgatcctaacctcagaagctagatggcctgcttgttgccagtaattcaggaacacaatgtaatactgtagttagattttcagagactggttattcaatcatatgagggttttcagaggaaaaaacaatgcgttgaaattgaaaaggtagtaaaaaattaaatattatagaaaccatagataacaaagtaaatgagggtagaatctatccactgagaggtaattatttttaatatctcaatatcatcattagaataagttcctcagtatggccaataacaataattaaataatttcaaataatttgttaaaaattaaatagaacaatttggcaacttctttagaaaatttaagatggctctgtgtttttctcttgagccaatatcatagactattaattagttcggcagataaaattgaatatacaaagggcatttgggaactaggagtaggtggcaatagagtaatatttaatggcactaaatattagaatcttcaactagatcccagttttagaaaactatattcctttttatttcaaataagtttgaaaatttaatagcattgaatgtttgttttgaatctattttacatgacagaaagcaaaatttaaaacaccagcaaaaactaacgaagtataaaacagcagttaaagtattcacttagtaaagcatttctaacatataacaaaaaaccttctagatgtattgctatgctactttaaatgtataatagagaaaaagaatttgctatcccactgttttttttttgaaaattaaactctgatgagtgacctacattttttcacatcctctgtgataaattaagaaagctatatattaagataaataaaatgtctttaaattcaatagaactattaaaaataggcattataatagaattaatgcatgtaaagtactaatatatctttcgtaatattcttgatcttgtgattaagccagcattttcccatttttgaaagatgaaactttcaaaatattatgggtcattcattttggtcaaattattcaacctggtgttctttgtgcacttgtctgatcagtaaagctttaggaagacagcttgctctcaggcactctccataagactgagcatataactgtgctggtcagttacaggagcaaaatgttcctttgaacctctatagattcaatggcaaacatgctggaggtctcactttgtagtacaccatcacccgtgcccaaatagggatgtgactatatcaagagagtgcagccattatgtgaggacagattcaggggacttgttagtttctggtaaagaaggagtgtaagtttaactactttccaaatgcggcctgatggagcatgcagagctgccatcccagcagagtaccttatcttggaaatgagatggatttgtggactgaggtgtgtctgaggagatctgatcacattggtgtcaactgaaggatgtggggagtccacaggctgaattatatacaataagggggtctacttaatttgtcctaaatcactgagattagaaagtttatccaggtttctaggagaaaaagtgagaatagggtgttttttttatatcacaggaatcttattaattttatgttcatgaagagatgcttggtgctttaaggaatgccagttaagtaatgggtaaatgagaaagaaaaaaaaattccctgcttgcctgattactcttttctagaagtaagtaacctggttttatggggctcaagactatgcctcaagttactacttttgtaaaacacaactcgccttactccaacttcatagaaactaagcttttgcaaatgtcataaacagctattgaatgtagtcagttacttttgcacagaataaaatatgaagaatatatgtttgcctggctcctgccatgatgcctgcccctgcttcttcgtgctccccatatccgtgtattcatttctagatagcaattcagccattgagcctcagacctagtacttgaaataaacataagttatttagaaaaccagctgcattttaacacattgcctgaggcaaccaactgggtcctgtgaactttatgcagttattattgacctgttttctctgttactccaaactaaatgtgtattatattgaggtaaccattatgcaagcaaatgtggttcttaaatatatttatgaaatgaagaaaatggtcagataagtggtaataattgtagtttagctgtggataaagttctggaattacttgataggaaagttttaagtctgatgatgatatctcaaatgttcaacttcagactctggaacttagtaagctatcacttatgtatttatgagatttgctgtgatagtaacattttaaatgcaaaggtacatttaattgagctttctctttttggcaacttgtactagaagaatgtacctaaattttcagtaagctgatcaaattaggagagcatctgtcttagcaatgtattattcatctctaaacaataatgatgcgggcagttgtattgtattgtcataattgaagttgcctagccatatgttatacaccctgaagacacacaaccacacaaaaattttaagtgatcatttactgattctgatattttacttgagaagataagcattttcaagtgcgccaagggaaataaaaatattacagagattttcctttgatacctaaccattaaattcaataactcataaatcaaaaaattttaaagcttattacgagtcaagaattgtggtaaatgagcagctgtggagacaagttaaagcctgataagatagaagccacctttcccaacactgataggaattgaaaaggaccattgaccctcaacctggaagccccacaaacacttcaaactctaaagcccaaatgcaattgccctccacaatcacacttctgcctagccaagcaaccaagctagagagaagcatctttgatatctggctctgtattgtttatcctctatgttaaaatctgtctacaagcactatcatttcaaattgctaaatatttcttgaaatgactctcttgtttacattttgtcattgatttcttcttaggcccttattaaatgatttatttctgcatttaagaaattctagactgagtactactatgtatcaattctgtgccagttacatgatgacaagagagaacatggtcttaggtagcttcagtggtgtgggtaagacagatataagaaacaaaccattttgtataaggatacattccataataaatggattacataagaagatgtacctaacatagcctttatgctggacctttcatcctttattcttcatgtattttatgcgtgactcagatgccaaaatccctatgcctgggcaacccatgcattctttatgtttttgtagattttctacatttcattttcttaaaagtatacacagcagcactggattaattatatacttatttgtctagttatctagttattcactgtcaagccataagtttttaaagagcaggtatcatgattatttattgaattcctaggtgatgagaaaacattgtttgtatgagatagtgcaaactctccctgggtattggatggaaggcttcattgaggaagtgaacttgagttgacttttaatataaattaaattagaaataaattcttaaaggaaattaaaattttaatagaattagacactttccagacagaaaggatttcagtggcaatgtgaaagcaaatgtgatggtgtgaaataacagaataacatgaaatgatccaagagctgtcagtagtttggtgtggctggggcatactgttttgggaaggagataccagaaatcaggacgggcatgggtagagaggctagaaatggaagcaccttgtacattttgcagagaaatgtaatcattatatgctgaaatctcagaagtagactgagttttatttttgcatattacctaggtagcaatgagtaattattttttttaaaactttttgggtctcatactcctcatctgtaaaatcatgattataatagttattttgaggatcagatgtatgtctataagtgcttagaaaaatgtgtggtccatggtaaacattcaatataagctggctggttttactgtcattatgacttttgtcttcattattattaaatatttgagggccatgagataatcttaaagcaattaagtaacatcataattacattttagaagggaaactgtgttacatagggagaggaaggactgaaaatgaaaactgaattaaaaaagataatttaagaggctttatgacagattttttgcttaaacagcattgtttaaatattatatttaaaatactttaaattaaaagttaaatagttttaagctgtgaaaagcatccacaagcaatggtgatggttacttatttaaaagataataaaaaatagatgagacaaaagcacagaattaattcattaatgtacaagatcacttttattattggggtattcgtattcattaataagagagcatagtgtaggggaaattaaatgctttaattaaaaaattgagatatttagagatacctggcagacaattacatgatatgatagcagtgctaaacgaagttctggtctctaaagagaggaatcagcaacagaaagtaaatgagcacagtatatccttcatcaagcctattttactaccaaggaaaaaaaaaaagtcagctgatctaaaccatgtttaggtccttaaggacagaagagcttatatacattttgatgcaagtttcttagctcagggtagatcagaattattcttggaccagtgtgcagaccagtgtttgaggagcactagtccagagcttaagaaaattaagagaattctgaattataaatattgagttaggactatacactagtaatagataaaatttttggaatgtaggaaaacattaaaagaaatcgtgagatgtgtaaaaaaaattaaaccacttaattttaaaagtgggcagagaggaacaccaaaaagtaatactcatggaattagaccatgaacaataagagcatggcacactgacaagaggataggcagcaattctcaaagggaggaaggctccccaagggaatgatcatgcaagacatgataattaacttactccttcagaaaatgctggatacttataaattcactctagtcttgacttttccctatcagatagctaagatactagatctatagtttaaagatggctatatgacttaagattgacaaagaagtttatctgttttatgtgccaaggtgtcctaatggagggaaaaacattataggaagtaggaggaaattttaaaatgttcatcattgtaatttatgcctataaaacacttcaatttttatccctatattttatgcctgtcttcagaggggtaatcaattcctctaaccactgaacagggattctgaagagactttcatatagctgctgctgtttcttagtttcctgctcccagggttttagttttagcttgctttgacctgctaagtcagttaacatgtactcatcagctttcaggtccaagactttttaacatctctttgtggtgtttcttctccaattctctcttcttttgtagccttagttttatttttcctgtcatttggtaggaattggggaaagagcaaatataaacttgtgctaacactacccacttccctgggagtccaaatttgtaatatgtgaggtaaatttatagtcatgctgaaataacaatcctttcttttttagtgattcatttacctttcctctgaacgttttctgttctaaagtatgttttcatcactttcctatttttataaattatataggtagaactcatgtagaatagttctaaagtctgtatcatttccattcttctctcagtctgattctaattgatgtgacttgagcacaacaaattattgccttgagcaaaacactgatttaagccactccctctctcttacatcatgctagggctaaaatttctgtttcactaagacgcaaatgtgcagttgctatcacttattgcctatgcaatttgttttgtctttttaaaaactagatctcttacatatagaacttactttcttgcttggtttttcagatttaataaatgcatctatcagcttttccttaaaccttttattccattatataaatcattttgttgatctcactaatttctatatctctacctttaaaaagtaaatagtattaagtgctgaagttaagtagtactaagaagggctcagattcaacacatcacatttctttacataagtatctttcaaaaagttaaataaaattatgtaatagacttttaagcaatatatgcttttcaatgccttcatatcccttcttctttgctattacttgtagaatacctaatttgtccatatattattgatcatttattatctaggatgcatcattttgagtaactatttgcccttaaaatcacaagccatttattaacaatagttaaaatatttataattgtactcatctttggaacactatttgtagtgtttttatgtctcccttctgaaagcataactgcaaggcatgtgattatatcatttgtataattatcatctgtatagcatccctaaatatctagaaaaataaagtatcaactgcttgtaaaatgtatattatgaacatgttccaataattcaattacactgtgtttaattttcaattaagtctatggttgtaccattttatccccctgaattggtcttttggcttccttgttacctaagaaaaaagggcacagtggcacctaattaagtgatttagattgctgacattgatgccattaaaaatattgggtcattcaatttgatacacttgtggaataaacccagttcaaagttaagaactatttatagttatttacatttctaattcaatcatctgtttttcttcgagataaagaaaatgtgaagaatgagggaaataagtaatacttagtgattactatgatccagatattgtgctgttttatttatttaatcttcattacctcacgtgcccatctaaatagatacccattttttgactttcagccattaaaataactaataatataaaatatctaatgcagtttaatatggtgaattatatatgtgtattctaagacatatatagttatatactatgctacatagatatactatatagtatatactatacaatatagatatactgtatatatattacatataatatactacattgatatactatatattatatataatataacatatcaatataatatatatatactttttttattatactttaagttctagggtacatgtgcacaacgtgcaggtttgttacatatgtatacatgtgccatgttggtgtgctgcacccattaactcgtcatttaaattaggtatatctcctaattctattcgtcccccctcccccaaccccatgacagaccctggtgtgtgatgttccccaccatgtgtccaagtgttctcattgttcaattcccacctatgagttgagaacatgtggtgttttattttctgtccttgcgatagtttgctcagaatgatggtttccagcttcatccatatccctacaaaggacatgaactcatccttttgtatggctgcatagtattccatggtgtatatgtgccacattttcttaatccagtctatcattgatggacatttgggttggttccaagtctttgctattgtgaatagtgccacaataaacatacgtgtgcatgtgtctttatagcagcatgatttataatcctttgggtatatacccagtaatgggatggctggatcaaatgatatttctagttctagatccttgaggaatttccacactgtcttccacaatggttgaactagtttacagtcccaccaacagtgtaaaagtgttcctatttctccacatcctctccagcacctgtttcctgactttttaatgaccgccattctaactggtgtgagatggtatctcattgtggttttgatttgcatttctctgatgggcagtgatgatgagcattttttcatgtgtctgttggctgcataaatgtcttcttttgagaagtgtctgttcatatcctttgcccagtttttgatggggttgatttttttcttgtaaatttgtttaagttctttgtagattctggaaattagccttttgtcagatgggtagattgtaaaaattttctcccattctgtaggttgcctattcactctgatggtagtttcttttgctgtgcagaagctctttagtttaattagatcccatttgtctattttggcttttgttgctgttgcttttggtattttagacatgaagtccttgcccatgcctatgtcctgaatggtattgcctaggttttcttctagaatttttatggttttaggtctaacatttaagtctttaatccatcttgagttaatttttgtataaggtgtaaggaagggatccagtttcagctttctacatatggctagccagttttcccagcaccatttgttaaatagggaatcctttccccatttcttgtttttctcaggtttgtcaaagatcagatgtttgtagatgtgtggtattatttctgaggactctgttctgttctattggtctatctctctgttttgataccagtgccatgctgttttggttactgtagccttgtagtatagtttgaagtcaggtagcatgatgcctccagctttgttccttttgcttaggattgtcttggcaatgagtgctcttttttggttccatatgaactttaaagtagttttttccaattctgtgaagaaagtcattggtagcttgatgcggatggcattgaatctataaattaccttgggcagtatggccattttcacaatattgattcttcctatccatgagcatggactgttcttccatttgtttgtgtcttcttctatttcgttgagcagtggtttgtagttttccttgaagaggtccttcacatctcttataagttggattcataggtattttattctctttgtagcaattgtgaatgggagttcactcatggtttggatctctgtttgtctgttattggtgtataggaatgcttgtgatttttgtacgttgattttgtatcctgagactttgctgaagtcgcttatcagattaaggagattttgggctgagatgatggggttttctaaatatacaatcttgtcatctgcaaacagtgacaatttcacttcctcattgctaatggaatacctattatttctttcttctgcctgactgccctgggcagaacttgcaacattatgttcaataggagtagtgagaaaaggcatccctgtcttgtgccagttttcaaagggaatgcttccagcttttgcccactcagtatgatattggctgtgggtttgtcataaatagctcttgttattttgagatacgtcccatcgatacctaatttattgagaatttttagcatgaagggccgctaaatattgttgaatgccttttctgcatccattgaggtaatcatgtggtttttgtctttggttctgtttgtatgatggattacatttattgatttgtgtatgttgaaccagccttgcatatcagggaagaagctgacttcatcatcatggataagctttttgatgggctgctggattcagtttgccagtattttattgaggattttttgcatcgatgttcatcagggatattggtctaaaattctctttttttgttgtgtctctgccagacattgataccaggatgatgctggcctcataaaatgagttagggaggattccctcttttcctactcattggaatagtttcagaaggaatggtaccagctcctctttgtacctctggtagaattttgctgtgaatccatctggtcctggactttttttggttggtaggctattaattattgcctcaatttcagagcctgttattgctctactcagggattcaacttcttcctggtttaatcttgggagggtgtatgtgtccaggaatgtatccatttcttctagattttctagtttctttgcatagaggtgtttatagtattccctgatggtagtttgtatttctgtgtgatcggtggtcatatcccttttctttttttattgtatctatttgattcttctctctttgcttctttattagtcttgctagcagtctatcaattttgttgatgttttcaaaaaaacagatcctggattccttgatttcttgaagggtttttttctgtctctgtctcctccagttctgctctgatcttagttatttcttgccttctgctagcttttgaatgtgtttgctcttgcttctctagttcttttaattgtgatgttagggtgtcaattttagatctttcctgcttctcttgtgggcattaagtgctataaatttccctctacacactgctttaaatgtgtcccagagattctggtatgttgtgtctttgttctcattggtttcaaagaacctctttatttctgccttcctttcattatgtacccagtagtcattcaggagcaggttgttcagtttccatgttgttgaggggttttgagtgagtttcttagtcccgagctctagtttgattgcaccattgtctgagagacagtttgttataatttctgttcttttacatttgctgaggagtgctttacttcctactatgtggtcaattttggaataagtgcaatgaggtgatgagaagaatgtatattctgttgatttggagtggagagttctgtagatgtctattaggtccacttggtgcagagctgagttcaattcctggatatccttgttaactttctgtcttgttgatctgtctaatgttgacagtggggtgttaaagtcactcattattattgtgtgggagtgtaagtctctttgtaggtctctaaggacttggcttatgaatctgggtgcttctgtattgtgtgcatatatatttaggatagttagctcttcttgttgaattgatccctttaccattatgtaatggctatctttgtctcttttgatctttgttggtttaatgtctgttttatcagagactaggattgcaacccctggtttttttttttgttttccatttgcttggccatatgtagaaagctgaaaccagatcccttccttacaccttatacaaaaattaattgaagatggattaaagacttaaatgttagacctaaaaccataaaaaccctagaagaaaacctaggcaataccattcaagacacaggcatgggcaaggacttcatgtctaaaataccaaaagcaacagtaacaaaagcgaaaatagacaaatgggatctaattaaactaaagagcttctgcacagcaaaagaaactaccatcagagtgaataggcaacctacagaatgggagaaaatttttacaatctacctactgaagcctcagcaatggctggcgcccctccccctgcctcggggctgccttgcaattcaatatcagactgctgtgctagcagtgagcctggctccgtggcattggaccctccaatctaagcacaggatataatctcctggtgtgccatttgctaagaccgttggaaaagcacagtattagggtaagagtgtccgaattttccaggtaccatctgtcatggcttcccttggctaggaaagggaattctccgaccccttgcacttcccaggtgaggcaatgccccaccctgctttggcttaatctccttaggttgcacccactgtccaacaagccccagtgagatgaacctggtacctcaattggaaatgcagaaatcacccgtcttctacattgctcatgctgggagctgtagactggagctgttcctatttggccatcttggaactgcctcccgatatatgtatattcttatccatacaacaaacctatgagaggtaggtgaaattattaacatagataataatgaagaaagtgcaaaacagagaaatttgttaacttgtaacatgaaattgcataataagagtcaagacccataagtgtgctgtattcaggagaaccatgaaattgcataatttgttaacttgtacaataagtagcatgaaattgcataatagacttctaagcaattcatgctttgcatcaccttcaaaccccttcttctttcctatgttgttcaagttaataaatttaagaagtcaaacagcagggtctcttttactccaaagcttatactgtttccagtatactatattgttttatgacattctagttaacatatcttttaatttgtttcttaggattcaatgtggttctttatttagtaatagccatcttgccaattgtgtcaataatatgtcgactctttaaagttgctaaatgtttattccttaccactgggactcatctgtttgtaaataagcagttccacaaatacacgctagtaaattctagagctgatagaaacagtagtgctagttatcgcatgttatgtaagaatgtgtcatttgttttgtttttaatatagctgacaatgtattcatgatttttcctggtacataaataaaagactttcaatttatagttaaaatgataatatcttcatgactgtacaacatgttgtataaataaaatattctgcttttattatattgttatccatgtttaatgaatttgagctatgtagataaaacttgaggcactagacagaataagtttctaagtcctcagtttttttattcatagtattgttagccacagaattattaatgaaaaaaacaacctttgtttatttgaatattctcacaacatggcacattgaagatgtgttttattttaaactcacatttcatacctaatattgcaaagcagacaatcctcactgtaagtattatttattgatgcttaaaacttcaatgaattattcagcccctttaacccttcttgctttgctgcacacctattgagttttcagagcagtttcatatcaataaatttgttcttgctttgctgctccaatttcatgcttggcctttctaagtgacatacaagaaaaataaataaatagctagaaggaataaaataagtatacaaattactttgaacaactcgagatccaaatcattaaagctctcaaagattttaaaaattaagatgtgaaagcaagtctacaaaaacaggctacatgcaaaaataataggcaaaaaccgtgtcttgttaacatgcaatctgtggagagtgaccatgtatttatacgcatcctgtacccggggttgaaatgaactctttacaaataagttcctaagagttcaaggacttactgccactttttatctcatgttgtcatgcacattagagaggtagacaagaagagaatgaacggcctttttagtatgtttgtgttactataaagaaacacttgaagccaagtaatttataaagaaaagaggtttatttggctcacagttgtacaggctatacaagaagcatcatgtagcttctgcttctgatgcgggagcttcaggctgcttccactcatggtagaagggaaacaggagcaggcttctatacagagatcacatggtgagagaagggacaagagagatggggaaccagctctacagggaactagtagagtgagaactcactcattactttgtggtcaacaccacccatgagggatccattccatgactcaaatatgtcccaggaggcgccacttccaacactggggatgaaatttcaacatgaggtgtggagagtcaaatattcaaactgtagtcatctcttctgtggagctagagggttgggaaatttacccactaactccatttgtcagtggtctattgccgtttcagtgagggctgttgatgctcctgcacttccggcttgctcagcctaggagctgatagtgctccaggccagtaaaaaaaaaagccctcaggccaaaagtgagtactaatcctttagcacagagatgaatgtctagagtacaacagcctcagttgtattaagataaagagagatgttcatgatgtttaaaatcagatgatgacatcaaaattgaaatggaaaacaaaaagtaaatatttcttttcacttcctcattcttctgactttgaaaacctcttaccttttatggatacagagacaaatatatctctgtctatggaaatagtaaaatgaaattaagaacaattttcacataacagtataatttagtataattctctactatcaattgtacaagaatgctttatctcatgatgcaagattaaattgttatccagttccaaaccaggtggttatatcagccagcctttttatgatgacttatttgcctttaagcaaatatattacatccaaccttttaaaatatttttatcatttcctatttttaatactgaatcctcagactgaaaattcaacagtttttgctttaaagttttacatctcttcctaaattttatttgcctgcaatctgatataggtgttcatagtcatctaaacatttctcttgttgttgttggctttgctgctggggcattcagtaattttcatgacctgtctccaggtgctttataatttccacatgccttgtatttatgaacaccagcttatataacattcagatagaaacaaaggaaaatgttatatatcacaatggcaggatgatacagctgtgaaggtagcagacatatacagtgctttatattttttaaatcattgctttaagattagatatgatgaatttcagatgagtaaaccaaccatagtgtactcctgtattttatctagaaaagtaatgataatggataccctcaggtcagacctgggtgttcatgatcacaacctctgtgtcttttcttggcaccttatttgctgtgggggaaaacaatttccattcatgtatcatactccattcggacaaagcaaacacctgaaacttagacaaatgttattcacatggcatcctctagatttctgaggcaaagacattggcaaaaacaaaaaaagaatcatttacaatagtgaatctcagtagaccttttcccctatctcagtaaagattaaacaatcttcttaataaactttgcattaggaacaattaaatggttcatttttgatgcagacatttatttgaatgattttaattaccacttaatatgcccttatattgcccaatttattcattttagtatcttataaccttgatttacatatttttgctgttctatttatcaccattcattgtaggttattagtgagatttaatttacactgacatttccagtgacacttaattttatattctttttccagatttaaatgtttctgtagttttcaaattttatttttaagccaacaaagtttccttcccatctccatgtgttctattttaaaaaattttcaaaagtaatttcaaaaacctttagttcagttataaatatagatttttattcttcccaagcaatactgtttatacattcaaaatcttatagctacccaaagtataatgtgatcagtgaatattactcttaaagtaaaaaatactaatttctttgtctttttcttttttctttttttcttttgcagagtctcgctgggtcacccaggctggaatgcagtggcactcagctcactgaaatctctgcctcctgggttcaagcgattctcctgcctcagcctcctgagtagctgggatcacaggcgcctgccaccatgactggctaatttttgtatttttagtagagacaggttttcaccatttggccaggctggtctcgaactcccgacctcaggtgatctgcccactgtggcctcaggccgtttaccacatattctctagattcgtgcaaaataaacacattgacagtaagttccttaactttaaagaatttccatatccttatcagaatcagtgtattaatgtgactgggaaaaggagaaaatacagcaaaatgacccaccattttactcagtcctggttttctttgtttttcttgaactggggaatttatcaatatcatgtctatttctaaaaagttacctagtcaaaagctttgtaagcaatttcactgttattcctactggataattgagtaaaattttggaggaggaagacattttaaatttcacttcttatattcaaatccaagatttttttcaatttaaaatactaaatactgtctttccatcatttttttttaccatagatgaaataacttaaagggtagtatgagctgagaagggaatacagaatgtaatttactcacatctttgtttgatctactatgaaaatttttaaaggcttcttttatgtttgctgccttgaaacatttgaatgaacttcatgaaagatgtactgagcatgtatacctttatgttctggttgcttgagtccttcgaaagctgaagaacctatttttacaaaagaattttctcaggtaccaagcagccaaccaatgataatcactagtttctttagaaaacttaaatattctctgccttattttattatggcaaaacatattatggcaaatgaaataaaggaaagtattaggaagaataaagagaaaaagaatgtataattttatgttacctttatgtaatttatctggtctatttcccttggttttgattcaatgaaatgtcaatttaggaattatttattttaatacagctttttttctaaatgttttataagcatgtatccaacaaacatgatttatgataatgtttaatcactaaacaaaatcaataacacaatatatttggaaaatacagcacattcagaagctagatttttagtgatcttagcatcatatactaaaaagtacattgtcttctgtatgaagtcacttcatccccaactaaaatgattatagttatgtgaagttaataatctgttgttagattgaagattcacaatatttatataattttatgtaattttataaattttcctataatatagattttagaaattactgtctgattactatcttttgggactcttctaaatttcttaaaatattcctctcataatattttgacatgagaggataagagctgcatctggagaaaagaggcttgggtgttattaagtcctcagtgttataccaattacttgcaagaaattaagtccaactgaaatggctgtactagaagattacttaagccatcctcatagatagaatttttgataagaatttagtgtcctttccaagaatcttcagtgactccctatttttcctctgttgctcagtatttctaacctattctgcaagggttttgaatgccttaatttatctgataccaccttccagataaaactatctggaagtaattaatcactaaatttctgcatatatacatatatatatatatatatatatatatatatatataaaatcttgactagttaatatatttaatattttgcttcccattttctgtgacctaatttgtgtgcttagttgtataatttatacacctgtatggtgtttattttagtaccaaacccataattatgattttttctctcataaggctgtgagtcctttgagagtttgagaaagggttttcattttttttttttcatcccactactgatattggagctagtggcacaaaaaaaaaatgttttggatgaacaagatagccaggattttgacccccaggatctttgcctctggtgttatgcctataaacatgactagtgttatgttgttacacagtaaaaaaaaaaagactttgcatatggaatcagtgggccttaaaatacatagattatcatggttatccagatgggcccagtgtaatccttggaccctgaaaggcagatgagggggaagtgacttcagcaagaagcagggttaggaggttctccacttgtatctcttcacagcaacaataattttgcagccatctgtaggaaaagaaaagtgactttgtaggggtattgggattcaggaaactccagtggagcctaagccctggaagaattgttttgagagggcagacccatgcccaggtggccagatctctaatcatggtcccaactccagagcctatccccctgtaaatatatctatattcctgtttggcttttgccatgccaccagaaccatccaccgaggaatcagggaagagtcacacccactcaagccttgagtgacagatccaccaactcagatccagctgtgagccatgaaacagctgtaagacacagctccaacctccctcaactatattctgaggccaatactgcttgtccagagacccacttggttaccaagtggaatctcttccagaaacctggaagaaggcacacacatctgtgaaattggtaacaagctctccatctgtggacatgaaagcaggtattcatcctggtgccagtgctactgactgaggtccttatggaagtccaacccacccagggaccagacaaatccataatcactggagtctccagtaacaggcccaccaaccatagactctgcggcagattcaacagtaggcacatgtcctggctcaaaccccaccagacaattatcttttaagcaactttatcatcccagataccaaacaggagaaggtctttacattctgagaccagtctgtaaagaatggaagtggtatttattccttcaaatgcacagatacctacacaaggctacacagataatgaaatatcttggaaacatgataccaccaaatgaaacaaataaagctccaggagctaaccctaaagaaggggggatctatgaattgcctaaaaataattcaaaataatgattgtaaagaaggtcaatgagatgcataaggaaacaaaaaaaaaacagataactaaatgatattaggaaaaaaatgcatgaacaaagtaaggagtttaataaagaattagaagccataaaaaaagaaacccaaacagaaatcctggagctaaaaaatacaatgatagaaatttaaaaaattaatggagagcttcagcagcagacctgatcatacagaagacttagtaaactcaaagataggttggccaggcatggtagctcactcctgtaatcccggcactttgggagacataggcatgaagatagcttaaggccaggagtttgagaccagcctgggaaacatagcaagaccttatctctacaaaaatgttaaaattaaatattagctagacaagtaccaggtttggtggcacacacctgtagtcctagctactcaggaggtggtagtgggaggatcactggtgcccagaaattcaaggtgacagtgagctataatccttccactgcattcaagcctgggtgacagagtgagaccatgtctctcaaaaaaagaaaatataggccaatcagaacaagaacaacaacaacaaaaaaaaacaaaaagaatgaaaaaaattaaaacaagcataagggacctatgggacaccatgaagtgtgtgaatatatgaattaagagcatcctagaaggagaaaagagaaaaagccagaaagcttatttaaagaagtacttactgaaaacttctaccatcttaagaaggacatggacatacagaataataaagctctggggatctaagcaagataaatttaaaaaatcatctaagacacattataatcaaattgtcaacagtcaagaacaaagagagaattttaaaagcaacaagacttgtcacataaaagggaacctacaaaaggctatcagcagacttctcagcaaaaaccttacaagccaggagagagtgggataatatattaaaattgctgaaagaaaaaaaaactatcaaccagaaatactataccaagaaaagtggtctttcatacgtgaagaaaagataaagacattatagataaacaaatgccaagagagttcatcaccaggaaagctgtcacaagaaattctaaaaggaagtctttgagttgaaacaaaatgctgctaagtaacaatgtgaacacttaagaaaatataaaactcactgctaaaggtaaatatatggtcaaatcagaatgctctaatactgtaatggtggcatataaattacttttaactttaacagaaatgttaaaagacaaaaatactaataactatcactacaataatgtattaatgcttacacaatataaaatatgcaaagtgtgacatcaataacattaaatttgagggggcagtgaaaatgtagagttcttccatgcaattgaagttaagttgttatttgcttaaaataaaattttataacactaagatgttttatgtaaacccaatggtgactgtaaggaaaaaaacctgtagtagatacataaaagagaagcatatcatttcaaaaaaattcacaaatttaaaggaaggcagcaagagaggaagaaaggaacaggggatccatgagacagccagaaaacaatgaacaaaatggcaatagtaagactatgcctatttattatctctttaaatgcaaatggattaaattctccaatcaaaagatgtagagtggccaaaagaattttacagtagaaatccaacatttgctacctatgagagaccaactttagccataaagacaaacataggttgaaagcaaaatgactgaaaaacaaaacccatctaaattgtaaacagagcaaaggtgactatatttatattaaacaaaatacacttacaattaaaaatatcacatgagaaacaaagaaggtcattatataaaatcattatataatgggttgattgattcaagagaacataacaaatgtaagtataagtaagtgcatcatatgcacccaaaattgacacacctatgtatataaagcaaatgttagtagaactgaagtagatatagacagcaatacaataatagtaggagacttttataccccactttcaacatgaatagatcatccagacacaaaacctataaggaagcagtggacttgaatagtgctatgtggcaaatagacctaacagatgtatacagaacattccatctaacagcatcagaatacacattcatcttaactttactcagaatattctccaagatagcaattgtgaatgggagttcattcatgatttggctgtctgcttgcctcttgttgatgtgtatgaatgctagcagtttttgcagatctattttgtatctgaggctttgctgaagtggctaatcagcttaacaagcttttgggctgagttgatgatggggttttctagacatggaatcatgacatctgcaataaaagataatttgacttcctctgttcctatttgaatatcctttatttctttctcttgcctgattgccctggccagaaattccaatactatgttgattaagcatggtaagggagggcatccttgtcttgtgctggttttcaagggaaatgcttccagcttttgcccattctgtatgatatggctatgggtttgtcatatatggctcttactattttgaggtatgttccttcaataccagtttattgagagtttttaccatgaagcgatgttgaatattatcgaaggccttttctatgtctattggaataatcatatggtttctgtatttatttcgtttatgtgatgaattacatttattgctttgcatatgttgaaccaaccttgcattccaggaagaagccaatttgattgtgttatataagctttctgatgtgctgctggatttcgtttgccagtattttaatagaggatttttgcattgatgttcatcagggatattggcctgaagttttattatttttttgttgtatctctgccaggttttggtatcaggatgatgctaactgcatcatcaggagtccctcattttcaattgtttggaatagtttcaccaggaatggtactcttattttatgtctggtagaattcagctgtaaatccatcttgtcctggtcttttttaattgataggctatttattactgcctcagtttcagaacttgttattggtctattcagggattcagtttcttcctggttcagtcttgggtaggaatacaggtaacaagggaagtgaaggacctcttcaaggagaactacaaactactcctcaaggaaatcagagagaacacatacaaatggaaaaacattccatgctcatggataggaagaatcaatattgtgaaaatggtcatactgcccagacgaatttatacattcaatgctattcccattaaactaccattgacattcttcacagaattagaaaaaaaaaactattttaaaaatcagatggaaccaaaaaagagcctgaataggaaagagaatcctaagcaaaaagaacaaaactggagtcatcacactacctgacttcaaactatatcacaaggctatagtagccaaaacagcatgacactgacaaaaacagacacataggccaatgtaacagaatagagaaaacagaaataagactgcatacctgcaatcatcttatcttcgacaaacctgacaaaaacaagcaatggggaaaggattccctatttaataagtggtgccgggagaactggctagccatatgcaggaaattgaaactggaccccttccttatatcttatacaaaaattaactcaaaatggagtaaagacttgactgcaaaaccaaaaactatgaaaaccttcaaagaaaatctaggcaataccattcaggacataggcactggcaaagatttcatgaggaacatgtcaaaaggaattgcaacaaaagccagaattgacaaataggatctacttaaactaaagagtttctgcacagcaaaagaaattatcatcagagtgaacagaaaacctacaaaatgggagaaaatttttgcaatctgtccatctgacaaaggtctaatatccagagtctacaaggagcttaaacaaatttacaagaaaaaaactgaacaaccccattaaaaaatgagcaaaggacataaatggacacttctcaaaagaagacattcatgcagcaaacaaacatatgaaaaaaagcctcaacatcattgatcattagagaaatgccaatcaaaaccacaatgagataccatatcatgccagtgagtatgatgattattaaaaaatcaagaaacaacagatgctggcacagctgtgtaggaaaagattggtggaagtgtaaattagttcaaccattgtggatacagtgtggtgatttctcactgatctagaagcagagatatcatttgacccagcaatcccattactcagtacatagccaaaggaatataaatcattctattataaagatacatgcatgcatatgtttattgcagcactattcacaatagcaaagatattgaatcaacccaaatgttcatcaatgatagactggatgaaggaaatgtggtacatatataccatggaatactatgcagctataaaaaggaatgagatcctgttctttgcagggacatggatggagttggaagccattatcctcatgaaactaatgcaggaacagaaagccaaacactgcatgtttttacttataagtgggaggtgaatgataagaacacatagatacatgtttaggaacaacacacactggggcctgtcattgggggtcaaggggagagagagcatcaggaagaatagctaatggatgctgggcttaatcctaggtgatgggctgatctgtgctgcagaccaccgtgacacatgtttacctatgtaacaaacctgcacattgtgcacgtgtaccctggaacttaaaataaaagttgaagagaatttaaaaaatattctctaggatagagcatatgttgagccacaaaacaaatcctaacaaatttaagaagcttgaaatcatatcaagtatcttttctgaccacactgttataaaattaaaaatcaacaacaggaagaaaaatcgaaaattggtaaacagtgacttgacacaaaagaatattgaaacataacttaccagaatgtatgggatgcaaacaaaaaagcagttctagaagggaagctgtgaccaatgcctacatttagagaaaagaaagatactggataaacaacttaaattcacacctgaaggaaatagaataaaagaacaaattaagcccaaagttagcatcaggaaagaaataatacagattagaactgaaataaatgaaatagagactagaaaaacaatatataaatcaacaaaattcagagattttttaattaaaaaaaaaaaaaacaaaattgacaaaactccagataggctaaccaagaaaaagagtgagactcaaataaataaaatgttaaatgaaagaagagaaattacaaattataccacagaaatacaaaagatcataatactatgaacaaatatacactattaaattgtgtaaccaaaagaaatgaataaatttgtagaaacatgaaacctgccgagactaaatcataaagaaatagaaaatctgaactgatcaataatgggtaaggagattgaatcagtaatcaaagaaacacccaacaatgaaaacctagaatttgatggttttacaggttaactctaccaagcctttaaagaagaaatacaaccttctcaaactttccaaaaaattaaagaagaaacacctcccaaactcatttactatgctagccttaccttgatactttggtatcaagtattaaagacaaaagctttgccagagaaggacattataagaaaagaaaattacaggccaatatccctgataaacgtatatgcaaaaatcctcaagaaaatgctagcaaaccaaactcaacagcacattaaaagaatcataaaccatgatcaagtaggatttatccatggggtacaagtatggttcaacatacacaaatcaataagtgtaatatatcacatttacaatatgtacagtaaaaatcatatgatcatctcaatagatgcataaaaatttttcaacactttttcacgataacaactgtcaacaaattaggtataaaacaatgtatctcagcataatgagtggtcatataaaacaagcccacagctaacatactcaatagtgaaaagctgaagcttttcctctaatatcaggagaaagacaaaaaaagtccatttttgccacctgcattcaagataatactagaagtcttagccagaacaattaggcaaaaataaatgaatagaaggcattcaaattggaaaggaagaagttaagttgtctctgcaaatgacatgatctaatatatagcaaaccctgaaaattcagtaaaaactgtcaagctaataaatgaatttggtaaaatcgtagattcaatattaaaattcaatttctgaaaagttacaatgagccacctgaaaaagaaattaagaaaacaatttcagttacagtagcatcgacgataacaaaatattaggaataatttgaaggagacaaaacatctgtacacctaaaattatgagattttgatgaaagaaattgaagaaggcacaaatgcaaaggtatctcatgctcatggattgaaagaattaatcttgttaaaatgtccatactatccaaagtaatctataaattcattgcaatccttatcagaattccaatggcatttttcagaataatagaaaaaaatctaaaatttatatggagccacaaaagtccaataatagccaaagcaatcctcagaaagaagaaaaatctggagacatcacatgtactaattccaaactatattacaaagctatggtaatcaaaacatgatggtactggcataaaaacaaactcatggacagatggtatagaatagtgagcctgtaagtaaacccacacatatatagtcaaaaaagctttgacaagagcaccaagaatacacgttaggaaagatgagtttcttcaataactaatcttgggaaaactggataaccacatgcaaaagagtgaaactggacccttgtcttacaacatatacaaatattaacacaaaatggattaaatacttaaatgaaagatctgaaactctaaaagtcctagaagaaaacatagggtaaactcttcttgatattggtcttggcaatggtttcttggatatgactcccaaagcacaagcaacaaaagcaaaaataaacaaatgggacaacagccacctgaaaagcttcagcacagcaaaggaaacaaagtgaaaatgcaacctacagaacaggagaaaatatctgcaaactatatgtctgataattggttgaaatatgtaaggaactcatctaactcaatagtgaaaagaaaacaaattaccttatttaaaaatgggcaaaggacctgaatagacagttttccaaagaagacataaaaatatccaacagatatataaaaaggtactcaacatcattaattgtcagagaaatgcaaatgaaaatcacaatgagatattacttcacgtctcttagaatggcttttgttaaaaaaacaggagataacaattgttggcaagtctctggagaagcagggaacccttatatgatgttggtagaaatgtaagtttgtagagccctgtggaaaacaatgcagtttcttcaaagatgaaaaatagaattaccataggatccagaaattctacttctggttatatgtccaaaggaaattaaattaatatttcaaagatatatcttcatcatcaggttgactgcaatattattcacataggcacaatatggaaacaacttaagtgtcagctgacagatgaatggatagaaaatgtgatagagatagatagatagagatatatagatggaaaatgtcttttagtcattaaagcaaaaagggaaatcctgccatttgtgacaacatggataaacctggagggtattatgctaagtgaaatagccagagacagaaaaacaaatcctgtgtgatctcacttacgtgtagaatctaaaaaagtctaacttacagaagcagagcgtagaattgtggttcccagtggctgggggttggaagaaatggggaaagttggtcaggggtacaaactgtcaattattagatgaataagttctggggatcacagctaatgtgaattagcatgggtggtgtgttagccagagatgtcctgtgaaacagaacagaagggtatacatagatatataaaaggagatctattacaggaattggcttaggtggttatggaggatgaaaagtctcatgatatgtagtatgcaaactggagaaccaggaaagcctatggtgtaattcagttggagtctgaaagcctgagaaccagagaaacagcataactctcgtccaaggctgaaggcctgagaaccttgtggagtcgtgggtgtaagtcctgaaatacagtggccagagtatgtgtaactctgatatcccaggcagaagaagatggatgtcccaactttggaaaagatggctaatttgtccttttactaattttttgttatatggaggcgtatcttctttattcagtctgttgattcaaatgctaatctcttccagaaatatatcatagacacacccagataaaacattttaccacctgtctgtatatcttgtaacccactcaagttgacgcataaaataaacgatgacaggtagtgatgagcatgttaatttgattgtagtaatcattacacagtgtaaatatgtatcaaatggccgcactgtacaccttcaatatacataatttacacttatcaattaaatattttaaaattaaaaattaaaaaaagttaaaaaaaaaaaccacaatgagaaaggaatgataaaaggaaaggcaggtaagctgaggcaactgaaggattttgattataaagggctttatatttcagctgcctttgaagataaaggaagccaggatcgaagaaatgcaggcaagctttagaagcttagattacccttggcaaaagccagcaagaaaaggggacctcagttctacaactgccagaaactgaattttgttaacaacctgcaagtgcctggaagtaaattctcttccagagcctccaggaaagaatgtagccctgtccacaccttgattttagcttagtaatactcatgatggactcctgacattcagaactgtgagataataaaacttttgttgttttaaccatgatgtttctggtaatttgttacatcagcaaaaaaaaaacccctgtacattaagttattgattgtatggttgaatatctttgctcctccctttgcctttacatccctttctctttacatactcacattcacctttccaggctcagcctagtcacaccacagcacagggatcttctctgatgattccggcttagactgatcattttcttctctgaattttcttatgtgtacaacacacttactgcattttgtgttgccttattgcctaattgtgtgtcatacttaattaccctgttaataataattttgtatgcatatattttgttttccatgtggatttgcaaacagagaattaggaggacattggtgcttatgaaatactcattgtttgattcatgttttttaattttcaaaatatttctaactaatcaagtaattcttaggtgattttttaaaaagaattccagtatattttgaaacagatttctggccttaattttgtataaaaaagaaaaaaacagatgcattaagataaaaggatcctgcacgttgcctttaggacatccagtaaatcaccaaaaagaagcaaagcatataaaatcaaaacatacacaacctttttaaaacagcaggtatagctcaagttctataacagtaaagcagctggtgttagcaatgggtaaataatttatataggactgagaggaagttggaaagacatttcaatgtcaactttttaacatataagattttcaaattaataaatatagcgtatttgtggttgtggctactaaaaataaaattcactgaaaattaagacataattctactaatgagtttattctagaaaacctgacagttttatatggcatgaaaatgcatatcttctttttatttcattagaaaaacatgctgaaatatagtattgtttttttcttttaaaaaaagtaggtctggcctggcgctgtggctcacgcctgtagtcccaacactttgggaggctgaggcgggcagatcacctgaggtcaggagttcaagaccagcgtggccaacatggtgaaaacccgtctctacttaaaaaaaaaaaaaaaattagccaggcatgatggaaagtgcctgtaatcccagatgctaaggagactgaggcaggagaattgcttgaacccaggaggtggagattgcagtaggttgagatcatgccactgcaattcagcctgggtgacaagtgtgaaactccgtctaaaaaaaaaaagtagttctggttaacggtagaaaaagaatataagcataattaggaacctgataatcagaggtttgcttagcaaaaataggtgaaagaaatacttaatattccttattttataaagaacaggcttgaaactaatttctaacatatagcttatgaaaccaagaaacttattttataggtaatgcacaaataagacacttagcctctagaattgaaagcaattactggaactttattcagaagagtttccccctatctacttatcttactagcatctcctaatataaattttagcctataaaaatactggtcatctccttcaaagaagttctaagaaaacaaaagataatatatacaaatcaaccaagcagtgttcactgagtctctgtattgtgcactgttcccgtcagcttcagaggagacagcaggcagagaaatgtcatatataagagaatgagttatgatctggtcaccagaaagcctgcaaaatagctgaagaatgaggaaacctatgtaaggaaataaaggcaaagagtacataacactgtaagaactcagcagatcttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaatttttttgtatttttagtagagacggggtttcaccttgttagccaggatggtctcgatctcctgacctcatgatccacccgcctcggcctcccaaagtgctgggattacaggcgtgagccaccgcgcccggccaagaactcagcagatcttaagaaaactcttagatctgcggaatttgggttggtttttgaaatgccctctcacactttacctttctcatcctactcaaaccttcaatatctgggtcaacagttatctcagctctatggagtaattttgttatgttcccacacaaaattattccactgttttacaaccactctagctatttcacatttatccacatttctagctatatgcacttggatagttacttaagcactctatgcctcaatgttctcatcagtaacataacagtttctatctcataggattattgtattatatgagtttctataaattagttagaacagtgtttggcacatagtaagtgcttgagaactgctagcttttagtataataatgttttatttttaggagccgatattataaaatgcaaggtcattaagagtaaaatatgccttatttttacagaagtaaatgtaatatctttccgagtataggtgattaatagctattgtttaattggtgtgagtatgtagaaaaagaaaatgttttaggtaagagaaacaagaaattatatgtgtggttgtgattaagctttcataccatagttcttgtttaattgaattagcttttaatattattcctctcagtaaaatgacttttatacacattaatttgacttgaattggacatgtatgtttaaatatgcctatttttataaaactatcctatgaatatatatgaactaggtgtaagcaatgtatggtttatatatttaagaaattaatttgtttctaataactatattttgagttagaaacactaaaagcgacagcatgaatttttagtatcctggcttaagagaaagaagataattgacatgtttgggtgaacatcttttacctcgtattttcatttttgctcaattttagaactaatgggaactttaaacttttttatcttgaaaaacaaaattgaaggaaatacttttgagaaactttgctgttagaaagattttgatttcattcccatcagaatgtcatataaattacacaaatcaaatctgtcgacatcccaagaatattataattacacgttcttatgaattacatgggaattgcacatactgtgaaaagcattgtaattgtaattattatgtaatatgtattataatttatcctatagaagtaacaaagtcttgtaattaaataaagtaataaatgtgttgctatattaccataattgacaagtaattgataagttatcttctttaggacaaaatggtcactagtaagaatggacccaattcaacttttatcttaagttaaaatactcattaaatttaagatgagcattgggtatctaaaataatcagtcatagaaatagagtcaaaagttggtttccatagactggtagagagggaaatgtggagttgctgctcaacaagtataaagtttcatttatgcaagatcaatacgttctaaagatctgctctacaacattatgtttatagttaacaacactgtattgtataccttacattttgttgaggatagatcttatgttcagggttcctaccacaatttttaaaattatactttaagactggtatacatgtgcagaatgtgcagttttgttacataggtatacacgtgccatggtggtttgctgcacccatcaacccatcacctacattaggtattcctcctaatgttatcccttccctagccccccacatcccaataggccccgatgtgtgatgttccccttcctatgtccatgtgttctcattgttcaactcccactatgagtgagcacatgcggtgtttggttttctgttcttgtgatagtttgctgagaatgatggtttctgacttcatccatgtccctgcaaaggacatgaactcatccttttttatggctgcatagtattccatggtgtttatgtgccacattttctttaaccaatctattattgatggacatttgggttggttccaagtcttcgttattgtgaatagtgctgcaataaacatacgtgcacatatgtctttatagtagattgatttataatcctttgagtatacacccagcaatgggattgctggatcaaatggtatttctagttctagatccttgaggaatctccacactgtcttccacaatggttgaactgatttacatgaccacgatttaaaaaaaaaaagaaaagtagtggattgactcatgaaaggtcaagaaacttcagaatgaaattttacacagaaatattcagaattttaaaaaaacttagtctattgtatttaatacaatttcaatttgaaacctatatgataaaatgtgtgcaattttaagagtatttttaattgaatcctaaatgtttcttgttgacttttaatttctgatttgtgtgtttgcatatttgtatgtaaattttggatacttaatagtcttctaaaaacaattttgaaaagtaaaacagactttaaatttatataaaaaaatgattccaacttttagaatgcttactatatgctgggtactaagcatgttatatttattgaaccctatgagtcagacactcatataagtgattcagataactcatttaaagctcactataatcctataagtagatgctgttaccatccccattttctaggtgaggagctagggcacagtatagtaaggtgactgtcctaacatcatagaataatgatggattaatggtattcaactctagcagctagttccagaatccaggctcttaatcaccatgctaaccatcttcattcaaatggaaaacagataaggaagatagaagtttaaggttgtttttctgtgaatgaagaacatcaccaccaccacatttatttaacagccttacacactttaaagtagcacttttcagatgggacacattgattgctccaaggggataggtacaaagtaaataaaatttccccacggcccatcctgctgtcttatcctggaaagtattagtcacttttctcaaagtgtgattcatgtaatatataacatcatgttaggtgctcttttcaaaagcttacctttcagtgggattgtatgtcaagaattacaaacttgtacgatcatgagtaagttacccagccattcaaggattcagtttttctatctgtaaacaatcccattagactgaatgagttctaagcatattttagatgagtttaggatatacaatggagaaaaaaatgcaggctttgtaggcagagggccagcttcactgatgaagttaccaatttactgaatctctacttttaccactgtgaaactgagatgaaaataatctattttacagaatggttgtgaggattaacttaactagctagtgcacattcaagaaatattagccattattcttataaaataatataataattgtatttactataaaatttgacccaattgcaaatgactgtttgtcatggagtttattactaagggaacttaatttaaaataactgacatggaattttaaatgatctggtgagatttaaatgattctgttagtatgcttttaatatgcttgattaaatgtctttgtgtataaatataaataccatgcttagtccagggatatagcttttatttagctcctaatacaaagtcccaattgctctgcaggtgattcacatcttgaaagggtataaaagtgattctacactcattttcaatccaacttgaatttctgtttcattattttctaatgaaattgaatttggtaatacttgacacctgataagattttgtttatcttgttataaaaaatagactaataaaacagatttccacagcgctcaatcttggctatagcattttacagccacataaaaattatcatccatccacttacaatattctatctttatggcttttcataagcaatattgctttcagtttggtattgaattttaagaaactaaaatataattgtacacattgtatatttctgtaatgaaattgagttaaacacaattgtctagattcctttgtcactttttatggacaacatttattcaaaatgcagtggacatgtgaacaaatttgggtctttataatatggcaaatgcagttgccttgcttttggaaaataaagcatcctaaaattggcatcaattactaattagaatgttagagtttaaaataagactatgatcttcagagagtgattggactactgagatcgtagtacatcatcactggatggtctaggtgcagtcccaacttgattttctttctctactcccattttcagatttttcatcagactctctagttgtttatttccaaccacctttcatgccctgtgtgtaattatgaataatatattcttttaagtattcgtaggtacagtttctgttccttactgttttcacttgtttcttagatttataggtattgataatgtgtaattctctccttttgatacattattgcattttagtattgtttgaaattcaatcgaatgaaaagtactttattaatcatcactctattgtctgtctattatttttcaaaatctttagaaatgcaaacaatgctgcaatcaacatcttcctgtttatatctatttatatgtgccaagtttcctgcaggtttctgaggtcttccttatgcttatcaattatgaaaagattaaaggcaaaaggatagttctgagggaaacatattacccctccaaggcaggaataaatacagcattgatttatcttgtatcaaattaaagagtttttgataatattagttcttctattatcataatactttttcttttcaagctattatttcatttttatgccatcacagaataaaatgtcaatattatgtactaatcctaccttatttctcccttaagaattttagattctgttttggtctttcagagacataatttcagatgttcttgactgatcgtttttgatatctatatctatttctctttcaatttaagtacgttcaaatgcatcttgcagaataatatatgatggaacaataatcttttttaaagaaaacaggtactacactataatatttagctattaaccttatttgtttttaaaagtacataaaaagtcacttgacaccaaaataaacatttgttaagaacccattacgtgcccaattctgttaccattttattatttattcacctaaatatactatttatttagatcaatacagtatcacagtgtagattaagaaagcaagagtgagaaagtaaaaatctgtaaacattttgaagcaaacatatgaaagcaaaattcttaattactaggtttttgttgatttttgttaataaggccacaaactttactgatatttatgcacacgataaatatacttaaattaacctgtcttacactcatgttgtcatgagtaaaatctcaagcataagaattttattatattttcatctgaaaatatattaagtactattgaatgtaattctattgtctataatctcagttacgtgtttttttcctttagcatgctttaaaagttaattaagataagtatattctatactagaaaatttttatcattataaaactatctatattaaacagactagatagatctgagacatacaacctatgcctcatttctatattttcacttcactagcaatgtgtttatagcattgtgtaacactttaaaaaatttttagctttcattgtttatatctcatgtattttacaaatacatcttatgttggaaaataattgagactagaaagacataatttatcattcaaatcctcttaaaatatcttggttgggatacttggtatatatgttcagaacataagtattttcacataaaattatatacaataagcattcaaaagaatagggggaaaaaagctattacaatggtataccatagtatttcagtcattgtgtttaaacttgtgcctgtgtgtgaatatagtggacatttttctcttagaaatattgtaaaaacagtttttattgcatagggtatgtgtattatttgaaacgtattagattttaaatttactttactacagactatgtgaaatctgaatattgacttcattctaacctgtgctgacttcccagttaaactattgattattttgcttacaatgcaccagtatgcacatgtgtgcatgggcacaactatttttactttgttaagattttatttgctgatacataaaggtaacaagcacccaatttattgctgaaagaatattaaaggtgttatttagttctcaattgacttacctttgaaatatgattgttttccaaaaaaagaaaacattatgaaatggacacatggcaaaacaaagaatatcattcggctaagttgaaaaccattttagaaatgttcgattatatgaatgtactacatatttcttttcctacttctttagcttctcaaatgaatgcaaactctgattcttttctacacttttatgagtgtgcttttgtacatctacataccacgactttttagtcaagtgctaaacctattaatgatggaaatcctctagcgttttattggttctttcattcatgtaaacaatctgttttattgtatataagccttttgtaaataaaaatttggctagcttggccgggcgtggtggctcacgcctgtaatcccagcattttgggaggcggaggtgggcggataacgaggtcaggagttcaagaccatcctggctaacacggtgaaaccccgtctctactaaaaatacaaaaagttagctgggcgtggtggcgggcgcctgtagtcccagctactcggcaggctgaggcaggagaatggcgtgaacccgggaggcggaacttagagtgagcggagatggcgccaatgcactccagtctgggcaacagagcgagactccatctcaaaaacagcaacaacaacaacaacaaaaacaaacataaaaaattggctagctaatacattcacagagctcaaatttggaaaaataaaactataaactgtgaaatgcttttccttcactattttttcccagctacccagttaattcaattttagaaactattgttattagttttctaggtatacttctaaagagagtgttttcacacatatacatacacagcatttcttcccttttttttcggggggcggtggatggggtttcgctcttgttgcccgggctggagtgcaatggtgcgatcttggctcacggcaacctctgcctcccaggttcaagcgattctcctgcctcagcctcccgagtagctgggattacgggcatgcaccaccacgccaggctaattttgtatttttagtagaaatggggtttccccatgttggtcaggctgttctcaaactcccgacctcaggtgatctgtctgcctcggcctcccaaagtgctggaattacaggcatgagtcaccaagcccggcctcttcccatttttatctaaatcgaagcattctatacaattgtctaacaccttgttattttaattaaggatatatgttttagatttttctaaattagttcacaggttttttttttctttattgttggttcactgctgcatactttttccattgtatagatgcaacataattgatatggtttggctctgtgtccccaccaaatctcatctcgaattataatcctcacttgtcgagggagggacctggtgggaggtgattggatcaccagggcagttcccctatgctgttctcatgatagtgagggagttctggtgagatctggtggtttcaaagtttgtagcagttccccatccaccccctcttgctgccttgtaaagaaggttcttgcttcttctttgccttcctctgtgattgtaagtttcctgaggcctccctagctgtgtggaactgtgagtcaattaaacctcttttctctatagattatccagtctcaattagttctttatagcagtgtgataatggactactacaataattaatttaattaaacacctatttatagacatctgtgaatagaattatagtacaaataatactataatgaataactctcgatgtgtgtatgtatttctatagaataaattccatgaagaggatttgcatattcaataaatatatagatttatttcaatagatacagacaacgttttctgtatcaggcttaaaacaatttacaatgtactagcattttatgagagtgtctgtttcctataccctcatctagagaatatgctatcaaacttccatacttttattaactggtaggtgaaaaaaatatctctatgtagatttatttgcacctctctaataataaatgaaattgagcttattttataatcataaaagggacatatattcctttatgtgaacttttcttttttactactggatttttgtattgtgttactgatttttaggaggtttatacattagggaaattagctctttgtagtaatagaacttctatatttcccgttttaaaaaagttgattgtagtcatttttaatttttatgttatttaagttatattttgttttattaagttttggttttggaaaggcttctcccactctgatagtgtgaaagtaaagaaatgtgtattatggatctaatacgagtatgtatgaggtactatatcagttgctattatcaatacctccctgcccagagaggtatttgggggtaatcaatgtgaaaatgactgagaaatactaggttgaataaaataagtgatataataatatataagccacattaatttactctttattatattgattaccagttataatttttagttatatgaatgaaaatttgattagcaattcttctctttcagaccccattaagctccgtgagatttagaaagtatagtcgtgtgccatgtaacaacatttcagtcaatgacaaactatatattgtctgtgggtggtcctgtaaaattataatggggctgaaaaattcttatcacctagtgacactgtggccatcataacgtcatagcacaactgctttatttcttaataaagtgtagcctaagcgtacagtgtttataaagtctacagtagtgtacagtaatttcctaggccttcaccgtcactcagcactcattcactgactcgcccaaggcagcttccagtactgcaacctccaaacaaggcaaatgccctccctacacaggtgtaccattttttatctttcattctctcatttttagtttcctttttaaaatatagacatatgtttggatacataaacatttaccatgtgttacagtattctgttaaaattgcctgcagtattcagtacaataactgctgtacgggtttgtagcctagaagcaatgggctgtaccatagagcataggtatgccacagtccatctaggtttgtgtaagtacatcttatgatatgtgcacaacaatgaaatcacctaaccacgtgtctgtgttgttagatgatgcatgactgtatgtctgtcttgtttatcaaagtgtcccaagagtctagctcagagcctagaaaatggtagacacttaagcatctacttactaaataataaatcagtgtttatcacagtacctcacactgtaaactaagtctacctggaaagacacatgtttaagcaaataatcatagtataggttctgagaagtaacactaatagggacaaggcattgagaccgcttgaggaaggagctcctgactctgtctgagggcgacttctggagggagacttatcaactgagcacacagtcttgaattatggtactccggctgcacaaaatattcagaaggaataaaagtcatagcagaaaaagggaagcaaactattgtaatggtttgttttaactgctacagactttttgtttgttttttttttgtttatttgtggaatcgctggtatttttggtagtaggggaatgttaaaataggggtacttaatttaggaatatcttgtggaataggttatgttcgtaattagaatatggaaaaacggcgtagcaactcaataggcagaaaattgatgggaaggatccaggtctaaaagaacacgttcaaagttacagagaagccataaaatactttgttgtttttttaaaaaacagatattatttagaacagcagaagcctaacaaaagcaatacgggtaaaaaatgagatagggtgtcctcttagagaagtttaaaaatgaaagggtgtaagcttaccaattcaatatcttaataaaataattttttgtttgtttttcactcctgaatgtaattatgcatagtaagaatatccacagctttccataactggtatgaagattgatggcagttttttctgttttatctattttatctcataaatatttctcaatagcagttattttacagaatataatagagactaagagtattgacctaaatctgaacttgccatacatattcctatgatacaaatgagccaaggattttctttacaacttgtcctcttaggtcaggagccattccaagattccccttggctcagggtcctggtgaaagacatagtccaatgatgatgacatcagatagttttatgagtctatattctttactttttagtttgaaatttatttagagcacttttcaaaatagtttcttcctaacatggccgtagagttctgttgttgttgttgttgtttgtttgttttgtctatgttccatgatgtttaatgaatttacctgctggcatgtacatgggcaatatcaaggtttggtggcagcagctgcacattttcttgttagtgcaacaatgcttatctaacactttccatggtatttcatgtataacaaaagtgtctaggctgggtgtagtggcccatgcctgtgatcccaagcactttgggaggctgaggtgggagaatcacttgagtcctggagtttgagaccagcgtagacaagatgatgaaactctgtctctacaaaaaatatttaaaagttagctgggagtggtggctgtgtctgtactctcagctactctggaggctgaggtgggaggataacctgagcccatgagatcacggctgcagagattcgtgatcatgccactgcactccagcctgagtgacagagtgagaccctgtctcaaaaaaaaaaaaatgtatctaaacatttagaaaattcaaaatgcaaacttgctttaaatactcaaaaataaattgctttctcttacttttcatcgtctgagagttagaagattgttagaaaagatttcggcaccatctatctctcatgcttcttaaagcatgtgtagtattaaattacaggaatttatatgtagttcttttatatattttttgaaaacttatgaactactgggaagtatttatgctaacaattttaattagacacaagaaagtaaattaaggtatttataccatttaaagctttatttgagatatctccactaattattttggcatgctttcatgtaaaacaattcaactttcatttggagttcatagttttgagcccagcctataatttgctttttgtcttactttcatttgaatcaaaccactatgttgtacaaaactgtgcttatgtgattacaactggaacgcaacatcataagtaactgacataaacatgccaaagcagtagaagaaagctccttggattagctgtatttgagcaatactcttttttctggtctctgcccatccatttgtggctccctgcaatcaattttcatcattgaaggtagattaattatatcactgtagttacattatattattaggttggttcaaacattattgtggtttttgctgttactttcgatgtcaagaaccacaattacttttgcaccaacctaataagactttctattttatgccatcttccctcttactttctgtgatctaggcacattggatttatttcagttcctcaaagttttgtttctgtttggtaggattttaaattaaggtaatatatataaatcacacagagtactacatggcatatagcaagctttcaataaatgtactgatatttatgatgttttgcctaagaacttatgaagaaaggaaataggaatcacttaaacaccaagatcaagtaaatttttctccaaaaattttctctaatcaatcttgcctcaatgagagttaatttttgaaggtgatagaaagtatgagaaagtcgatgacttcagttttgaattattagagattctgcttcaagacatagaaatggagatttatttaggcagctacatagatttacagtatacataatgctgccaatgttaataatcgtgtggggaggtaaatgagaaaatgagacttagacaggttaaattatttctttaagatcaaggctatttctgctacaccatgttgtcttccaatagtgaaaccatgagtggagctcagctagggaaacagagagatagccaagccacagatggatctaaattaggaaaagaagtcaaagccacagagaaagtctagtcagagacagagcaggacaaaaagcacaatgtctcaaacatccagaaaagaatttccaaaagtatttattgaaaataaccaaaagccaattaagataaagttgtatgaaaatgtccttggtgcctagggacttcctactttcatgtgttacctgtcttcctggcaattgcacataaggtgtgagtgaaggcctgctgagatcatatttgcctgctaagtcaggtgggtaacacatgaattatcaaagccctggaactaaagaaactgaagaggccatgcttagtgtccttgcctttgcatttaaattaagattcagactttcagagagaaaggaaaatatgagaaataaatgtcagattaactgggccaaaaataaaacttgtatttttggtgcatatctaaagatatcagaatactagggtattgactagggattaagtatatctcataccctgggggaagcatgtttgttcagaaggcagtttatttgaccataaaggaatttgaactgttgtgggaggaaaacatgtatggactacacataatgtcataaaacaagaaaaatattgaggcgctattctgcaatttgcagctacgtaattatagatcaaacagctctaataataaatggacctccagagcctcacgatctcagaatggatgtttaaaataattaatatgagggcagccaagatggccgaataggaacagctccggtctacagctcccagcgtgagcgatgcagaagacgggtgatttctgcatttccatctgaggtactgggttcatctcactagggagtgccagacagtgggcgcaggacagtgggtgcagcgcaccctgcgccagccgaagcagggcgaggcattgcctcactcaggaagcgcaaggggtcagggagttcccttccctagtcaaagaaaggggtgacagatggcacctggaaaatcgggtcactcccaccctaatactccgcttttacaaagggcttaaaaaatggcacaccaggagattatatctcgcacctggtttggagggtcctacgcccacagagtcttgctgattgctagcacagcagtctgagatcaaactgcaaggcagcagcgaggcagggggaggggcgcccgccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacacagccggagatctgagaatgggcagactacctcctcaagtgggtccctgacccctgacccctgagcagcctaactgggaggcaccccccagtaggggcagactgacacctcacacggccgggtactcttctgagacaaaacttctagaggaatgatcagacagcagcattcgcggttcatgaaaatctgcggttctgcagccaccactgctgtcacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggatactctaaaaagcagagcgcctctcctcctccaaaggaacataattcatcaccagcaacggaacaaagctggatggagaatgactttgacaagttgagagaagaaggcttcagatgatcaaactactctgagctacaggaggaaattcaaaccaaagacaaagaagtaaaactttcaaaaaaatttagacaaatgtataactagaataaccaatacagagaagtgcttaaaggagctgatggagctgaacaccaaggctcgagaactacgtgaagaatgcagaaggctcaggagccaatgcgatcaactggaagaaagggtatcagtgatggaagatgaaatgaacgaaatgaagcaagaagggaagtttagagaaaaaagaataaaaagaaatgaacaaatcctccaagaaatatgggactatgtgaaaggaccaaacctatgtctcattggtgtacctgaaagtgacggggagaatggaaccaagttggaaaacactctgcaggatattatccaggagaacttccccaatctagcaaggcacgccaacattcaaattcaggaaatacagagaacgccacaaagatactcctcgagaagagcaactccaagacacataattgtcagattcaccaaagttgaaatgaaggaaaaaatgttaagggcagccagagagaaaggtcgggttacccccaaagggaagcccatcagactaacagcggatctctcggcagaaactctacaagccagaagagagtgggggccaatattcaacattcttaaagaaaagaattttcaacccagaatttcatatccaaccaaactaagcttcataagtgcaagagaaataaaatcctttacagacaagcaaatgctgagagactttgtcaccaccaggcctgccctaaaagagctcctgaaggaagcactaaacatggaaaggaacaaccagtaccagccactgcaaaatcacgccaaattgtaaagaccatcgagactaggaagaaactgcatcaactaacaagcaaaataaccaggatcaaattcacacataacaatattaactttaaatgtaaagggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaaggcaggggttgcaatcctagtcttggataaaacagactttaaaccaacaaagatcaaaagagacaaagaaggccattacataatggtaaagggatcactacaacaagaagaactaactatcctaaatatatatgcacccaatacaggagcacccagattcataaagcaagtcctgagtgacctacagagagacttagactcccacgcaataataatgggagattttaacaccccactgtcaacattagacagatcaacgagacagaaagttaacaaggatacccaggaattgaactcagctctgcaccaagtggacctaatagacatctacagaactctccaccccaaatcaacagaatatacatttttttcagcagcacaccatgcctattccaaaatagaccacatagttggaggtaaaactctcctcagcaaacataaaagaacagaaattagaacaaactgtctctcagaccacagtgcaatcaaactagaactgaggattaagaaactcactcaaaaccgctcaactacatggaaactgaacaatctgctcctgaatgactactgggtacgtaacgaaatgaaggcagaaataaagatgttctttgaaaccaatgagaacaaagaaagatacaacataccagaatctctgggacacgttcaaagcagtgtgtagagggaaatttatagcactaaatgcccacaagagaaagcaggaaatatctaaaatcgacagcctaacatcacaattaaaagaactagagaagcaacagcaaacacattcaaaagctaggagaaggcaagaaataactaaaatcagagcagaactgaaggaaatagagacacaaaaaacccttcaaaaaattaatgaatccaggagctgtttttttgaaaggatcaacaacattgatagaccactagcaagactaataaagaagaaaagagagaagaatcaaatagatgcaataaaaaatgataaagggcatatcaccaccaatcccacagaaatacaaactaccatcagacaatactacaaacacctctatgcaagtaaactagaaaatctagaagaaatggataaattcctcgacacatacaccctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccaggatcatccttataccaaagccaggcagagacacaaccaaaaaagagagttttagaccaatatccttgatgaacattgatacaaaaatcctcaataaaatactggcaaaccgaatccagcagcacatcaaaaagcttatccaccatgatcaagtgggcttcatccctgggatgcaaggctggttcaatatacacaaaacaataaatgtaacccagcatataaacagaaccaaagacaaaaaccacatgattatctcaatagatgcagaaaaggcctttgacaaaattcaacaacccttcatgctaaaaattctcaataaattaggtattgatgggacataactcaaaataataagagctatctatgacaaactcacagccaatatcatactgaatgggcaaaaactggaagcattccctttgaaaactggcacaagacagggatgccttctctcaccactcctattccacatagtgttggaagttctggtcagggcagttaggcaggagaaggaaataaagggtattcaattaggaaaagaggaagtcaaattgtccctgtttgcagatgacatgactgtatatctagaaaaccccattgtctcagcccaaaatctccttaagctgataagcaacttcagcaaagtctcaggatacaaaatcaatgtgcaaaaatcacaagcattcttatacaccaataacagacacacagagtgccaaattatgagtgagctcccattcacaattgcttcaaagagaataaaatacctaggaatccaacttacaagggatgtgaaggacctcttcaaggagaactacaaaccactgctcaaggaaataaaagagaatacaaacaaatggaagaacattccatgctcatggataggaagaatcaatatcatgaaaatgaccatactgcccaaggtaatttatagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacgctacctgacttcaaactattctacaaggctacggtaaccaaaacagcatggtactggtaccaaaacagagatatagatcaatggaacagaacagagccctcagaaataatgccgcatatctaccaccatctgatctttgacaaacctgacaaaaacaagcaatggggaaaggattcgctatttaataaatggtgctgggaaaactggctagccatatgtagaaagctgaaactggatgccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctacccatctgacaaagggctaatatccagaatctacaatgaactcaaacaaatttacaagaaaaaaacaaacaaccccatcaaaaagtgggcaaaggacatgaacagacacttctaaaaagaagacatttatgcagccaaaaaacacatgaaaaactgctcaccatcactggccgtcagagaaatgcaaatcaaaaccgcagtgagataccatctcacaccagttagaatggcaatcattaaaaagtcaggaaacaacaggtgctggagaggatgtggagaaacaggaacacttttacactgttggtgggactgtaaactatttcaaccattgtggaagtcagtgtggtgattcctcagggatctagaactagaaataccatttgacccagccatcccattactgggtatatacccaaaggactataaatcatgctgctataaagacacatgcacacatatgtttattgcggcactattcataatagcaaagacttggaaccaacccaaatgtccaacagtgatagactggattaagaaaatgtggcacatatacaccatggaatactatgcagccataaaaaatgatgagttcatgtgctttgtagagacatggatgaaactggaaatcatcattctcagtaaactttgaaactggaaatcatcattctcagtaaactatcgcaaggacaaaaaaccaaacactgcatgttctcactcatatgtgggaattgaacaatgagaacacatggacacaggaaggggaacatcacactctggggactgttgtggggtggggggagggggagggatagcattaggagatatacctaatgctaaatgatgagttaatgggtgcagcacaccagcatggcacatgtatacatatgtaactaaccttcacattgtgcacgtgtaccctaaaacttaaagtataataataataaaataataataaaataaaagaaaataatattagcgatcagaaaaaaattaagtatagagaaaactatatgtatatatatataaatatgtattatataatatatataattcatttcagataaaaagaaaaatgggatttttattcacacttgattagataaccatccaattatatagatatttaacaattcagaataatttatttgtccaaatacttgaagaagtgtatagtggaattcttcctaaaattagtaagaataaacttaataatacccttattgaatctgaggagagctacttactgaaattatatgtcctggcttcagaatggatttccaaggagaagaaaacaaaagaattgcttgtgatacattttgtctcattcaacttttattaggttttttcaattaatgtatacatataatacacaggaatattatttaatggtatgatttattgatggggtgcgatcacatatacttagatattttccttagtcttcaaatggcatcttttctgtcactagagttaaaaataaaaacctgagaacatgagaatctgagtattcaacaatgtgaaaagcttggtagccacttagaacaaggagcataagctaaattatttaattgtccagtagagcatattctttgatataaacttactactgcatattttatacaagttttctaaaataaaatgtctaatgatgtaatcatcaataataggaaagcaaagtgatgcaagattcacgaacacactgagcacaaatcattttttttaaagtgccaattcttttgctttttttttgagacagagtctccctctatcacccaggctggagtgcaatggcaccatctcggctcactgcaacttccacctcctgggttcaagcgatcctcctgcctcggcctcctgagtagctgggattacaggcgcccaccaccacacctggttaatttttgcatttttagtagagatgaagtttcaccatgttggccaggctggtctcaaactcctgacctcaggtgaccagcccaccttggcctcccaaagtgctgggatcacaggtgttaaccaccacacccagcctcttgcttcttcaagctaatggaccactgtgagtgaaatgtcagatgatggtgaaaacgtttatatatttgtagtttgttgtccttgcttgctttaatcagtagtagctctcaatttattggtgaggtcaattactaaaattcagtggccttcctcacactatggctaaacattccattcacttcagtgtgctgtgcttcaggatgtactttggtataaatcctgctattacaggaaagagagtgtgttgttaaaagcaaagatacaaatgtgtctacattatactgtaaagatgttcctgaaaatgtgagtataaattctttaaaaactattttttccctcatttgcttcatacttggtctagggcttttctgcctctgaggtaacttttagaagataataacaatctcccctttgcttcaacacaaaataattcctgtagggcttttcttgcctgctgctgtgcaaaaccctttcaagaattattttatgacttgaaaattttaagatatttcatctatttttattattttattatatggtggtattgctatgaattttacttgtattttgcaacagtttttgtattgggagataaaaagagagatatttggccaactatagtaagaaatagtaattcctttttttttttttttctcattttagccatcttttcctctctctctgccacccaatagcaaagacactttctcccaagcggtcacagtggactggcatgggagttatgatgaataagagaaatgttgacagtagagattatatatttttgattttatgaaaatgtagagaccaaatactgatgtattcgttatcattctctctcactttctcacccccaccatttctttcactttacatccaatctatttgtttttatctctctatttatatccctgtcatctatccatagcttctctctatcatttatctttcaatctaactatccaccatccatttaacatatattacccccaaatttgcaaaggtaccttctattaacaaaaaaattggcccaagttggagaagaataaagcacagtgatgtcataataacactctactgtctttgattggatacctcttcaaaaatagtgggtttttttttctttatctggtctgtgtaaattctgcatctgccaccctgcatttccataaaagatttagaatagaattgattcttaatactgataattacacttaagaaatgactattatttttgaagtgcttagaatatatattataaataagaaaaacaagtgaataattgttgtatagtttgagtgggaagaagtgtttcattctgactttgttttgcttttgtaatgttttattgtgtattgttttaatgcctagtaagaacagtgtgaaggtcgtgccttcattgtttgcttttttgtttttgagggaaagtataattttaaaaagttttattcctcatacttttttgccagatgataaggataggattttagcagactaagtcacatcaagcagtggccaaaagcaagaatacattggttataagaaaacaattatttattcataaattaagtaaaaggtcatcactttagacattttgaactaccaagttttctatacagtgagaattaaccatttacatgtcagaagatttacgtattggcagagtgtgctctagaaatactatactgtttttctgttacaaatattatgcatattcattatggaaactttcaaaattcaataaattttaaaacgacatttttaaaagtctgtaaccccagatgaatacataacaactgatattctgctatttttctttctattctttgtgtgtgtgtgtgtgtgtgcatctttgtatgtagtaatgaatatgtaatgtctatgtaatgaatattttatacaaatatatattttaaataaataaatatatatatatatataatagtcctgcatcctttttacttgatattatttttaaatatttttatattctggaaaatatttgacaatacagttttatgatgaatatctgtataaaatattttcttattagatatttaggttatttcagctttgcggttatgatgtctacagcaggtatttattataaaacatatttggcaatatattgaatttcttcttgaattcggggtacttttttcttgatttggtttagttaaaactgtgaatggagatggagtgttataggaagtaaatgtctcctttccctaagttaagggtagctggaccatatcacttggtgtggctttagcacagggacatggggtgtcaaccaatgcttgacatgtggcatcaggggctttcttagctcttcctaacttccattcattttcctgagtttaggcgtcttaagcttgctaaggaaatctcttgaggctccaaagagagagttacagagtattaagaagtccagtgacttttgaggttacacataatattgcagtgccagaggttgtctgcttcgtgtcatagaacataatgccttttctctccttttactctttatagttgattctccccttttcttctgtcaatgactagtgctccttgtcttttgttccttgtcctgtcaccctttatagtgttggctttgtcacttattatcttacactcccccctaaacctgctatttctcctttattcctcatcttgattggtggttcaaatgtctccctcctgtggagctgctcccagaattgaacaaatcacttccttctccatgtacctatcacactactattatagcaatgttgctgaaaacaatgatatgtcagtttgtaatgaaatttgaattatttaaaaaataaggacagaaaaattagttttccatgaagttaaataaatttaataagatattttacttaatgatgatactgtttttctactatgattgatggtctaatagtatatactttatgcagtaatgctagaaagcaagttgacagccccatttttgtttaatttttttgaaattaagattgcactggcccaagacatttaaagtctagaaagtacagtaatacagtacttatcatagtgaaatatacttatttgtctacatgtgtgaatctttcagattttgagccttttgacagcatgcttgtgtctttaattttttctcctattgtctcataaagagtggtccataaaaagtggtgcttattaagtgtatattatgttttatttgcattattttagatgtttatgtgagtgttcatattactttcagtgtaagagttgagtaatgtaatttagcaaagttttacataggcaagttgctacttcataaggcaatgatctacctgaggataaaagcatgaattgaaattggatcattctctgcattctggtccaaattaatcggtctcattttgtattaatgctctacctttccttttagtattatcaacttatattaatgtttgtctttcaaattttcaaatatttctatttgacagactaatttctctgttcttgcttttctataaatttaattttcagcacacacacattattcttcacactttctgtaaattctcctgttcttctttaaatgtatgaagcttgattgtgtaactcagggaatttcattcaataaaatatcttagctcaataaaccatttaattacttaaataatagttcaaattgcttaaaacatatttatcaaaaacaaccaattacatatttggatagataatgttacctgaaggtgttatttgaaataatcctaactcattcagtgtgtggtcttagatagagttgcttattttgagtgttaagagtgtttctatatttttatctgatatccatgtatccatgcaaaaattcagggtccttggaataatttggcgttttaccataataaaataaagctaataatgattattatgatgataaaaagttgttcacaattttactgaacatttatgatatgccatatattatgtgccaagattaattaatcttgtgtgcttaattaatttattcattcaacaaatgtttatgtatcattgtaggaactggtaatacaacaggggaaaaaaatgcatgaagttactgcccttgcagaacttgcattctagtagggagaggcagacaacaaaggaattacaagtgaatatacagaactatagacagtgataagagttttgaaacaaataagagggaataagaatagtgatggggtagggggtaggtatggtttactgttttacatggggtggtcagggaaagactcactactaatgtcacatacatgtagagacttgtaagatggaagggagtgggccatgtagaaacctgtagaaagaattcagaaagagaaaagcaaatacaaaaccctcgagaggtcaggatgatttgctttatgtaaattattcctcatgccagagagatagacgttactctcctgagaagctgctctcaccacagaatgagtcactcactcctctatgctcctgaagcagatgtggtaatatttttcaaaacattagtccactaattagggttggtctatgataaagatttcattgagtaaaaaaaatgagaaaagtggtggtaattgagagtcccaggttgacacctaattttgaagttaaaaatttgatatatgaaatccaaatgaatctgaatcatttggcatcataagacatttagacagtttaaattgtgtcattttttttggtgctcagtagacacctctctctccagtaaaataaaaatttaaaatgattacaaatttgtaataatacaggaagataactgagctctgtttaggttccttctctctgaacttcaccatggaaattctgcagacagcaagccagggcaattgtagggcggacctcatttggttctcctcactccaagattatgatactgtgaaattttaatcacttttcagtccctaatatgcttaaaattatttatttaaattaattatttttcgttaattgttttgtatttagggactaaaaagtgattaaaattttaagtttgttgaaattttatgaattcttgaaaagattcatctgcctttttggaaaaagatagaattggtcactgttaactgaataaagctgaataaagtatataactttttaatgttctcaaatctttctcattttgaggagttgaattgaaagtagtttcaatatggcagtgttacatttagagatcatgagttaaccattttttatttcattttatgttttgttcttctcagactgagtaaccaagttctaatctgcatatgtgatttatttatttgctacattgctatgaactgggtactacacagggcaagttatatgctgaaacaaagcctcacaatggctggagatttgtttttatacaggatgggtcgtcatgctgtgcaagagaattgtcttacttcccagtcctactagggagagactcttctactcaaaacgtcctatatttcctcctcacataccgacgatcatgaatttcttagaaagcattgtttagaaacacagagcagagaattattcattcatgggaaaaaaaaccatcaaaacaagcatgacttaatgagacatctgattataaaacctcaggaagtacttacctttatcaactataaaaccttaggaaggacttccatttatctggaatcatggcttccaaatttactctgtagccctaaacaactaaaaatcttgatacaatatataaaacaacaggtttcacacatcggactataggtgtcacagtatagtaatcttggagtgaggagaaacaaacgagatgggccctacaattgtcctggcttgctgtctgcagagtttccaggctgaagttcagagagaaggaacctaaacagagctcagttatctccttcattgaggagacagagtatttggggagttagttaaggtggctgtaattgatgaggcagtgcaagtgagatgagagaattgcacaagagagctcagaggtctgctgaggacttcactccggtcttcagttcggtactaatcagcatttctgtgagaaactactcaatgctaaaaaaatgtcatgggaaagaaatgggtgacacaattatcagagctcagacagggctaggagtaattcacaatccaaaaagccaggatgggaaaaaagttgtaatacatgaaacatcaggcaaaagggtcatttcttagtctgttagggatactataagaaatacaatagactgagtgacctatgaacaacagaatttgtttctcacatttctggaggctgggaagccaaaatcaaagcactggcagattcagtgtccggtgaatgtgagttttctagttcaaagatggtaccttctagctgtatcctcacatagaagaaaaggggaaccccagcttgtttgggcttactttataaaatcaaaaatcccattcatgaggccttatgctcatgacctaattaatcagcttccaaaacatcccacctcctgataccattaccttgggggttataatttcaacatatgaaaatttaagggcttcaaacattaagactgtggcatgggaccaaattagtcctagaagtaaaggctgctatgggcctaatgaattttaaaagctcattttaaaagcatcatactatttccaactagcttagttgcaaactaaagtaaatttgaaaaatatttaaaggattactctcttaaagaaaaaagtccagcacccagacacacttcaataaaaaattgttgaacattcaaagaagtagaagaccaggaataataataaggagaataaccaatcaatagaaacatccagaaatgacaaataatagaataagcaaacaagagcattaaaagagccactgtattctccaaataaccaaaaagaaggaggaaatcatgagcatgttgaaaaattctgcatgtaacatacaatatgcacccaaatttaatttctaaagctgaaaaatacaatgtttgagataaaaaaatacttgggtggaattaatagcagattagacactgtagaataaaatattatagaatttaaaaataaaactttagtagtaagtaatttaagtaaaaatgcaaagtcccagtttcatattaagtattagtaataagcattaccattatcgagaagtaaacatttctgattagcctgggttgagctggtccaatgtgatccaaaaaggtactctggactgggccaacaatatcttagttgtgttcctgaagacttatctctatttcatttttaagggtttgcatcagaacatgctctatatacactatgatgtctggatagtaagtatttacatctcattatgaagtgtaggcttagatgttttcaacaaatcctggaaagtaacttctatggcaggagtctcagaaatgataatccatagtcatagggcaaaattgacacacagacatcctctcttttgccagtacaattaaagttaaatttaaatgtcttcaagtagagcatatcatcatcttgtcacagatcccatgaacctagcctgtgaaataatttgaacttgtaactcaagccttttgaaaacattttacaaaattttctgaactccatggactccacgtgactgtaagagtcagaggcaatggcaggtaagcattgccttttatgtggttttgtcttaataaggctaatttgtattgggtacactacttgtcatttgtagagtaccagaaatactaaaaaacactcatattggtgttgactggcaaagcacatatgtcaagcaaatctaaatgtatgtctttgtcactcctttgagaacatttccagaaatgatacagccaaagtgataacagaaaagggtaaataactgcacattgtcttccaaatgtgctgagatactatagaagctaaagatggaaaatgaaattcatacatcttaaaacaactgaatgaattccttaatttcttagtcacagcaagttcaatgtttgacctgtaaagctaataaagactggagacctcactttgttcttgacaagcactgttgagctctttggttgcagttgaagctgaagagcattcctaataagatttttttctagctcattttcctgcaaatgaaatctctgccttacattgtccttagttatggaaaataagatcactaaaccttggtaactgttgccgaatggcagtaaagatttcattgttcaaataatcctcaagacttcgcatatcaagtatactctatattttgagaaatatttgtattactctcttttaaatgaagttacctcattttattacctgtcacttcactgggtttcaaattgtctaatttatttaactagcaaagtaagggatttgagcccactataggttatgatttatacattatcatttggtcatttagagttttgtttggtagtagttcatggtgattctgtaaattttgtaaataactatccttatactttctagcatttggagttttatgtcttttcttggtgaaattagtgttctgcaaattaggaaaggcagaaacaagtcaatcaaacttataacactgtctgcttgagaaagtcaccatgttcattttataggtgatttgttttgccccattgtattttgaattctcccgtcagccaggtcatttgtatctcaggccacagagggtctctcaagactgcttcctgtgaaattgagtggcccctttttatttctctgttacaaatgtttactttttccagagcacttttctcctaaagaaaattttacatccatttaaatgtcttgccacctcttccttgccaggcatactgacttttaaacctaagcctttggagcatgtaaaatcaatgatgtgtactgagttttctatctattcccgataaattgcagtcactacttcacctttgcctacctgctcagcaatatcctccgaagaacccaagcatatctggcaggtgttctatatcttagctgaatctatagctgattttctagcatagtgaggtgagtctatactaggcttggaagaaacagaagaaattatataaaggaaaatatatgtggctttatcattatatcacatattttcatctggtgataggccatttatgaaaggaataactcctggatacacaagtggatgtgtgaatggaagaaaataatcaaataattaatgagcacattctttgtgtctagtattgtaatgaggtatgtttacagtgtctcacagatgtcaacaggaataaatatcactagaacagcattctatattaagtgtttcttaacctgacatctatgagctccagaactttcatatacatggtttaacgttcagaggtaatcaagaacatggaactatttttaatagtgtttgcattggttttctatggctgttgtaaaacattgtcacacactttctggcttaaaacaatacacgtttattctcttacagttctggaaatcagaagtctgaaatcagtttcattggggaaaaatcagtatgactgcagggctggtcgccctacaaaggctctgaggagagaatcagttcccttggcttctccagctcctagatctgcattctttgcattttgtgctcgtgaccccttcccccatctttaaagccagcagtatctcatttttatttagtagtcacattgttttctgcctctgcggtcaaatttccctccaccttctacttataaggacacacacagattacatttaggacccacctggataatccaggataatctccccatctctggatctttaacttaatctaatctttttggcaaacttccttttgccaaaaagttaacatttacaggtgttagggattaagttctggatattttgaggggacattttattcagcctattataatgtctgaaacagcttgttaactcaggatcttatttaattttttaaaaggaagctattaattgtaaattactaagttggcactgtaacagtttattcaagagtctatctaagtatatttatatatgtgtcaactaacaacatctaattaaggtgttctgtctggtgttaatttcccaaaatcgactccccgagaagctgatgaaatcttagccatagtagacacagaaaattcccttgttctaacccttttagcatctcgattttgaaatgttcacagttatatttgtcaccagtggcagtttcaactggaatagtaattttctgaatttcttcatttgtttaaattctaattttaaggagactatttgccagtgatttctattttttccaacttctaaaaaaagtaaaatgtaattgctggatcatgttttgtatataaaaggaagcaaatatatctaggttactcacaaaatatttgagtttaataaaatttcatggagggaaagagagaaaacattccaagtgaaaataacacaatgagtggaggtaatagaaagttcctgtgtcacctatcctgggatctgacttatggaaaactgaattaggtgtcccctcattctgtcagggtatgtactgtgctgtagtcatttatgtttctccttgctatggtctgaatattcttttctctcaaaaattcatatttttggaactcagtatacaatatgatagcattaacaggtggggtcttttggaaaatgattaaatcatgagggccctagcatcaggaataggattgagattagtgctcttataaaagagattgaatggagtgttcttgcttcttctgacatgtgagaatgcagcaataaggcaccatctaggaaacagacagcaaggcctcattagacaccgtatatactggaacctccttcttggacttcccagcctccagaattatgagaaatagatttctgtttttcatatactacccagtctaaggaatttgttaaagcaggctggatggactaagacgcccccaaccagactgaaggcgtgattatgccttttctttggagttgaaactcccagcactatgcctgaaatataattgcagaacaaatatttggaagcaattggattgggtagaatattaggatattagacaggaatttgatgagagtaaagatgtgtgtatgtggaggaatgggggaaagttgtatatgcacaggaatggctcacgttattgagatctttaaagtcgagggaaaattttgtctgcaaaccttgttaagaatgcatagtgaaggggaattcagagacaaggaggtaaactggaaaagtcatctctgtaattctgacctaagataatgagaatctgaatcatgattgtcttagtcagtttgggctgctaccacagaattttatgaactaggtgtcttgtaaacctgtgagaaatttatttctcccagttctggaggttagaagtctgagttccagcctggtcagttcctggagagggttctcctgtgggttgcagattgctgacctcatcttgtgtccttgcatggtgaaaagacagataactatttcttgggcctcatttcataaggacagtattccctttcatgaggtctctgccctcatgacctaattacctcccaaaggtctcatttccaaatactatcacagaggggctagggtttcaacatctaaattttggagggactcaaatgctcagtcccttgcaagggttaaatgaataaatgaaaaagaggtaggcagatggaacagaaaagggacatttcaaaggagaaatggctagagtgatattgccaactatatcttttaatgtactttcttaaatgcttgttatgcactttctaactgtatttttcaacttgaaagccatatttgccattctgttctctttttttaagtttttttcatgtattgaagtagtcattctgaaaatagaattttaaaaaatcctatttcaccacttcaagcagtatttctatcattttacttattccaagtcaaacaattccaagttaccaggtgaaagttaccactcatactttctgtttttataaattgtagctctgatattatttacctttgttgtttcaggaatatacttaagttggtcaggaaccagacccactaaaatactaatactgatatttttattgaatctaataaatgttatcttgtttgccaatctggataaattaaattttccattgctgtccatttactttataaaaatgccattttattaattgaattatttattggcctgagtaattctttcgtgtcatatacctgtatcataatccctgtgctaaaattaaaataagaattatttaatttaggaagtattcgttgagtagctactatgtgcatagcattgaaaggaacatacaatccatgtgttttaatatttttatctttatctgatatttgcagtttcccaaatttaccttttcctaaagaatggctacacgtctcccatttttatcccaccacatctaaatatcaactgatattcatattatttctctagtttactgtaaagaacatgagtaaattatacacatatatttaatcagtactatagtttattttgcctgaaaatacatgttttaacattgtacaatttttttctaacttgattatcctagttcaagaatatcttcaactcctatttttgtttagtttcaacccagaagacattttctttaaaattttaattggctaggtttggtggctcatgcctgtactccctacactttgggaccccaagacaggagatcacttgagccaggaatttgagatcagcccgggcaacatagcaagaccccatctctacaaaaaaataaaaaaaataattagtcatgtgtggtggcgcatgcctttagtctcagctacttgagagggtgaagctggaagattgcttgataccaggaggtcgaggctgaagtgagctgtgattgtgccactgcactcaatcttgggcaacagagtgagatcctattgaaaaaaaacataaaataaaataattgttttacttgagatttttttgtattacaatttttaacatgttaattttaaaataatcattgattacttttttacctctcttccaatcaaaaagtgtaattttttctgtaggcaagctttatcatctaaaatgtactgatattaaagaatggtaacacattaattcataagttctttgaaatagctaaactgaaatttgatatgaaattatattagatacaagtgtatgatatatgatgtcagactatgaactgatgtgttattttcaatgaatatttaactatataatgcaataatggctttatatagttatgtatattctagaatgccatgctttagctttagtagccatgcttttgaggtctttctcaagaaatctttgcctggaccaatgtcctgaagtagttctccaatttttttcttttagaagttttatagttttgagtctaagtctttaatccatcttgagtttgtttttgtatatatagagagataggggtgtactttcatccttctgcatatggatgtctaattttaccagcactacttattaaagagactcttccccaatgtcctttccccccatacaagagcaatgtatgttcttggttcctttgttgaaaatgagttggctgtaaatatgtggatttctctctgggttctctcttctcttccattggtctatgtgtctatctttatacagtaccatgcatgctgttttgggaactatagctttgtagtatattttgaagtcaggtagtgagatgcctccaggtttgttctttttgctcaggattcatttggctatgtgggtcttttgtggttccgcagaaattttgcaattatttttctttttctgtgaagaatgtcattggtattttgataagagttgtactgaatctgtagatcactttgggtggtatgggcaatattaattcttttagcccatgaacatggaatatctttccatttcttgtcctcttcaatttctttcatcagtgctttacagttttaattgtatagatcttgcacttatttgcttaaatttatttctagttatttttatagctactgtaaatggaattgttttttatttttccagttgttcactgttaacatatagaaatgctgttgacttttgtacaatgattttgtatcctgtaacttaactgaatttgttttgagatttttctcacagtgatagtggcattttaaaaatatatgacctcctctccctatttttgatgaatcctttaggttatcataaatatttgttgaacaaatgtaggaacaaaatattatgataatggaacttatgggttttttttccctaagagttcttatgggacacaatatataatgtttccttcatattaaaaatcaattttaaataatcaaaaaattctgtgcataaaatgtgacttataacaatttgtttacaaagtctttttttaaaaacagaaattctatagtgaaaaagaagcactggggataatgagctgttagaattgtatttatttttattatttagttatttgttgataagtgttgtatgaaagggaggcttaagaggttatagagcataattattattgaagcattaggaatatgcatactaggaatgtgagtgtgtatgtgttatgtgtttgtatacatgcatatatatatatgtatataggcatgagtgtttctgggagcagatggatacaaataaaattgtttgattcctaagccagcatcctaccacctagcaagaggacagaggaaagtaatttcaggtatgtgaagactgccaagtaacacaggataacaagaccgaagagctgtgatatacgtggctctccaaggtagggagatgaaataacagatacaaagatgaatatttagagatttagagaagcatatttgattggctgccaggctccaggaatgatcagaagttcttgggaaaaaaaatggtgacttacttctgctacctctgtctttaagaccagtgtacaatttctaatttcactataccagagagtaaatcttgctcaaatgtctgtggccttaacattgaattctacttcaaggactactctttcctccatcagtatttttaactttgcaaaaactgcagttattccagtttataaaattctgttgttcacttgcttactagattattttacacctgaatataataactttcctatgatgagaaacagctcctcaccttgcttgttatttgagatagccattgactaagaaaaaagcctaagagatagaaatatcatagcaactcagccactggcagtggcaagcagagcattttgaagggaaatatgtagcccttcttcacatagtctcaaaggtagagtaagcatcaggcaatgcaagatcacattgcaggagcatttgactgagtggtaaatatcaaggccagcttccatggagagttgaaagtaaaatcagtaatttgtctttaatttgcaaacaaaaaaatttacatgtgttctaaataaacaaagctgtttatttccttcgtctaagaatattgataattcgtagggatgggttagggtactgctccttctatctagtgactccattaacatctcagatttcaaagtctcttgttggattttcggcatccagccagcagaagaggtaagagaaaataatgcagagaattgaggaatagcttttaaggtccaggaggtgacattccctttgccctcgttctactggtcaaaattcagtccgatggctctaacgatatgccacaaagattagaaaatatagtctagccctgtacccaggaagaagagaaacaatttttgtgtatctaccagctagagtctagctagtctgagtcttggtgatgatggtgatgatgatgataattgttgggtttggaataatcatctgtattaaccttatccttaatttgcactggatcagagacaagttaatcattaatatttacatatcaacaactgtgttgatcccttccaccccagtgtttactcttcgagcacaccgtgaaagccaggtggtaaaatctcttattgtgagtggccttacactttcatccataaatgtgaggatgaaagaaaatacattatatctacttgtatgctacagagaaggatggttgctttcaccacaaatcccaaaaggagggagaaaaatttctattccttggggatggaaagaaaaggaaaatttattcttactctaacctttggaatgaaaatcccctcaaaggataaaaaaaatcccattttccctggcttctatgacttttatgacttttagagatgtctccaagaccatgagtctcagtttctcttgaaatggaaacacataccactctgaggtaggtaaatctcttttgagttctctcactatctagatggttgtaaatttacttccaaagacttgctcatagcccaggatctcaagtttttggcataatttatttagccagtctatggctaaaacacagaaatactttcttagcactccacaatgacaatgatgataataacagctaaaatttattaagcacttgccatgtttcaaaaattattctccatgttttacttagaatttgtagtatctcattaatctccacaaactagtgaggatattactgattgaattccattttacacgtgagaaaattgagacacaaagaagttagtagagtacctaagaccacacaggtacaaagtggcacagatggaatttgcacacatgtagtttagtctagagtgtgtaaaatatatcctttattaagaaaaaaaaagtatagttgtgggacaacaaatgacccctgtgcattgtcaaaccccttaccaggacgtccttttatcactgtggtattaaggttcctgaccaccagccctcatttggattagctatacttgtatggatttcggtggagctctttattagtaaaatggctgttttatcttcaaacaatgtagcatacctattggattgatttatgaatagaaaagtagctttgagtcagagattttagtttgtttattcctgggttccctaaagcctagcacagtaatgttcaaaagggtatctctcagtaactatttttgtacaaatgattaagaacatattctaagcaggcatgtagcagatccatactaagcagtaggagtctatccttctttctgactaaggaccatagcccatttatggaataaaccaagtgagaagtaagtaactggtgaaaatacattcattatgggcaaattaagagctcttttactatctatttaatgtgtttcatcataaattataattccagggacctattgctgctcactcaaacaaaagtacaatcttattaagggataaaaagatgtaaggggaaatgtttaagagtgaaacttttcagagattatataaatgtaatcttcaattagttattgccttaataatcatgaattctgaagtaacaaaaatcctgaataaatgagattttcaccctgagattgaaagaaaattttcaactgaaataatttcctccttatcatacagtttaaatccctttttattcatattttatgcaaatatgtcattatattttgtacgtatcagatattgaagctctcttctaaaactttatatttttgataaatatttctgtgaaataaaagaaaatatgggaagggtggttccaagatggccgaataggaacagctctagtctacagctcctagcgtcagccacgcagaagatgggtgatttctgcatttccaactgaggtaccaggttcatctcactggggtttgttggacagtgggtgaaggacagtgggggcagcccaccgagtgtgagccaaagcagggcacggcatcgcctcacccgggaagtgcaaggggtcaaggaattccctttcctagccaagggaagcggtgccagacggcacttggaaaattgggtcactcccaccctaatactgtgcttttccaatggtcttagcaaatggcacaccaggagattatatcttgtgcctggctcggagggtcccacacccacggagcctcgctcattgctagcacagcagtcagagatcgaactgcaaggcagcagtgaggcttggggaggggcgcctgcaattgctgaggcttgagtaggtaaacaaagtggccaggaagcttgaactgggtagagcccacctctgctcaaggaggcctgcctacctctgagactccacctctgggggcagggcatagccgaacaaaaagcagcagaaacttctgcagacttaaatgtcccggtctgacagctttgaagagagtagtggttctcccagcatgcagctggagatatgagaacggacagactgcctcctcaagtgggtccctgaccccctgagtagcctaactgggaggcaccccccagtagaggtagactgactccccacatggccaagtaaccctctgagacaaagcttccagaggaatgatcaggcagcaacatttgctgttcagcaataatcgctgttctgcagcctccgctgctgatacccaggcaaacagggtctggagtggacctccagcaaactcaacagacctgcagctgagggtgctgactgttagaaggaaaactaacaaacagaaaggacatccacaccaaaaccccatctggacgtcaccatcatcaaagaccaaaggtagataaaaccacaaagatggggaaaaaacagagcaaaaaagctgaaaattctaaaaatcagagcacctctcctcctccaaaggaatgcagctcctcaccagcaacagaacaaaggtggacagagaatgactttgacgagttgagagaaggcgtcagacgatcaaacttctctgagctaaaggaggaagttcgaacccatcgcaaagaagctacaaaccttcaaaaaagattagacgaatggctaattagaataaccagtgtagagaagtccttaaatgacctgatggagctgaaaaccatggcacgagagctacgtgattaatgcacaagcttcagaagctgattcgatcaatgggaagaaagggtatcagtgattgaagatcaaatgaatgaaatgaagtgggaagagaagtttagagaaaaaagagtaaaaagaaatgaacaaagcctccaagaaatatgggactatgtgaaaagaccaaatctaggtctgattggtgtacctgaaagtaacagggagaatggaaccaagttggcaaacactctgcaggatattatccaggagaacttccccaacctagcaaggcaggccaacattcaaattcaggaaatacagagaatgccacaaagatattcctcgagaagagcaactccaagacacataattgtcagatttactgaagttgaaataaaggaaaaaatgttaagggcagccagtgagaaaggtcacgttacccacatagggaagcccatcaaactaacagcggatctctcagcagaaactctacaagccagaagagagtgggggccaatattcaacattttaaagaaaagtattttcaaaccagaatttcatatccagccaaactaagcttcataagtgaaggagaagtaaaatcctttacagacaagcaaatgctgagagattttgtcaccaaaaggcctgccctacaagagctcctaaaggaagcactaaacatgcaaaggaacaaccggtaccagccactgcaaaaatatgccaaaatataaagaccatcgatgctaagaagaaactgcatcaactgacaagcaaaataaccagctaacatcgtaatgacaggatcaaattcacacataacaatataaaccttaaatgtaaatgggctaaatgctccaattaaaagacacacactggcaaatcagataaagaatcaagacccatcactgtgctgtattcaggaaatccatctcacatgcagagacacgcataggctcaaaataaagggatggaggaagatctcccaagcaaatggaaaacaaaaaaatggcaggacttgcaatcctagtccctggtaaaacagactttaaaccaacaaagatcaaaagagacaaagaaggccattacataatggtaaagggatcaattcaacaaaaagagctaactatcctaaatatatatgcacccaatacaggaacacccagattcataaagcaagtcgttagagacctacaaagagacttagactcccacacaacagtaatgggagactttaacatcccactgtcagtattagacagatcaatgagacagaaagtgaacaaggatatccaggaattgaactcagctctgcaccaagtggaccgaatagacatctacagaactctccaccccaaatcaacagaatatacatttttctcagcaccacatcacatttattccaaaattgaccgcatagtcggaagtaaagcactcctcagcaaatggaaaagaacagaaattataacaaactgtctctcagatgacagtgcaatgaaactagaactcaggattaagaaactcactcaaaacccctcaacaacatggaaactgaacaacctgctcctgaatgattactgggtatataacgaaatgaagtcagaaataaagatgttctttgaaatcaatgggaacaaggacacaacatatcagaatctctgggacacatttaaagcagtgtgtagagggaaatttatagcactaaatgcccacaagagaaagcaggagggatctaaaatcaccctaacatcacaattaaaagaactagagaagcaagagcaaacatattcaaaagctagcagaaggcaagaaataactaagatcagagcagaactgaaggagatagagacacaaaaaacccttcaaaaaatcagtgaatccaggagctggttttttgaaaagatcaacaaaattgatagactgctagcaagactagtaaaggagaaaagagagaagaatcaaatagatgcaataaaaaatgataaaggggatatcaccaccaatcccacagaaatacaaactaccatcagagaatactataaacacctctatacaaataaactagaaaatctggaagaaatggacaaattcctggacacatacaccctcccaagactaaaccaggaagaagctgaatccctgaatataccactaacaggctctgaaatttaggcaataattaagagcctaccaaccaaaaaaagtccaggaccagatggattcacagccgaattctaccagaggtacaaggaggagctggtaccattctttctgaaactattccaatccatagaaaaagaggggatcctccctaactcattttatgaggccagcatcatcctgataccaaagcctggcagagccacagcaaaaaaagagaattttagaccaatatccctgatgaacattgatgcaaaaatcctcaataaaatactggcaaactgaatcagggagcacgtcaaaaagcttatccattatgatcaaatgggcttcatccctgggatgcaaggctggttcaacatatgcaaatcagtaaacgtaatccatcatataaacagaaccaaagacaaaaaccacataattatctcaatagatgaagaaaaggcctttgacaaaattcaacagcccttcatgctaaaaactctcaataaattaggtattgatgggacgtaactcaaaataataagagctatttgtgacaaacccacagccaatatcatattgaatgggcagaaagtggaagcattccctttgaaaactggcacaagacagggatgccctctctcaccactcctattcaacatagggttggaagttctggccagggcaatcaggcaagagaaagaaataataggtattcaactaggaaaagaggaagtcaaattgtccctctttgcagatgacatgatggcatatttagaaaaccccatcatctcagcccaaaatctccttaagctgataagcaacttcagcaaagtctcaggatacaaaatcaatgtgcaaaaatcacaagcattcctatacaccaataagagacaaacagagagccaaatcataagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatggagaggaggaatcaatatcatgaaaatggccatactgcccaaggtaatttatagattcaatgccattgccatcaagctaccaatgactttcttcacagaattagaaaaaaactactttaaagttcatatggaaccaaagaagagcccacattgccaagacaatcctaagccaaaagaacaaagctggaggcatcatgctacctgacttcaaactatactacaaggctacagtgaccaaaacagcatggtactggtaccaaaacagagatatagaccaatggaacagaacagagccctcagaaataataccacacatctacaaccatctttgacaaacctgacaaaaacaagaaatggggaaaggattccctatttaataaatggtactgggaaaactggctagccatgtgtagaaagctgaaactggatcccttccttacaccttacacaaaaattaattcaagatggattaaagacttcaatgttagacctaaaaccataaaaactctagaagaaatcctaggcaataccattcaggccataggcatgggcaagaacttcatgtctaaaaaaccaaaagcaatggcaacaaatgccaaaatagacaaatgggatctaattaaactaaagagcttctgcacagcaaaagaaactaccatcagagtgaacaggcaacctacagaatgggagaaaatttttgcaatctactcatctgacaaagggctaatatccagagtctacaaagaactcagacaaacttacaagaaaaaaacaaacaaccccatcaaaaagtgggcaaaggatatgaacagacacttctcaaaagaagacatgtatgcagccaacagtcacatgaaaacatgctcatcatcactggccatcagagaaatgcaaatcaaaaccacaatgagataccatctcacaccagttagaatggtgatcattaaaaagtcaggaaacaataggtgctggagaggatgtggagaaataggaatgcttttacacttttggtgggactgtaaactatttcaaccattgtggaagacagtgtggcgattcctcagggatctagaactagaagtgccatttgacccagccatcctattactgggtatatacccaaaggattataaatcatgctgctataaagacacatacacacatatgtttattgcagcactattcacaatagcaaagacttggaaccaacccaaatgtccaacagtgatagactggattaagaatatgtggcacatatactccatggaatactatgcagccataaaaaaggaagagttcatgtcctttttagggacatggatgaagctggaaaccatcattcttggcaaactatcgcaaggacaaaaaaaccaaacactgcatgttctcactcataggtgggaattgaacaatgagaacacttggacacaggaacaggaacatgacacacctgggcctgtcatggtgtgcagggaggggagagggatagcattaggagatatacctaatataaatgatgagttaatgggtgcagcacaccaacatggcacatgtatacatatgtaataagcctgcactttgtgcacatgtaccctagaacttaacatataattaaaaaaaaaaggaaaaatatggaggtaataaaatatttataaccataggaatagttttttttgataaaaagaagcaatcacaatgttatgttttattagtaatccaacaaataaggatgattttttgcaaattttggttgtatatgtttatgtttttatatttaagttttccatttagagttaacattaatcataaaaattattaaaatatattcttttaaatatagatttgatcctataactgaaaaagaattaatcagtttacttgggagaggtgcaataatgctctggatgctggaaatatcagaaatataaatggttgtgctgaggtataaatacatctcaagatgtaagccattgactcatgtctcattggtgatactaaggctatcataaatatgtccatataattttaagggatattaggccaaaattcaatctcatatctaaactaattatccaatttcagaagctttgccttccagatcttacagtccactgctcaaaatagtttgttagtttattagaaaagtgaaaagaaaaaataagtagtggaaaattaattgataatatgaaagattcgatgcagatttatctaatataccaaatctacattggatctttcattttatcaattaattttcttgtgtattactgatttcaaatttttgacaagctgctcatatctttaggcaagttaaacttcatatcttgggaattctgtttgtaaagctgacattttagctgaaaaatccttctggcctgctatgatataagataacaatgagacatgaagtgctttaagaatcacttcagtagaacatagtttttaaaaaagttctgactctaagaaaaggtggactacatgtatttctacatataatattttccctaataatgcttttaaggcagatttttcgttcagcttagtttttaggaaacctatcaaccactgtgtgttcactctgtttcctctcttggggcaccccaaaactagcaagtagttttccccctgttatccttcacattgacttgaatgtctcagtttgcttaaaagattagggtgaaagagaatcataccagtctagactaacctaagccctggagaacttccctaggttgagttaggtcaaatactcaatgctctgtgtacaaatgcttaactagatatgactaccttacatgaagtggctcaaccataattctgcatattgtttaaacaattctacattggatctatgatacttattaataagtgtctagaaatcacattaaaagaggaaataagactaattttgtatgttttggaagataattaatagtgatttcccagtgccctctactaagtggtgcaatcatagaagaagtttagcaagtgaacttgctaaacttaaaatttgctttgctcattcataagctatgaaactccatttgctttgctcattcataagctatgaaactcattcctacacattctaatgtttatgatgcaaatatatgtctctggaaaatttcaaattaccttcatggactttcagattgaaagtccgactgttaaatctgtagatgcaaaaagcctacttatataaccagtgctgaaatgacatctacagtgccatgggctaatcgtatctttattttaatattttgtaaacttgctaaactgaatgttgttaaactgaatgttgaatttgaagtgaagttatagacacttaggtgctagggtattgtacagattgtagacatttaacattttatttcacatttaaagtttcaaatatgtttttaaagctaatatgctaatggagaaggtatctaaatcctttgtagttggaagtaattctattcctccttcttcttcctaaatatactagctttcttctactgcaactaatcttttcattttattaataatatttatattatggaagactgaaatggtaaaaaaaataaaaataaatgagatccagtgtgtgctgctttatacgtagcagactggggatgacacgtatactttgttcttttttgctgttgttgttagagacaggctctcccaaagtgctgggattacagacatgagccacaccacctagccagcatatagacttttatctctcatgcctattctgatagaatagtagtggttacctggagggctgtgtacagaggaattttaggttgaatatggtatcagaacagaaaataattaataagccatatctgctatgagttcttgtaatctaccatctgccagtaaatccttgatttttggaagggatagtcataagacctctgaaaatttccatattcaaataagaacgtgtaattccctcttccccccacaaaattatgtatgcacagacaaatgaataataaataggatatattcatagcaatccatttgctttgctcattcataagctatgaaactcattcctgcatattctaatgtatatgatgcaaatgtgtgtctctggaaaatttcaaattaacttcatggactttcagattgaaagtccgactgttaaatctgtagatgcaaaaagcctacttatataactagtgctgaaatgacatctacagtgccatgggctaatcgtatctttattttaatattttgtccagttcaacaatatttgcttcagagataatcatgcatctaattgggccaaaatataaggttttaggggtgaatgttaagatgtaatgcatcagagaagactttcagtagcctcatcattgaatttgaaggataagaacactatggagaaattaggagaaaacactatgctatggaaaatactatgctgtggaaaccctatccagtaactttaccatgagtgtaatctacccaaatgaattgctggacccagactgtgtgcacagatggctgaaacagtcagacctacacctaggagatgagatcattcaggttcaccgtgacccagccgcgctggatggatctggatgtgctactctcacggttgtcatgaggtaatatggataggctattaacaaagccgtgacgacgcactcccctgagacacggtctgcttgttttgctgcatgtagtaaacagctctctcactagatctgacagcacttggtggtgatattcttttcccttcagactgactgaggaggatttcagaggtacctacagcattaagcctttgcctgtaggatgttataattttttgtgtgtgttgcataaggataaatttttgccatgttgctgtaaaaacatctaaagaaggagatcaagaccatcctggctaatacagtgaaaccttgtctctactaaaaatacaaaaaaagtagccgggcatagtggcgggcgcctgtagtcctagctactcatgagactgaggcaggagaatggcgtgaacccgggaggcagagcttgcagtgagctgagatcgtgccactgcactccagtctgggcgacagagcgacactccatctcaaaaaaaaaaaaaaaaagaaaaaaaagaaaaaaactaaagattttatttaactaagttattagtaaaaaaaatcattaggtctcattttagaattcacttggcacacatgaaaagaggtgacctgtttttcattgtttttttaaatgacttagagcttttatttacctagtgaatttccgattcacttgtactttatcaatttgtgactttgccaactggtgagctttcattttagggcttcgctgaagttttcttgagacaggctgttatgatagcatctctaagtgctgcaatatgacaagcttccaagacagttgtaaaacaattaaaattgtcactaaaatgtcttggctggaattcatattaacatgaataaaaggaactcaagagtctcaaatgttcttacttgagtctgtagtgttacttggtaaagattttacgtttttttcccatcgtatcaatcaatagtaaaccccaatcctttctttttggactgagaagtatgcaagcattttcataccacatgatattatctttccaaaagctacttgtagatgtaaaataaaatctgaattgttttattttgctcatagttagtaaatgacacattctgtgtctgggtgaaaatctttctctataataaccactgatatcttgagattgtaatatttgttactagtaccaagacagtttcataggcacaatctcttcgactggctcttttgcagctctttgggacccttgaataatatagagacagaatcttaggagatgttagcagtatcacaggtcataccttatgacaagccttaacaatagtgtgtcaggagactctcataaaaaatcattagatggatactttagctgcaaattatttcctctggacactgttctgtcctctttatccatcatcataacagtttatatcacataatggtcagcaagaactgtcaaaggagcagataggtagattactgatgaatgcctttcctgatattctcgtttttcctatgacagtctgtgatctgtgttatccctggttaagttgtggttactaccaactccaaattccaaatgatatttcatattctgtgtgttccgccaatgcccagtattacatggtattagggggaacataatcctttgctcagccaactccagacaaagtctgcagagcttctccttgagatgagcaaacttggaatgtaaggaaagttactgttcatcataaacatttttaactagtggaaaaagataacataaaagtccatatgctttcagaaagtaattttcattgtggaagcttctgagtagggcatacaaaggaacataaaacctggtgatgccatgaagcagctctttgcacagttgacatcatttctcataaagtattcccttttaagtcatccacagtagaaatcacaaaagaacagagatcaagtactggtctcgttagtcagagattgtgggttcgtacctcatttggtctgggatttcttagtcacaggggtgttttagaaggaccatgttttagaaggaccctggaagaacagggtttttggattcaacagacttagattaaaatcacaaccctagctagctcttttatctcagacaatttagttaatattttgatttcagttttcttatttataaaattaagatgatgatatatacttcttaggtttgttgtgaggaaaaattaaaagagtgttgaagagcctagcccacacctggcatactgtcagcactcagaaaatcatggctattatttttactattagcatgagactcagaaactatgggcctgttatctcatttgcctggttttatttcatatgtggatcttatgctgagatagctgactaggcatccaggcttggccacatcttctaagtatattttaatcaactctgtagtgtctgtttctttgttaacctcaaagagactattctgaaaaacaagtattattccctcaaattaacttcccgaatcatttttcgagaatataattcatatattaatgttaaaagtagtgttgtgtattctttaagtttcttcgatgttctagattttcagagtcatgagtaacaaatgctctattgctgtattttgcatgttctatctaatttccttgactagcctcatcaaaattttggtgatttttacacagtaaaactgggatcagaagttaaacactgggtgggattaagattcaattcacagtaagaaaaacaaaacctttgtatgtaacataagtgttttcattattccctatataacaccacaaaatggataaaaatctttgtataacagtttaaaataatttaaacatccagactaggaaataaaaatgaattaataatggataataaatttttatttcttatattgtgttacaattatataattacatatataatcacacatttaataaatatgtataatatcttattctgatatggatatagaattttacagttgataaatctttttaattcaaatcattctattctattcttaaaacaaaattctttgggataatgattacatcaattttttaaatggaagactaatgccaatgaggaatacaagtcgcaaaccaagatttgatagtagttctcatttacattttaccacatcaggctgcctcatgatgggatatgttgcaatctatgaacccactctccattttggggagtttcttcacagcatccttttcttctctcagtcttcttgtggctaaatttaggcacacatgtatacatacatgcacacacacacacacatgtgtgtgtatatatatatatatttgtgtatatatatatatatatatatatatacacacacacacacacacacacacacattgccttccaaatttgagggataaaaagtagaatgtaataacatgactcagtgtaaaactgcaccttcagttttatccttgtgtatttatcattgcatgtttatttatttataaattttgtataacatgtagctaattttgagcattgggtaataaaggtgggttagggtcactttttttggtggaagttgatgttggaaggaaggtgagacagtctcatataagaaactatgaatcatagagtctctactgttacacattgctgctgatgagaattttgttgtccaggacaattgtcattcctttgtaagtgactatgttttaaaggatgttgtgtgtgtgtgtttgtgtgtgtgtttaatgtggattaattttacttttatattcctgcatatggctaggccttctccttcagaccctgaacatcactatcttttgtaaaatagatacagtaaaatagatatagggatagtaaataagaaatgctcttacttcacttgaaaattttaatgtgatttcagagcagatatgaggttgatatggtacgaaggcgcacatttaatattggagtcaactaaggtcctattcattttattaccaatatcccaaacttgttatataaactcttaccttatattctaaaaggggggtaataataccttctattgtaattttaaaacacagagttttgagatgtgttaagaatcacagtgccttgcacttaatttagtaaaagttgaccccctgccaccttttctttctcttctgattaatagaggagtctactacctcaaacatttattactgatttgtgtggggaacattacaaatcttctagttattttgaaatatactataaattcttgttatctgtaatcatcctactgtgctaccagacactataacttattcattccatctgaatttttatacctattaactaacatctcctccttccctgctactcttcccagcctctggtaaccactattctactcactgtattcatgagattaatttttttagctcccacatatgagtgagaatgtgtgatatttgtctctctgtatcaggcatatttcatgtgacataatatcctccagttccatccatgttgctgcaaatgacaggatttcattcttttttatgattgaataatatattattgtgtatgacaatattttcttaagtactcatacatcgatggacatttaggttgtttccttatcttggctattgtgaatagcactgcaataaatatggaagtgcaggtattgcttcaatatactgatttcctttcttttggatacatattcatcagtgggatgggtagattatatggtagttctatttttaattttttgagaaactgccatattgttttccatagttgccatgctaatttacattcccaccaacagtatatgagtctctcctttctccacatccttgcaagcattattttctgtctttttggtaagaaatagacattttaactgggatgatatatctttttatggttttgatttgcatttcctttatgattagtgatgttgagcattttttcatattcctgttggcaatttgtgtgtcttggaagacttagtattgttaagatgtccataccgcccaaagtgatctacaggttcagtgcaatccctacaaaaataccaatgacattcttcacagaaattttaaaaatgaaatgatcctaaaatttatatggaacaacaaaacacctcaaatagccaaagcaattttgaggaaaaagaacaaagctggagacatcatattacctgacttcaaaatataccacaaagttatagtaactaaaatagcatgacactggcaaaaaaacaaaaaaaaccccatagacaaatagaacagaataatagaatagagaactcagaaataaatcttactcatttatagccaactcattttcaacaaaggtaccaaaaacatacattgaagaaaggacaatctcttcaatagatcatgctgggatgtctggatattcatatgcagaagaatgaaactagattactctctctcaattaatacataataaaatcaaaatggattaaagacttacacataggatgtgaaagtatgaaactactagaagaaaacattggggaaatgctccaggacagtggtctaggcaaggtcttacttttcagtaagacctcaaaaaacactaacaacaaaagcaaaaattgacaaatggattacatcatgctaaaaggtttcttcacagaaaaggatacaatcaacaaagtgaagagacaacccacagaatgggagaaaatatttacaaattattcactctacaaaggattaatacccagaatagataaggaactcaaataacttaatagtaaaaaataataataatccaatttaaaaatgagccaatgttcttaagacaattctcaaaagaagacatgtcacattgttttcagataatttttaaattggttttccttctgaagatactaaagttttggtggcaagagcactgaattttggttctagaccatgggttctagaatctactgtaatactaggcttacataatttcagctatgaaatgcagggtttggatttaatgctttgtaaaattatttatagctccaattttttttattaatacttctctattttctgaggaaagatttaacatgatatcctttacagtgtcctataggtttaataacattatagcctataatctaattttcaaaagtagttttcaagtactttttcacatgtatgtcaagttatggttataatgctaaataaataatcaaaaggttgaaaaaataaagcaattaaaatttattataataacttccaaagtgtactgaaaactaaggattttatctttcacttgtggctttccaaaggtgaaagagaaatcaataaaaattcttacattattaatgccatttaaaacaacacaccaaatcaacaatggcttgggtagtatatatgcatcaaattcttcttgttgataaacataaagatatctttgagctagagggcatatggttcctactgtcattttacaaatagaaaagaaatcaaaagcccagatagtaaatgactgattcaaggtcatagaatgaagtattacgactatattccagtcttcttgaccactagacaataatcttaattcatcaggtggcaaatacccaaatcatatttattggtttataagtttgtagccattgcttacgatcattaaaaggaatatagaagtcattgttcaatgtttcctgaaaagtctttcaaaaaaatcttactgatcccaagcttttctaaagtattaataacttgctggactaactgatttcaattatttctataaaatataattactggttattcctgctgactgtaaattagaactattcaactacattttagctgctgggcaattacattatttctacaagtaaattattttattttcaagagtctgtttttattaatcttaaatatgaattattacccaattgttcttgttatagaaacaatatgtcatttagttaaatattgtagaaaattgtttaaaatataattacgtgatttttatttaaaaactaagttgaatacttgagacagtctcaataaggatcagtcactaaaaaagatgaaaaaatcgtaacagtctcagagattctgcattcagattgataggcaaatgtattaaattctagtggtgctttaaaaatgccaaagctagacatcagaaacaattagtggatatatagtatgacatctgcaaaaaagtgtagttaaacatgattttttttaaatgtcaaagttcgaaatggtataactatgggcagactttgaagctataaatatttcagttgatcatatagatgacattacttatatttctatacctactttatatataccacaagagacctacttattcagtcaaataagacattgcgtttaatatagaatttaagaaatatataaaaatactcattataattaaatcttctatatttagcattgcagatttttaatttactctgtaaaataatgttatataaactgttactagtattagcctaaacacactttagtaatatatgtttgtgactttatttttttataattaagcaaatatacatacgtttaatgtagtagcacaattgcaaatagtatgtttcactattcattagagggataagttattatgcacaaaagttaaaataaaatgaaaataatactacaacttaaggatctattttgaaattatgaaattgacatcagcaaaataaaaacattttgttgaatattttctttctttttttttttagaataaaattaacttttattatgttgaaaattgtgacaaagaacgtttagtttactctggtcttagggaactatttaaatataaaaagcgatgggattacatggattccgtgaaaagttaaagcttctgtacattaaaaattcctaaaattaaaagataaacttcaaattggcataaaatatttacaactgatatgatagagaattaggatcctcattttgaaaataatattaatgaaaaaactggatagaaaacgtcactagaagaatcacacacaaaaagattgtatatagtgaataaacatgaaaattagtcaaataattacaataaaataatgaaaggtaaatcaaatcaccaccaaagataaataatactgaaatactattggttgagtctcaattttttagtgacaataatgctgttcagggtatggtaagatggagatacttcctaatgggactaagaattggtacaacatttatggaaagcagtttattcttattcttttttttttcttttttttctttcttttttatttatttatttattattattattaatttttttattatactttaagttttagggtacatgtgcacattgtgcaggttagttacatatgtatacatgtgccatgctggtgcgctgcacccactaactcgtcatctagcattaggtatatctcccaatgctatccctaccccctccccccaccccaccacagtccccagagtgtgatattccccttcctgtgtccatgtgatctcattgttcaattcccacctatgagtgagaatatgcagtgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaatgaacatacatgtgcatgtgtctttatagcagcatgatttatagtcctttgggtatatacccagtaatgggatggctgggtcaaatggaatttctaattctagatccctaaggaatcaccacactgacttccagcatggttgaactagttcacagtcccaccaacagtgtaaaagtgttcctatttctccacatcctctccagcacctgttgtttcctgacattttaatgatcaccattctaactggtgtgagatggtatctcattgtggttttgatttgcatttgtctgatggcctaacactacttgctccagtatggcaaacctgaatgtcattgagattgacaccaatctttgtttttgtctgtttctgttctgtgtactgtaacagaaatgtttcatgtttatgcactttgttttgcaagagcacttcacatatctctgcccagttccaaagtataaccgagtagcagaagactacagtcatttccttatctttttaaatgtcacctaactccaggagatgttttttccatgttggaaacagcagtctagagcacaactgttttaaaatcccatctcctaattttaaatgatagaacgtgacacttcttacttctaaagaaactgttaatatgtaacaagtgtcttctcaatcactattgaattcaaaaacaggtactcaatctataaatcattgttctactgggagtacatttttgttgagtgacatttttcttaggttgtgtgtgtatgtgtgagtgagagagaggaagagggagagagagtcagtcttagccttcatctctgattttatatctgttttcctccctaccatttccctcccctccccacccctgccctcccttcccctcccctccccacccctgccttcccttcccttcccctcccctacagcctctcctttcctttatgtcaaccattgtgacatgcagtgtttgaatgacttcataatcagaaatgatatgctgtattagtttgccagggctgccataacaaagtaccacaaattgggtggctcaacaacagaaacatattttcttatagttctggagattataagtccaagatcaaagcgttggcagttttggtttatccttaagcttttctccttagcttgtagatggctatcttctctctgtgttctcacgtgatctttcctctgtagttgcgcatacttagtgactctttttgtgtccacgttgcctcttttcgtaagacacaaatcaggttggttgaggacctaccctaatggcctgtttaagctaatcacccccttaaaggccctatctccaaatactgtcacattctgacatgctggtggttaaagctgcaacatacacattttagtgagacacaatttagcccctaacatgaggattgcaagctattccacaaaataagattgggcaacactctacaaatgaaactattggaaaaatagttataatgggagagtttagccattgctacaatcagccacatacaaaaccctaaatgtgtaggaaactaaagaatttgaggtttcctcaaaagcatatcatagtggcccaggtggaggatctaattaaactaaaaagcttctgaacagcaaaagaaactaccatcagagtgaacaggcaacctacagaatgggagaaaatttttgcaatctactcatctgacaaagggctaatatctagaatttacaaagaactcaaacaaatttacaagaaaaaaacaaccccatcaaaaagtgggtgaaggatatgaacagacacttctcaaaagaagacatttatgcagccagcagacacatgaaaaaatgctcatcatcactggcgatcagagagatgcaaatcaaaaccatgatgagataccatctcacaccagttagaatggtgatcattaaaaagtcaggaaacgggccgggcgcggtggctcacgcctgtaatcccagcactttgggaggctgaggcgggtggatcatgaggtcaggagatcgagaccatcctggctaacaaggtaaaaccccgtctctactaaaaatacaaaaaattagccgggcgcggtggcaggcacctgtagtcccagctactcgggaggctgaggcaggagaatggcgtgaacccgggaagcggagcttgcagtgagccgagattgcgccactgcagtccgcagtccagcctgggtgacagagcgagactccgtctcaaaaaaaaaaaaaaaaaaaaaaaagtcaggaaacaacaggtgctggagaggatgtgtagaaatacgaatgcttttacacttttggttggactgtaaactagttcaaccattctggaagacagtgtggtgattcctcaaggatctagaactagaaataccatttgacccagccatcccattactgggtatatacccaaaggattataaatcatgctgctataaagacacatgcacacgtatatatattgtggcactattcacaatagcaaagacttgcaaccaacccaaatgcccatcaatgataggctagattaagaaaatgtggcacatatacaccatggaatactatgcagccataaaaaatgatgagttcatatcctttgtagggacatggatgaagctggaaaccgtcattctcagcaaactatcgcaaggacaaaaaaccaaacaccgcatgttctcactcataggtgggaattgaacaatgagaacacttggacacaggaaggggaacatcacacaccagggcctgttgtggggtggggggagcggggagggatagcattaggagatatacctaatgtaaatgaggagttaatgggtgcagcacaccaacatggcacatgtatacatatgtaacaaacctgcacgttgtgcatatgtaccctagaacttaaagtataataataaaaaaaaggaaagaaagaaaaaaattaaatgacttcccagaaaaaaaaaagaattagtaaatgtaaattcatagactagtaaatagtgtcatactctatctgataaaatagaagaatgtgttggcaaagatgctgatggtacatacagaagctagagaaaaacagccaaaagggtaagaatttgatgttacatttctagcaatgtaatggtctgaggtcagaatgaagggattattaagctttctggctactagaaaaatatgtcctctcttatgggcctgacttaaaggccttgctgaagtcagctgggttgtagtatgtccctgttattatacttttttacttttttttttttggagatggagtcttgctctgtcacccaggttggagtgcaatggggtgatcttggctcactgcagcctctgcctcctgagttcaagtgattctcctgcctcagcctcccaagtagcttggattacaggcacctgccaccattcccagctaatttttgtatttttaatagagacgggatttcaccatgttggtcaggctggtctcgaactcctgaccttaggtgacccacccgcctcggcctcccaaaatgctgggattacaggcataagccactgcacctggcctgtactgtttcattatattccatttttattatatcttatttttgtcaagagtaatttattctgaaattcaatttctcatgcgttctaacaatgcgaacttcatgaagaacaaacataaatattctagttctagggaacgataaccccaagttttaaatgaatagagttgctttctggtttaactatctaccatgagctccaagatagtcttgcccaagtaggcagccattttctttggaatgttccttatagtgcttacaactttaacttcagcacactcatataataagcactgttgagtcttattctgcctattctctaaaaaaaaaaaaaaaaagcaaagcaaaacaaaaaatagtatacatgattcagttctcaaattccaccagctgttttaaattttttttgaaacctctagtccagtcttaatatttaatcacatagcattttgtatggcattttgaaacaaactgaaaaacactaaattcagcttatttgagctttttgttactctagaaccttgaactactgctcactctattcttatatctttgcaaatctcacttctttacatattccatgtcaaatgtcaactcctccaaggatttcttgactacacttgttaaatgaccactcattcccatccccagtcactactgcatagacaaatgactgacactaattggggtcagggaatatttatttactaaacaaaatcaacaaatcaatgaatccattctggcttctatagcatatttgaagaatgatagttaacaacacaatttctatataatatttatttataaatgttcatgttttaggtaaacattgcctaaaagttgtagataatccctaaatattttcctatgatttatataatttatgaattcatactatcttctattggaagacaagtgatttttagcttctaaagagttcacttgtcaatgaattcttcagtgattctcaaagtgtgatccccaaaacagtagcattagcatcacctacaaatctattaaaaataaaaatttgaggccccacacaggaaccactgaatcagaaactcttagactggggtccagttatctgtgttttaacagactttcccagtaactcttgtcaaccactcttacctaatcaaaagtctaaatcgatacctgtggctattacagttaaaatggtagcattgtcattggaatatatttgaatttctttagtgattttagaaatttttgatataattgtagaaaatcaatcttagatcactactgatttacaattccattcataggcttgacatctcagactgatccaagagccctatacctaatttctcagctaaaagtcaatgtagacttggattcatttcctactacatggataaaaagctatttcccataacatttctttggtatgaaacagtaaaaaaaaaatgaataggaaatgacaataacccagcaccaatttatcaaccttgctgtcatttcttaaatatcattttcacaaatatgttattacagagctctggtagaggacaaagcgatgatttggcaagctccaaaaagactcaaatgtcggggaaaatattttaattccagaattatgacagatttatgctacgaataaatgtttgaaattcagataatatatgtcacctttcttttgtggcacaaagataatagaattataagagagaaacttcattgtttttacactatgacaaaaatatgggcctgtattaagaaggggaaaagtagcatgtattattgaagaaacaggagccagcggttgaatactctcctgccttttatctccacctgtagtgaactcacttgtactcttcttgccctacaaatagaactgcaatctgccatgcaattattacctaacctttgcaagctgcctgtgttgtcaaaacatttctgctcagtaacatactatacttaaagaagatagttactaatgcacttggacacattttctagtacaggcagaaattcttgactcttaaaatggcattattttcacttcttcatatacttggattgtatcttctaatagagatgatgaagcaaaaaatcgaaacaacaatgatttaaatcctttgggaataaatatgaagatcattgcatacaaatagaccaaaaagactaataattttttgaataggaatatctacatgaatatattttaaatgatgaaatgaaggtcctcagtatgtaggaaaatatagttcatgaaaattggaacttaaaacaagttttctttttaatgtagaatataagctcatccttttacaccactttatgtatatttcaattcaatgaactataattttattgagaattgcattttccactggactttcctagcaatttcttattaaaattttaagaatgtatgttgaaagcatatttactattatgaaaatatattgtatatatttaaaaatatatttgttattttgtaatatcaattgtatcaaaatgtatttcttagaaattacttttaaattatagggccttcagctagaaagagggcataatttgatgatctttctcctgaaaaaaaattagcatgtagtcctcttggtaaaagcataaatttaatatggcttgaaataatgcctttgtggcagattagagacacttttttgaaatattacaatgccttttaaaacttttagccttcaaaaaaggaactatttcagatactaattactaccaaaatttatttagtcatttttaactgctcaaacagcaaaatacacaaaagtaaaataattttaaagttgtaatcacggctgttgccctttgtgcccatgggttctgcatccacagattcactcaatcatggactaaagtattttgaaaaataaaaataaaaaacacaaatttaaaaatacagcataacaactatttacatagcatttacattgtattataaataatctaaagagatttaaagtgtttgagaggtcgtggatagattttatgcaactactatgccattttatataagggacttgaacatcagtggattttggtatgggatgggggatttctggaaccagttgccctgggatcccaaggtatttcaactgtatttcctgctagttatagatatttttagatctgctcttagattttttcctatagggattgattaccattgtataatgttagtataaaaattttaatcatgttgtagtaactgctgaaatatatgtaactaacatataatgtgattgtgaagtcttgatatacataaaccaaatatacatgtgcttaaagaggttacttgtatttttaatggcatataggccattattaaagaaactattaatttacaaatagaatcagcacagcttcttacaaaataaatacaggatatattttttgccttggaatagtcatagaaaaagtaggatttgttacattgtgggaaacttaggtagcattatggtttcaattagagtcgaaatttaagttcttcctttcaactttttttggtattttacgtttagaataccttcaactttgggaaacataagtcaagaggcagcaggaagggtctactcactcagtaaatacacaaggcatgctttgaactcaggggaaactaatttgcacaattcttactgctcttttgttgtggagaaagttttatgtgtggaaacaaatatgttcaaagagtcatgttacagaataatagagaaaactaagtaatttgtatgttatcagataaagtaaaagttctaatggaacaggtagtaagtcaggaaatgggtactttactaccaactatttacattaaccagatggttatttgcctaattttatttagattattatgtttcaatagtttgtagttgcacaagcaaaagaacagagccatatagttgcttaatataatattatgtaactctcaaattttctataattttaatttcctttaaatggaattcattcatatcaattcattcacttgaatatcactaaatttggtatctggtacagtataaattctatatgtatgtctgttgacattatacattatacataacattcaactatatatcataattagaacaacatgactatttttagagtaaaaatagtttcaaattgtatatttgtttcagatatgcacagatatgacatggtatacatacctgaaatgttatatttttattctgttgtaaaattacttttaagttaaattatataagacaaaatataaaattaataaaaaattaaatacgatcatttgaaatgattgtgatttaagaaatattttatagaaagcatttgaaaataactaaatttttcacatgcttactatctcaatatgtgcttcttatgattttaatagtatacttcaaaaggaaaaaaacgcagggtgttcaatcaatattttctatttatttgttcgcataagcggttatccaaaaattaagagttaaatggacatttgcctattatcaaataaaattgtttgtattttccactctgttctttttcattttatatggcaattattttatgtgattttttaaaatcaatttcaattattcatggatccctaaatatgaattttctatagccaatccaactaccaaataatgatagaaattcattaattcaataaacatttactgagaaactaccatgtgtcagacactattctaagccttagagattgatatggtttggatttgtacccccacccaaatctcacatcgaattttaatccccagcattggaggaggggcctggtgggaggtgatcagatcatgagagcagatttcccccttgctgttctcaggatagtgagtgagttagcacgagaactggttgtttaaaagtgtgtaacaccttgcccagctctttcttcctcctgctccagccatgcagtatgtgcctgcttcgccttcaccttccaccatgattctaagtttcctgaggcctcctcagccatgcttcctatacaggctgcaaaatcatgagtcaattaaacctcttttctttataaattacccattctcaggtagttctttatagcagtgctagaatgaactaatatggagatacaacagtgaaataaacaaagcccctgcggtcatagactgtactgcattgtagtaagggtcaggagattataggtagaaaaactaaacaaacatacaatttgttaggaagtcataagtttcaagcatcaaaaaacacaaatgaaaagagagtggtctaaaatggaagaaagcattattttgtaatcaggaaagattcctttcagatggttacatttacatagcgagtcctagaaaaaaagtgattgagtaagccttgtggatacatggggaaatgatgtttaagtgagaataaatagcaagtgctaataccctgagtcatatgcttgaaagtccttttggaagaaaagaaatgaaggaacatgactagaattaagtgaccaaagcagagaggggtagaagaggtattggggtagaatatgaggtcagaaatgtagatgagtaagagcagcagattatgccaatcttgcaggcccccacacagattttccattttattctgagtaatacggaaagtaattagacagttctttttttgtttcttacaatgttttatctctggggcagcctgccttcatttatcccttactatcttgcttatgcattatttatgtagtccctggaacagttagatagtctttgacatcagtatctacccaatctccacttttcccttcactgcaagattaagcttcctaggccgggcacggtggctcatgcctgtaataccagcactgtgggaggttgaggctgactgatcacctgaggtcaggagttagagaccagcctgaccaacaggacagaaccccatctcttagctgggtgtggtggcacgcacttgtaatcccagctacttgggaggctgaggtaggagaatcacttgaacccaggaggcagaggttgcagtgagccgagatcgctccactgcactccagcctgggagacagagcgagactccatcttaaaataaaaaaaagattgagcttcctaaaggacttcttggatgatgatactctctgaccaaaacttaaaaacaacccgaatatatatggacctcaaacaactctatagcaaaaaactcttataatccagttaaaaactaggcaaaagatatgaatagatatttctcaaaaaagagatacaaacagcaaacaagtgtacaaaaaggtgttcaacatcattgatcctcagagaattgcaaatcaaaagtacaatgaggtatgtcaccccagttaaaatggcttatatacaaaagacaggcaataatgaatgctggtgaaaatgtggagaaaagggagccttcctcaactattggtaggaaagtaaattagtacagccactatggagaacagtgtgaagcttcctcaaacaactaaaaatagaagtaacatatgatctagcaatcccactgctaggtacataccccgaagaaagaaaaacagtatatggaagagatatctgcactgtcatgtttattgctgcactattcacagtagtcaagatttggaagcagctgaaatgttcatcaacagatggatgaataaaggaaacatggtatatatacaagatggagtagtatttagccataaagaagaaagagatcctgtcatttgtagcaacatagatgggactggaggacattatgttaattggaatacaccaggcccagaaagataaacttcacgtgttatcattcatttgtgggagctaaaaattaaaataattgaactcatgaagattgaaagtagaatgatggttaccagaggctgggaaaaggtattggggtgggaggaagtagatttaatggtacaaaaatatagttaggtagaacgaatacgatcaagtatttgatagcacaacagttgtgctacacttaacagtgtgactacagttaacagtaatctagtatatgttttaaaataaccaagagtataattggaatgtttgcaacatgaagaaatgataaatgcttgaggtaatagataccccatttaccctgatatgatgattacacattgtatgcctgtatcaaaatatctcaggcactccatatatatatatatatatatatatatatatatatatatatatatatatatatataaaatatgcgtctactatgtacccataaaaattaaaaattaaaaaaaataagcaaaaaggccaatagtgattatcatttatagtgttacatccattatctaatttaaattattattcacgtgaaccctctgaagcaaatactactgttatacccactttacaaatgaaggaaacatggcttaataaagttaagaagtaatttgcttgagtgtatatatctagacaatgatggagacatgattttatctccactgctaatcaaatgaaatgaaattttctcaaccaaaaagttaagtccttccacatggtgcttacatgtaatctagactggccaagctccatgtgccctctccatcgcctattaaatttggggtcagaggcaagttatcaaacctagcgagtcagtaaacctctgtaaaattaatatcttcctcaaaattaaatgagaaaatgaacacaaaatactttaaacagagcttagtatatgatgggaaattagatgtcagctatactcattacctcggtattatcatatacatcaaataatgcaacaaaatgaagaaaaatttacatgtaaatcatattattgttaaattgcaggaatatatgctcaagatattggttggccacagcataggtaaaactataccatattatcaatataccaaaaccatatgtgagcattttaaaaacttatttaccttatctctttttctaaaatgcatgtttctttacagttatagctttaaaaagtttaactaaagccatgagtgttcttctttggccagtaggagctgaagaatattttttcctattattaaagaataaaacttttactcatgtgactaccctaccagatggatcaatagatggaaatgtttacaatgacaatgatgaatggtaaaaatattataattacttacaattcttcatgttattcaaatgttctactcatcagaaaaaaattcaacttatggctattaacaagtaatagaggagtagaataagtcattgctaatagttttttttttttttttttgcaatgcggcaatgtatctaatgatagcagcttctattaagaaaaataaagtggtatttatgaattttgtaaataatgttctctggccaggtttttaccatactcctgatgtgtaccactatttaattagcataatttttatttctctctgtcagcctgctcttggcttatctcctacaggaagtaggatggcttttattttaggactacattataatggctggatttttacaaaagcctgtcaacaccacctcaaccccactgtctgtaggaatataaatacagtgtaactgacaacatagaatggctggaagcataatctccaatttactactgcctcaaatctgtgaaaagcccaaaagggagttgctgaatctcttcttcaaataaaatcctataaagagccaaatttaccaaaaaaactacaattgtataaagtgctctcggagatctgggtaaataagcactgctgtctcttcccagggattcttcaggacaattccaggtctctgaagagcaacctctgcatttgatactctgcagtatatcccccagataagtccaactgtcagagacctatgtgttttgactataaactgttggctccatgtagctccatgctttcagttgatgtcatggcgtgaacttaagaacattataagaagcagcacattattaaatctgtaacaaagatgttgttgaaaatgtttatggatttacagagaatcctcgggggcaatttctctctggtctaaggcttttcatgaataattttctgactgagggaggagaggacagtcttcatagagatagtggtctttgaacttggccattttctgatggattattttataggatcattccagaaaggggaaatttatagatctgagaaagtacatgattagtttagggaataagtgattttgtgttctggtagcattgcatgtgtgaaataatgttttatgaagtatgactagacacatgagttctcattttacatagtgtagattattttgtgtgttccattaaaagcctgtgagaagcaaactcataatgataggagatctctgaaagcaatatgaaatactcgtaaatattgccctcaaggagtatagtttgtgtgcaagataagttttccatagaagtaaacgtaattaaatatagaaagcctgaaggatgtgagtcttatttgagtcattttattcatcttaacagagaactatatccttatatcatttatgttagatttatacacacatattctctctctatatatattaaacataatgttttcctgtgttaccttctgagactataactcatctcatttatcacatgataaagaatacaagggtagataattaaatctaaaatagaaagtcaataaatatttatgtgtattattaatggctagtgaggcataagttatttttcaagatacataatttctacatgttcaagtttcaaaatgtgtttattatgaaaaaaaatatgaaagtattcttttaaatgaaatatttattacaatgaaaccattactatttttcaattacaattaaaaaggcaataattatggaattcttattattttgtttttcttaggaattaagaatcattgttatgcaagcacatcattctcatagccaaattatacagtctttctaaattttttgctagtctgtttactgtcactggcattttagcatgtccttctttgactcatagtgaattatgattaattcactatgaattataattaaaatattataatttcatcaactcatgaggtgattccttatcaataaaatgataatgtcattaatttcttttctagataccacaaatatctaattttttttaaaaaaagtttgagccaaataagtaattttcagaaatatggaaagttagcaaggcatgataactttcactctgtagttcaatattattatattatctttccacaggggagcacatttcagagtttgatgatactatggtctgaatatgtcctctaaaattcatatgtcaaaacttaattgccaatgcaatagtattgaggtggggactttacaaaatgaaatgggggactttataaaagagactgaagagagcacgttagataagcaacaaggtgccatcttctaagtaaagagtagccagtactaaataccaaatcttccggccttttgatcttggactccctagcctccagactgtaagaaatatatatctgttatttataattaccagtgtcaggtattttgttacagcagcacaaacagactgagacaatgtgcaaatgtgaactactagcagtgggcaacccaggagaatagcaaaatcacattttatctatattttaaatcatacaatatctctccatgcgatttctgctcgttaagttcaaatacggttcataatgagtatgatgtaatacacacgtagtttccatgaatctttaattcatgtaattgggaattttacccagaatttccttaaaatattatctgttctatattttgcatatgaggactagtaattaccagtatgttttgttacaaaaagagtactaagaaatataatccttagaaatatgcatacagtttatttggataaacattcaatagaatatcatatagtttacaaattatcaataaatctgttcccacacttaaaaaattacttttcaatgctgaaacttccaataacatggaggaggtttattttcttttgtagtaatgcttaatcattcatttcatttttttcaaacttaaaaatcagtttgaatttgaagagaacatctctcaatctaatctttataaaaacagattaaagctaattgtatgatatttatttcatcaaaatggttggttttcaaaggaagaggtcatttttaaaatgtcattaattttattttatgtcattaattttattttattatacttctacgcagcattccataggaggattccttactcaaagtgtttgaggctcaaatatccaaatgcctgtaccacattgctacgtggtgttttgactgactcaactcctgtgtttcagttttctctctagcaaaatgtggggagttaaattaatgagtttgcatgtatgttggttagtgtgtaataattttcgaagaaaaaatattttaacttgtgtactttaagttctgtaattatgattagaatagtaatcagatacatataacactacttgaatgaatttgttcatggtattaaatgaggaaagacagtcattaagtatgtcattaggtatatatattcacatatataatgcaaactatacatgttttctgtatattgttgaggtatataaatacttaagtttgacaaactgttaaaaaccattattctaaaagaattatctctgttttggttcagatattgcttctttgatgcttctggttctagtaaccttattttgtatctcatacctttcttgtcctgcagttttagagcttgaatcttattttattttattaggaccattttaccagtgaagaattattttttacttgttccttaaaatttaaacttaaaaaaaaagcaatatgatatcagtaaaatagctgaaagaatggtataaatattctttttttggttcatttacttcaattccatgagtcattccttcagttattattcaagtatcaatttcataattttggtttacaagcagaaatatttagaaatatttttccccaaaacatattgtctgattttgtgtcaggatgaacgaaatgtaaataataaagtaagatattaattttatcagtattggtctattatctttccctcctttttacacaaaatagaagaaattttaactttattataaatttaaatatagctccgagttttttctgatgtacaatgagtactgggtaaaattaagtcaaaatactttaggtttatgcatgataacgttttgaataaaagcataaacatttgaatcctggaacagtttaacataggtgatagtaaagaagtagatttttataaaacttttaccatgaagaaagtgcattaagttgtgctttctgctatgataattgttcacaagtcactctaatctcccaccattagacaaataacagagagcagagttcctgagaatctctaagtgtcaacagatgataattttattttcttttggaaacaatcctaaatgcagtacctcagacatttttattcatgggcatgaagtaagagatgaaacaaaatacagtaaaaacagaatcattaaacgtattgaaatatgaggctttggttggtcattgagagcaaaggcttgtttttctgtgcttgtatcaccagttcagcagattagaataaattaagttaaacaaacacatcttgcaattcaaaagccttatggtataaaatgctatattataacagttactaaacatatgcttcttttcattttgagcaccaaaactacaatttaattatatttttcgttgaaatgagttttataaacactgtgatctactgtatgttttatgtatttgcctggtgtaaatgctttctacaaaaaatatatgaacatgagtggtatagttggcataaatcttgtatatatatatatatatatatacacgaatatatatttgaatatatatatacacgaatatatatttgaatatatatatattcaatatatattgaatatatatatattcaatatatttgaatatatatatattcaatatatatatatattcaatatatagaatatatatatatattgaatatatatttgaatatatatatattcaatatatattgaatatatattgaatatatatttgaatatatatatattcaatatatattgaatatatattgaatatatatatattcaaatatatattgaatatatatattcaattcaaatacatattccaaactaaatttgcaggaaagcctatttgaagtatgcacttttgggaatgaaattataaaacagaaggttgcatagacttatcgatgttcttctccatcctgaccattcttactgctattcttttctgtattagattcaaacttgatctctccacagatggtcttagggatagcatattatgctaattaaagatacacactctgaagttaagttgcctgggcttaaatcccagatttccatttactcactatttgtgcttgatcaagtttcttaacccctttgaggccttaggttcctcctataaattatgattaaaataagaatagttacctcatgaagcggttttgaaaattaaatgatgtaaaaaaagcgtttagaacagtatgaacacttctgctaagtctatatgctgatcacaagtcttagtacagttctaatattactggtttacatttctaaaaaaaatactggtgctaagatgtccacatttttatttttagggaagagaaatcaatatctagcattggcaaatactgaaaatagagaaatgaaatgttaataaaacaaaaattcctgtgatatagattatttaatctgtaatgtttaacatttcatataaaagagctaaatttgattcttctgattatgaaatgataactatggctttacaagagtttttgaaggatgctataataaacaatattttaaaggagttaccgtgttcagtaatctatgctaatttttaagagattttaaagctagagataaggaacacgtgtattaaaatcgaaattaggataggataggttttcttcagtttgactttgttttttaaaaagacaaaacagatgtatagtattcactattatatcaatctttaaaaagttattagtgacaggaccagtaagactaaatgaactgatatttaatgttttatgatgtactatttaaagaaaaactgtgtgaatttttctttaacctctagaagtatctttgccccacaatcctccccaaccctaacatgtgaaagaggtaatttaagtattgagcattacactttattgtgtggattactgcaattaactgtgcatctccaagcaacatatagccattgtgcaaaaccactgtgaacagatgatacattaagaagcacagcttcgctgtgcatccggcccttgatattgagaaatacagcggttcagatggaatatgcaaatagaaaatcgacccaaggtcagagtgagaaaggcaaaatgacaatctttgctggtttcagaatgagaaatccatttctgctgcaaaataaaggttgaagaaaatcagtaaaagaaaatttagatatttcacttctcctttcttctttagctggaaagtaattcagtaatttttgccagtacagagaaaaggaagaattagttacactgtatattatccctccgggataactttacacttttatttcctaacatttttccctttatatttactctaataagagaaaatggtgtgtagttgatagaaaatcactcctgagtttatccatcgtctttgttctatttatgcttttttttttaattttcagggtgaccttgagaatgtacatttttctgcacttctctttctccatcttaaataagtgtaataataattgataaatattatgttcttaattttcctggaggattaaaaatagtaataattaataggtttatttatctaaataaactttataattttatttctcttttttattttgtagtcaccttaggtgcagaggaattatctgatcatatttctgttgatggcacatggcacactatcctcatgccattctttttcttatcatgtttattataatatccacttctctttttatgcacttttctcataagtttgataaatgtgttatgatgagtatgtatcacataaaatatgtcccattaaataagttctgaatgcttaatttatataactacaatacagttatacatttcatattgcttatacatgcaaccatgtacaatatccattgtacatatccagcataatttacttattatgttaataatgttgtctccactctcctagatcacctgcaattgtctgttactgcaaacaatgccaagataacatcctggtatatgtgcccttctatacttatgcaggaatttctctaggcttaaacccatgaatggaaaggctgggtcaaatgttatgtttcatttcattttgttgcattttatttaatttcaagatatattttatttaatttaatgcactacattttcatttagggaattgatgtttgtattcacaaatttagataattagtattttggggttttgttttcttctgattactatgtagttactatgtattttgaagtttccagatatgtggagatttattcactttaagcaactttatttttaaagcactttttagtttacagcaaaattaggcagaaggtgcagagatttcccatataatccctgcccctacacgtgcacagccaccccactgtggacatcctgtaacacagtggtacatttgttaccatcaataaacctactctgatacatcatcattatccaaaatacatagtttacactagcattcattcttggtggtgcagattctgtgggtttagacaaacgtatgacaattatccaccattttaatatcatacagaataggtttacgctctaagagtcctctgtggtctgcctattcatctctcctttccccctaatctttgacagccactgatccttttactgtttctatagtttttacttttccaaaatgtcatataattgaaataatatactatgtagtcttttcagattggcttctttcacttggtaatgggcatttaaatttcctccatgtttcttcatggcttggtggctcattcatttgtgtttagtgatgaataatgttccctttctggatgtgctacagtttatctgttcatctactgaagaacatcctgattacttcctagtttggcagttatgaataaagcagttataaatatcaatgtataggtttctgagtgcatatatatttcaattaatttggtaaaaatcaataagtgcaattcctaaaccttatcgtaagagtatatttagttttttaagaaattgccaaattgtcttccaaagtggcagtgccattttgtatttacaccagcattgaataagaggtcctgttattccatatcctcatcaacattttgtgttgtaggcgttttggatttggccactctattaagtgtgtagtagtatctcattgttgtttcaatttgcaatgccctaatgacataatattgaacatcatgtcatatgcttacttgccatctctagatcctcttttatgagttatctcctcaggtcttttgcccatctttaaaatcaggttatttgatttcttattgttgagttttaagagttatttatatattttggataagtcctttaccagatacatctgcaaatattttctcctggtatatgacttggcttctcattttcttgttgtgaagtcttaagctatattcttcataatttcatttattttttccagagaccatagtaaataatatagttctttttcattttattgattcttcttttgtagctttgactacagtcaatttttgtgaatgtttcatgggtgcttgaaaatatcttttgctttgaacaggaatgtaaaggatagcataggctctgaaattcagaataactgattataaaactattttgccttttcttttgagcaaccttgggaaacttactcaaacattttgtgcttagattttccacatgaaaaatgtagataacaataaaacactccatcagttattttttattattatttcaaaagctttttgggaaacaggtggtgtttggttacatgaataacttatttagtggtgatttctaagatttgaactgataattaaatgaattaatgtatgttaggtacttacccagtgcctgagaaaaagtgttagatacttacaattattatttgttagtttgaagtaattgtgaaattcattacatttctataccttttatgttttttctactggactatcagtttctgataatgatatattaaatgcccttaataattatagattagttgttctatttatattaatatagtctgaccctatattattagatgtatatcaagctgaaaatattatattaatcaatttttattttactaggatataacatgtcacattgtcaagacacttggatagtttttgcttgttttcttttgcattaaataattatttgattagaaaattaacatctagaatttctttttatttatgatcccattcctttttgttgttgttgatttaagcctccttctgatttaaatgttgcttatgttcacaacattaatcttattttttccagttagaaaatctgtaattgtaattggtttaaccatttacatttattgtagtaactaatatattaggatagtttctgccatcttattatctatttattcacatttcttgtcttccatttgacattttacatttacttctgctaatttaaagagttacataatccattcatattcttttaattattacccctaatataataggacaggtatttatttgtatcttttcacttattccttatgtttatcaataactttaatttctccttgcataaaaattgtagtttcacatacttatctgccctattctccttttttctgtacctatacttctgcttttaacatgttattttttcctagaattatttttaccttttatctttcatcatttgtgttagataacaacatcaacaagaaactactaactaaattatatattagtaagagaactcaatttgggcatgtcataaaagaaacatgaaatgaaaaattaaaacatgagaatttcccacttttatgtagccaagtaaacccattacttacatatattcaaaataaataataactggttcttaagtaagcacaattgacagcatcacttatcatacacagttcatcttagatttacctgggttgtccatttgtgttagttaattggctttagacaaaggaaaaataaaacttactaatgataaaagattgtattgcgacttagaacaaggtgtccaccaaagttaggctcctgtcctcccacagaaactggtatacaggagtgctaactcctttgatgtttacagttcaaggagaggactgccagggctttgaggaaagcattcctggaacatgaagttgacaaaaggactacctagttttaaaaagatttcttattaaagagaggagaaagtacttacaagtttcctaaagtaaatactctgagaaaagggaaggacaactctcttcctttgttttatcaggaagaattaagcctctcatttttaattattatttatccttacaatacatagtgtagagcatgctcatttcatcctatattaagtgaaaaaaatttgaaaattaatgaaattaaatcaaacatattcttggcatataataataatatcatcaacaacaagaagcagcagcagcatttcttgttttccaagcctcaggtattttaactcatttaatcacaccacaatcctatgaagtactccattaccaccccctggtggagttgatgaagttgaagcactaaaagacctcttctaactgcagcaggtctcatttgccaattattcatcattaagccatccttaattattgccatcacagacctaatgtgaatctgtttcatcattgttaaagaatgaaataatttctcagttttatttttcttttttgtttgtggtaaaatgaatatagaaaacatatctactcttgtttttcactgacacacaagtgctccaaacagtgcctgacttgtagtaggagtttaataagtatttgagaaatgaatgagatgacttaatgtagtcttaacatatattcaaattgcagaccgtcattggccatgcttttaaaatcaaaatatatttatagcctgcattttcatttaggtgttctgaaataaattataatattttgaattaatatgctattgaattccactaaaaaaaattttacttttaaatctttgtttgtgggaaacttgtataagaaagatttgcagccaggcacggtggctcacgcctgtaatcccagcactttgggaggccgaggcgggcggatcacgaggtcaggagatcgagaccatcctggctaacatggtgaaaccccgtctctattaaaaatagaaaaaataagctgggcgtggtggcgggcgcctgtggtcccagctactcgggaggctgaggcaggagaatggagtgaacccgggaggcggagcttgcagtgagccaagatggtgccactgcagtccaacctgggagaaagagcgatactccatctcaaaaaaaaaaaaaagaaaaaaagaaagatttccatattttcaatggctatatgtgctgtagaaagggaaatttgagaaaatattagaaataaagtaaattattgaactgtggttcaatctgtgtatttttagaataaatgtgagaaatgtcagtgaagaaaatactgttaattttgatgaatttaaagcatggtaaatcactggcttgtggatatgtgttcctgtctggggtcttttggaaattatttgttttgagctaaaaaatgttaaaaggagcagtatctaaacttttactcataagcccggaacacaaaggctctggggaatcaatcaaacatgtttactcttaaaatattattaagattaatatgtgcgtaaaaaaacttttaataaagtttacaatttagaccagaacttgagaataattatatccagatgacttaaaagtcacagaaaaggttgctataacataaagttcagtagtttttctctagctccttagtggttaaatatggagacatgattatattaactattttcaaaagtttcttgaatccttgtcattggcggggtataatggagtttaataagtaccactaaattgcatgaacacattggatttatctcagagaggattcttatattcttttattactgtctactctgcatacataagtcctttttatttacttatcaatagaaattaaatcacattgaagtgttggattataaatgcacaggatcacaactgaaggactacatgtcacagaaaaattgtaagtatggtttcaagaaatatgaaagtacaacagacacaatactgtatggcagattactattaaacttttagcctaggatgatacatgatttatttttgggaaaagggtatacatttgagagtcaaaagaattgttgtatctaagtgaaactttattaactatgctgtaaaatgtggaagcaccaggtactaattgttttccctaatctgatttttttccacctattgaccattttccaaaaaattctaaaatttcctaagttgacagaatgaaatgaaagcataataggaggtataggacttatcccagacaagattagtcttatgttgcctacaaacaacatttgagtgtcttaattgttatgctggcctttaattcataagaaacagaaagcacttgtagatgaacaatattatagaaatttcattatatcatcacatatcacatatggttttattaaaataatactagataataattttattgtactttatcattgacatcattaaggataaattgcaaaactatcataatttttaaatttgacacatttttatttcaaaagtcagattcttatgtttcttattacctattttaatagttatttagccaatagaccattatgaatacaaccaaacaaaacatgactaaatatgaatatattttaaaatgctaacagtcaaaataattatggtgagaaggagtgttcacttgagtgataaaccaagtgaataaattactagcatgcccatctgatttttgacatttatttcctttgttcactttgtctttttacctctcaaattattttattctttaaaaaaattattttaagttcctgggtacatgtgcaggatgtacaggtttgctatatgggtaaacatgtgccatggtgatttgctgcacctatcaacccatcacctatgtattaagccctgcatgcattagctatttatcctgatgctctcccttcccctaccccactgacaggccccagtgtgtggtgttcccttccctgtgtccatgtgctctcatcgttcagcttctcccacttttaagtgagaacatacagtgtttggttttctgttcctcttgtttgctgaggataacgacttccagctctatccacatccctgcaaaggaaatgatctcattgctttttatggctgcatagtattcatggtgtatatgtaccacattttctttaatcagtctatcatctattgatgggcatttaggttgattccatgtctttgctaatgtgaatagtgctgcaatgaacatatgcgtgcatgtatctgtataatagaatgaattatattcctttgggtatatacccagtaatgggattgctaggtcaaatgatatttctggttctagttctttgaggaattaccacactatctttcaaaatggatgaactaatttacattcccactgacagtgtaaaaacattcctatttctccacagccttgccaacatttgttgtttcataactttttagtaatcaccattctgactgacatgagatgatatctcattctcgttttgatttgcagttatctaatgatcagtgatgctgagcttattttcatgtttgttggtgcatgaatgtgttcttttgagaagtgtctcttcatgtcctttgctcactttttaatggggttatttgttttgtttcttgtaaatttaagttctgtatagattctagatattagaactttgtcagatggatagattgcagaaagtttctcccattctgtgggttgtctgttcactctgatgatagttccttttgctgtgcagaagctctttaattagatcccatttgtcaatttttgcttttgttgcaattgcttttgatgtttttgtcatgaaatctttgcccatgcctatgtcctgaatggtattgcctagattttcttctagggttttatagctttgggttttacacttaagtctttaattcatcttgagttaatttttgtataaggtgtaaggaaggggtccagtttcagttttctgcatatggctagccagttttcctagcaccatttattaaatgggaattctttcctcattgtttgtttttgtcaggtttgtcaaagatcagatggttgtagatgtgccatcttattcctgagatctctgttctgttccattggtctatgtgtctgtttttgtaccagtaccatgttgttttggctaccgtagccttgtattctagtttgaagtcaggtagcatgatgactccagctttgtttttttgtttgtttgttttttgcttaggattgttttggctatatgggctattttttggttccatatgaaatttaaaggagtttttttttctaattatgtgaagaatgtcaatggcagtttgaaggaaatagcatttaatctataaattagccatttttatgatgttgattcttcctatccatgagcatggaatcttttcccatttgtttaaattcttattcttatcaactttagtggaaattaaaataggaataatgtgcttttcataacattaaaatattctttattgagaagtaattaacatatagtaaacttcattttttaaaattacaattaagttgttttcagtatgtgcatagagttgagcaaccattaccattgcctaatttataatatatcagtactcctttgctaatcctgttagcagtcggtctcccaaaccctggcgaatttactttctgtctcaatgaatttgcctattttggacgttcatgtatatgaaaacatagagtctgtagtttttgtgaccatcacttagcatattatttttatggttcattcatattgtagcatgtatcaatgcctcatttcttataattgataataaaaatcaattgtatggatataacattttatgtatcattactcagttgatgaaaatatgaattattttcactttttactattatgaacgaaacttttaattacatttatgtacacatttttgtgtggatatatgtcttcttatgtcttggctatatgacagtagaaatccatgatcacatggtaactttatatttaacattctgatgaactgccaagctgttttccaaggtgactgccacattttaaaatcccaacagcaacatatgaggatttcaatttctccacatcatatccaacatttgttgttgtctggtttctctagtttagccattctagtgggtgtgaagtggtatctcattgtgattttgattttcatttcttcaattcatgatgttggacatctttcatatgcttttgaccatttgcatatcttttatttatttatttatttattttttagacagagtatcgctctgttgccctggctggagtgcagtgacgcgatctcggctcactgcaagctctgcctctggggttcacgccattctcctgcctctacgtatcatttttgaggaatcatctattcacatcttttgcccatctttttaaattaggttgtctttttttttgttaagtggtgggtgtacttagtatattctgaatacacgtcctttacatatatataacttaattttttttctctcattctgaaggtagtcacactttcttgatgctgtccttagaagcaatttaaaaaaattttaataaacttcaatttattttcttcttttatcaaggatgcttttggtgtcttatctaagacatcaaatacttcaagattatgaaggcattcttttattgtgttttccaatttcatttttagcttattcattgctactgtatagagataaaattaattttgtatattcatcttgtatcccacaacatatctgagctggtttattagttctaataagctcttcatcaatttcttaggattttctatatatatatatatatatgaaattatgtcatctctcaataaagaaagttttactattttctttacatctgtgcctttttttttcttgcccaagttttctgtgtagaaactccagtatgatattggatagaagtgtctaggacagagatccttttttttttttttctgggtttttttttttttttttcctgatcttggaagaagaatttagtcttttaccattaagcatgttgttaactgggttttttcattgatcttcacatatgaaatttgaagaagttcctttcatttctaccttcttgagtacacccaatataaaaacatggtggcgcatttatccaatatcttatagcatctattgagatgatcatgtggtttacctcctttcatccattaatatggtattacatgaatggaattttgtattttagaaaatttttacatccctaagggaaatcccacctgttcctgatgtgtaattgtttctatatgctgctggatttgatttgctaatactttgatgaaggtgtttgcatctgaatccaataaaagttactggtctgtagtttttttttttttttcacatgaagtctttggtttaggtatcagtgaaatattgaccatatagaatcatttttgaaggatttattcctattctattttttgaaagagtttatgaaaaattgctattatttcttcttagaatatttcaatgaattcaccagtgaaggcttttcatgggagtttttactattattattatttaattcagtttcttcacttttttaggtctgtacagattttcttgttcttcattcggttttggtaatttgtatcttttggggagtttgtccattttagctatattacctaatattggtatatggtgattcataatatttccccttgatccctttgatcaattttatttctgtaagatttattgtcatgccccctttttcacttatgattttagtaatttgtgtgttctctctttctagtcattctagctaaaagttagtcaattttattaatcttttcaaaaaacaaatttcggatttgcttatttttactgttgcttttctctttctattttatttatttcctctgtagttttcattattttcttccttctgcttgctttgggtttagttttatgttcttttttttagcttctttatgtgaattgttatgtattgatgcaaatatattttcctctttaggatagacatttacagctgcagatatctctgtaaacactgtttcagctgtaacaaatccattttggttcattgtattttcatttagattaatctcaaactgcctcgcatataatctcttccaccaattggttatttataactgtgttatttaatttccacgcatttgtaaattcctcaatttttctcttattacattctaatttaactttgttctgcttgaagaatatattttgtatggctttaatcatttaaatttattgaggttcattttatggcctaacacatggtatattctggagaaccctttggaacttgaggataatatatctactattgctgagtggagtgttatatagatttctgttgaatgtagtttaaatgtagtgttcacatcttccatgtgttcaccttctgcctagttgttctatcctttattgaaagtgaaacctccagctatttctaataacattttctgtttttcccttaaattctttcagtttttttgtctaatattaacataatcattccagcttttttggttgtttctgttggtcaggattctctagagaaacataattaatagaatatagatgatagatatagatacagatgaagatatatagattttttttacataatttcaacttttattttagattcaagtggtacatgtgcagtttgttccattaggtacattgtgtgatgctgaagtttggggtacgattgatcctgtcaccgaggtactaagcatagtacccagttgttagtttttcaacccattgccccctctctccaccctcccatcccatatagccttgtgtctattgttgaatcttcttatgcccgtgagtacccattgtttagctcccacttataagtgaaaacatgcagtatttggttttctgttcctgcattatttcacttgggacaatggcccccagctgcatccatgttgctgcaaaggatacaattttgatttttgtggctatgtagtattccatggtgtatatgtgttacattttattttccaatccactgccgatgggcccttagctcgattccctatctttgctattgtgaatagtgttgtcataaacatatgagtgtaggtgtctttttggttgaatgatttattttattttgattgttgggttgagtggcagttctatttttagttctttgagaaatcttcaaattgctttccacggtggccgaactaacttaaattctcaccagtataaaggcattcatttttctccacagccttaccaacagctgttattttttgactttttaataataaccattctgactgacaaaagatggtgttttattgtggtttttatttgcattctctgatgacgagtgatgttgagaattttccacgtttgttggccatttgtatgtctactgttgagaagtgtctgtccatgtcatttgttcactttttaatagggtttgtttttacttattgatttctttaagttccttatagatctggatatcataccttttttggatacatcgtttgcaaatattttctcccattctataggttgtatactctgtactttttgctatgcaaaagctcttcagtttaattaggtcccacaggtcaatttttgtttttcttgtaaatgctttagaacaattgcttttgagcaacttattcatgatttgttttccaaggccaatttccagaatggtgtgttctaggttttcttctaggattttcatagtttgaggtcttatatttaagtctttaatccatcttaagctaatttttgtatatggcgataaaaaagggatccagcctctttcttctgcatatggttggtcagttactgcagcaatatttattgaatagggagcctttccactttgcttaattttttttttattttgttgaagcgcagttggtatgtgtggctttatttctagtttctctattctgtttcattggttgatgtctctgtttcagtactagtaccatgctgttttgttattgtagctttatagtatagtctaaagttgagtaatatgatgcctctggccttcttatttttcttagacttgccttggctattttggctcttttgttgttctatgtgaattttagaatagctcattctagttctgtgataaatgacattcatagcttgacaggaatagtgttgaataggtagattgctctgggtagtatggccattttaatgacaatgcttccaggccatagtaatgcaatattttttcccatttgtttgtgtcatgtataacagggggtccctaaaccctgggccatggactggtaccacacagcaggaggtgagcaagggaagattcatctgtttttacagccactacgcatcactcatattactgcctgagctccacctcctgtcagatcaatggtggcattagattcttttgggaacatgaaccctgttgtgaactgcacatgtgaggaatctaggttgcatgctccttatgagaatctaatgcctgatgatctgtcactgtctcctatcactcccagatgggacctcctagttgcaggaaaacaagctcaggactcccactgattctacattatggtgagttgtataattattttattatatattgcaaagtaatatataatagaaataaagtacacaataaatgtaatgcgcttgaatcatcccaaaactctccttccccagtggtctgtggaaaaattgtctgccgtgaaaccagtacctggtgtgaaaaaggttggggattactgatctataattacttttggcagtattttgtagttatccttgtagagatctgtgatggttaatattgagttaactatctgcgatggttcacacttttggtgatgttttgtagttctccttgtagagatctgtgatggttgatactgtcaacttgattggattgaaggacgcaatgtaccgtttttgggtgtgtctattagggtgttgccaaagaagattaacatttgaatcagcgcactgggagacacagacccaccctcaatctggatgggtaccatctaatcaactgccagtgtgattagaataaagcaggcagaagttggaaggacttgatttgctgagtcttccagccttcttctttctcccatcctggatgctttctatcctgggacatcagactccaagttcttcagcttttggactcttggacttacaccagtggtttgccaagggctctcaggcctttggccacagactgaaggctgcactgtcggcttccctacttttgaggttttgggactcggactgatccaccactggctttcttgccctcaacttgaagacagcctattgtgagcctttaccttgtgatcatatgagtcaattaacttgacaaacttaataaactcccttttatatatacatctatcctattagttctgtccctctagggaacactgactaatacaagatctttcacctccttgattagatgtattcctaggtattttatttttatggctattgtaaataggattgtattcttgattttgctcttagcttgaatgttattgatgtatagatatactacctatttttgtacattgattttatattctgaaactttactgaagttgtttatcaattccaggagccttttggtggagtctttgggagtgttctaggtatagaatcatatcttgaatgaagagagacagtttgacttcttcttttcttatttggataccttttattttttttatcttgcctgatttttctggcaaggatttccagtattgtgttaaataggagtggtgagagtgggcatccttgttttgttccagttctcaagggaaatgctaccagcttatgcccattaaatatactggctgtgcatttgtcacagatggctcttattattaatattttgaggtatgttctttcaatgcctagtttctttagggtttttatcatggagggattttggattttaatgagagctttttatgcatctatggagatgataatttttaattttagtttttaattctgcttatatggtgaatcacaattttttatttgcatcccaaccttatattccaggaatgaagccatgttatcatggtgaattaactttttgacatgctactggatttggtttgctagtatattgttgagaatttttacatctgtgttcagcagggatattagcctgtggttttccttttcccatgagtctttgccaggttttgatatcatagtgatgctggctttgtagaatgagttagggagaagcccctcctcatcagtttttttgaatagtttcagtaggatcagtaacagctcttatttggacttctggtagaattcagctgtgaatccatctggtccagggctttttttggttggtaggttttttatcactgattcagttttggaacatgatattggtgtattcagggtttcaatttctttctgattcaattttgtgagatagtgtgtttccaggaatttattcatttcctccagattttctagtttgtacacagagaagtgttcctaatagtctctgaagatcttttgtatttctgtgggattgtttgtaatgttaccatttttttttattgtgcttatttttatcttctctcccttttacttcaagtagctagcagtctatcaatgttgtttatcctctcaaatgataaatttttggtttcattgattctttttatggatttttgggtctcaatttcattcaattctgctctgatttcagttatttattttcttctgctggctttgtggttagtttgttcttgtttttccatttcctctatacgtgttgttagattgttaatttgagatctttttgactttttaattaggcatttagtgctataaactttcctgtcaacactacttttgctgcatcccctagattttggtatgttgtatctctgttttcacttatttcaaataatttttttatttctgccttaattttattgttaacccaaaagtaattcagaagcaagttgtttaatttctatgtacttgtgtggttttgggaaattttctgggtattgatttctattttaattccgctgcaatcccagaatatggttggtatgattttgattttttgctttattgagacttgctctatggttatgtatgtggttgatgttggagtatgttctatgtgcagatgagaagaatgaatattctgtgattgatatgagaagtattctatagatgtctgttaggttgatcaagtggcatatttaagtgcataatttctttgttagtttcttgccttgatgatctgtctaatgctgtcagtggggtttttaattccccgattattgttgtccaggtaagcctttttatacatctaggagtatttgttttatgaatctgggttcaaaaatagatttttatttggattagcttatgtgattatggagactgacaagttccacaatgtgcagggtgagtcagcaagctaggcaccatggagcaccaatggtttagttccagtcaaagtctgaaaacctgagaaccatgagagctgatggcatagttccagtctgaaagacagcaggctcacaatacaggacgacaaagtctctcagttaaaaggcaattaagcaggaagaattctcttttaagcagaggagaaatatcctttttattttttgtttttcaggttttcaacttaatagttggatgatgcctgcctacattaggaagaacaaactgcttaacttattctactgatttacaggttaagcttatcaaaaaacaccctcacaaaaacacccggaatgatgttttaccacatattgagtactatgtgacccagttacattgtcaaatatatttaactatcacatatggtattatggtattatttttcaccctattattttaaaactgtttgtatctttgaatctaagggggatttcttatagttaacatatagttggattttgcttttttttcttgtaacttttatcttaggctcaggggtacatgtgcaggtttgttaatataggtaaagtcaagtcatgggggattggtgtacagactgtctcatcacgcaggtatgaggcatagtaccttgtaggtattttttctgatcctttctcacctcctaacctccatcctcaagtagatcccagtgtctgtcatttccttctaagtgtccatgtgttcttgttatttagctcccacttataaggacaacaggcagtatttggttctgttcctgcattagtttacttaagataatggcttccacctccatccatgttgctgcaaagtacataatcttgttctttttatggctgcataatattccatggtgtatatataccacattttctttatctagtctaccactgatggtcatttaggttgattccatgtctttgctattgtgaacatgctgcagtaaatatatacacacatgtgtctttttggtagaatgatgatattcttttggatatatacccactaatgggattgttgggttgaagggtaattctctttttagttctttgaggaatcaccacattgccttccatgctggttgaactaatttactctcctaccagcagtgataagcattcctttttctctgcaatcttgccagcatctcttttttttttttttttttgacttcttaataatagccattctaactcatttgagaaggtatctcattgtcgttttattgcatttctcaaatgattagtgatgttgagcattttttttacatgcttgttggcttcatgtatgtcttcttttaaaaagtgtcgttcaagtatttgtcccactttttaatggggttgtatgttttttgcttgtaaatttatatatattccatatagattctggctattatatgtagttagaagcatagtttgtaaatattttttccctttctgtaagttgtctgtttactcagttgacagtttcttttgctgtgcagaagctcttaagtttaattagatctcatttgtcaatttttgcctttgttgcaattgcttttggcatctttgtcatgaaatcattgccagtttctatatccagatggtatttcctaggttattttccagagtttttataggtttaggttttacattcaagttcttaattcatcttgagttgatttttgtatacggttcaaggaggcatctggtttcaatcttctgcatatggctagacagctatcccagcaccatttattgaataggaatacctttctccattgcttgtttttgtcagttttgtcaaagattagatggttgtaagtgtgcagccttatttcagggtttttgattctgttccattggtctatatgtctgttttttgtattggtactatactgttttggttactgtagccttgtagtatattttgaagtgagctagtattatgcttccagctttgttctttttgcttaggacgtcttgtttcttcgggttctttttcttccaaatgaattttaaaatagttttttctagttctgtgaagaatgccattggtagtttgataagtgtagcattgaatctgtaaattttggggagaagtatggccattttacaatattgattcttcctatttatgagcatggagtgttttcccatttgtttgtgtcatctctgatttctcggaagagtattttgtaattctcattgcagagatttttcatttccctatgtagctgtattcctaggtattctttttgtggcagttataaatggcattgccctccttgtttggctcttggcttgcaggttgttgatatattggaatggtactgatttttgtacattgatttcttatcctgaaactttgctgaagttgtttatcagttcaaggaacttttggtcagacaatatggagtttcaagttatagaatcctgttgttgaaaaatgagatagtttgacttcttcttttcctatttggatgccttttatttctttttcttgcctgattgctctggctagaaattccataccatgtttataggagtagtgagagagggcatctttgtgttgtgcaagttttcaaaaagaatgcttccagctattgccccttccatatgatgttgggtgggggttttaaaagataactctttattttaaagtatgttccttcaatgcctagtcatttgagagtttttaacatgaaggatgttgaattttattgaaaactttttctgcatctatttagataatcatgtgtattttgtctttagtcagtttggttcatttgtacactcagctgttttgtctatcagctcctgtattgttttcttataatccacaacttctttggattgtgtttcaatattcacctgaatctcgatgatcttcattcctgtccatattcttaattctacgtctgtcatttcaggaacctcagcccatttaagaatcatttctgggaaactagtgcattcatttggaagaaagaatatactctgccatttgagttaccagagttcttacgctggttctttcagttctttctcgtgtgtgtgtgtgtgtgtgtgtgtgtgtgtgtgtgtgtgtttaactttgatataaattgagtacagtcagtaaacttatattctggatgttttcagagggctgatgctttgtgcaagacctttatttgtagctgaatttttgcttttggtttcacagggggggtatgatagcaaaacatttttgatgttgaagtttgggatgtgaactagtaggtggtgcttaagcataatgatcagtaggtagtctcttcctcagtcatgtagctcctctgtatttcctcatgtttgcagccatgctccctctgagggctctgaaattgtggactcctctttctcttgagtgctggctgcagatcttggcttggcactcccgggctgcatgcagcagctctggggtgatcttagtctttatgtttcctccccagcttggtagcagcaaaggaagcgaccttagcagtggttgtgttcaagagattttcacttgtctcttggggctctaccccagagatatgtggagcggcaatcaattagtgctattggctcatgatggagcagccgctctgtgggcccaagctggggaggaggtgtctggttatgagcagggggtttgggtgggacccatgggagacagattggccttctctccttagggcaactgcagctttctggaggtgtggataaatactcagtattttcactccttctatagtccaagggaagctagggaagtaccactgcaaaggtgtttttggttgccctggtagctccacctccaagaaacgtggagctgctcctactgagactgttcagccagagggtggggcagctgtactgctagcctgagctagtgggtctgtttgttgggtgttggggcatcaagggctcacatggaggagagactgggctcctctctatatagtggctattatgtgctgtaagttcaggtgaagacctcagactctttgttatttccttagaccaagagaaacaggagcagaaccatttctgtggcagtggcagaagggttgtcacttgcctttgagagactcttcccagggaaactgagagccaccaccagtgggtatgctcagccatgggttgggcaactattctgtggtcctgaaccaggggcccagattggtgaagagtgggggttaggctttcccagggaagatggactggactctgatccatgcagtggctgcagtgtgtgggaggttccagcgtattgactaggtcctttattctttccctagcctgatggtagttagagtggtaccactgcatctgcaatggcaaaggggttgtgggttgagtgggattttctccttggagaaatgctgagccacttctgaagtatccaggtgggggcagggtagatgtgctggagacctaggtcaggaggctgcgcccaatgaggagatgtaaggacagggacctgtatggagaacagtcctgccacttttccatagggcggccacactgtactgggggtccgctctagacagtagtcactcgggactcttcagagcctgtaggcagcaaaggtgagggcttcaaaacagcaaagatggcagcccaccccaccctctggaaactccagtccgggaggtacagagctgctactgtcctgagagccccagtgagggttggctggtgtcccagaccagtgggtattatcctgcgaggtgcagtggaatcaagtcatgcagacaatcactgctcaggttcctggatctagcccccttcctcggggcctatagggagcctaggcaccccttttgctggagctgcagccatgtgtgcctgagcagtggctctgcccagactctatatagctctgcatgtcagtctgaaggccttggtggagtggactcacaaggggatctcctgatcccagggttgcaaagatctattgaagaaatgtgggtccttggcatctcccactcactcactatttccctatggagggggtgtctcccctggctctgtgccactcctgggtgtgtggttgtcctgtcttgctcctccctgtcttccatgggttgagttgtcaagttgtttccttgatgaatcccaatatgttcgcctggatgtttcagttgaagatttagaatttacttgccacctccttttctgtctctgaaaacaatgtgtactagttccctctagtcagccatcttgtcccttcccccaatttgtttttttagaatcattatgccagtatctgcctcttgattaaagtattttgtcaatttacatttaaagtacttattgataaggtgagatttatttctgccatttactattgttttctacgtgttttatgtcttttctgttccttgtgttcatccattactaccttattctgtgataaatacatattgtctggtgcactgtactaatttatttcctttgtttattttaatatacatggatatatgtttttgagtttttttttcttagtggttgttctagggattacaattaatgtctttacttcaatctatcttctttagattaattccaaattaacttcaatagtatacaaaactgtttcttttttttttttaatcagtgttgaccagattggccttgaacgtgtaggctcgcctccctgagtgccagggcaactggcctgagacactgtggctcccaaaactgtttcaatatagttttttccctaccctccttagtggtctttgttgtcataacaattacatctttatgtatcacaatctatcaacttggttttataataattgctttttgcaatgatcttttaacttacatatgaaaagaaaaggttttaagcaaaaacacattttttactgtgttttctatttacctgtgtagtttcctttacttttgctctttgtttcttcatatggattcaagttactgtctgatgtctgttttttcagcttaatgactccatttagtacttcttgtaagataggtctgctggcaacaaattcccttagtttccttttttctttttaatatgaaatatcctaatttgtacttttgtttttgctgtcctgttatttgtaagagtcctgtgtaacaattttatgaagttctgacaactgtgaattatcagttggaaaatactgctctaagttcattttatttttcatttattcatttttttattatactttaagttcgagggtacatgtgcacaatgtgcaggtttgttacataggtatacatgtgtcatgttggtttgctgcacccatcaactcgtcatttacattaggttatttcttctagctatccgtcccccagacccccgcccctgacaggccccggtgtgtgatgttccccgcaatgtgtccaggtgttctcattgttcacttcccacttatgagtgagaacatgcagtgtttggttttctgtccttgtgatagtttgctgagaatgatggtttacagcttcatgcatgtccctgcaaaggacatgaactcatcattttttatggctgcatagtattccatgttgtatatgtgccacattaatccagtctatcattgatggacatttgggttggtcccaaatctttgctattgtgaatagtgccgcaataaacatgcatgtgcatgtgtctttatagtagcatgatttataaccctttgagtatatacccagtaatgggatcactgggtcaaatggtatttctagttctagatccttgaggaaatggcacactgtcttccacaatggttgaactaatttacactcccaccaacagcgtaaaagtgttcctgtttctccaaatcctctccaccatctgttgtttcctgactttttaatgatcaccatgctaactggtgcaagatggtatctcattgtggttttgatttgcatttctctgatgaccagtgatgatgagcattctttcatgtgtctgttggctgcataaatgtcttcttttgagaaatgcctgttcatattctttgcccactttttgatggggttgtttgatattttcttgtaaatttgtttaagttctttgtagattctggatattagcccttcatcagatgggcagattgcaaaaattttctcccattctgtaggttgcctgttcactctgatggcagttccttttgccgtgcagaagctctttagtttaattagatctcatttgttaattttggcttttgttgccattgcttttggtgttttagacatgaagtccttgcccatgcctatgtcctgaatggtattgcctagattttcttctagggtttttatggttttaggtctaacattgaagtctttaatccatcttgaattaatttttgtataaggtgaaaggaagggatccagtttcagctttctacatatggctagcccgttttcccagcaccatttattatagggaatcctttcaccatttcttgtttttgacatgtttgtcaaagatcagatggttgtagatgtgtggtgttacttccgaggactctgttctgttccattggtctgtatatctgttttggtaccagtaccatgctgttttagttactgtagccttgtagtatagtttgaagtcaggtagcgtgatgcctcagctttgttctttttgcttaggattgtcttggctatgtgagctctattttggttccatatgaatgttagttttttctaattctgtgaagaaagtcattggtagcttgatggggatggcactgaatctataaattaccttgggcagtatggccattttcacgatattgattcttcctatccatgagcatggaatgttcttccatttgtttgtgtcctcttttatttcgttgagcagtggtttgcagttttccttgaagaagtccttcacataccttgtaagttggattcctaggtattttattctctttgtagcaattgtgaatgggaatgcactcatgatttggctctctgtttgtctgttattggtgtataggaatgcttgtcatttttgcacattgattttgtatcctgagactttgctgaagttgcttatcagcttaaggagattttgggctgagctgatggggttttctaaatatacaatcatgtcatctgcaaacagggacaatttgacttccttttttcctagttgaataccttttatttctttattttgtctgattgccctggccagaacttccaatactatgttgaataagagtggtgagagagggcatccctgtcttgtgccagttttcaaagggaatgcttccagtttttgcccattcagtatgatattggctgtgggtttgtcataaatagctcttattattttgagatatgttccatcaatatctagtttattgagagtttttagcatgaagggctgttgagttttgtcgaaggccttttcttcatctattgagataataatgtggttttgtcgtttagttctgtttatgtgatggattatgtttattgatttgcatatgttgaaccagccttgcatcccagaaatgaagctgacttgatcatggtggataagctttttgatgtgctgctgtatttggtttgccagtattttattgaggattttcgcattgatgttcatcagggatattggtctaaaattctcttttattgttgtgtctctgccaggctttggtatcaggatgatgttggcctcataaaatgagttagggaggattccctctttttctgttgactggcatagtttcagaaggaatggtaccagctcctctttgtacctctggtagaattcggctgggaatccatctggttctggacttctttttgttggtaggctattaattattgcctcgatttcagagcctgttattggtctattcaaggatgcaacttcttcctggtttagtcttgggagggtatatgtgtccaggaatttatccttttcttttagattttctagtttatttgcgtagaggtgtttctggtattctctgatggtagtttgtatgtctgtgggatcgatggtgatatcccctttattatttttattgcgtccatttgattcttctctcttttcttctttattagtcttgctagcagtctatcaattttgttcatctttacaaaaaaccagctcctggtttcattgatttttgaagggttttgttgtgtctctatgtccttcagttctgctctgatcttagttacttcttgccttctgctagcctttgaatttgtttgtgttttccatgttagaatgacaaaatcacctatataaagtcactgccatattgaacaacaacaaatctaacattggaggaatgcctatgttttacaaactgccttttcattactctatttcatctttaagaacacccatgtgaagaaacaggacatgtgaaataactttccctgtcatccacttggtaatttgtttaaattgagtttcacctcaaggtcatatgtctcttaaattgtgaaatgtttccactacgttgaaggatatcactttagaaattttaagtatttctgtgaaggcccttcattttgtgacattgttaacaacagaggttataacatctctttttttgaaggagtatttgaagtcactatgctcattttgtttttatgaatgctgtaagttagtcataagtaaaaataagtgaagctatttcagttcttttgaataaaaaggaaagcagatttttcagttcagaaggataaagacacaagtctgctcaatgagatgtagttacaagatgctctggcttactcctagcatgtactgaacatctatttgtaacatacttggagatttctccactggtttttgtgagtaaaaacctggtggttatctcaatttgatattaattgctagtaatttgcttgtaataacctaatggtcgtgcctactggaggaagataacaaaagagaatgagagaagggaaccttgcagtagtagctcttagattctatgaatgaagaaatcctaaggggaaaccgtagttatttacaacaattagccaagagtgattacaccgcagaaaacaagtatcccacttgtattccatcactaactaaaaggcaagaaaaaatattaaggtaatgcagagtcttaaacaaagggcatggttatattgtcttcgtaataagaataacaaagagatctgttcttatcacataggacatagtatttccagggctcttctgcagattggggaggataaagtgtttcttgacagaatacataaattattttcattaggaaatcaggcagcttaagactccattaaggcagaaaaaaataagtgcagaacctggagagtggatcaaaagagaaagaaggaatggggaattttaaaaatggtctgtgctagagatctctaactaatacgagaatctccacagtgagggagattctagggctggtggagaagttccaggtttaagatagttgaggctaattgaaatataataagaaatatacaggagagtatataaatatgacaaaggaagtctaagaggggaggcagtatatttttggagatacaagaaaggcttctcttacaaaaggagaggtcaagaaatgtgggttggaattgctggaaggaagatccttaagattgattatgtgattgtctgcaatatgaagacaatggtatgtagactagatgtagacattaaggaggtcaagtgttttctaagattattttttgggctgacagactttctatacctgatgtctgattgatgtctacactggtattaattcactctgattatgaaccgtataaaggaaattgtaatccactgtgattataaactatgtatgggaaattgttttataatggagagagtgtacactatgtctcagtatataatcatctacttttcctctcacgctttaagctagtcatatcacttattatcagcctcctgctcacccctcagataccccctcctgtcattagtgtcagaccttcacatcatatttgtctccatctgtctcagaactcttttctcttactccaagtacactctaccctcttacctatgcttcttcttatttgtctcatatacgtagcctcaacctatggactttgatactgtaaaccaacactaaattctaagccccaccctgccaaccacctaagtggaattcctcctcagctagggatattttaaaatttaacccaagagactgtttcaggccacaaggggaagtgggggtcagacatgtctcattatacttctctggccatcacataacaaataaataaatcaaaatattttaatcccaaatatatttacttttcctatcttgaaatagccctgcaaagtttgttctttgggaaaaatccacattctgtagagaatctccttttccctttttcttctttccaaatccaggagataatcaactaagagacaggcacccttttaagtcccataagaaaatattttacaacatgttctctctgaagcctgctagctaaaagcttcctctacacaataaaactttggtctccatgatcctttatcttaactcaaacattcctttctgtggattccagatctttggataaactcaaccaattgtcaaccagaaaatattttaaatctacctacaagctggaagccccctacttcaagtcattctgcctttctggaccaaaccagtatttttcttaaatgtatttgattaaagtcttatgcctcccgaaaacaaactgcaccctgaccaccctggggacatgttctcaggacctcctgagggctgtgtcatgggccatgaataaatctctggctcagaataaatatttggctcagaataaatctctttaaatatattacagagtttgactctgtttgttggcaataatatccacccttttcttcagatcatatactctattatttacttatttcttgagatggagtttgctcctattgcccaggctggagtgcaatgatgcgatcttggctcactgcaacctctgcctcctcggttcaagcgattctcctgccaagtagctgggattacaggtgcccgccaccacgcccagctaattttttgtatttttagagacagggtttcaccatgttggccagggtgatctcgaactcctgatgtcaggtgatccacctgccttcgcctcccaaagtgctgagattataggcgtgggccactgtgcctggcccagatcatatactctcttgaataggagttgtcctattctcatttcaacttcaggaaaactctcctttgatgcagtcattaggccagctctgagactggccagccccaaccttaatctcatcaaaagaagtaatgacaatggacacaatagaattaaataaagtaaagtataataagaacacagaagaaggaagcaatgtgttaatgcatgagctaatctttatgagtagaacattaacagatctttaaagagaaaatgatattttgggaagatggatttattttaataaagtcatctgggtcttgaagtgcatagcattttaagaacaatgagtcatctattgtaagggaaatatattgaacatgtgccaaagaacttgctctgagattaagttgaaaatacagattagtgtcagaatctgaagtgtcttgaatgctatgctaaaacaattttactttcactactgatagtagaagtctctaaaggtcactgagcatgaccaatatgatcacatctgtatttggatgaagcaattttgttaccaatgcacaatatagtatttgaaaagaaagagatcaataaaggctattgtgatagccaaataagaaatgaaagtatcttgggcattaatgtggcaatagaaatagaaaggagaaaaaaatgggaatattttggaaatcaagtagaattaagatgttatttcagattatggagacagatataacagtgacataggtttctatattcaataaatggttcataccgtctactgtgatagaatattaaagaactggagatatgtcatttcaagtatgtttagtatgaggtatatatttagtatgaggtatatatttagtatgaggattagcatatataaatatctaaaggcaaatagaaattcaatactgcaggtaatacaagagggaagtcatctagcgctattgatacagacatgtaaatctagaaggatccttgcttccatagtacagaagcagcttattttacaagtgctaatatatgtattttgttttgttttgtttttgagacagtctcactttgtcacccaggctggagtgcagtgtcgcgatctcggctccctgcaacctccacttcccaggatcgaacgattctcatgcctcagccacctgagtagctggaattacaggcacaggctaccacttccagctaactttttttgtagtattattagtagagaaagggtttcaccatgttggccaggaaggtctcaaactcctgacctcaaggaatgcacttgccttggcctctcaaagtgctgggattacaggtgtgagccactgcgcccagcccaagtgctaatatatttgctatattttcatataatgtatttgcccatagtggttgccttgttaatgtctaaattatcaaccaataataattaagaaagtgatggtatataaagtgtcaaatgcagttttgttatttattctaacttctaacctcctataaacaaatgtattatcaacatacagctaataaccaacacacaaataaacagcatgttatttaaaaaggtaaatactttgacaaattcctttttccaaaaaaagagacatatttccaaaaacagagcaatgttgctatacatttcctcgggactacatgttaggttaaggtggttctgttgatgacagatatggcatacagatatatattttacatttctatatccagcacaataatgagcacatattagagacaatatgtttttgttgagtgaagaaactaaaataataaacattagatgtaaaagactagtcctttattgtgtagtaacccactccatgcttattgaatactcccttctgtgtaaagtctgctttttcttcagtgctgtttactttgctcaggatttagaagtttcccataaaaataatacaatgttaataaatacatcattcagagaaagttatgcagagtggaaatttatctgggtataaaatactacatacatcccaggacttctgggacacagagaaaaactgcatcagaattgaaggttttaattaatcgatcataataggagaaccaatccaaagtgcatttttttccaaaattctgaaacagaaatattgttactaattaaaatgtgaccaattttgtttctcaatgcttttgtttctcagtgctttgctaatatcacaggttttgatcaaatcattcccttgaatgacccccttggcagtgaattgtatttaatgacattggcatacccatagattaaattagtttcagatgtaagaaggaaaattctaaatgaatcctttcaatagcagtgaaattaaaatagactgcacttatctttttagtcagagaattatagaggggcatttatttatgtgtgtattttttgtttgcttgtttttaatattttgatttgtttctgtagccatgagggtaattttgtttactgcaagacccatgtagggcaagaaggaattctaaattaaatgttaattctaagttatcagttgtttttcaatcatattttgggagatttacattaaatggaaattaatttaattggtttgctttcacatgtttaaatgattgatttatgacttatcaaattttccttatactgtcttcaccttatttgttgtaacagcttgggaatcatgtaaaagccatgagaaaacgtggtcattatttattgtataaatactaggatgaaatcaagttgctttttctttttcctttttacatgtatctgagactaccttttatggcaagctacttaacagctcattagattgagtagctgcaggatagatctaagctattctcttcccttctcaggaagtctttgatttgttttgaccatctaaggaaagttaatagatttttgtctgtatatgttctctcctttatttcatctctgaaaaatgttctgatcattagcattgacagaacaagttgtagatattaactaaaatccacgtcagagggaagacacagggaatttatttactttctgaatgtatattacatattttccctgaagcaatttcatatcccaggagtatttcttctcattatgaactatatccatatgtgctgaacactgaaacttgtgcagatttttcagaaatggaaagcatctgaagaagcaaatgctttttaacaaatattattgaggtaccatacttgaatattattattcttactcaaaattaatcaatgaaacagtttatctctcaacggtaatgaagaaggaaaatgattaataagagggccttgagcctcaaaagaggcatgtgcttttattaaaaacatatattcaataatataaaaactagtgaatatgtgacaggatttgcctatcaataagttaatacattttaatttttaatatttagattacatttatatagtatatgaatgctataaacaatttatgaatattattggaaaataaattttagttttagcctaataactaatgcatgatttaagatcttacagataatttattaaagtcaattcccatctgttatattatcaaaaataacaaaacattaacaatgaataaatggaccaattgtatgtttcatgccagacaagttgtactgctctggcattaataaaaatattaaaaattatgtaaaaagtacattattcactttctacacaagctgattgttaaacattgaatcattacatattttgtctcatttctggactgttgacctatacaactatgtatttatgctgaaaaaaaaattctgttataaagaattgtatttttctttcttttttttttttttttgagacagagttttgctttggttgcccagggcggacagagtgcactggtgtgatctcggctaaccacaacctccgcctcccaggttcaagcgattctcctgtctcagtctcctgagtagctgggattacaggcatgcgccaccacacccagctaattttgtatttttagcagagacggggtttctccatgttgatcaggctggtctcaaactcctgacctcaggtgatccacctgcctcggcctcccaaagtgctagtattacaggcatgagccactgcacccggcaaaaattgtatatttctttaaaatcctttattcaataaaaatgtatacttatttattgaagatgtactaggtactttatgaggcccccaaaatattaaaaagatgactattttctatttaatgtatataggtagtaattagacaaagacattggcagaaataatttcaacattgtaagaggtatttaaaatttaagtaaattctgccttaatccaaagactgagcatgtatttcattatgtacattgtttaaaatttaataattggaggatttctccattcagaagatctatgtgattgtattcatcatataaaatgttaattttccttatgcctaaaatatgccaagcatgttataggaatatagtagttgaagtttttataaaccactggaagtggcctatcttgtagtatcagtgtggtgagttcttaattttatttgtctttggagtttaaagtttaagaaacaaagataataatgtaagaaaataccaaattacaacacaaacttactaaagcttagaaatgtaagtattcaatgaaaagggaaagtgtttaacttacagatagtaaattgttagttactccatgttttagtccattcctgctgctataacacaatgccttagactgggtaatttaaaagcagtagaattcattgctcacagttctggagactgggaagtccaagatcaaaacaattcaatgttgggaaaggacttgctctctgcttctaagatgacaccttcttgctgcattctcacatggcagaagagggtaatgagcccacacacctcttgcataaggacactaatcccagcaatgaaatatctgctctcataatctaatcacctctttaatgacccacctcttattactattgcatttggataactgttttgatttttaatagagataaggtctcactatattgcccaggctgatctcaaactcttgtgctcaagggaaatttctacctcggtctcccaatgtactggaattacaggtgtgagccactgctccaggcctacaaacaatgacatattatagccaatcagagtttcttgtcactatgctataattaatgtttttatgcagaatggagaatgtcaagacgaaaatgaataaaccaacttttcagttgcctattatgctgaaataaaaacttagggaatcaggtgaagatatcactggtcttcatattgaaggagagtttggatttttacctgtattggtagattataaaatgaaggcttaaactattgttttctgaccatctttaacaataaaattttaggtgcatttctaactagaaaaagacgcattataaatgataccatgtaaatggataattctgtaattctctaatggtttggaattattcatctagctataaatatagtctgagtagttactatatagagaccaaacttaattgattattatcccatctgcactatcattaggtaattattatacatacttaaactaactggaatattttctagattgagaataagtaagtaaagttagataaaaggcaaagtaatttgcagaacaaaaatatgtgtaatcagtagacatatttatggttagcatgtcttcaattaaaagttacactttcctactgggcgtggtcgctcatgtctgtaatcccagcactttgggaggcagaagcagaaggattgcctgggtaacatgatgaaacccattctctacaaaaaaatatgaaaattagatgggtgtggtggcatgcacctatagtcccccagctacccgagaggctgaggtgggaggatcacttgagtctgggaggaggaggttgcagtgagccaagatcacaccactgcactgcagcctggatgacagaatgaaaccctgtctcataaaaaaaaaaaaaagttatgctttccaagaggattaatcttactctatttttatagccatttgtggaggtatcccataaagaaatcattgctaaaataccaaagcataatctttgcagtgttgatttttcatcattcattcactgaagaagcattgttatctacctattacatgctgtacattaggcactaggaatacaaagattaatgcatttaaatatattattgtaaatgcacgggcaataagttattatttagattatttaatcaatgtacaacagaaacctgaataattctacctcactattttttcagagggattattttatatcattttatatacttatttcaacttttcacctaattttagtggcaaaaggttgaaaatatgattaatgtgtatgagttaaacaaatgtcttccgaccttacagttactagactctcaaactctacaatataaaacaagccataagttttcctatgattacagaatctcatatatattttggaaggagctttggaatgtgttttatccaacctcctgaaaaatgttggagtttcttctttatccttcccaaaggggaggggaatagggtatggaagttgattacggtagttgaaatatggataaaagaagagcaagagtgaatgagaataggtttagaagacaaatagctctttctctcaattttgcagaaggctggctatgattattggtataagccaggataagtcaaataatcaaatataaaaattgcagtgactttagaataaattgctggggacttaaatttgaaaaccccttttgtttgatttaatgcagttgagttctgtgtgtatatcaggaaaaatgaaaaaaaaaatcttaagcttctttgtaagctcattatttctacatttcccaatcgtaatttttaggtgactaaaataatgagtttaaacattattcattcacctggttctcaattatatcatggttgtttttactgtaacattgaaattttaaaggggttcttagtataagatatgtagcttctttctctgcttcttgcaggaatatgcctaaacaaaactgaaaaaaaattgcaaatagatatatgaatcattttccccttgagactctgcttcatataaagaatgcttctttcaagctactttcctattcaaaatcctctggcaactgtagattatctctaggattaagactaaatttgtgaggctaatattccattcaaggtagccacaatctatactccgtcacttttttataacttatttaaatttgaaataaattctcattagccactactattggcctatttatacctttttccaaattgccaggcacactctgtaatcagttatagtctcttaaatctgctatgtgcatttctgtctctatcattttgctcacattgattttgctaattaaattctttccgctctcttcctttccaacctaagttataatggttttaagtatgtatctaaatttaatgttcttggaatttttcaggcagactctgttgcacagtccttaaaaatcaagttctatcaatgagaaaccacactatgatgtttacttgctttctatcatgggcaattcatgaaaaatctttgtgctatgtatttagttatcataattggaaatactactagcaatatcacatgggtttgttgtgaagattaagtgaactaatatttggaaaatgtaaacattctataagtgttgctactgttgctgatattattgctattgttgctattattaagctatgtgacaacatgtttattgccttatataatttcttagctatattaattcaatttttatgtgtgattgacatatctctttaaattttaagctctttaagactgaataaaacatgtaggataatttctaaatatcctaattactttggacattttatagtaaaagttcaagaaaatgtgctcaatcaataagtgaaattatgaatgaaagactgaaataatgaatccttgtattcaacatccaacaatccaacattcttctattcccatttgtccatatagatcaatactattatcttaaatcacattttcttcagataaatttagccttttatagacattttgttttataaattttgttgattgttataaactctactacagataattttattttgtgttacatgtgtaagtataaattaagtgaacaataaatatttcataaaaatataaactagaggattttagcatcattattggataaattctcccaaatattaataactaatttataaccaaaacaatttgtatctgaaataagttattgtatgttacataggttgggtagaaattttatttttaataatgtaagctctgaatattgatttagccaatttatgacattaataaagtatgatatttggtgaaatttttattaatttaaccaaaaaaactttcagtaatattttgagagtttcctaccaagttatttgtactgggaagcaggtagtcatagaaccagatgtgctgaaagaactagggttattttggaaggtgagaatgatgaggtgaggagacggaataaaatctcacaaaatgaaaaataaaaaacaacaagaataaccaaatcttccactaggaggtattctcattctgctcaatgtcattattagcagttggatgtcttttgggaacatgtggttataagcattgcctcctgatttatgaaacgatttctgtttattcctatatatttatcagttttaaaatcagtaaataaaattttaagaataaacagaaatgtggaaacaaatatgaaaagaaacagtgaaaacatgtgatagtgcttgtcttctaagaagtgaatgttcaaaaggaaaattgagtcaacagacaagtgtttctcatttgaatccttgtaatgaagcttgaattttaacttaataagacataaacgtaatgactataaaagcaaaacatgggatgaagcaatgcttacagggtacttataaagtaagcaagaccacattaatctaaaagcatacttggcacctccttaaccttggcctttcccttttgtcctctcttctctttatcccttcaaaaaaccaatcctcccactcttccatattttagtcacaatttggaatattaactcataccaatgtaaatatatatttttccaggaatactctagttttcagaaggatcacagttttcaacataaaacgtttgtgaaatttaagttatcaactagcagaggatgtttaagatttcagtgtggaagaatgaacagttgtcagaataaatacttccatgagaaatgtatacctactcatgcataacacaaaactttaatatttgcctaagcaaactttatggcaacttttgaatacaagaaatatttattgacttccaataattttggaatgggtatacatattcataatttccagaagttcaatttgtatttagatcatgtttagctgccaaacattcaccagtacatgatagagagagagagataggcagacaaatataagaaacgcagagttggattctatctgtttgccactgtagatccagtctctacctttttctaccctgctttgctccctaggaatttgaattatattgactgataaatgaactcccttcccctccaacttctaattgatttccactaagaagaaagagggcaggagatttaaaggatcaaggagagtgactttggataatttattgctttggcacccagtctgagactcagcattctgtcacttccgtgaccaaaggtctcagttcctgtcatgtagctctgccctatcaacaaaatttgtcttgtcaccaactccagtaaccctctcgctcacttctcttcaaagaatattaaacaatccccactgttattagccttaggattcttcattatcccttatagttccctatgtttttttactatttgtaaatagtcctttttcatcctgtcttaaaaatatcttgctctgagccctagaactcctaagatttcaggattttgtcctggaatcttaagtacagtagatggagagacagttcttaatcactggaatccctgggattagtgggattttattttttattcctaattatgtctaccttttgtgatgtctccatttttaaatacatttatcttccatttgattactgcatatgttaataattgtagcactaaaaatggttaatagtcattatgtgtttattagcggtcaggcattatagtaaaaggctcgaacacattagtttacagcatccctgtgaaagaattactaaaattatcccctactaaagatgaagacattgagacttgcttaggtcaagtgactgttccaaagtcacacagctagtataataagtgagatttaaaccaaggcagcagggctccatgcttttaaccaccatacggtgttgtatagtacttcactatatacatttgaacctagacagaataaaattaattttaaaaaagtatttagcacattgtagttgcctgctatagatgccatttagacattaaaattttcatgtgaattgaattccagtgatagttacaaaaaagtgctttgacaattttttaaataggaaacagcatgttactcagtgataaagcacacaaaaatggtatgaaacttttaaaacctaaaggacctgacactttaaatgatcttttgtattggttcgagaagtcattaaagtcatatatatttagggaccatagcaaaactaaataacacatcagaattttgtacaaaattattttttgagtacttagtaatatgctatcatataaagtgtgataactttttctaaataatgacttaaaaaaatgaatcataaagctttacatcccatagcaatcaacaatatacctatatgggagtacagagtatatatattccatgtaaaaccacatgttttttttctttatattcatcctatcaaattaaaaaaatcaaaggcaaaattttgatgaactgatatctttcctcataaaataaaaacaggatgtgccctggttctatattctttaattttactttttgaatgcaagaatgagagaaagcattaaatcacaatactgttaggatgaattggttatattcagatagacactaattatgtttgactgttcttaaagggactgaacaaaatttgcatcagtaaaattaattcatacaaccactattcaatcatgcaggaaagataatagtctgaagtaaatgtttaaattttcttgtttactctaatgaaagaaattctttccttgtaaataacattcgtatgtatgaggaatgagcaaaaagatgaacttcatagatactccaaactaaataattttgttacttaactataatattaaaataattgaagaagggaaagcaaatgttcttctcagctttttggataattgaaaaaaagttaagctgcttttgaagttagactgcatctataagcttttcacatttgcaggcaccagttatgaataagtttgttctgaaacagttaaaaataaaagattttcttcatgaccaaaaaaataaaaaacagcattaataataataaaactcctcagcactggaagaagttggagaggctctctctcaggcttagaaaaaatgaggaagccatcaaaaattcaagaccacagacatagagaggtacacctgcttcaaacagcaggactgctgtgcctccattctccactttctccttctccctgccccaaacaatccctatacaaacataaattttagttaaatatatgtgtatatatgatatatattatatatacacatatatatatataatatctcagtgccatctgagttgtagattctatcattttttcctctgtggaactgttgtggagacaaattgagaagttagcaagtgcattattctggttctaagcaacagcaactttaatcagggaaggctgatgcaaaccctctaggaatagtatataaattgttagtgtagtctattctaatgcttaaacaacctttactgtattgacagtctcctactgctacactctccatagtgaagcctaagcccatttacccttgttctgtcagcccagctgaatgacagcagatcaattttctttctaaaggtccttccagtttagtttatatttgtagaattattttttctcacttttgccttctctagattgaatcatccaattgttttagttaactttgacattttcacttctttatctctagctgttaactctttatcttattcatattcttttttgtttgggtaacatgaataatcgagtccatgtgctatgcttttccttatatattgtgtgttctttaacttgtgtttgattaatagcttgtgttttcagattatcttcttatcaaaaccaagatctttctgaaatgctttaatactgatctttatccatgatatagttgttatttttcccttctgacgcttaaacttatctttgacttgttacctcacttaccaaattttctgaagttaatattcttcaatgttctagctaatgttttctaatatatactctcttttctgtagaagagtttttaagtgctgctattttactgggatttcaataaaatttatctcaaacatcctacatatggtaaagctcaataaatatttgctgaatttggtcatccatggtattgctagtggtttcctaaatcagcatgtggaaatagattttatgaatatgtcagacttctcaggaaattatgacagaattaaataatagtgtctgtagtatgttgccttctttctcagaaagatgtttgctgaattatatgaatcaattttaagctttattctttctgtaatcagtctatctatcaccacctacttctgtaccaccttctctttacttactacatctttaatttccaacttattcattctatcattagaggtttgattagtgcacagcttattgaatcattagagctgttacttagaatcctgatcatttaaggccattcacagattgacgatgtgcaaaattttaagtttactttgatgtgattcgataaaagaaaatgtctgggattgcttatctttaatctatgcatgatggaacataagtaagtctctaaaaattattttaataagagcttacaaatttctaggtgttttgtttcacatttttaaaaattgatatacttcaagagcttttttatgctcatagaaaattgaatgaaaactatgaagttcccatgtatcattggttcctctactagcacagccttccccactctctacatcccacatcacagtggtacatttgtagagtcaaacctacattgatgcatccttatcactcaaagttcatagtttacattagggttcgcacttggtcttgtatatcctactgtagattttaacaaatgtacagtgcaaagtattcaccactgtaatatcatgtagaattatttcaatgtcattaaaatcttctgtgctttgtgtactctttgcctattttaattgagttgttttcttattgtttaatgctaagagctctttttatgctttgaaaaacagccctttatcagatgcgtattgaatattttttccgaatgtgaggcttctcttttattctcttgatattgtcttttgcaaagcaaaagtttttaattttaatgaagactagtttatcaattatttcttttatagattgtgcctttagtgtatctaaaaagtccttgccatacccaatctaggttttcttctgttatcttcaagaggtttatagctttgtgttttacattgagatctctgatgcattttgagttgacttttgtgaaggatgtaagatctgtatctaaatttatttgtttttgcatgtggatgtccagttattccagcaccattccttgaaaagtctatttttggttcactgtattgcctttgcttcttttcaaaagatcagttgattatatttaagtggatctacttaggtgggctctcagttacacgccatttatcagtttgttctttccccaataccacactgtcttgattactatagcttcctagtaagtcttgaagttgaataatgtcagtcttccaactttgttcattttcaatattgaattggcttttctgtatatttcaccttactatataaattttataattgatttgtcaatattggcaaaatagcttactgttatttctattgagattgcattaaatctacagaacaagttgcggcaaagtgagttcttgaaagttttgagccttcctattctatgaaacatagaattagtctctacttatttagttcttcattgctatcattcactacagtttttcttttttaagtatacttttaaattctagggtacatgtgcacaacgtgcaggtttgttacatatgtatacatgtgccatgttggtgcgctgcacccattaactcgtcatttttattaggtatatctcctaatgctatccctctcccctccctgcacaccatgacaggcccaggtgtgtgatgttccccttcctgtgtccaagtgttctcatgttcaattcccacctatgagtgagaacatgcggtgtttggttttctgtccttgcaatagtttgctcagaatgatggtttccagcttcatccatgtccctacaaaggacatgaactcatccttttttatggctgcatagtattccatggtgtatatctgccacattttcttaatccagtctatcactgatggacatttgagttggttccaaatctttgctattgtgaatagtgccacaataaacatacgtgtgcatgtgtctttatagcagcatgatttataatcctttgggtatataccccgtgatgggatggttgggtcaaatggtatttctagttctagatccctgaggaatcgccacactgtcttccacaatggttgaactagtttacagtcccaccaacagtgtaaaagcattcctattgctccacaccctctccagcacctgttgtttcctgactttttaatgactgccattctaaatggtgtgagatgttatctcattgtggttttgatttgcatttctctgatggccagcgatgatgagcattttttcatgtgtctgttggctgcataaatgtcttcttttgagaagtgtctgttaatacgcttcatccaatttttgatggggttgtttgattttttcttgtaaatttgtttaagttctttgtagattctggatatgagccctttgccagatgggtagattgtaaaaattttctcccattctgtaggttgcctgttcactctgatggcagtttcttttgccgtgcagaagctctttagtttaattagatctcatttgttaattttggcttttgttaccattgcttttggtgttttagtcatgaagtccttgtccatgcctatgtcctgaatggtattgcctaggttttcttccagggtttttatggttttaggtctaatattgaagtctttaatccatcttgaattaatttttgtattaggtgtaaggaagggatccagtttcagctttctacatatggctagctcattttcccagcaccatttattaaataggagattctgttatgttgtgtgtttgttctcactggtttcaaagaacatctttatttctgccttcattttgttatgtacccagtagtcatttaagagcaggttgttcagtttccgtatagttgagtggttttgagtgagtttcttaatcttgagttctagcttcattgcactgtggtctgagagacagtttgttataatttctgttcttttacatttgctgaggagtgctttacttccaactatgtggtcaattttggaataagtgtgatgtggtgctgagaagaatgtgtattctgttgatttggggtggagagttctgtagatgtctatcaggcctgctttgtgcagagctgagttcaattcctggatatccttgttactttttttctctttgatctgtctaatgttgacagtgtggtgttaaagtctcccattattattgtgtgggagtctaagtctctttctaggtctctaagaacttgttttatgaatctgggtgctcctgtattggatgcatatatatttagcataactagctcttcttgttgaattgagccctttaccattatgtaatggccttctttgtctcttttgatctttgttggtttaaagtccattttatcagagactaggattgcaacccctgcctttttttgttttccatttgcttggtagatcttcctccatccccttattttgaacctatgtgtgtctctgcacatgagatgggtctcctgaatacagcacactgatgggtcttgactctttatccaattttccagtctgtgtcttttaattggagcatttatcccatttacatttaaggttaatattgttatgtgtgaatttgttcctgtcattatgatgttagctggttattttgcttgttagttgatgcagtttcttcctagcctcaatggtctttacaatttagcatgtttttgcagtggctggtaccggttgttcctttccatgtttagtgcttccttcaggagctcttgtaaggctggcctggtggtgacaaaatctctcagcatttgcttggctgtaaaggattttctttctctttcccttatgaagcttaatttggctggatatgaaatctgagttgaaaattcttttctttaagaatgttgaatattggcccccactctcttccggcttgtagagtttctacccagagatccactgttagcctgataggcttccttttgtgggtaacccgacctgtctctctggctgcccttaacattttttccttcatttcaactttggtgaatctgacaattatgtgtcttggagttgctcttctcgaggagtatctttgtggcgttctctgtatttcctgaatttgaatgttggcctaccttgcttggttggggaagttctcctggataatatccggcagattgttttccaacttggttccattctttccgtcactttcaggtatgccagtcagacctagatttggtcttttcacatagtcccatatttcttggaggctttgttggtttctttttactgtttttttctctaaacttctcttctcgctccatttcattcatttgatcttcaatcactgataccctttcttccacttgattgaattgactactgaagcttgtgcatgcgtcatgtagttctcgtgcaatggttttcagctccatcaggtcatttaaggtcttctctatgctgtttattctagttagccattcacctaatcttttttccagttttttagcttcttagcaatgggtccgaacatcctcctttagctcggagaagtttgttactaccaatcgtctgaagccttcttctctcaactcgtcaaagtcattctccatcctgctttgttctgttgctggcaaggaactgcgtccctttggaagagaagagatgctctgatttttagaattttcagcttttctgctctggtttctccctgtctttttggtttttatctacctttggtctttgatgatggtgatgtacagatggggttttggtgtggatgtcctttctgtttgttagttttccttctaacagtcagcaccctcagctgcaggtctgttggagtttgctggaggtccactccagaccctgtttgcctgggcatcaccagtggaggctgcagaacagcaaatattgtagaaaggcaagtgttgctgcctgattattcctctggaactttgtctcagaggggcaccctgctatgtgaggtgtcagtctgcccctactggggggtgcctcccagttaggctactcgggggtcagggacccacttgaggcagtctgtcagttctcagatatcaaagtctgtgctgggagaaccactactctcttcaaagctgtcagacagggacatttaagtctgcagaagtttctgctgcctttatttcagctatgccctgtccccagagttggagtctacagaggcaggcaggcctccttgagatgcggtgggctccatccagttcgagcttcctagccgctttctttacctactcaagcctcagcaatggtggataagcctcagcaatggtggatgcccctcccccagcctcactgccaccttacagttggatttcagactgctgtgctaacactgagggaggctccgtgagcttgggaccctccgagccatgtgtgggatataatctcctggtgtgccatttgctaagaccattggaaaagcacagtattagggtgggagtgtcccgattttccaggtaccatctgtcatggcttccctttgctagcaaagggaattccctgaccccttgcacttcctgggtgaggtgatgccccgccctgcttcggctcatggtctgtgtgctgcacccactgtccgacaagccccagtgagatgaaacaggtacctcagttggaaatgcagaaatcacccatcttctgtgtcgcttacactgggagctgtagactggaggtgttcctatttggccatcttggaacctccctccattcactacagttttgttttcttcccgtggattttgtatataaattggtagatatatatctaagtatctaatttttgtggatgctaatataaatagtaatgtgttcttaatttaaaattccactcattcattgcctgtttataaaaacaattgacttgtataataactttctatcttacaaccttgctatctttacatattagatccagaagggcttcttttgtttatttttttagatttactccgtagataatcatgttatctgtgaacaaaagcagttttgtttcttccctcctagtctatataactttcattttattttcttattttgttgcattagtaggacttctagtaaaatgttgaaaacagtggtggtgtggagattctaagcttgttctttatcttagaaagaaaacttaaagtttattaccattaagtatggttttagttgtaggttttattgtagatgttctttattaagttcaagaagttcccctattcctagtttgctgagtgttggtatcatgactgggtttttaatattgtcagatgttttttctgcatctattgatataattgtgtaatttttattcttttgcctgctggtatgattgattatctgaattgaatatgaaaagttgaacaaatctggcatgactgggttaaatcccacttaatatggtgtatatttttatatattgggtttgatttactaatagcttgttaaggaggtttgcattgatgtttatgagagatgtaggtctatagtttacttggactggatttgacagtagagtaatgctgaccttatatagagaatgagttaggaaccattccttctgcttccctgttctggaagaaattatagataattggtataatttctaccttagaagtttgatagaattagccagttaacccatgtctttttttggaattttatttattattgattctttaatagatttatgccttttcagattatctatttttgtatgaggtttgacaaattgtttttcaattaattgatccatttcatccaggttatcaaatatgtaggcacagaatttgcctaatatttctttattatcattgtaatgtttatgtgttctgtaattatgccacctcttctatttctaattttggtaatttgtgattctcccttttattctcagcctagctagagggttattaattttattgattttacataaaatcagctttttgtttcattgctctctattgatttcctgttttaaatttcattgatttgggctctaattttatttctttattctacctactttggatttaatttgcccttctttttctagtttcttgtggatatttacatgattgattttagatttttccttttttctaatatatgcattaaatgctataaatgtcctactaaacaatgttttctctgcatcccacaaattttgatgagtagtatttttgtttttatttagtccaaaatattttttaaatttctcttgagttttctttttttttttttttcacccatgtgctatttaggagtgtgttgtttaaattccaagtattttgggatttttaagctatccttctgttactaatttctagtttaattctagaacttagtctgggagtagacattgcatgatttatattatttttaatttgttaaggtgtgttttatggccccgaatatggcttgtcttggaaaatgctccatatgagctttagtgtatagattcaattacatgtaattgactggtgatgctactaagtttagtaatgtccttactaattttctacctgctggatttgcatatttctgttagacggatgttacaatcagctatgataatggattcatctattttgtcctgtagttctgtcaggttttgtttcacatattttgatgctttgttgttaggcacatacacgttaaggattgttacattttcttggagaattggcccctttatctttatgtagtgctccttttgtcctgaagtctgctgtatctgaaactacagccaacttcactttctcttgatcagtattggcatagtataccttcttccttctgtttacttttaatctacatgtgccttcatatttaaaatgggttcttacagacaacatgtagttgggtcttattttatgatccattctgacaatctgtcttataattgttatatttctacgattgaattttaaattgatgaatggtacagtcatactaatatgtatcatatttgtttctattttatatttgttgcttttatatttttttccaataatccacaatttttctgagttttttgtttttttgtttgttttttgagacagagtctggctctgttgcccaggctggagtgcagtggtgtgatctcggctcactgcaacctctgcctcctgggttctagcaattctcctgcctcagtctcccacgtagctgggattacaggcgcatgccaccatgcccagctaactttttgtatttttagtagagatggggtttcaccatgttgcccaggctggtttcaaactcccgagctcaggcaatccacctgccttggcctcctaaaatccaagtgctaagattacaggcgtgagccactgcgcctggcccttttatggttttgagtgttatatattgcactattttctctcctttcttagaatatcagtgatactttgttactatcttactggttgcgctaaagtttgcaatttacgtgtaaaactaagcaaaatccattttcaaataacaccatacaacttcacaggtaatgcaattaccttataataacaaaatattctttattcctccaaactgtcccttgtatcattgctgccattcattttatttatacacggtcatacatgcacataaattatacctattattttgaaggaatatatttctgttaagttaactaaaaatatgcaaaataagtttttattttacactcactttttccttctttaatgttctttctttacatagactcaagtttctagtctgtattgtttttcttctctttgggcaacttattttaacatttttttgctaggtaagtctaatggcaacaaattccttcaatttttttttttttgaaagtctttatttctccttcagttttgaagaataatttctcatggtatgtaattctaggtttgtgggtttttctctctcaatattttaaatattctattcaactctcttctatctggcatggtttctgtggagaaattggatgtgattcttttttctttgcttctctgtaggtaaagtgtctcccccacaccatccccctggcttcttttgtgacttcattattgattttctgaagtttaaatatgttatgcctaagcgtcattttctcaacaattatcctgcttggtattctctaagattcctggatatgtgatgtatattacattaattggggaaaattcttcatcattattccttaaaatattgcttctgtttttttctctcatgcttctccttctgatattcccattatgcatgttatatcttttgtatttatcccacagttcttggacattcttttctgtttgtttgtttttcagcctttttttctgtttgctttttaattttggaagttcttattctcctattcacatgctcagagattcttttcttagccatgtatagtctactaataagtccatcaaagtcattctttatgttatactgtttttggtctctagtagttcttttttattctttctttagaatttttatccctttttacattatcatctgtgcttgcatgttgtctactttttctaataaagatcttagcatattaatcatagttttatgaaattcattatttgtaattttaacatttctgccttatctgactctggttctgatgctcattcattctcttccagctgtgtttatttccttttagtgtgctttgtaatttttttgttgaaaggtggatatgatgtgctgagtaaaataaactgtggaaaacaggtctttcataatgcaattgtaaactgtggggagatgcgatgcattcaatcatactattattaagtcttagtcctttgggggccaggcaaggtggctcaagtgtgtaatcccagcactttaggaggcagaggcaagcggatcacttgacctcaggagttcgagaccagcttgggcaacatggcacaatcccgtctccactaaaaatacaaaaattagacggccgtgctggtgcgcctgtaatcccagctacttgggggactgaggcagaaggatcgcttgagcctgggaggtggaggttgcagtgagccaagattgcatcactgcacttcaacctgggcaacagagccagaccctgtctcaaaaaaataaatgagccttagtccttcggtgagccagtgtctacactgtgaacttcactgccgcttctcagttttgttttgtcattgctgctttttttttttccttcctgcattaagtgggacaacaagatagtatgtgttggagttggtatttctctttacccatgtggaagggtatagggaactgtcactgggtcttccctaacatgggaggctagcactggctacagttgggtattttccttcctccaggtatgtcaggctctgataaaacttttgcaggttaggctctgggaaaatagtttctcccaagggaaggacttgttaaaaacagaatgctctgaaatatttccaaactttcctttttccctcctcttgctggaagcaagatggaatgttttctggtatttattgtaaggacttcgtagggcttttgcaggtaaaacacaaaattgtggcaccgtatgtcactccacaccatgccccatgactggtcccctttggagcttttaactcaaggacttgtcctcagggggtctccagcaattcatcaattacagtttagattttcctattgcttcccatggaagtttctgctctgataagttgtggctctctgtatctgcctatctgtctttcaaatttggagaatgcgatttgtgctgtaacatgacttattattttatgaatctaagaagagttgttgatttgttcagcttttcgtttattgttagaatggagtggctatttctggttcagaaaacagaagttcgttttgtaatgttttaagaagagaattatatttaaaattgagagcttcttgggctatactatactatatcataccatatcttactcataattttgatttagtgcctggagcagaattggtgttaatgaatgcacaggggatgaaagaataactgaatgaaatgctaatatattattgatattagaattttgcaatattgttttcagtaataaattctctgaatatgcgcaaagcaaacttccatctccagttctatgattttacatagaagtgtccaaattcactgtttaaaacaaaactaacttgagcatttgaaactattattttaaataatattgaaagtttatgttcatgacttactttaagaacataaagtattttctgcttgatatagccagtagctccagatatactctacaataataaaaaagaaagagcagtcaaatataattcaaactactatatttctaggggcatgggcaggatttttgttacattattttacttatatactatatatttagggaagcaataagtaaaacaaaagcttatgtatatatttgaggtaaaaataatatactcttcaaatacctttatatatgcagatttttgaaaggcaatacttatgttattgtgttaattgcttaaaatatagttttgctatacagtgcctttatagattaaaggaaaatttctttaaatgtttacagtttatctcaataaaaacagtgagctatgaattactctgaaatgtaaagcttatgattctttgcttgataaaaaataatgagcatattaaacccaacacctaacctgctgcaaaacctcattgaagagccgtattcaatagctgtttgatatttctattagggttttattgtaggtaaagttgaaaaccactggatacagtccaatagagacttccaaagacccatgcagggattttattaacaccaatttatgacgaaagctgagcttgtataggctctaaatgttccttaaaatatttgtttctcttgagtagttcctgaagcagcaggcaaaaaacaaacacacacacacacacacacacacacacacacacacacacacacaatcagtcaaggccgaagcactcaagatggaggactttgcaatgtactaccaggaaattattcttttattaatttatatttccaaagaagagatcatttacacacaaaaggtcacttttttgcatgttttattgagattttgttcctgaaaatgaacttctttccttttagtgtgctgacaaacatcagaactgtcaaacatcaacatttgtaattataacttgagcttaaagtagaggcaaaagggaggggaaaaatgctgtggcagtttgaattttgacaaatttcaatgtagtaggaaattctgatattgaaatcaaaattagtattgtcttttcattttatggtatatagaagaaataagttcattttttaagataaaaatttgaatataatttttaatgtatgacataaaatctctaattcaagtatgtgctcagatggctaaactaccctcaaatttgcatagacaagagattttagcatgttacagcccaataacattttattcaatgatgctgagttagaatccaatgtgcttaagctgataaatgtaatgaataattagagaccctcaaatattcttattaatcaatctattatttaatttagcaagtatttccaaacataaattactttccaggcaccattctgaggcctgaggatacagaaaagaatgagacactgtcttgaaggaacttacattcttggggctagaaattaataatcaataaccaatcaagtaattaacaagatcattatacagagtcataatttgggttgatgtgataaagaatgagaggatgggtggtatgcttctttatatttagagctagaggtccctctaagacagtgtatttggacagtggccttatatatgacaaaaggaactacagtagttcattttatacactggaagatgtataagtggaatgctcaaaagagtggaagcaacaaggctgactgtggatttagcttgtcatgctaaaacagaagaaatgcaactgagttttgcatgttgattttatatcttgcaactttactgaatttcttttttaattctaacaattttcttggtggaggtcttaggattttctatatattagattctatcatctaaaaaaagataattttttcttccttttttatttggaggtctttaatttctttttcttgcttaattgctctacataggatgtccaatactatatcaaatagaactggcaagtgtggacatccttgtctttttgctgatcttagaggacaagatttcggattctcaccattgaatataacgttagctgtgatttgttttgtattatatataagacaggcctagtaagaggcctttattatgttgagagacgtatattctacacttaattttttgagtatttttatcatgaaaggatgttgaattttgtgaaatgcttttctgcatctattgagatgattatatgatttctattcttcattttgttaatgtgttagatcacattttttgacttgcagatgttgaacatccttgcatctcagtgatgaatcccacttgatcatagtgtatgatccttttcaatggcctgttaagctctacttgccagtattttattgaaggatttttgcatctatgttcatcaaggttattggcctataatttttattcttacaatgttcttgtctggctatggtatcagggtcattctggcctcataaaatgagtttgaaagcattccctcttctttaatattttaagaaagatagatattaattgtgttttaaatgtttggtagatttcagcaatgaatccatgaagtcctgggcttctcttcgtcgggagatattttactgattcaatctccttacttacgggaattttttttttgtcttcagtctccttacttattattagctttttcaagtttttgtatttctgcatgaattagctttggtaggttgcatttttctataaatttatccatttctactaaattattcaatttgttgttgctcaattacttatagtagcctcataatctttctaattctgcagtatcagttgtagagtcttcttctctttcatgtataattttattgatttatatatccactcttttttcttttagtctagctaaaggtttatcaattttttaaaaaaaaccaatatatttgatattttctattataattcttgtgtctcatatattctctaatcttcattattttttcttctaattttcagcttggttttttctttttacttaatgtgtatagcttattgtttacttgagatcttgcttattttcttaatgtaagcatttatcattataaacttccttcttagaaatgctttcactgccttctgtaagttttggtatattgtgctctcattttccttagtctcaagatacgtattgattttccttttgatttatcctctgacattgtttattcacaggcatgttgtttaatttccacacatttgtgaatttcccatttgtcttctattattgatttctaatttcatatcattgtggtcaaaaaagattctagatatggtctcaatattattaaacttgttaaagcttttcctgtggcctaatatatgatctatcctggagagtgctcactacaggcttgaaaagaatgtattttctgctgctgttgtatggaatgttctgtatgttcattataaccttttgatctaacaataaactgtcaaaaaagaagctaatgaaatgaccacatacacaatagcacaaaaaaatcttaagaacttggaataaatttaaccagaaagaggaaaatctgtacactgaacactgaaaaacattgataaacaaaatttaagaagatgtaaataaatggaaaaatatcctgtgttgaaggactacaagaaataataatgtaaaaatgtccatactacccaatgcagtctatagattcaatgcagtctctataaaaattccaatggtattttttattaaaatgcaaaaaaatcctaaatttatatagagctacaaaagacccagaatagccaaagaagagcaaagctgcaaagacatcacactactgattttagaatatatcctaaagctctctacagtcatcaaaaaagatggcagtgccataaaaacacatatagaacaatgaaacaaaatagagggctcaggattacatctatgcacttagtattatttgatatttgacaaaggtgccaagaacatacaatagggaaaaagacagtttcttcaataaatgttttggggagaactggatatttacttgcagaagaataaaattggacccttatctcatgccatatgtaaaaattgactcaaattggattaaaaactcaaatacaagatctgaaactctaaaattgctaaaagaaaatatatgaggaaagcttcttgccattggtctgcaaaatgattttttttcaatatgacccagagcacagccaacaaagagctatgccaatttgctggttgacctcaaattcactatttttctctttgtaaattggcccagactcacactaccaaattcagcttcttcaagtcacatttttctatgtgcattcatttctgtttattactgcagttcaaaaatattaatatcactgatcagctaggataagttactgtatagtttattttcttccattatatattgtatgacttgaactaaatatactgtgactagtatcaactaaatataccaaatatactaagactagtttaaagcccaatgcccggcacatagtaatcaatcaactagcagtactctgattagttgtattaattatggtcttatatactgtctaaagaggaatacagtgaggatatataatttatactaacattaatgttatccattttcaaagaaatgactaaatacatacactagatacaaaaacaaatctaacaaaagaatgaatatttggaacaagaacaaacttaaaagctaagacaaagccttatttgagaaaatttttattcataatgtacctgtgttatcaatctacctcaatttcatcttattttatgtttttacttttttgcaatgtatctttcttctttggagtacagtaaaataacattttgtacttacagagcatgtttcatcagaaaggtcaatgtgcttttcaaactcattaatccttacagcatccccaggggtgtgtaattgtacaggtaaagaaatagaaagctgagatgtataaacaattttatcctgtcacattgaaatgaaacggtcaaacccttaattactccattgtagatgcaaaaatagaagtttcaatggcattaatatgatgataaatactggtaaaagaaaaacttaaatgagttaagtaaatgaaacgtgccttagcacataacacatatgtgtttcattgaggaaaatgttgtatttgtagttattttaacgtaatatttttagaggaaatgaaggtcaggcccaagaaatgagtgaatgctaattttgactttgatctaatttgggacagctcattgacagttaaatactttagctttaaagttatgattactttcatttaaagtgaaatattacccaacttatctgtaaactgttaaaaaatttggtctattcaaaactgatggctctaaccttcttttttttaaagtggattattaataaacttaaagaacacagtggaaattctggcccaagcattcacaggcaatcagtaatagtagaataattttttaaatgatgagttaatgggtgcagcacacccacatggcacatgtatacatatgtaacaaacctgcacattgtgcatatgtactctaaaacttaaagtataattaaaaaaaacctttgaatgaaaaaaggcaaaaaaatgagtgttcaaaactatctagacagattataaattaataattactggatgaaatatgttatataaagagcaatcctgccgactccatgatcttagggtagttgtgggatgaatgggctttcctgtgagaatattttctaatatttcagcaactttcatttatttttagcagagaaaaatttacagacagtaggcacaaataatttatataattggtgtaaatgcattatattaaaagatattttaagaaaaattattgatttctttgaatgtaagaattatatgaaatgattagaatgtttttgtttttcttctgaccaatatgtcaaaacaacaaagtcacagccattttttagagaggccattttttagtttttggtgaatcttcttatacatattttcaacatttttataaatagttttctttatccctactggctctattaaatggcaagaaaataaatgttttctgtgacactttgcttaaaatatttagaataatgtagggaaaggaggttacactttgaaattctttcttgactcagagtgtaccacagaatgtatggagtgtacaactcttaagaatattgttcaaggatacatcagagctcctgcatgttgtgatctgtccttaggagctcttggtatccacgtatacaagtcaattatttgtttctgtaaaattgtaaaattccaggaatttgttattttatataatagctcctggaattgaataccttgtgctattgacttaaagttataagatagccctgaagagtcttggcaacatcatatttactcttattttttaaattcatttttaaaattcattcagaatttactgaatatcttctatgtggcaggcacctactgaacttgggaaggtaagataatctagactctgatcctactttcagagaattgatacataaataaataaacaatatttattaatgtagtaaatactatgataacaattagaacagagtaatattggagtatagatgaggaatgggattaattttggttagggatattagagaaacttactgaagaagagataattgagctatgttttaaaggttggatgagttcctaatggagtacaagaagataagggcattcatgaagaaaatatagtttttacaggagcccagagtgaaagtaatgtgttcaaggagttgcaagtaatatggtgaaaaggttttgtaaagatatattaaggttgcagtcattgacagttgttatattaatattttcctatagggaagtagtctccaaagtttttagatttcatatttgtatcaatgaagacattttgtaagcaaaatgtaagcatttacatatttatttatactaaatcatgttatactaggaccatgataaaaatacacaaaaaaagatattaatggggtaaattaaaatacaattaatagtactttaaatatttcttaaacattttatttaatgtatattacaaagaatttttactcttaatatggtattttaatatattaataattaccttttaataaaaaaaatatatttcattatttttgaagcctggtattgaaaagctatatttagttttttcttgtatttgattttaaaagttgtcttatccaaaggatatattctcttccaaaacttcattgatccaaaaaacaaaatatgtgtattattggttcccatgttatttccaggaattattccagccattttaaaaagcagatggagataaatgtacttcctcaacatagctagcgtattgttttttgataattattaagaaccatcaatgaatttagagtattttagcactgtatttaaatattgctgtaacaatgtgagttttttttgtttgtttataaatgtcttgctaattgtaatggttccatgttgttatttgctgatgtctgaaatcacaatacatactttgagtaaagttcacaatttgtattagtctgttttcacactactgataaaggcatacctgagactgggaagaaaaagaggtttaattggacttaccgttccacatggctggggaggactcagaattatggcaggaagtgaaagacatttcttacatggtggtggcaagagaaaaatgagaaagaagcaaagttggaaacccctgaaaaacccatcagattttgtgagacttattcactatacgagagtagcagggaaagactggcccccatggttcaattacatccccctgggtccctcccacaacacatgagaattctgggagatacaattcaagttgagatttgggtgaggacacagccaaaccatatcaccattaataatactggatgtaagtatttcaaatagcaatttctaattattttggtaatttctcatcagctatggggagattcttgttgatttcaaattatatatctacagaatggttcatggttcattctaggagcagaagtgtcaactccacattgcttcctttgctttcagtgtactactataagtttaccttacatatgtctagttaagtatgtgtcatctaatattaactaacaaagtttggatatggacctctgtcaactattctgtgctggaaatcccattttttttgagaatcctagagcatactacatagagttaaagtcagtgtgttaagcactaattttccaagttaaatttatttcttatttaaaataatataacaataatttaaaattctaatactttattctcatgctggtccactatgagcatcttcaagaattctccaaataaaatcaaagcgtgtataattggctccacaccttcagctgttctctaagttcattgtaatgtgtggtaaaacaaggtcacatattctgcaaggttattctattaagatgaaggaatatttttccccctgggatatttcagctctcctagcactgggcttgacacctgcactaaccaaaaggggtttactaatccatctggccattttttttgaatccaggggagtagggatgacaattctggattactttatatttatgaatttatatttttcataaaacatagaaacatgaaaatcaaactccagttattcccaagagatatcttaattgccttaagaaaatttgtgagtaaattattaaaataataatttccaattacaaagaggtatattattctcatccatgttgctttataagtcattattagaaaaattatatttattttttctaatgtaagttgtacatattttaaatagtatcatattgtaatatcttaaccattagtgatctaaataaaaatggtcttattctattactttatgttttggccagtgggtgtcattggtaaatgtaatgaaaaaaggaaaaactgaaaatttaaaagagtaggaaaaatataagaaatcaaattttgacaatattactttttgacaaggctttttattacatgtgtcatcaattgacagatgagtaggtaaactgattggataatgaataaatagataaatagatattgttttaaatgctagatacatatactctagtcactcaaggtaataaaatatgttgctttattgaaaaaaaagtcccattttcatcactgttaccaaggcaaaatcaattacataatgtggtagttagattgatgttgctaccatataatttccaattctttctcagtttacttgacagaacaacattatttagtttgtgcactattgttgaagcagttaaaaggaaacaaacacttttcagcaatgttatcaaatatatactttgtttttccttttgaagcttgattatttggcattgatattttgtctgaaacatagtgggtgattagtaattaaatgttgactaaatggattatcccattgatatatgaacatacagtaatattattcttatttaaaacaaaacaattttctccccatggatggaacatttgttcattaatagctggcaggctattaatttaactatatattttaaaaattcaaaagctttatgaggtcaagttgcaggtcaatttttatttcttgctgtatgctcaatcgtttaataacaaacacaatgtctggtaaagagcacccatcagtatatatttaccgaattaacaattgcttaacctcaaatagtaattgatttctttatggcaaattattcactcatatctagcctacttttcctgtgaatttgaccagagttttaagcttctcaagtgcttttcttttccagtagtttattatgctcagattacttcacgtgatacctaattataaagaacaacatattgttctttagaattaaagaaaaagtaacatcaagagtgttctatccagtagacatcatagatacagagctagtgcttacacatttccaaggacctgtacaaagatttaataactgaaagcaaactactgactccaaaacctgaaagtaaaactatatgaaaaacccaaacttgtactttaaatacatgtatttgtaaagctttaaaattccaagtcatctctctcctaacctataacaatagcctactattctcactccaacctggaatatcctctgtatatacagaagccaaaattgtgttctcaaagtgtcgtgtcttacccatcactcctctgcttaaaacttcttcctgtactgtaatatatctaaaatggaaaatggtccttaccatgaggctacataatgtgattcctgacaacttttctgaccttgttttatacagttttcattcacttccccctctgcaaatacacttgggtgtcatatttgattctgaagtcttttacaaatattgttagtttttcctggggttctctattctgagacctttatctgggctgcctctactcatgatttaagtttcaagtcaaaatttacttcctttgagaggatttttctcactagtcagtgagattatcccctgatccctcatgtagtcattctttagctcattatacttagtaattttatttacagcctttagcaatacatgatatatgtatttacgggtgattttcagtcccctttacatagaaatttaagccccatgaggggaaaatcttgatcttgttcacagttacatcaccaatggctagaatggtgcctggaatttagtaggaaatcaataaatgtttttatttctaaaaagcagacaaatcaaaaatggatttaaactcttgcataggatgaaagctgtttctgctgctgaatttttttttcagtttctttatagctgtcacatatctactcctaaaattctcaaaaggagcactcttatgaacatataattcttagatttcttctatgggtatatcatgggtaaaatttaactatacattaagtaaaattcttttcagggcaatatttatttttgtgtgattatatagctctacatcttattttatctgacctcataagagcagtttcatagtttattcaggacttggatgaactggatctcatatacataagggaaatggtgatttcagtgagaattgtactccactgatgatgtgtcagacatctagaaaatagggttaaggttaatgtaacttcaatcacattttaccaaagttattttcttttgtcaatcactgaaattcaaaatatcttgctattataacattttaagatattgaaaagttaagaaccactgttttcatgagacatattgaagtgttttttttcaaaattgtgaacttttatgtctttaaaattggattattgtaatgtcacccttaaaaattcttaaagcagaccttatataacttttttctgtagtctgtactaagtatctttatataactttttctatagtctgtactaagtatcattgttttcagaatattctccttcaagctgttgtgtgtgccttggatggaataagggtttatcttctttccatgttctacctcttgcaaacagagcagctgttgtcctgtgtaaacatgccaaatttaaattttaaatagatggaggcagcacaagacctactgattcagaacccttgttccagagtcaagaattgtagacccacttagactctatatgctgatggccaaaaagaaattgaatgaaagtgttcattgtttagcatagccattttcagagtaggatcttccatgcagagagttttagattgtacttatagtgatagctaataataaaattattttgaaatggcaaatacttctcattcaaaatgatattgtaacgtattttatttaaatagtttaaagaggaaatatttgatgtgaagacttttcaggaaatgaaataatgtcatcaacattattatgagacaaattacataaagacgtttgagagtctaacaagttgtagaacaggagtgagttttgaaaataagtttgctgaattgataatgttcatgccaaactcaatatatgtgcaattaaaaagtcataattttaaacctgagcaggccaataacaagtaaggaaattgaattagtaataaaaaatctcccatcaaagcaaagcagacatgatggctttatttttaagttctaccaaacatttatgccagtccttctcaaatggttccaaaataaagaaaagaaggaaatacttccaagctcattttacaaggccagcattaccctaatactaaagtcaggccgggacaccacaagaaaagaaaattacatgccaatatctctgataaaatagatgcaagtattctcaacaatatactaggtaactgaattcaatagcatatcaaaaaggatgattcaccatgatgaagtggaatttatccatgagatgcaaagatggttcaacatacacaaatcaataaatgtaatctaccccattaacagaatgaaggatgaaaatcatatgatcctttcaacagatgcagaaaaagcatttgaaaaaaagtcaacatcctttcatgatcaaaactctctgcaaattagatatagtgttccatatctacacacacagtgttccatatctacaacacaataaaggctatatgagaccatcccacagttaacataatactcagtggtgaaaagctgagagttttccctctaagattagagaaacaagacaagaatgcctactcttgtcacttctgttcaacatagtacttgacatcgtaaccagagcagttatataagaaaaagaaataaaagacatccaaatcagaagcaagtaaaattgtctctttcggcaaaggacatgctctcatacagagaaaattctaaagatttcaccaaaaacctgttggaactaataagcaaattcagtaggatgctggatgcaaaataagcatacaaagttagttctgttttttaaactttaaattttagatttggtgatacatatgaaggtttgtttcataggtaaacacgtgtcatgatagtttgttataaatataatttcatcactcaggtattaagcccagtacccagtagttatcttttctgctcctttccctactcccagcctcccccattaatagaccccagtgtctgttgttttctactctgtgtttataagttcttatcatttagctcccacttatgagtaagaagatgaggtatttggttttctgttcctgcattagtttgctaaggataattgtctccagcttcatccatgttactgcaaaagacagacataatctcgttcttttttttatgaagacatagtattccatggtgtatataggccacatttttttaatccgatctgtcattgatgggcatttaggttgattccatgtctttggtattgtgaatagtgccacaatgaacatacccgtacatgtgtcatcatagtagaatgatttatattcctctgggtatacacccagtaatgggattgctaggtcaaatggcagttctgctgttagctctttgaggaattaccatactgctttccacaatggttgaactaatttacactcccaccaacagtgtataagggttccttttctctgcaaccttgttggaatctgttctttcttgactttttcataattagcccttctaactggtgtgagatggtgtcttattgtggttttgatttgcatttctctaatcagtgctactgagcttttttttaatgttgttggccacatgtgtgccttctttagagaagtgtttgttcattttcccactttttaatgctattgtttctctcttgttaatttgtttaggttccttatcaatgctggatattagaccttcttcagaagcatagtttgcaaatattttctcccattctgttgtctgtttatgctgctgatagttttgtttgctgtgcagaagatcccacttgtcaatttttgctttttttgtgattatttttggtatgtttatcataaaatccttgcctgttcctgtgtccaggatggtattgctgtggttgtctttcagggtttttatcatcttgggttttaaatttaagtctttaatgcaccttgagttgtgtgtgtgtgtgtgtgtgtgtgtgtgtgtgtgtgtgtgtgtgtgtgtgtgtgatgtgaagaaggggtccagcttcaatcttctgcatatggctagccagttatctcagcaccatttattgaatagagagtcttttccccattgcttggttttgtcagctttgttgaagatcagatggttgccaatgtgcagccttatttctgggttctctgttctgctccactggtctatgtgtctggttttgtaccagtaccatgctgttttgtttactgtatccttgtagtgtagtttgaagtcaggtaacatgttgcctccagctttgttctttttgttcatgattgccttggctgttcaggctcttttatggttccatatgaaattaaaattattttttctagttttatgaagaatatcattgatagtttgataagaatagtattgaatctgtaaattgatttaggcagaaaagccattttaaagatattgattcttcctatttatgaccatgggattttttttccatttgtttgtatcttctctgatttctgtgagcagttttttattatttcattgtagagatctttcacctctttggttagctgtagtcctaggtgttttattctttttgtggcaattgtgaatgggattgcctttctgatatggctctcagtttggctgttattgaagtatcaaaatgctagtgaggctgtacattgattttgtatcctgcaaatttgctgaagttgtttatctgctggagcagctattgggctagggttttctagatatagaattatgttatctaaaacagagatagtttgacttcctgtcttcccatttggatgccctttattcctttttcttgcctgattgctctgtgtaggacttccaatactatgttgaataggagtggtgggagaaggcatgcttgtcttgtgcctgatttcaagggtaatgcttcttgcttttgcctgtccagtataatgctggctgtgggactgtcatagatagctcttattattttgagttatgttccttcaatacctagtttactgagagtttttgacatgaaggagtgttgaattttatcaaaggccttttctgtgtctattgagataatcatgtggtttttgtctttagttctgttgatgtgatgaatcacatttattgatttgcatatattgaaccaaccctgcattccagggatgaagccaacttgtgcatggtggattggctttttgatgtgctgctggatttgatttgcaagtattttgataaggattttgcattgatgttgatccaggatattggactaagttttctttctttgttttgtctctgccaggttttggtatcaagatgatgctggcctcatagaatgagttggggaggagcccctcctcctcaattttttggaatagtttctgtaggaatgacactacctcttctttgagcatctggtagaattcagctgttaatccatcaggtcctaggctttatttggctggtaggctgtttattactgattcaatttgggagctttttattgatctgttcagggaatcaatttcttcctgactcagtcttgagaggatgtatatgtccaggaatttatccatctcttctagattttctagtttgtgtgtgtagaggtgttcataatagtttctgatggttgtttttatttctgtggggtcagttgtaacattttctttatcatttctaattgtgtttatttggatcttctctctattcttctttattagtatagctagtaacctatctattttattaacttttcaaaaaaccaactcctgaattcattgatcttttgaatggtttttcatgtctttgtttccttcagttcagctctgatttttattatttctcatcttctgctagcattggggttgatttgttcttgcttctctacttctttcagttgtgaagttaggttgttcactgagatctttctaacttacttttgctgtggacatttagtgctatgaatttccctgccttagctgtgtcccagagattctggtatattgtatatttgttcccattattttcaaagaacttctttatatctgccttaatatcattagttacccaaaagtcattcaggagcatgttgtttaatttccatgtaatcacatggtattgagcaattttcattgtcttgacttctatttttattgcactatgatctgagagtatgtttggtgtgattacatttcttttacatttgttgaggattgttttatgttcaattatgtggttgattttaaagtatgtgccatgtggtgatgagaagaatgtatattttgttgttttaaggtggagagttatgtaaaggtctatccaatccatttggtccaatgttgaattcaggtcttgaatatgtttattaaattttctgcttcagttatctaatactgtcagtgaagtgctgaagtctcccactattattgtgtgggagtctgtttctctttgtagatctctaagaacttgctttatgaatctgggtgctcttgtgttgtgtgcatatatatttaatatagttaggtcttttgttgaattgaattctttgccattatgtaatgccctttgggttttttgatcttcgttggtttgaaatttgttttgtctgaaataaggattactacccctgttttttttctattttccattttctttattcctccatccctttgagcctctgactgttattacatgtgagatgggactcttgaagacagctacccactgagtcttgctttcatacacagcttgccactctgcattttaaatggggcatttagcccatttacactcaaggttagtattgatatgtatggatttcatcctatcattgtgatgttagctggttattatgttggcttgtttttgtggttgctttacagtgacactggtctctgtgtttaattgtgtttctgtattagctagtagaggtcttttctttctatatttagttctcctttcaagtctggtggtaatgaattccttcaagatttgcttatctgaaagggatattatttacctttcacttaggaagcttagtttggctgagtataaaatttttggttgaagattttcttctttaagaatgttgaatatgagtatcaatctcttctggcttgtagggttttagctgagaggttcgctgttagcctgctggaatttcttttgtaggtgacctgccctttctttctaagctgcctttaacattcttgctttcattgtgaccttagaaaatctgatgattatgtgtcttgggggtaatcttcttgtgtagaatcttgcagagattctctgtatttcctgaatttgactgttggcctctctaacaaggtttggatatttttcatggacgatatcctgaattatgttttccaagttgtttgctttctaccctttcctttctgggaagccagtgattcattgatttggcctcttcatataatctcatacttcttggaagttttgttcattcatttttatttttgtttatttttgtccgctgtcttatttcagaaaaccagtcttaaagttctgagattctttcctcagcttagtttattctgctgttaatacttgggattgcattgtgaaattcttgtatggtgttattcagctctgtcagacccattaagtcctttttatactggctatttcatcattcagctcctatattcttagttctgattcttattttccttagactgggtttagccatctcctgaatcttgatgatttttttttctatccatattatgaattctatttctatcatctcagccagttcagcctggttaaaaaatcttgttggagaaatggtgaggtcatttggaggacatgtgacaccctggccatttgagttacaggagttcttgcactggttctttctcatctctgcatgtggttgttcctttaactgcagtgtggattgagtggaatcaacagacttcttttctggatgttctcaccaggccaaggctttatgtagggcctttatttgaagctgtcttcttgtctctggtttcagaaggtggtacattagtgaggtatttttggtgttggatctttggagcatgatacagcagttggcacatgggcttattgttgagttggtagacccttgtttggttgtgtggctcccttgtgcttcctcacagttgcagccatgttccttctcattgctctgaaagtgtgggttcctctccccttgagtgctggctgtagattgcaacttgacactctgggctgcctggggcaatctcagtgtttttgttcctgccccaacttggaggtagaagaggaaaggatcttagtagtggttggagctgaggattgtttggttgtctcctgggggcttgtattaggctgttctcatgcttgtgtgaagaaataccagagactgagtactttatttaaaaaagtttaattgattcacaattccacatggctggggaggcctcaggaaacttaacaatcatggcagaaagcacctcttcccaaaatggcaggagagagaatgagtgccagcagggtaaatgccagatgcttataaaatcatcagatctcatgagaactcactcactttcatgagaacagcatgggggtaactgccatatcattcaattatctcccaccaggtcccccccaaaaaacatggggatcatgggaacaacagttcaagatgagatgttggctggaacacagccgaaccatatcattctgcccctgcctcctcccaaatatcatgtcctcacatttaaaagcataataatgcctttctaacagttccctgcagtcttagaacattccagaaattcaagtccaaagtctcatgggagacaaggaaagtcccttctgtctattagcctgtaaaatccaaagcaagttagttacttcctagatatgatgggggaaaaggcactgggtaaatacacccattccaaatgggagaaattggcctaaacaaagggactccaggccccatacaagtccaaaatccaatagggtagtcatcaaaccttaaagctgcaaaatgatctcctttgactccaagtctcacttccaggtcatgctgatgcaagaggtgggcttccaagaccttgagcagctctgcccctgtggcttttcagggtctagccccagttctggttgctttcatgggttggcatgagtgcctttggcttttccaggtacacagtggaagctgtcagtgggtctaccattctggggcctggaggatgtggccttcttctcatagcaccactaggcagtgccccagtggggactctatgtgggggctctaaccccacatttcacttctgcactgccctagcagaggttctccatgaaggctcctcccctgcagcaaatttctgcctggacatccaggtgtttttatacatcttttgaaatctaggtggaggttcccaaacctcagttcttgacttctatgtacctgcaggccaaacaacatgtgtaagccaccaaggcttggggcttgcaccctctgaagccacgacccaagctgtaccttggccccctttagccaaggctgaagctgaagcagctggtatgcagggcaccatgtctcaaggctgcatagaacagagtggctttgggcctggcccaggaaaccatttttccctcctaggcctttgggtctgtgatgggaggggctgccatgaaggtctctgacatgccctggagacattttccccattgtcttgctgattaacatttggctcctcattacttatgcaaatttctccaggggtattgaatttctcctcagaaaatgggtttttcttttctattgcatcatcaggctgcatattttccaaacttttatgcttcctcttgaacactttcctgcttagaaattccttccatcagatactctaaatcatctctctcaagttcaaagttccacagatctctagggcaggggcaaaattccaccagtctctttaataaagtgtagcaagagtgacctttactccagttcccaacaagtttctcatctccatctgagaccacctcagcctggacttcattgtccatatcaccatcagcattttggccaaagccattcaacaagtctctaggaagatccaaactttgccacattttctcgtcttctgagccctccaactttctaggacattccaaactttctcacattttcctatcttcttctgagctctccaaactgttccaacctctgcctattacctagttccaaagttgcttccacaatttttggtatcgttatagcagcaccccacactctgtggtagcaatttactctattagattgttctcaggctgctatcaagaaatatctgagactgggtaatttataaagaaaagagatttaattgacttacagttttacatggctggggaggccttgggaaacttacaatcatgtcagaaggcacctcttcacagggcagcaggagtgagaatgaatgccagcagggtaaatgccagacacttatagaaccataagatcttatgagaactcactatcatgagatcagcatgggggaaaactgcccctatgattcagttgcctcccactgggtccctatgacatgtggggataatggaaactattatagaattcaagatgggatttgagtggggacacagctaagctatatcaggggtccatcccacagagatgtaggccatcagttgctcagtgcaatcagcctaggatggagggtctgtgttgtgggcccaggccagaggttccttgtctggtgatgagcagtggtggggtgtgtatagactcgtggtgtgtgacccatgggatatggactggcctcctctccttgggtctactgcaacttgttggaggtatagatagacatttaggatcatttctccttcattagttcgagggtggcaagcgcagttctgcagcagaggcagtggcagagaggctttcaattgcccgttaaggctctgttcagggagttgccaagttgctactggctcgataactctggtggggtgactggggacacagagctggaggatctgcccagtgagaaaatacgggaatgggtacccatttaataatctggccacttttttgtaggactgttgcaatatacttgggccagctccagtctctagtcacttcaaattttcccatacctggtggtatcaccagagaaggctgtgaaacagtgaagatagcagcctgtccatctctctgggagcttcatcctagggaggtacaggcctgttgctgaccaaaagacacctgtaggaggtggctggctaccctggttggtaggtccagcccagtgaggaggaatgggatcagggacccacttaaaaaatcagtctggccactgccagactgattcagttcaattcctggttgcctcaaacacttcgatgaccaaaggctggaacagtgatgtcaggcaaacggcaaagacggtagcctggtgcttcctctgagattgctatcccagggagaattcaactctctttctgccagagaacacctgcaggtatagccagaggccccagttgggaggtcccacacagtgagaagtgggactggggacctggcttaaagaagcagtctgggctgggcatgatggcttatatctgtaatcccagcatcttgggaggccaaggtgggtggatagcttgagctcaggagttcaagaccagcctgggcaacatgtcaaaaccctgtctctactaaaaatctataaaaaaaaaaaaaaaagaagaagcctgtccatttcttggtagagcagctgtgctgtacttaggcatccctccacccctagtcagctgggactcttcaaagcctagaggctggatcagctaagtcactcaaacagcaaagatggtggcctgcccctccctctgggagctccatctcagggagaattcaaatctttgtctgctggaaaacatggaggtgagaggctggaggcccagtttgggaggtccttcccagtgaggtggaacgggattgagaaccctcttaaagtggcagtctgaccacattgtggtagagcagttgtgctgtgctggggggaacccctccaaccctggttggcttgtactccaaaacctgaaggctggattggctaaggcacccaaacagtaaggatggtgttccaccccctcccaacaggagctctttcttagggagatacaatgctgccattggtggctggctggaattctaagtcagtgggtcttatcttgtgagacaccaaggaagtaaatcctgcaggctgtcactgctcagccccctggattcaccctctttcctagtagtatacacaggggtgtaacctcctactttgctggaaagtccaaggacctaaggctccagggtctccacgcatgcctgagtggcttctctgccaagagtctgcatagctctgtcagattgaaggccctggtggagtgcagtgggttcacaaggagatctcctgacccaaggattgcaaagatccataggagaagtgtagttcccaattcacacattcactcagcacttcccagagttggggaggtttccctggcttcgtgatgctaccaggtggaccgttgccctgctttgcttttctttgttttccatggatcaagttgtttccttgattagtcccaatgcaagtacctggatgtttcagttgaaggtgttgtatttacttgccccttccattcctctttgtgagaaccatgcacactagctgcttctagttggccatcttgggcactccccacccagttctgtttttatacactaacaatgaactattcaaaaaagaaattaagaaagcaatcccacttaaaattgcatcaaaacgaataaaatactttagcataaatttaaccaaggaggtgaaagatctgcacattgaaaaccataaaacattgatgagagaaatcgaggacataaataaatggaacaatatctattgttccattgattggaataattaatattttttaaatattcctactacccaaagtgatctaccaaatctctatcaaaatttcaagagaaattttcacagacattgaaaaaaagcaattcaacaatttgcaaggaaacatataaggtactgaagaactaaaataattttgaggaaattactattattaaaaagtcaaaaaacagatgctactgaggttctggaaaaaaaaaaatgaatgcttatacatatattcagtgttggtggaaatttaaattggtttagccactgtggaaaacagtgtgtacatttctcaagaacttaaaacagaactaccatttgacccagcaatcccattactggatatgtatctaaaaagaaaatcattctaccaaaaaaacacatgcactcgtatgttaatcacagcactattcacaatagcaaagacatggaatctatctaggtgcccattaacactgaattggataaagaaaatttggtacatatacaccatggagtatacacagatgtaaaaaagaatgagattatgtcatttgcagcaacatggatgcagctggagtccattatcctaagcaaattattgcaggaatagaaaactaaatacctcatgttctcacttataagtaggagctaaacatcatgggcataaaaatgacaacaatagacattagggactaccagggacattagggagggaggaggggaaagagttttaaaacaaactgtttgttactatgctcattacgtggattatgggatcatttgaatcccaaaccttagcatcacacaatatacccatgtaacaaacctgcacatgtaccccgagaatctaaaataaaagttgaaatttataaaaagaatcttgaaaaagtagagcaaagctggaggcattgcactactgatttcaaattatattataatggtatagtaatcaagacagtattgtagggataaaaagaggtacataggtcaatgaaagagaatagaaatcccagaaataaactcatgtatatagggtcaactaatcttcaacaaagaaaaccaagaatacacaatgaggaaaggacaatctcttcaataaatactgttgggaaaactgaatatccatgtgcaagtaaaaagtgaaatgagatccatatccataccatatacaaagatcaatttaaaatggattaaagatttaaacataagacctaaaaccataaacctcctaaaagaaaacccaggagaaaaactcattgacattgatcatggcaatgtttcttggatatgacaccaaaaacacaggcaacaaaagcaaaatatgatcaagcagaatgtcatcaaactaaaatatctgcacaagaaagggagcaattaaaaaatgaaaagataacccattgaataagagaaaacatttgcaaatcatatatctaataagggagttcatacccaaaatgcatatagaactcaaataactcaatagcaagaaaacaaataatctggttaaaatgggtaaaggatatgaatagttatttccaaaagtgatctaccaaatatctatcaaaattccaaaagtatttttcacagaaaagaaaatcctaaaatatgtatggaattacaaaagatgaaaaatagctaaaataattttgaggaagtagaaccaagctggaggcttcaaaaggaggcatacaatttgtcaaaaagtgtatgaaaaaaatgttcaccatcactaataatcagggaattgcaaattaaaacaacagtaaaatacctcgaacattttagaatgactattataaaaaagacaaaatataaaaagggttggaaggggtgtagagaaaagggaacctttatatatggttcatgaaaatataaattggttcagccattatgaaaaaactgtacgaagcttcttcaaaaaattaaaaataaaactaccatataatgcagcaatcccacttctggatatatacccaaaggaaatgaaatcagtatgtcaaagagatatttacacttactcgttcattgcagcattattcacaatagacaagatatggaaataacctaaatgtccactgatggacgaatggatacagaaatgtgatctatctatctatcaatcatctatctatctgtcaattatctatgtctaaatcaatatctatataatataactttattcagcctttaaaaagaagggtattttgtcatttgtaacaatgtaggtttacctggagggcattatgctaagtgaagtaagacacagaagacaaatactacataatatcatctatatgtaaaatctaaaaaaagtccaactcataaaaacagagagtagaatgatggttaccagggacttgcatttcaggagcaggtaaaatgagatgttggttacaaggaccaaactttcagttatgagtaaattctggagacctaatgcataccctagtgactatgtttaataatgtatttttgaaatttgccaagatagtaggtcttagatacaggttgagtatcccttatccgaaatgtttgggaccagaagcattttagagttggagtttttcagattttggaatgtttgcatatacataatgatatattttatggatatgtcttgggaggtgactgaagtctaaacatgaaattcatttttgttttttatacactttatacacacaggctgaaggtaatttttaaaagtattttaaataattttgagatcggggtgaaatttttcacttgtaacaccacatcagtgctcaaaaagttttggattttgagcattttggattttaaatttttggattaggaatacttaacctatattttcagcacacaaaggtaactatgtgaggtgatggatataatcattgattgcattgtggcaatcatttcatagtgtgcatgtatatcaaaacatcacattgtatacctcatatatatttaatttttgttttcaattatatactacagtaaagctaaaaaagtcataattttgctgcatggagcaaaccttccaaataacattggtgcatagcttactgaacacactttaagagatttggaaaagtacgttaaaatgatctatagaaacctgatattaacacaggcctttatatcttttttttaaatgtggtttcctctgagattatctgcttagctcaaagttcagacagtttatgagcatctcacttgtgagactctggttattgtgtctatgctaagccacaagttagaccttggggggcacagaaaaagatatatgatacttgaaagtgctcagaagaagaaggggagagaagatcagtgtttccagagataccaggaaaactgccaggaagtctaaatcacactaaaattacatttcaaagagaactccttgcggattcaataacttttccaagaaagcagcaaaaaataaaataaaaaaaaataccttgcaattcacaattctttctagcatattatatttttatcaccaggaggaagcaaattaattacaatgaatagtattggattaatgaacatcataaaagatgccatatctaaccatgtttaaggaccttgaaagggtcttgtagaaacaccttcaatgtaatctgatgtaacactccgttaagcgatacttgagaatatttgaatattgcattttattcaaaatgctaagagtccctaagctcttgaactagcagattctgctgccttttatttcaggatatattggtttcaatcgttgtgtcataaaaattaaacttcaaatgacttaagcaataattagtattttatctcttattatgtgcatacatttttgctttttggtaaacaaattcatttgtctaagacaaaactatatgttgaaaattgtggatgattcttctgattaaaaaaaaaagttcttggacattttatgtcaatgtttaaaatgccacttacactaaagactgcaagttcagcaagtttgctagaagtttcctttaaaagattgaggctccccaattttgatgcaaatctaatgtgtgtgaagcacccacctgggctgctttgcatagccccatgggtcttgggagcattgggaactaatgcacacataaagcttatgctgcttgctttgccatggtaataaagttccttggtccctaccctggaatatcttgtcttctgtcaatatccataaaactatggtaggccaaaggtagtatatatgtatatgtgtatatagttcccaatttttcagtttgtaagcagggtattatctcaaaactgtcacagtttctaacatatactattcttttcaataagatttttgaaaaaaaatttaaaaccattttattatatataagaatactcagaatatatgtacttaataaatgtatcagattgctgggaaatgtgttaaaatgctgaatctatgtcacaatatagcagatttctgattcaaattttctgagggtaaaagtgttccattttagcaacaccttacataatacttagacctgttgaaatttgaaaccattcatctgaggaaattgatggctagaatgcttcttaggttataacataaatttaattttttaaaatgagtcaagtgaatgatagaatagcttttcttttctgagaaacactgcacgctgatggttaaaatgtgcttaatacactttggaatattatttctcccagttttggaaatattttttatttcttcatattttctgaggaatatctttttcccattgtattaacaatattgattattctgcagctggcagtagaatgtggttcaggtgtttgttattaggttgatatgcaaatgagttatgtttacagaagtacccactagtggtgatagaatatacatatatgtgtgtatgtctatttgtctattcatccatccatatctgcttgatttgaataatacacatcagagaaatcacaaatacctcatagttaaaatctgagttatgaagatatggctaaaatgtttcctgcagcccggttagctgccttaatacacaccatccttgcatcgtcctttattttcctgatcttttcttccttgcatcatcctttactattattattatattattattattattattgtttttaaacctttctttctgagcacatgaggatggatagctttctattagggttttggaatacatatttttgtttgtttatcatttatttcctttttaaaattttatttcacattcagggggtacatgtgcatgtttgttgtatggaccaattccataatggtggggataggactcctagtgtacccatcacccaaatagtgaacattgtacccaattggtcatttttcaatcccccctcccctcccactcagtacatattcgaaaagaagaatgactctctcccttagttaactcaccataggaaatggcatctatgtgatgaaaacattaccaatagcaaaatttaactgcaacattgtgaataaatgttaatttttatataaatgtttccatgagaaagggtctctcagagaataagctagaattgacaaagtggctgatggaaagaaagggtgagtaaaactattctgtggtataaggctagccattacatcaagagcaggtaaataatattcattttcctaaaccctaaatagccttactgaatgaaagaaaaatcaaaataccttttctgcaatgactaataccacatgtgcaaagatgaaggaatgtagcatgaataggggattaaccatggcaagtgaataccatggtcatgaaaagccgaactccaaaagcagtctttacttttcctttgtaaattataacacaaaataacaaattttaacacataataaatggcaagaataaatatctatgttcctgaaaagtcctcattttaatgaaggaatgaccctagctctaaagtagcgtgatgcattccaagcttcatgtgacacaatcatgagggataaatgtaataactttggccaaatttgctggatgtatttgcacattgggaataatggaaaaagcttcttattgcaggaagacagttaccagcttaaggatagaaatgatttactgccagttactgcagagcaagctgaagaaaaattcaataatattctttataatgcagcatattcaatctttcagaatttgacatagttgtactttattaatgacaaaatttaacatatccatggaaattttcttttggtgacatattagatatccttatttttgttatagacatcatgtccctgctcactatgttgacattcttctatacagtaaccatcagcctagtatttcctgtgtgccaggtattgtgctaagcacattccatacagtagctcatttgattctttaatctttcttttctaacaataatttttttttggcttacacttttatatatgtggaaatgggcctaaggaaagccagatgttggagtgtgatgagagatgatatggttagaaaattgacctgtaatatacccagactcattgtagaaactcagaattagtctgaaatgttttgcatcaattgatggtacctggtgaacaggcaggcatttagcctgatccttcaaaattgtgaattaagggaccattttaaaacccctgtgatgatggcaaagctgagattctaatgaagctgatattctagaccctcatttaggggacttggggtctgggaaatctgcaactctggtagaatacagtgttgtttctcactttaaacaattgcctccttgacaatttggctttcatgtccttgccattacagatgcttcatttttattttttcagatcttttcatcattcacataatcattcttttttgacaaccatacatcttcattttacagatgaggaaaataaagatcaaagatgttaaagaatttagccaaaattatataacctttaagtgactaagataggatacaaaccaaaaactatctgtctcggagcacaagttcttaactattatgcttcactacctaaaattatttttagctagaggcagaccttccacagataaggacttcaccaacagacctcctggacaattgtataaaaagaaaatagaaagttgctatttaaacacatctaaccacataattatatagaagttaattagtaagtagagagtaaaaggaaacataaaatggctagtccttctaatttttgttccttttaagtctatttcttcaccagcgatattagataagcaagcaccagttgctggcctcttctcatagcagtgttttatttcatatacacgtttttcttgctcagtgtttttggtatagcaaattttgccagaagggcagcattagttgatcaataggagcagattcaggttgttggggaaaaaaattgtagtcatgcttcaggtgcagcccaaaatcaataagaaagagtgcttcttaacagagtgaaatgaagaacaattacttactgcagctaaatgacatcctgtgtgggatcattgtctatactggaggctgataggcaccaaactgaggggctgcaggataagcagctgacagggttacaaatggagtattccaaatgatgatttaacctgaattgtgaattaaatctctagttatgtacactgtcagagtcaggaaaatgtttcattcttaagctcttgagtaaattcaaaaataagtattagcaggacttatagttttaatttactgcagagtttctcaacattagcactattgacatattggactggataaatctttgttgtgagggcctaccttatgcagagcagaatttctgacttccacctcctaaatactaatagtccacccccctcattaataacattaaaaaatgttccctaagaggcaactttgccctagttgagaaccactgatttaccgtattaattatttttacttgattcataacatgctcatacattatttctttcttgttacgattcttggatagatggaaataaatgtttatgtatatgcacctcaagggcaaaagtaagttttgtcatgaatagaatctaatttgaaagtaaacctcaaaatattcaggatctctttctacttgtattattgtatttgagtagatgtatttgtttcatttgaatactgcatggcagttattggaggtcttgctattttttgaaaatgattgctacatgtaggcaagaagaagtttgtgcagaaaccactttctataaggaacaggcagaagataactgtacctgacctaccattctggacattcaaatcttgtctgaactgttagttaagattctgtgagtccagacctctatataaaacaatttctgaaggaaatcttgtaatgcaggatttatacacaattaaaatgattttttgcctgattgaaatgacacttgaagtatacagtctttcacagctctatattaatcactctagctacccacatttgggatttactattgctcaaatttgtataataaactcaaggagatatgtcctttgatcgatgtgcatcatgtagtccgattatggaatgctacctcttttgtgtgtaggagtcagatttaactattatccactagggataggtcatattgactatctatttaggttggtgcaaaagtaattgtggttttttcattacttttcatggcaaaaatgcagttacttttgcaccaacctaatatctatcttttatctgtctatcaatcaatcaatctatcatctctgatgggattatttaccttagggaaacattcatcttacagtatactgcttgtcttaggaacatatgacatgcatgttataattcaagaattctgagcccaactgcaaaactattgagtcacttctatggtcccataaatatttatttcaactgatcataaggtaatttttacttatgagaaaattttagaactaatttcttagagctaaagatagcaaactgaatgctccagaatgactaatcccatactgtatatcgttgtatagtccacttaagcctaaactatatatgaaagccatgactaacatacagttggagccactgataaatttctcacttttattgaggaatttgtaaatatttggagtcaagtgtggctatgagaataaatcctttttaatgtactcttttgtaacacaatctctgattatatttattgtgttcttatatccctagcacacattttttctatttgaacatattcaaatagaaagtttttatatagcaactttaaatcaatttaataaaataatcagtatttctctataatatgctatgcaaaaaaaattgttcctaagtatgtattatctagaaatagcttcattcttttttaaattcttcttgtccagcatttataaattgcatctatctccttatggttctgtgtgaattatatctgagctgtcttcattcaagggttgtttccttccactcctgagtagatggtgctaattatgatatgttctgagttaaaacaaggtgtactactctaaggacacacgcagattttctatagagttccttgacatttgaaaataaaagtttaaagcatcttgattattgggatatgcaataattgacttctaagcttcttgcttgaatagactagtggagttttggtttttcatgatgtcttgccttcttcttgtgcattacactaagtagtacaaatattatgcatgtttttatataagaactatacaaagttttaaacaattattttgatagatcagatgtctcctgtgagatagaagagatggaaaaagtgtcatatgccctctgctttaaaggatggctgcaactttatacagctctttagattttagggatgaacttgaaaaggacatattgttggccagatgaagtgaggactaaggaggattctacaaaatgatgttttgaaacattctggatactagaatgctgtacagctttgtttgtttccttacaaaatgttcacagcatgctttgttagcaatctgcattcttttaaaattgtctgagatattatatagtaaattaaaattatttttaaaaagtaggtactgggaaagctggtgacctctttattcattttttgttcaacagatacaagttcaacaaataactactaaatgccagaaccagagctaccatgatctgctttcacctacgtagttgcatttgagggtctggaggcataattctctatcactcatccccatgcccagtcagtagattctcagttttcagagaaaaaataaatttcaagagaaaatatttgaggctctttggactagatgtattagattgtctatgaagaggcatggtttctcagactcatttggatggatacaggaaaatcattctcactgaggtagtataaattgtttttggaggcatttatttcatattggtgagaccctgagcataggatccagtaaaaaacaccctgatgctgtgcagtagatcacttttatatcaatagacttttctaaataaaaatatcctagggaaaatttagaaacagtattaacctcaaaatgtttcatcatttgttcatattttagggaaatactagtaaaagttttgttttacataaatcctgtgaaaaaaattaaatacattttgattggtcctaaagtatgttaattataaattcaacatgttaatatttttactatataaaattaaaattgatttgaagtctatatatttttcttcaggttttatttgtattttaactatataaacattgttattaaaaattattgttttgcatttttttcagagccttaaaaattttcttcttgcctattatgtgagacatctgaattactataatatggaactttaattataaccactgtttgtgacacatgtcttccttcattcttaacaagtgtatgcattctgaattgccttttattatgtatttttaccttgaactgattaattcccaattatgtaacctttctaaaatactgctttgtcatgtcacttacctcatcataaacctttaattgaccttcatttgatttaaaatttcactctttaaattagcagccaaaaacttaaacaatgtagacaacttacatacacaaaattttcttgatccatttatttctatgtaaacatcctacttcaccttagcaagtaagtttaatactagtagttctcagaataggtctcataaatatatacttactccttattcgtgatgcccaggatgcctttctgacttttcagtaatccaagatatagtcactctgaaggatttagttgagatagccccatatatgatccttctctcttttccccatttcactcaatcccttccttttttcactcatcttcaacaaatgtttgtcaaacacttactttatatcagaaactaaggtaaatgctgggagaaaaatttgacacaattcttgctttcacagagcacactgtctaaattagtgataggcattaaacaaataaatgcattatatgtatgtatatacatacatatgtataggacaattgctataaagagaatgtataggttgtgtttgcatttggaaggtttaaaatagtataatttgaattaaattctgggttgtgaaaaggcttaaaattttctagggactgagttacctgtcaggtaaaaatgaagggaagaacattccagatagaggctaaaagcgtaaaggacctaaaagacctaaggaaggagaaagtttttcatgtttaagaaactcaaagatggctaatgttgctagaaacccaatgattaaagaaaaaattgtcctaggaaggaattaaagagggagctagatcattcagagtgatgtaggccattacaagaatatttatcttcttgaaattcagtaggaaggtattgaaagaaaataagaaggtcaatggcatgattaaatttgcattaaaaaattatccctcttttgtggcatatgtgtgaaggcacaaaatagtggataaagtagtacaagataatggtgttgaactagagggatggaggtggagagtagtgggcagaatataaatagaatcgctgtcaactagtgatagagtgtagaggtagaaggagaatgcatcaactacaacttcagagtttctttgtggtctccactcatttatttgttcaacaaatgttactgaagtattaagatgaaaaccagacatgatgcaattattatgagtttagttagaaaaaaataagattgagataccagtaaaaaagtcatggaggtagatacacgaatgaaaattaaaagaagtttagattaaagcaaataagttaagagttgttcacatgaagttggtatgtttaaagttatgtgaatggatgagatttccttaggagagtgaaatgaatctggaccatgccatcaagacccaagcgtttagttggaaaagtgcccagcaaaggatattgagtagttgtgaccagagaaacaggagaggcaccaggagcgtgaaatgtcacaaataccaactgataatggaattcaaaatgaaagtgctgaactccattaaaatgcctcttaatgtgtaaagaaaatgtataaactgacaagtatccattttacttgacaacttagagattttcaagagcaaaagccaaattgcagtgggatgatgaacaaggtaggggtgatggtgagaaactgaagcaaccaaagaaggcaattcttttaaaagctctgtttcatgcttagaaattatgttgtaccacacatttttcactaaatctggtcatgacttaagatacgatattgttgttttagtggcttcattttgctcttttgatttttatttatagtagtctagttccttaagtaaaagtaagttcttgggggtaatattgcatacttagtttatttgaatcactcattgtatttatattttgtgggtattccataataatgaatagatatgaatgaatgaaataataaatagtgaagaaagaaccacagagaatgaaaaatattaataaacttagcatgggagatgcaatctcttttattaggactagttttagattttgacactcctcagatacctcttctctcacagttatttgtgggaaattgcccagtatactcaacataacacacaatctatagagttgatttcttagagaattcatttggtacctatgttagtatctgccaatttgtcttgatgttagagagataactaccacctctgtgaccatcatttggattcaccttagccttataattccaacatcaggacctttcaacatagtctctgttgaaaatacagaagacatcacctgtgtagacagggaagacttattccttctgcttttagaaaacttcaatctggggaatccagatctatcctaagccaatatcttattaccatgtctttccttttaactgcagcctattgtagcacagcatacctagcaaagatcagacatatatatgttgactttatcatcaaatgcttacttcttgatcttcatttctcagtaacacagcacaaaatatcttccacattctactctaagaatttttctatttatccatcctttttattccgtaaacgtaacagatataatttctgcatatccatcgttcatgagatttgccgaaatataacaaaatggctggcatgtacaattaaatattccagcaaaaatcttttggatgttgtttttcttacatcgaatgcagatcttgtgtctatgcatgaaaatgaaaggtgataggttctgtatggaaatattaaacactgctttagaaaatcttgaattggttgttgcctttaccattaacaatctttataatctaaggcaagtcacacagtctctctagtcagtttccttataaaatcaaggtattaaaatacattaactttaaagcctctcttgaatcttgaattaatattatatcaaaaaataaaaatatttatattttcagtgagcaagaagttaagatattaataaaatgaaaataattgacaataaaatgaaaataattgacaattattttagatctttgcaattgtaagcttcatctgactctcattatattttgtgctttgttgattttttttctatttaaaaatcaattttagatctttttaaggatgactaactttgaagctggtggcccatctgttttctctttgttagcagactttttgcgactactctgagtttgcaaagaaaatgatttgctttgataaagcagcttttcaaaaagaaaaaaaatagccttagatttttttttcactctatagtaagtgtttctaacactcataaactcatcctaagtaggaaaaaagtggttggctatttgaaaaattgctattattaaataagcctcttatctctaaggctcaactctttatacagcaaaagaatgtatttttgaaattctatgcttctttaaaaattggttctaacttgtatgtaatgatattctgaccataactttttgtactataattaattccctgctgtgtcttattccttatttatactatgtgaaagaatttcaaaaaattaggtggatattacttcaattcccagctattctgtatgtttatatttctatatatgttagcagtattcttttctatatatgttagcagtattcttttgatgttttaaattctttgaaggacgttcaagtagtattatgttcaccaaaccatcgtgcagaaaatgtaggttcttattatttgtcacatcattgccttgtgtatgtcccctgaatttccttaaatgacatttgttcaacccagaattgtgcatgttgctgaaggaaaacataacttatgtcaattattaaatcaattattagtaagagcctcagctttccatgtataaaaatgcctttgaagtaaggcatccaaaactaatctatcttaatgtacatttacaagaataaattgggatagtttgtatgaaagccatttataatattttacagtatatgacagatggaattctgaaattacttgtattgtttgtactatcctccaaaatttgctatgtatttagtaatatattgactttatcagtgggtcaagcttattcctaaaagtagtttgcattacattatactgatataaaacaacacattgatattatgaaattactgtatttttatttcacttccttgctcatattatctcttagattaggtaaatacgttacttttagaagtttccaaggagagcatacagagtaaaattacttgtaagatagaatcatttaagcaagaaatttagggctcacattatttaatcatgctaataaggactaaaaaaggatgaaaaataagtttgattcttaatttaatgatatacaatatatttgtttatgcatttattggactccagaatttctaccacataaagccacagcgattggctataaagtctatgaattattcacacgagacattatgtgaatctaaagatttttttaagattattaaatactattctcattcaagaagcattttattacataatatgtgctaggtgttgggcagcagggtgtctagacaagaggctcttttttttttttttatgttttgctatactaagccactacaattgttcacttttctgcattcctatgcaaatacagaaaattattctccactcctttccctctagcatataaatttaacttaaatctttaactcattcttttatttagaaatcacatatttctggaataccagttgtgcagaattatattttcatagatgtcttctgaattgagtccttaatcacactcctgttattgcttttataagcaataattgtctgaaattctcatttaaatcaccttttaactaaggagaattactgacacagagtgggtgatcacacatatacacacacacacactctctcacacatacattagtgttaaagacaacttactgttctacaagatttggttctgcctagagttcatttactctaattataaacagaacagtcaaaacatatgcctagtggcttctgggaaaactgttgtatgttttcacttgtcctttgaagagagagaggtgctgtgattttactctcttgggagctctgctggccttattagcattcaccttgcttatctcatgcatgtcttctaaccctgtttgtgtcctaaatgcccaccagtagaatttagtataccctaaagaatttagaagcgaggttgaaccagaagaagtagtttaactctggacaatgtgcaccattccacacctcttggtaatttgtgcaatctgaaaaaaaatcaggtcctgtctgccagaaccttttgatgtttcttttcggttattacatcaacttattacagggcttcctgcttgcaaagcagtaactacttctttacacagtctctctgtagtagagtgtttcctagacctttaacagaactctttatcactgaaaacagattccacgtctaaggctacaaacagacacagcaatggtgccaaaaccttttgaagagaacttctatttctcagtgatgacaggaaaagggcagcctgttatttttaaatttggtttgagtctacattggccctttaatgattgtacttgagaaagacgcacattttaggagtgcctgtttactttacatcaacacattgtgtcgtgatatatcaaaaggagcatttactttttaagtagtttttaaatgctttcattgtgtattactacgttggattgatttagtaaaggagatgatattttttaaaattaataattataagggcccagaagaatgcctggtatataataaggattatatgtgtttgcaaactaagtaacataaaaattaattataaaggcttaatttcactctcataatggctataaatgataaaaggatagaaatgtatgtataatggttttctttcttgatatgtatatcactgatcatttttatctgtttaatttaaggaagcattgtagtttagggcagtggttctcaactgggggcaattttgctgccatcccccaccccttggggacatttggcaatgtatggagacatttttagttgtcacaactgggtgacagagaggtaccctggcttctgtaggtacaggacaaggatgctactaacatcctgcaatgtacatgatggtcccaaaaacaaggcaataagtaatacatacttaaacatacagtacataaaatgaaaatgcttatttacatttaagatttatttataaatttcaatattttattcagtgagtaataatattcatacgtgcttttattcaaagcacttttcttacatgtaattatatttaccagtatagggacaatggcttcttgatatcacagcattgcatgtttctatgttgatgtatttgtaattaattaaattaatatatgtattatagagtgtattctgtcatttgttttgtttataatgcctcagcttatacattcatcatttattttctgaaataataaagtgatctactcaatcagtctccaagcaactagaccagtgtcaaatgggtcagtcagttgctgagtttttattctaaggaatatcttgctactactactaaattaccaaaattttttatttttataaattagataatattatgaccactgtcatttgtatttcagaagttaaaatatttacataaatagaagataaaggagttgagtgaaacatattttaatgcgagtatttttatagctctggattttacccaaagatgtatgtacccaccatttatgtttacacaatggggccgggcagcagttaaaaattgcagccatacaatatctccctttcaattcattttctacagtattgacaaaatacactgaaattgattttttttcatttgctttgatatctaatgctgtagatataatgtcatattgctttggtggttttgaaagatctgttaaataagccattttaataaggaaagtccagtagattattttccagactgtataaatattaatggagttctcagtaaatgccaggtactggtaggacatgtgtattcagcattgaacaagacaggcagagtccctacccttatgcaacttacattctatttgacctggtgtgttagtccactctcacattgctaatgaagacatacttgacttagaaaacttacttacaatcacggtggaaggggaagcaaatacgtccttcttcatatgatggcaggaagaattgctgagcaaaggggagaaacctcttataaaactatctgatctcgtgagaactcattcactgccatgagaatagcagcatgggggtaactgccagagtctctcccatgacatgtggggattacgggaactacaactcaagatgagatttggctggggacacagacaaaccatatcacctgggtactgtaatgggcagaggtaaatgtgtctattcttggaaataaaatatatggtattctcattgtgtatcttaacctgcaggtctcattaataggaaaccatgaacttattcagaagacacatttctcagtgtgaattatccatacaaaagttactacttagcttctactacaagaactgtaaccaagaataattctgattcactttaacataatttaatatttatctactctttcaattgaattcacattataatgttgatattttcattaatctttcaaatatttttaaattctgtttaacattagttatttttctaagtataataccagttttcctagatggctattgggggattgtttcaagtttctctattcctttaagaacaattcttgttgtaaagcaatattttttttttgttaagtggagaacatttgcaggaaaaatatattttaaagtcaatgaaaataatcatgtgcagagttcttatgtatgcaagcaattataacagaataattttgcctgataacattcatggcaactaccaataatttttacaaaacaaggaaaagaacttcagaaaaaataaaacattattaaacgttcattaatcagtgattgaagtatttctcccctcccccataaattctatcatcacatcatccagccttaacaaattttggctttgcacattggcatgattattgtatttctgtttttcaccaagagacaagtttttaatataatagaatccctaaatatcaggtttcattttacaatcaatgcttttaaccaggttgcagttgtaatgcagtttaaattgcccgtgcaatgtgtattgtatcatagcttcatatttgcctttctttaattgagttatatgcaatgttggtgctacatttgttactaaagaatgttttctaacagcttactgtacttgatgttataagaaaaataattttgtatacagaaagccaaggaaaaaaacagggtataattttaatattaatgaaataaatatttttaactgtcttgttttcaaccccgtgcttttttttttttttttttttttttttagtacagacagggtttcaccatgttggccaggatggtcttgatctcttgacctcgtgatccgcccacctcggcctcccaaagtgctgggattacaggcgtgagccacagcgcccagcccccatgcttttttcttaagtaaaaacccaatgctttataaaatctagagagggaatatacctatgtgtggatgacactgaatcattgagaaaaatgcaaaaggactgtctgtcaaatgccaaacaaggcaactgaacacaaaataaattgcaatgagaggctggtgtgacttactaatggatcacacaggctgaaataagtgaatgtggtttatttgttttaaatcagcatcaggtgttttgtttttcatttcttagtggtgtattaaataataatatgttttaaaattagtattttcttgcatttgatgaaatacaggctatatgctattgtaaagaaatgagaggaagacaattaaaaggtaacaatgaacttattataatgtgcacagtcgactgattaatcactagattttccatcctttcatcctcattaggaattctatggataggtaataagctagctgcatgacaactaaattgcgcagaatctgacataattacatgagtttcaggaggcttaattctgattttgagaaagatgtggctagacacatgcattaaaattaccttcagggatctcaaattcttcagaggtaataaacattggttaacatcataatatggaaattattttcctctgggccaaggcaaccaaatccatatatatatatatgtgtgtatatatgtatatgtatatgtgtatatatacatatatgtacacacatatatatacatatatatacacatatatatacacatatatatacacacatatatacatatatacacatatatacacatatatatacatatatacatatacacacatatatacatatatatacacacatatatacatatatatacatatatatatacccaaatcagatctatctatatctatctatcttagattcccatccttccgatccaaatgcatatgccaaaatgtattttaatattttgtgttaagaggatgtttcctatgtacttctaaacatattccaaaacatgtagcataaaataaacctagaattttagaattggaaagcaactgaatgattgttagagtttcttcaagatctaaattctattgtcttacattttattcatttcattcagtgagtggacttagaaactgaagcccagaataattaatttattcattccatgttacacagttcaatggtagcacaactagagtcttttggcttcaggttcagtgttctttctattagctcaaattgtcctataatatactaaagacacaatagggtaattagtgtagtgtatggtatgatatgcctcctacttttccctttctctgcctcaaacaaatacactttcaagactgaagtcttaatttttcctgttgctgagagtgttggcaactgatagctctcaagtaaatttctctccaataatttctctgcttaaaaaaaaaaagcaaaaccaaaaaaacctactcatccaatactatagcccttcccagggcctgccaatgtccaataactggatgatgggatataagactcccaccgacttgcctgaattggagaccactattaagaaccatcccaaattcagacctccctatgtgatcagtcgagatagtgtaattgcacagaatttaatttctcactctgcctgactctgctttcttcattctctatagttgttggcctaagaacactccccaatacatttcacaaacatctgtctcacagtctgtgttctgtggaaccaaactacaacaataaatataaaattacttgaattttctagagaaagtgactttctttttaaaatagagataaaagtgttccaagtgattaggttctaaaagatgaaataaatacctctcaaagtagtttcaaggtctgttagttacattatattgttactgtgatgatgatgattattgttgtgattaaggtaactacattccaggtaattaggcattttataatcaaggaggtcattaaatatttgtaataatcctttatgaagatatggatataaatataaaacttcatttctcagatgaggaaattggcagcttaggaagcttaggtaacttgccatgttcactaaactagaaagtgtctgacttgaagctgacttaaggtagcatttgggtcttatatgaacagccctatttcacatgatgtatgcagcaccttgtcctcagtgtggccaataaatatttatcacaagaataaatgaattcatatatatctgaccctacccatatgattaacccctgcacaatgcaatctcctatgtccactatgagctttggagataatagtaaatatcacagagaacttaaaaaaaaaaaaaaaaaaaaaaaaccaagggcaaaaaaactaacatgtcaaaaacaaactatgctaaataaacataaatggttgatttaaatgtgtattttcctttaaaaattgagagtaagaagccccatcttgcttcttttgatagtagatccacatgtgccttctaagtaccagatactgtaccagagaaggggtgctgaggctgcctgtgtgactgaattatttgatccttttcaatatgtctttttaaaactgtatattcaatttaatataatatgccaggagaattaaaatgatcacataaagaaaacaatgaatattccctcaaaggtaatattaaaatagtggaaatgaagtctactcctaccatttctactttcctaggcagcatctgttgaaatagaaatgaaaaagaaatgtaaccactggtgttatcattatggacttattaatgttgcattcatccccaattttttccacaatatttcataagcagcacccatgatatgtctaacatttggccacagatattgagcacaaggttgatttgggggttggttggtaacaattaaataaacatataagtttacagggatggaggaaaaagaaaagatcacatttctaataggtccatagcctagagtattgggaaagagccaagaagaagaaagtgagctagacaagttcccaaatgacgaaaatggaatcaaaatagtttattccttttactcctaaaaagtctgaggcatctcttgtgagtcttacaatgtttcctttctacaccaaattaccaacctacctatgtctactccaaatctaaggaaaagttaaaacagcatattagaattcacagaggggggtctgctgtaagtagcttatcacaaaaatataaataagtaaagatgacatcacaaacatcaagacaataaaaaggaaagatgacatcacagacatcaagacaataaaaaggaaaggcctgagtagcaaaatccttccctctgaaatcactgagtttaaggacgcctagtgggtctttgttttgtagaaaagaaaaggagggagacttatttcaataataatcattttgaggcatcagctcatattacaatgtttttctgcacgtaattaattttagaaaaatgtgatgaagttttgaaaaattcctatggaaatactcgaggaagaaggaactggtagataatcaagcagacggcctgtcctacactagcttaggataaaatcaaactctgtgctacaattttccagtctgtataacgggaataaaagaaactacctcaaaagactcttgtgaagagtgaatatatgagagcaatagcagagtgttggaaatacacacccaataaatattatgtattatctcaaactttattcagcaaatatttattaaatggttaatatgtgccaggcaattgtgtcaggaagaaagagtagaaatgaagagaaatggatgacttgagattatattttgtaaatagcaaggacctgattttaaggtgtatgaagaaaagagaaaagaataattttcaggtgttggcctgaatgtggtgccatttactgagaagggaaattcttggggaagaatgagtttcacagttgagaatcaagttttattttgtttggtttgatattatgccaaattagtaatattaatataagtaatattaatcaaacaaaaagtgatgatggctaaataagcaaatgagcctgcagctatctatagtgctcttctctcttctcccttgtctgtttctcttcatttttatcctctttctttgtagcaacaataaatccttcattttttgcatgcagaacaattaagccagccagtctcagtttttacctcaatgtgtttttctacacaaacatagtgctctcttcaggaggaatatgggtgctagcttgtaatctttgcttcttcacagcatgattcaatgagctatgccttgttattactagagtatacaattcttatgagcaagaagatggtatgtacttgtggacctgattttgattaataaattgcatccaaaagtctaaatgaaacatgtattgaaatttctaataagtggtctattggtcttcttagattcttgtagttacttgtgtgtttttagttcctttaatttcttgcttaccactttggtgatacaaatcatgatactgataattctataaactctctggacatatatttaagtaactatagcatattaagccaacaaaagctaatggcctcatatgtctatattcatcacttattaaaataatctgtattttcatactctggtatcgcttcaaatcatataaatcaccttttacttaataaaataatctgtattttctgtgaagctatataattcaaatttagtaaattagatgaacaaatataaaaatgccttttagagtaaattaaccatttaatcactatctgtaatagtattgcaccggaaaatttaatcccatggttaattgtattgataattttataaacctcattgaaaatttacgggttcagacacaaatgtataaatatcactctgtattgtatgtatgctatgaaagtgtttttttaagacatctttttctttctgtgtcttaccataggctacatatcgaaatcgaattgtgagccaaaatctcagcacaagggacagaaaagcaatacatactcccaccgaggaccgttttaggtattcggcagcggaccagacaagcccctacaaaaacaagacctgtcaactcccaagtctctgtttaagtaatttcctgaaggacaaggaactagcagaagttatcaaacattcaagaggaacttatgaaaccctcacttcagacgttacacagaacttacgggccaccgttgggcagagctctctgaagccaacagctaagacagaagggctctccacgttcttagagaaaccaaaggaccaagttgctacggcccgacagcattcgacctttacaggcaggtttggacagccacccagagggccaatctctttacacatgtacagcaggaagaatgtgtttctccaccacaatttacacagcactgagctgcaaactctaggccagcaggatgggtaattaaatcaccgtattcctgtctttgggtaggataaagatggttagtgtttctcgtgcatagttcatattaaaattgtcatgtactttttcttacattttagttataaacagagttgtgttgttgggttttttttcttagtcataaacaaagacttgtgggttttttttttccaagagtgaaagtttgagcatgttaattgaactaggttgcattgccttgaagactttactatataggtgtataataaatgggaccatcatgatcgtttatatagtccataatttatttattttttatctctatcacttactgatatgcattaaggtttcagaagataatatcaaatagcaatctgttcactgttaatggtgttactataaaagtagacctgatgaaaaatagataaaggaattataaagaattttaaattatataattaatagaaggaggaaaaaagagaaatgttaacgtcttatatttggtggtatatttatttgaagaatgtggcttgcttgcatgtaacctagagatgtgtttgtctctattacatacattcaagctcatcttgtgatactagtaagggggaaatggctgtattttttttcctttaaacgtttagttcatactagttcacaaaggatttcagacagagtaattgctagccaaatagagaatgacagctctgatctttgaaaaattttgcttttagtttttgttattgatgttgaagtaccgtgacataacacaaggtgataaagttggttgaattttgtcagatgatgcataaatactgacatgctatattctttgagccactgtcatggcaatataaacattttttcaaaatttcaaggatgaaacatcctaagaaaattattctttttctttactttccttattttttaaaatgttcttttttatgtaaatccaattttggtttatatacatcaacccatatctataattttatgaactgaagaacagaaagtcagtattttagtagccagcatacaatattctgactatgcagaaatctagatttggaacaaaagtaaagtaaatgtgaacattggcaatttaatcttagaaataagcttctaacaggaatatttaaaacccatttgatggcaaatatttctctttgacaaataaggcccaaatatgttataatatgttatatacttatgtgcactttagatcaatatatgaattgatctatggataattccatcatgttcaattagtagcagagcagaatcaaagagtacaattgaatacataaataaataatttttaaaagactaataggaatcaaggctgcagttttcttatacacatcagagctgttaagtacatccacattagccatagtccatgcaaattgaaactgtcatacctactgcatgatctgtttcccttgcattttctaacagaatctgtcagcgtgcacaagcaagatgaacaaagggaaattgagatagcagttttagcatggcatctgacaacttgcttaaattaaagctgtgtgcaaaatgcatctcctattataaaaatgtatttgtgccctgtgctttggggaaaagccattagacactccacccctgagctttaactactgaactttgatacatttgcaaacttagattggaactgataaagtaaggagtcgagtggatatgttgtacttgtaattttggttttccaaaggaacacacatgtgcatcaaggcagacatttgccaaatgttttctttctttgcgtgtttgtaattctgccaaaagagaacaatatacactgcaaattgcttgacttaatgagattgccatctaaagttcccaccatactttggaagctataatgatcatgcagatatacactttgggctgggcaatatttaagaaatgataggaaaatagaaaaatcatgattattaattgtggaattcagcttgatttgtcctaaatgttggtgtctgttgctagagtattttaaatctgtacataaataagcatgataaaataatcaaggattttttcccaggatatggaagaactatgtatcacaaataatgtttttgatttggacttttggagttgatagttttgttttcctggaagatagacttttgaattatactttataaaaataatctatttatagaagatctgtcatttaatagacattttaagagatgttttaaacgctagtattttcttgaaaaatcttttttaaagctgaatcattcaaaagaaaacctggattaaacagttcgattttaaaaggaagggtattttttggaaatatcatcttaaagctgttttgtatcagtattttcaacattgttataatattatttgtaatactaagtgtaactcaggcctggagaaggtgtaagcccactatgctaatgtacatcagtaactgtaaaacaggggttctttgtaagttcctcttgtgtatatatagtaacttataacaatggcatgtgggcattctttcagtgaattgctttctttgtactaaaatctctagttttctaagacagttccatgtataaaaatgatttatgcatttctccaaggcggtacatatccaaagacatgacaccagggggaaaaagtgcttgtttttctgatggaagcagtggtcttttcttttctttcctctttcttttgtgcatgtgtatgtgtagctaagcctaaataaccctgtaaaatttctgctgcaaattgtctcttctgaatttagaatgtgttttaaaggaacacttaggaagagaaataccttgaagaaaagctgtttccacctgaaataaactgttcccatttttataattattggaacatgaaactgtatttctatgaactcaatgatttttttccataaaattatatgctaagagagtcaccacaaaactatgaattctctcccgaattatttttgcttctttggagcaccatagtctttgttcaaatcacaacatgaaactgttgctgcaatgctaaagatgtgaatccaccactatcaatacggtcagggtaaaacctggagccacatgttattcaagttatttttgttatctaatgattgacatgaaaataaaatagtaagccaatattaatttgtaggcatagttgccccacttaaagtgtttacaaaga

SEQ ID NO: 976 - DNA, 546973 bp, Homo sapiens
gttaccatcgagaccggggctgtgtatgctcgaggtgcagggagctaatgtataaggagttaaatgaactcttgctgctgccaaatatgttgttatcactaactgcaccgctgctgtcattagtgctgctgccaacactgcaagccctgctgctgccagtgccaattctgctgatgccttgggctctccatgtcccagggtgattccatagacaagcagctgcttttagatttcacttgctcattacctgtagatcctttgccttaggactcaagcttaagcccatgaagcctgggatagaagacaattggaggtatgttttatcttctctagcatctgggacaactggccttgaaccaaacatgtgcacctcgtttttcttttcccttcttcctctgagatttcttttcccataggctcttatttcatgcaatgatccactagccctggaaacaggaacataaacactcgaaccctagaatgaacataatttagtcttaactacattagatattttagtttgaaagaaatcactcacatttcataatcctgaaacatataaatttatacttagttatctgtgcaaaaattgaatcatgataattattaaagaattactatgcaagtgtaaatagctttggtattaaccaagagtggtttcagtgtgcttttgtaaaaaaaaaaatactagagttcaaaaattcaggtctatatttgaagctctgtcaataattcatatacctcatatcaaaaagcttaccaagggacaagatgattttgttagtgggagtggtttactttttacttttgcttccaaccctaactcagaagaagggcaatagtctatcaaacctggaaaataagaaaacagcattcaaatttacaaagctctatttactaaaaacatgcaaaataagtaatttttttttgagagagtgtctcattgtgtctcccaggctggaatgcagtggcatgatcatggcttactgcagccttgacctcccaggctcaagacatcctcccaccttagtgcccccaagtagctgggacttcagatgcatgccacgatgcttggctaatttttaattttttgtagagatgttgctcacgctgctcttgaactcttgagctcaagcagtcctcccgctgtggcctcgcaaaatgttgggatgacagccgtaagccactgcgcctggctaaaataaagaatttttaactggaggaaaagaatcttatgttgttgaattctttattgtcttaactgaaagcaaaagcctgtttgaacttttttcttaatcgagaaaagcatatgaggagaaaagagctctaagttctatgccagatgcttacaaaacaaattgtttaccagtagtttagtgggacagggggtgggggtaaaagaaaaagttgtattaaaatcttgatgaagatattctgcatcaaggactattttatttttcttaagggcgaaacaatctgttttcttatttgaggccagtgaaagtttatatttctattccacctgggataataacaattgagagttttgtgttttattttccctaattgagaatatggggattggtaaataatatggtaagtaatttgcatttagaataaggtgaggttcttggttttccaaattattgatttgtggagtgaatttgcatctaggactctaattttttttttcagtaaatttcatgagaaatgttattgtttttaggaatgtaattttattaaaaaatttgcgggaattttgggatgtatttatatttaaagttatcataacatgttagatgttgtcatactgtgtgtgtatatgtgtatcctatatgtgtgtatgtgtgtatatttagcacgcatttttctttttatttgattaggttttcttaattttaaagttggaatgaaagaaaaatgtgttagtatatgattcataaaaaacaaaccagtgatggtactgtgtttaaacatctcaatatggatatgggttttgttatattttgcgagctacatgccagagtatattgtaaagaagtctatttataggtaaaataaagatgagaaagcagtgcagagagaaatcaaatataattgtcttacatttctgattctccttcatttttagtttttaatgggaatttctgtcttttatctgcatgaagatgctaatgttctcttaatgtacttaaaattgtagagtaagaatttcgaaatttgtaggaagacaaatggcatttataaatattagagtttatgagtacttaatatcccctctgtcatctgcatttaatgttttcgtttccttttaacagtatgtgtaagaactttctgtgctgtgcttagagtttttttcctagataaatgtttttcttatgctgtaaacctgtttaaggagatgagatttgaaagtagttgaattcagagctcttacttgagcagagtgtttctcaatagcttttccaagaaaattttaaaagattaaaatcaattttaatctttgtcgtataggccacagaaacttccattcatacatccttagaaaattaaaacaaggcaaaataacaatttgggaaataatcaattaaaaccataactatatgggaagtctttggaaatggaaggcccacaacctacctatatatgaagccagtgttgtctgaactgaattctaccgtagggtggactttttcttaacgtctgaatttatgaacctgtgaaagaggaacgttaaattgaaaataacgacaacatcttaattatggtgattttactgaaagactactaccataataagatgtattctaggtttccagagtagtggcagctgtcaaacaccaacatttctccctgagaataggtttagtgtagtgtgtttttcaaggacaagttgctcagtgagccctgctagttaatattcaacagttttcttaatcaaaattgtggtcttgctccctagagtgtttgtgaaaatgattgtatgtttatccgagccttcaacagcagaaagagaattcttgggctaggtgctggtaatgagaacctatattaatcccagggtgctgataagaaaaggaaaatcctgtcagaatacattgtttgtaaaaaaatgattactgtagctcaaaaagtcaaaccttttttttgaagcccttgtaccttatataacttcagttgtttatctgggataatggggaggtaggggtatggtgatgtccagcaatccactccaggaatggtattttagtgatcgagtagtctggggttctgttaatcattgcttctgttgcataccttattaagggtcctcacatgattcctttagattacaagaaggtcttaatgaagtaaagcttgtgaggtattagagagctcagtctggcattgtacaaatggtattgaagactcacataggaaaaacaagcttgccaaataaaataatgcaacagctaacattttctatgaaatattttgcttaggatgcaggttttgttagtgcttttgtttttaaccctaaactgttttctactgtcaggtgatactgcccttgaaacagagctgtcctggttgaatgtgacttttttctgccgtgggtacctatcacttccttctcacaccccctcaactcgtgcgcacatacacacacatacatctgaaagaatcaagatgaacagtttgaacaatatgatctctgtaatactataaagaacatttacttttggattttgttttgttttgtctgtaatggagctctataggaattaaatcttctgaaaacagtctttttaaaatattagcttggtggatttcttctagcattaatttttttttttttgagacagagtctcactttgttgcccaggctgcagtgcaatggcatgatctcggctcattgcaatctccatctcccaggttcaagcgattctccttcctcagccttctgagtagctgggattacaggcatctgccaccacacccagctaatttttgtatttttagtagagacggggttttaccatgttggccaggctggttccgaactcctgaccgcaggtgatccgcctgcctgggcctcccaaagtgttgggacaggtgtgagccaccgtgcccagccagaaagttttagtcaataacaaaaacacattttttgagtagttgtttaacatgattaaaagcacacttggactttaattaggaaacaataaacatacatcccataggagttaatctttgtaaacaacaccaattttgaaggctacagtcagttatattgatcacttcagtgatactgagacatatactgcactttatgcattgatctttgacatagaaagatcagcacgttaatgtaaaaaattgccactatgtatttgaaatttaagccctactattagctaatattcaaaataactcatttacttgatactgtaatgtgtagtcaactgatttttccttttaaatagattgatctgttatatatatattagaggcagagtctcactctgtcacttaggctggagagcagtggtacaattatggttcactgcagcttccaactcctgggcacaaacagtcctcctgccttagccaccactatgctcagctaattatttttaatttttttttgtaaatgtgggctcttgcattgttgctcagtctaatctcgaacgcctggtctcaagtgactcctgcttcagcctcccaaagtactgggattataggcacgatcctgcacctgccccaattctgtatttttatttgttcttagttgtagcttgtaattatttccaaatgtgaatcataatcagattgattcaataccaagttttagaagaattgtgtatcaactagtccactttgaagaggaaaaccacatagtaggttaaactagtgagtttaatttaaaaatattattaaagtatgacaaaagagtaacttctctctaagatatagagaaacctaagtggtaccctgaagctaaaggagtgtaaccaaagaatgacaaacttggaagaggatcagatcttaaagagaaggtgtaattcatctcactggagagcagagaagttttcgagtttggctgagcatccagagatggcccatagtcatggggcaagctggcggccagtagaatagtcggcatggataaccaaaccagtggctatgtttcagaggacatgagcaccctccagggaagagtatggggcctgtagtggactcagtaggactcaggaggactgccagaggggagggggcttcaggtagatggcccatagccctacagagggaattctgactctgatgggcatttctttctggagaaggccttgggaagattgtctctagcttgagactgcaagattggcaagcaaccacacgttcttataccctgcatggcttggcagggctacactgaatgtcctcacacctctacccaaatcactgactcctgtgtcaccagaagtcatggaagagccccttcctcctgcagtgtccctccagcttcctctactgggaacactcagcatcacacccattgtaaagaagaaatacttaaaagaattctatctatgatcataggacatatatttgtggaaaagtgcatttggagctgggaggcaattaattcataactagcacacattgccttacatttaggtgctggttatagctaatattgtggcaaaaatgacaactctaaatgccgtaagaatgtcatgttgctttcaggtgcccaattttagccccttggacttgtccatctggattagtcacattatcctagttttcagtagctgatcttaggcctgtgcttatttttcaccatatccttcaaagacaccacctatagctctctgcagtgggaatgaaagcctgtctacatataccactgtaaatatgctcaaattctttgagtgtttgagcagctttagtcaaaggaattcatggtgtatcaatagactctattctaattaaaaccatttaaatcacttttataagcaagtgaggaaactgtttagccccagagtgtgcactagtaatagcacatagttcatttcacaaagctaaagagcaatattgatgatagggcactaaggagcatgcgagtgcatagatcaatttgttactagtcagtcattgtttttctctgttattagtacaaccactattgtggtttaggtgagaaaatgttattagtgactgctttctggtgctttataggtgctatcatttactttcatgttcatatactgttgtaatcatgtatgaatgagttgccaactattatatattatgtatacgtaagagacaggtaaagaggtgcatgccggtatcaaatatgatatttacaaagatacatattaataattcctagataatggtggtttattatgaacgacagtaacagctagatggtaaatcattcacaatatttatgtctattgttgctttaacataggaattaccaatggcaatcacattttattttcctagcagccagaacacttttgttatacatcatttattctttcttaaaagaaaaaaaatcctttctagaaacactgttattcctttgacaatttgctttggatttgtaatctttccttagggtgttatttttttttctttagggaaaagaaggaaagggatacacgtggttaaaaaaatgccaacatgaataaatccaacagataaattgttagcaattacatttttaagagtgttgcaggagcattaacattgagaaactaatacttaagtacaaatggtttaattgtaatatggaaaataggtgatgctataaaaactattatgattcatatctataaaattagtaatggaatgattataggacaagaaatatgctttggtatgaaattgtattctaagaatcttctatcatcaaatctagttagttaaatctactaaccctgaatttaagatctgtgaatgaatttacctttatctaccatgaaaataacaaagcataggctgggcgcagtggctcccacctataatcccagcacttttggaagccgaggtgggcagatcacttgaggtcaggagttcaagaccagcctggccaacatggtgaaatccggtcttactaaaaataaaaaaaattagctgggcatggtggtgcatgcctgtaatcccagttacttgggaggttgaggcaggagaatcatctgagcatgggagacggagcttgcagtgagccgagattgtgccagtgcactctagcctgggctacagagcaagactccgtctcaaaaagaaaagaaaagaaaagaacaaagcataaatgtagtggacctaggagtactcttaggcactattcccaatgttaaggaacttaaaatctgtagcttttaaactgttgatattttttatactatagtacgaagaaatgtacaaaataattgagtcaaaagtatacaatttatttagaacaaaaaagcatatgaaaaggatgatgataataaatgagtgtattgaagagataataaaatgatggacaagaacatgaacctagtgaacaatgtagtaagctatcagttagcagataaccacaaaatgcatcatttccatggctctgtgaaaactaagcttacaaaaatgatttttcccctttggttataaggataacaattaattatagagcacgtttattgagtgtccactaggtatgtgactgatatgcacacaattagttgtttttactgatcgtttcactaagatacaaattattcaggacctgttgtaagttttaaatacaagttcaaacaccacaagggacttgcacaaggtcatacagccaaaagtaatgaacagagatacaaatcttagattgcacatcctcaaagcccaggccctttctactacatagtgtggcttctaaaaattaaaaatagtgaaactgcttggttcttgatgtgctggggacttgataatttcataaattccatgtggaatttaaagactgaatattcagctagttgatctctctctcttttctctctctctctttttttttttttttttttaaaataggatcttggtctcttgtccaggctgaagtgtagtggtgtggtcatagctcactgcagcttcaaactcctgggctgaagtaatccttctgcctcagcctcccaagcagctaggactacaagtgcacatcactatgccagtcctgtttttatttacttatttatttatttactatttttttgagatggagtctcgctctgttgcccaggctggaatgcagtgggacaatctagactcactgcaacctccgtctcccgggttcaagcaattctcctgcttcagcctcctgagtagctgggattacaggagcgtgccaccatgctcagctaatttttgtatttttagtagagatggggtttcaccatgttggtcaggctggtcttgaactcctgacctcatgattcacctgcctcagcctcccagagtgttgggattacaggtgtgagccactgctcccggccatgtttttattttttattttggggaggtggggggtcttgctttgttgcccaggctagtcttgaactcctggcctcaaacaatcctacagtctcaacctcccaaagcgctggggttacagacatgtgccaccatatcagccctcagctggtaatttccattacatatatagtcacttgactttcattatgtttttccctaaagtgcatacacaggtgaaaacgaaaatgtgacataaataagcagggtgaatatattataattttttaaaaaattattacttctcttacaagtgggaacctttttttttttcgctgttgtagcattcactggtattttcctgttaacctcttggtacacataacaaaaattaagtgtgtttatttcaacgttatgacttatttatagattcttattaaactttgcttcttaactagaatagaaatgaaaataattatcacaatagtgaataatcccttttgttttctgttatctcattataccaatgaatattttgagtattttgaggattatttatcatacttttccaattagaaaacgagtttcttaaagattgtattattttctcttaatgagagaggctgcacacagaggttatttaacagatattgtaggttaaacatctgactattgtgagtggagagaaaattatgagatagagttttgctaaatgtaacaagtaagatgcttaatggactcatggagtttctaaacttggcaagatgagtctgttttaataggcaaatttaccagtttagaataagaaatattacattctcatcagtaagtgccctgacaaatggtccagcattagaaacatttatcaattgttttaataaggaactgttgtgatattatcaggcagaggttaaatgctttgctagaaagacctatgtattagtctgttctcacaatgccataaaaaaatacctgagactgggtaatttataaaggaaagaggtttaattgactcacagctccacatggctggggaggcctcaggaaacttataattatggcagaaggggaaggggaagcaaggaccttcttcacgtggtggcaggagagagaagtgaggatgcaggaaaagctgccatttataaaaccatcagatctcatgagagttcactcactattatgagaacagcatggggaaaccgcccccataatccagtcacttcctaccaggtctctccttcaacacctggggattacaattcagaatgagatttgcgtggggacacaaagcctaaccatatcagtctaaaaatgtatatgtcataaaaattgcttagaaatatgtttagaggtatcatagacaggtgaatagaaaatgagctttagagtcacacgaccttggtttgaattccagctctgtcattagctctgtgaatttagccacagagtaatctcattaagatgtttcttcacttacaaaataaaaataatactatctcttcatgtaaggtttttatgaggattaactgtagtaatgaataaaaaagtaactggcatcaaaacgatgcacaacaaatgtagcttcttttaatttgaaatattaaagtgatatatttgatgctgattattgtatgtactggagattatatttttctgaatttttagaaagaaaaatcaagggaattttaaacatcatgaaaggcctacttgttcacacagtttttaaattgtgaatgacatttaaaaaataattttcattatgtttttaggctaaatatgtccaatgctttatagctcttgaaaaaatttagcctgatttttgttgctgttcttttgtggtgtaattagtgtcctcagctgaaacaaggtgctggtagctgaccccttctctaaggtcatggtaggatctttaggcttccttcttataagtcacagaggtcaggaaaaagacattattgttgggttggacttatcgcatgctcttataacagcccattgttagtgtagaattaactacagagtttttatttcttatgtcttgtaaaaatcagagcacttttgtaaaaatgacgattgaacatcaaggtaacctttatgttatatttccaaatgggtacatggatctatatatgaagaatttttagttgaaacagtttatagtgtttctgtttttggctctataactgacttccttcagaccaacttcatatactctctccttcaccttctggtgtttgtgaaacaaagggtgaaaaggacaagtgcagtgatgatttttagctcaaaatgttgggcttttctatctaatttagttgtccaagaacacattataaaatatttgcaaccacaaggaatctaatagcctaagaaaagtgaaaaaaaagcagccttttgtgtgtttgttttctccttagggaataactataaatggaaattagagataagatagttaatattgttctgtaaatattcagtcatcctgaaatagtcacgcctgtcataggagggagaattattatttactaggattacaagccagttgatcaactgacatcctgtggctaattgtggattggtatttcaaagataatgtagtctttattaagcatctgcaattttatagttacatttcacacattaccattttgatttttagcaacattttgtccttaaaaataatgtgtatgtgtgtgtgtgtattcctcattttacacatgaggtaattaaggttcagacaagtcaaacttttttcaaggtcgtacagttaaaaagtggcaaaatcaaatttcaaccctgtttggtttgattggtttgttaacatgtgcctttgtttctgtacttatcatttttagtgccttgctgactaaaatacaaagtttactcatttttatacaattcctcttatttttaggagatacaaataaaaacactgtagttaattctcaactaacaatggactactataagagcatgtagtaaacccagtccaacaagaatggcttttgtcggaactctttttctcctgttctcagtaaaaatttattgcttgaaatgtttattgagtctctgctggtgcttggtattctatttcactgctgggtacagcaatgaaaacagatggatgcaatccctgctttcataaagcatactttctaattcccaacatatgtacctatgataaagtttaatatataaattaggcccagtaagagattaacaataactaataataaaatagaacaattataacatctatgtaagaagttatgtgaatgtggtctatttctttctttcaaaatatcttattgtactgttgatcttagctaacctcactatagggtttttttttctttctttattaggttgagaactttcaccttttcacttaaaggaaacactttgcggcttctctttgacatatccaaatggccagcatcacgggggccattattaagtaaaaaaaaggttctttgaacacaagcacagttgatatgataacctactcagctacaaaatgactaaagggcaggtagcgcctacagcatgaatctgttggacaaagggatgattcacatgaggaacaaagcaggatactgtgagatttcatcatgctcctcagaatggcatataatttaaaactaatgaattgtttatttatggaatattcaagttaatatttttagattgccattggcagcgagtgactgaaactgtggaaagcaaaactgcagctccatcccatagcaaacattaggcataaaatctttatcaaattcttatctcgtacagagttgaggacaggtaaaagggaacttgtcgtagttgttgatacatcctggttgctatgtgaataataattcacaacaatatcggaataatatagatagaaaatataacaagaaaatatattgaagaaaacttgttgtgagaaatgcagtgaatattaaagtgactgacttttcacaccatcagattttattttaaagcataattttccatagaattaaactaatcagttaatgtaaacatgggatttttagtttgaaaactgagaaagtattacagatcatttaaaattagtactgctactttgaatttggaaaacatgtttctataccaagagagaatggaagcgaccatcttagtataatgtaaatccagactaaacgtataattaggaatatataataaattacgtatttatagggagatatctgggctattaaatgaattctacagttattttaatatatagtcagttttatatatattatatatgaattcctcctttgcacttcttttatttttagactagctggttcttatttatggttttttttgaaaaaagcatttttgatctgatctttagaatgaagcaatttcccaacctgtagtgaaagatattatttaccataaattttccagtattgccaatatatcttttttgggtcaaaaaatacgacagagacaaaatttaaaaattatttcagctgtctacattcattaaataaaatactggcaggagttgtatattatattagtttgaataagttgggcaaatatatttagctatttctttgattagatttataggtttcaaagttctatatatgcatgtgttgaaaataaaacacatggtaaattggtaaaggactttagaaacaagtacatataacactggcagaaggaccttgtctctcttgcataccattgttttcctagggcgtgtcacacaacaggtccttaataaatatgtattgaatgaatgtattaaattataaaagtaatgatgaaaagctggacataaaaaatttctgatgataacttcacatgcattagcaggttcttaatgtcacttgactgtattccttgcttctggcttcctaagtgggttttgctttgctggtcctgtactacagaccctgcctctgaatcatgacacattttgtcagtaatgtacacatcagtatgtagagagcttcaaaagcttgggcacttaacactaaccttctgctcaggtccttaggtaaatgttgggtatgcgccaccattaaataccctgtaactctccgatgctacttctctgctacatcttgtattctaccaaggtctagaggagggtggatttaaatgatcaattttcttagcattgactgatttatgtgtagaattttagatttttttttttttttgagacggtttctcactctgttgcccaggctggagtgcagtggtgtgatcaccgttcactgaagcctcgaccttctaggcttaagcgatcctcccacttcaccctttcaagtagctgggaccacaggtgcacgccatcacagtcagctaatttttgtgttttttttgtagagacagggtttcaccatgttgcccaggctgatctcaaactcctaatctcagacgatccgccttggcttcctagaagtgctgggattacatgcatgagccacaatgcctggccagaatttttaaaatcttaattatttttgttgagtcatagactgcagtagcaaatgtctagattataattacaggaaaataaaatcatttgtggcaaagacatggcatacttctttttaattcctcaaatagtactgtattccacagccctactcgtatataacccaccagacaagaaagctgatctgtgtaacaacttgaacttcttacttgccatgtttaaaaagggaagaccatcgactagagacaggggtggctacctttagagattactaattttgtcaatgcaaagcttgctaggataacagttgataatatcaaattgcttattaatagttttatcaggatgtaatttacatgttaaacaagtcaaccatttaaagtatacagttcaatgattttttagtatattcacagaattgtgcaactcagagtaaattttaaaccattttcattacccccaaaagaaatgcaattcttattagcaatcacccacaatattctccactctctcccagccctgagcaactactaatatattttctgtctctatagatttacttattctgaacacttcatataaatagaacatacaatatgtggtcttttgtgactggctcctttcacttagcataatgttttcaaggtgcatccatgttgtagcatgtatcagtactttattccttttattgctgaataatattccattgtatggatctaccacatgtatttttttattgatccattgatgaacatttgagttattttcactttttggttattatgaataatgctgctatgaacattcatgcgcaactgccaacatgtttttcaacacacttgcaccattttatatttccatcagcaatgcaggacgattccagtttctctaccatctggagaacacttattaatatcaatctccattattataaccatcctagtgggcataaagtggtgcctcattgtgggtttgatttgcatttccttaatggctaattatgttgagcatcttttcatgtccttggggtcatttatatatcttctttgcataaatatcgatttagattctttgccttttttaaaaaaattgggttgtatttttgagttgagaggtccttaaaatattatagataatttgttattagatctatggtttgcgaatattttcttccattctctgggcttttaccttcctgatggtatcttttgcagaacaaagttggtaattttgatgaagtctaatttatttatatgcttacttttgcttatacatttggcattgtatctaagaaggttttgtttaactcaaagttgttaagatttactcccattttcttctaagacttttatagctttagcacttacatttgggcttaagatctattttgattcactttttgtgtagagtgcaggaaaagaagttaaacttcattgttttgtccctgggtctgggaccatctgatgaaaagacaattctttcctccattgattttccctctcacccttgttaaaaatcacctgaccaaaaatataagggctatctgtactcttggttctgttccactgctttatatatctgtccttatgccagtatcacagtgtcatgattactgtagtttggtagtaagttttgaaattggaaactgtgtgttcactaactttgttccctttttcaaaattgttttggctattgtggcttcattttcatatgaaatttagcagcagcttatcaatttctgcaattttaaaaaggcagttgggattttgacaaggattgtgttgaatctgtatcagtttggggtgatttgtcatctttgtaataacacgtgttctaatcaatgaccatcaaatgtcttcaatttctttcaataatgttctgtcattttcagagtacaagtattgcactttttattaaacttattcctagagattttttcttgtgaatgctactgtaaatggaggactattttcttaactcatttttagattattttctactgtatagagatacaattgattttggtgtattcatcttgtatctgtcaaccttatcaaacttgtttattagttgcaatagtttatttttgtttgtgtatgtgtatgtgtgttccttaggaattattaaaaatataagatcataagatcattccctttgcaaatagaggtacatttatttctttttttctaatctggattcctttattttatttaagtgttataaatttttactttttgcctacttgtgctggctagaatgttcggtataataatgaataaatatgatgatattgaacagtcttatttttttctaattttagatgtgaaagcatttggatttttaccagtaggtataatgatagccagggatttttctacacatccttatcaggttgaggagatgttcttactagtttgctgagagtttttatcatgaaagttgtgttggaatttgtcccatgctgtttctgcatctataacagaaacatgtgctttttgttctttagtcgattgatatggtatattatattgattaatttttggacattaaaccagcattagatttctggaaaaattccacttcctcatggtgtatgacctttttattatgttgctggatgtttgctagtattttgttgaggattttatatataaaataataaaagacattgttcttttctttattataggtgtatttagagttttctatttactctgagtcaattttggtagtttacatctttttaggaatttctccatttcttctaagttatgatctgttggaatgcagttgttcatagtattccttttaattcttttatttctgtgaggtttgtagtgatcttttattatttcaaaaataatttgagtcttttctcatttttcttgcttgttctttttaaaggtttgattttgttgatttactgtattgtttttctatgttttatttcagccgtttgtgctgtaatctttattattttcttaattctgctggcttttaagtttcatttggtcttctttggtcagtgtcttaaggtgaaagataatgttattgatgtgagatgcttctttttaaatacaggttgagtatcccgtatctgaaatgcatggaattagaagtgctttggatttcagattttttttagaatttggaattcttgaattatacaggttgagcaacccaaatccaaaaatttgaaatccaaaagtgctccgatgagcatttcttttgagcatcatgtttttgcataaaaactttcagattctggagcatattgtattttcagatttgagatgctcaacctatatatgtttatggatagttatagctctaagcattgcttaagttgcatctcacaagttttattttcttcttcattaatctcaaagtatttccaatttctcttttgatttatttttcttttttaacacattggtaatataagaacgtgttttttactatttatatatttgtaaattttccaattttttattttaagatttttaatttttgtgggtacatatatttaagggatacatgaggtattttgacacaggcatgtaattcataataatcacatcatggaaaatggtacatctatcctctcaagcatttatcctttgtgttacaaaaatccacttatattattttagttatttttaaatgttcaattaaattattattgattatagtgcccctgttgtgttatcaaatactaggccaattttccaaattaaaaaaattaatttttaatgttattcctttgtggctggagaacatatttttgtattatttcattttttcaattgttcaatgtgtctatttctactaacttttaaattttcataatatattttgtctgatattaatatagccatttttgcattcctgtcatttttatttttatggtatagttttactttcttcgtttttgcatcttggaatctaaaatgtggctcctgtagaaggcatactttgaattttgttgtttttatttagtctgacaatctctttttgattggattatttaatacattcatgtttcatataattggtgatatggttggatttgtcatttaactttttgtttggtgtcattttttctccactacagcttttttcccagccaattcctttgtgctattataaatatgttacatttctatatgtcataggcccaacaatataattatgtacatattattgtaaaaaatagcttttaaaatcagttaagaaaaggaatggaaagaaatgtgcaattgtatgtcatactttctaatatgattacctttactgaaattttaatttttagtgggtttcaaattattgttgggtgtcacttgctttcagcttgaagaatttttttagtatttcttgagaagtagatgtgctagcaatgaattctgtttttgttaattaaagaatgtttttattcaacaacatttttgaaagattgtttcaatatgaaatacttgattgagatttttttcctttcaactttgaatatgtgatcccactgccttatattctacattatttttggtgaaaactcagctgttattgttattggggttccttaatatgtgacaaaccatttttctcttgatgctttcaagattttccttagtcttattgttgttgttcacttgtttatctgtttagtgactttgctcaacaactttggtgaagtccatttccccaatgggattcaatctctgatattgttcctaagaggcacaaccgtgggcatgcacacactctggtctttgttctccatcaacttctcaagagatgacagtggattttagttagtctctttttgattgtctctttctttcttctccctattaaatttctagctagtctgcatctactggtatcatatccatctgttagccttcactaattgctagctgattgctccattgtttttgacaatacctagtgcatagattgctctacagtctgatccaattaaatttaggcacctttgcagaggtattttttgaaatgagactttgagacttattcctaccctgggaatgctctttagttgtgtcttttcctggttttatctgttaaactctagcttgcttactgttatatttcttgctttcatgaagctatctgtctcctcttaaatttctcaccatcaaaatctttgttctttacaacagtgtcccaagacttgaacttcccatgccctgtcccaaataaagccagatcttttaggaagacctatagagcattagttccttctggcttgcctcgttctctgggcagtacccctgcaccagtgttccagagctggtggtcaggaagtcgctcacttctctaggaatgacagccttctctaatgagtagaatgcttggcaggggcagtagcctctgttcttgtcaacttgatattatcttgatgttgaacctccaccgtaaacttgctgaaacaaggacattcagggctcagtattatcagccagctatgcctgggggtagatcttccattctatgagtaaggctgagtagaggaaaggaacagggatcatttgactgttcttgcctgcagtggagcttcagcagcaatgggctgggcaggatgagaaaggctggtgatcagctcctcctgggaagaaactgtagccctaaacttgggtctaggaggagacagagccctgtgttcttgtctgtacatgccgatagtagagcttccataaagttgagctgggtaggagggaatgggccatggctcacatgccatagactgtcacttattgagatttatttgattttgctgaataaatgtttctccattttttgcatgtcattagggaaacttcctgataatttaagtggttactttatataatttttacctgttatggttgttcctcctgtagtgttcttagcatttactttcatttactaaaatatctgtatgttttttaaaagtatatgttgatatacatatcaacatatatatcaacacacacacacacacacacacacacacacacgcacactttatgaacatattgattctaccagcatttattctgcttctaccagtaatggtcttctttttaattaaaatggtagtgttttttaaagcataagtcaagcaaaatttagcgcttttcgtcagcaagtaacaattcttttattaaacactattttcaagtcctttttcaaataccatcagaatttccatttattaatttacaaagaaaattataaaaattacatagaactatttgaataagcataaccatatattttttttttctcagagtgatctacatgggaaccacattcacaagtagaaggttgcttggtgaccagggaatctgcgcaatcattaatctttgatgattggaatgattaatgatatcaagccattttgttttgcctgtccttttgcatcttcaccatctctgctctgcatttaataaatatgaatcattttatagaaatacagattgttataaattatggttattttaatcataaggatagtaattctcaaagcttagtttacagtttgacaatggtaaatgaaaaatttatatgttcacaaaaatattttgcaaacataggatttgtactttctaacaattttcagatatctgtttttaaaataagttttacaaaaactactgattacagaatagatatctagcctttaaatgcaacatattacatagaaattatagttgttgcaatcatccaaagaggtgtaaaaaaaacacagttaaagcaagagaagtctttatagaacagattgccagtagttagtgtacaagtatggtaacacttaatgtttattttcagtgtttgggacattattcactttacatgtataatgtcacccaattgtcacaataggtaggaacttgtcattcactttatagatgaggatactgaagctctagatgtttatgtaacttatctaagctagctagtgatggaactgtggcatttctagttaatgatagaactgtggcatttaccttgcagcctaactctagagttctcactcttactctgccacattgtatccagaagtatgccaaaatttttcttcatcttatataatttgttttcatatttttcacatatttgtaaagagcatgtttattgaccctgttccatgtccatctgaagttctctcttggttatttgagtaatggaggagccaattcctatagtctccattcatgctcaaaatcttcctgcagtctttgtgacctgactcattctttctattacaaaaatatgtaatataaacatgattaagatgaagaggatataatagccaaaatgtattgtgccaggcattgttctagtgtcttgtgtatgttatctcatttaatctatggtaaaattctctggggtgggcattattgacttagtgattaagaaacttcaaatcggagaaactaactgtgcttttggctacacagtttttaagtgttgattctgaattatgcctggtgattctgaagacattgccctttccctgtcatattctaaaatgtttactgagtgctgggtcttacatgccctgtgagtaggctgtcagcagaatacttctctagaggtagttatattaaaaatacattaaggttgagaaactcagaatcagaaagattcattataagatataagtttgcatagttcaccttgagattgctatggcaggttcataaatggattgacaaatgaaaagtgggtcactgatcattttatttactgtagttccccattatctgtggttttgctttccacgacttaagttatctgcagtcaaccatggtataaaaatagttgaatacagtaaaataagacattttgagagagagaaagagggagctcacatttatataacttttattacagtatattgctttgttttataattattattaatctcattgtttttcatttataaattaaattttaccatatatatgtatgtataagaaaatacatagtatttatgacattccgtactatctgtagtttcaggcatccactgcgggggggtcttcgaagatatgcctgatgggtaagagagggattgctatattcactgttatggaaaatagtggtggtcttaacagcagatataaaaattatttgcaaattaacagtatgttaacaaacaaaggaaaggagatggcataaaatatcagtgtcttatgttataaaatgaaatgttatatatatatatataggtatatgtctatataagcaatgcatcattgctattcattatcaaatactattcatcaaaaatgagtgcttatgattctaggacagggaccttgtatggttcttttgtttttatttataaaacatgacacataaagggcacttgataaatgtttaagggagcaaaaaatattttttggtgtatttaaaagtcaaatgagcaaagcagggatttatgctggtggaaaagagattaattatggtctaaatagcatagcatgctccttgtgttagtccagagagagagagtgccaataggatacagatagatagatagatagatagatagatagatacatagatacatagatacatagatacttagatagataaagaaggagagagatttaacataaacatgtaaatacttaagtaaatgtttatttattataaggaattggctcacacgattatggaggttggaaaattccaagatttgctgttggctgtctgatgacccaggagagtcaattacatagttccagtctgaatctgagtctgaagacaggagaattttgatattgtagctcccagacagtcaagtagaggagtgaattccccctgactcagccttttattctattcaggccatcaagggattggataagccccactcatattggagaaggcaatccgattgattcaggctactgatttcatatgctaatctcatccagaaacatcttcatagactcacagacataccctcaataatgtttaaccaaatacctgggcagtctgtggtccagtcaagttgacacataaaattaaccgccacactgttcagttttcctagctgttaactccaatcatttgaaaggaagcgatctcaaacttaaggttccagactctatagccagataataatttctggtttttataggctgatgactcccattctgtatttaagggctactggtatgacatcacagaaaaataattatttactcatttaaaaaaatatcggatgggcacggtggctcatgcctgtaatcccagcactttgggaggccgcggcaggtggatcatgaggtcaagagattgagatcatcttggccaacatggtaacaccccgtttctactaaacatacaaaattagctgggcgtggtggtgcacgcctgtaatcccagctactcgggagactgaggcaggagaatcacttgaacctgggaggcagaggttgcagtgagctgagatcacgccactgcattccagcctggcgaaaggtgagactccatctcaaaaacaaacaaacaaaaatatcaaagtgaaatatgtgtaagaaactcaaagaatattttaagagagtataataatgttaaaatacacaaagttccttatttatagtttcactttcaaagataaacagtcataatgatttgattttctagccatttttcaatacactatacaattaatagtacatatgtgttagttttattttttatttcaatagtttttggggtacaggtgttttttggctacatggatgagttctttagtggtgaattatgagattttaatgcactcctcacctaagcagtgtacactgtatcaaatatgtagtcttacacccctcactttctttgcaaccatgctgttttggtaactacagccttgtagtataatttgaagtctggcaatgtgatacctccagatttgttctttttgcttagtattgctttggttatgtgggctcttttttggttccatatgaattttaggattgttttttctagttctgtgaggaatgatggtggtattttgatgggaatagcattgaatctgcaggttgcttcaggcagtatggtcattttcacaatattgattcttcctatctatgagcatgggatgtgttttcatttgtgtcatctgtgatttctttcagtagtgttttgtagttttcctttatagttttcacctttttagttaagtatattcctaggtattttattgtttttgcagctattgcaaaagggattgcgttcttgatgtgattctcagcttgatcattgttggtgaatagcagtgctttgtatacattgattttgtaatgtgagactttactgaatttgtttatcagatctaggtgccttttggatgagtatttatggttttctaggtatatgatcatatcatcagtgaacagtgacagtttgacttctttttttttcccaatttgtatgtcctttatttctttctcttgcctaattgctctggctaagacttcctgtactatgttgaatagaaatggtgaaagtgggcatccttgtcttgctccagttctcaggggaaatgcttttagctaagatgttagctgtgggtttgtcatatatggcttttattactttgaggtaagtcccttctatgcctattttgttaagagtttttattatgaagggatgctggattttaccaagtgcttttcccttatctattgagatgatcatatggtttttgttttcaattctagctatgtgatatatcacatttattgacttgtgtatgttaaaccatccctgcatctctgtgactaaactcattttgtcatgatgtattatcattttgatcatccaccagctgttggatttggtgagctagtattttgttgatgatttttgcatctatgtttatcagtgatattggtctgtagttttctcttttttgttatgtcctttcctggttttgctattagggtggtactggcttcatcgaatgacttagggaagattctctctttatcttttggaataatttcagtaggattagtaccaattcttctttgaatgtctggtagaattcaattgtacatccatctggtcctgtacttcttttcactggcaattttttaaaattattgattcagtctcaccacttggtattggtctgttcagtgttcctgtttcttcctgatttaatctaagagggttgtatatttctaagaatttatccatttcctctgggttttctagtttgtgcatgtaaaggtgttcatagtagacttcagtgaacttttgtatttttgtggtattggttataaaatcgttgactttctgccttgatgatctgtctagtgttctgtggagtattgaagtcttccactattattgtgctgctatctcatttctttggtccagcagtaattgttttataaatctgggagctccagtgttagttgcatataggtttaggattgtaatgtcttcttgttggactgctacttttatgatgatataatattgttctttgtcttttttttactagtgttgccttaaagtctgttttgtctgacataagaatagctactcctacttcttctggttttcatttacatggaatatctttttctatccctttgaccttgagtttatgtgaatgcttatgtgtaagatgagtctgttgaagacagtagatattgtttggtggttttctaattttttatttgatttatttcttgatttattaagacagagtttcactcttgttgcccaggctggagtgcaatggcactattttggctcactgcaacctccgcctcctgggttcaagcaattttcctgcctcagcctcccgagtagctaggattacaggcgtgtgccagcacacctggctaatttttctatttttagtagaaacggaatttcaccatgttggccaggctggtcttgaactcctgacctcaagtgatctgcttgccttggcctcccaaagtactaggattagaggtgtgaggcaccacacctggctaggtgttggttttgttaaacccattcggccattctttaccttttaagtggagcatttaggccatttacattcaatgttattattgagatacgaagtactgttatattcatcatattcatcatattagttgttacctagatacactgttttttttttcactgtgttattgttttataggccctgtgagcttaatgctttcaggaggttctattttggtgcacattgagcttttggttcaagatttagaacttttagcatttttcgtagtgctggtttggtagtggcaaataccctcagcatttgtttgtctggaaaacactttatctcttcatcatttatgaagctaagtttcactggaaacaaaaatcttggctgacaattgttctgtttaaggaggctaaagataggaactcagttccttctagtttgtgaggtttctgctgagaagtcttctgttagtctgatagcttttcctctgtgggttacctgatgcttttgtctcacagctcttagaattctttccttcatgttgactttagatagcctgatgactatgtaccttggtgatgatctttttgcaatgaatttcccaggagttctttgtgcttcttgtatttggatatctaaatctctagcaaggtcaggaaagtttttctcaattattccctgaaatatcttttcaaacttttagtcttctcttcttcctcaggaacaccaattattcttaggtttggccatattacataatcccatatttcttggagactttgtgtatttcttttgattctttttgcttcatctttgtctgattggttaatttgaaagctgtgtcttcaagctttgaaatgttttcttatacttattttattgttgaaactttctgttacattttgtatttccctaaatgtgtctttcatttctagaagttctgattggtttttctttaagatatctatctgtctggaaactttttcacttatatattgaattttttttaaatttatttttgttgattttcacctttctctggtatttccttgagtagcttaataataaaccttctgaatttttatttgctatttcaaatatttcatcttggtttggatccattgctagggagcttctgtgattttttggggatattaaagaaccctgttttgtcatattacaaatccctgtcttaggtagagtattgctttaaattgtttttaaatttatatttgatttcttttaaatttctttttatcctcttgaggatgtggctttaatgtttatagtttattatagcctcatttgattcttggtgcttttagggctgaagactgtatgagttcgtttgttacagagtctttgtgtgctggctttcttagctgctcattgtattagttatgtacttgatgtgtgggcaagttcactgtctcctatggggttggaaaagcaaggatctcttgaagcttatttcattgccccatcgtatgcatttttaaaattttaattagttttttcctgttattttatttactgagttaatggttcaagttttaggccaatagaggatgtatctccgggtaggaatcagttgttgctaaagccagtgggtagatgcaatacccaatggtgggcagggatcccagccttgatgaaggtggctgggagagctctccattagatgcactgaagttttagcagggggaagggtgggagctaccttaactcccctgccaggccagtaggaaatctgtctacctcccagcctcactcctgcccctgtgttctggctgttcagatcagacaggtacctctttttgtctgtaagaacattgatattccaagtagagaggaattatgactctgccactcatgcaatcctgaacctggggagtgctcctcctgtggggacataatcaccctgaaatgttccaggaaggctgtctatagatgtgtcctcgctgagttcctgtgggaggagtctcagttgtgtctgcagttgtggacaaggcagaaacaagggccccttctccaagacccttcatgtgctgcctgactgttggggtagaggtgcagactttctccactgagcccagtgctgcaatagcatctctgctatgagaaacttcccaccagcggaaagatctgggactcaagtcctgccatccggattcttttgtcccatggcatgttccctagaagtggcattctccctcttcccctagtagtaggagttcctgagagccagactacagtgattggtattgcctttctggggctagccacccagtggggctgccacactctggactcgtactggggatgtctgcaaagaatccggctatgtgaactgactttaagtctcccagcattgggaagcagcaccagctctgatggaggtggcaggggagtgatgtagaccctgtgagattccttggttgtagataggcttagtgtgctggctttttcaaatgctggttataatcatagtgaacttgtcatgtggacagactcaggacctctggttaaccagagtactgcaggcaaagttgatagccgaagtcacacagccattttctttttcctgggcacagagttattctacctagagatgctgtaatggcccgagttgattgacctccaacagaggtggcgcttgaaaaggggcatcagctggcacagaggcagtgggatttgagcttgccctaagtagtctggggtaagtattctggtttctcaggtgatgggtggagctataaagctcccaaaagtttatgtcctttgtgttaagctagtagggccagtggaggggcatggccaactgctactccataacccctttgtgaattcttctgtgcagcagactattatactcccctctggaacattaccccagtggcctgagagccaccgccaaccctcacaggggccatgacttgtccccatcaaggaaagtcagagcacagacccccctaactttgcccccacttggggaagcattttttaggcataaagctacaaaagaaagatatagcagttttcaagtcacacttgacttttagagcaccatagtaaagaggacctcttgttaaaatacaccgtgggcttgatgaatttccttatgagcataatctgtgatattccaaatgtgctctttattgctattcttgtcaatattctcttcttccacaattaactggtgttacagtcccaatttgtaaatggctttgagtgttttgagcagttttctaccctcactttcataaattgagtggaatcttgcactttttacatgttctgctttggaatttattgtattgtgtatacattgcatttttggttgtttatactgcaaacctgactcccaaagacattaacatgatatctatcgagtcagtctagtactaactggggtgaaaaatttcattggctattaactttataaaaagttagtttattacagaatattttcatattaggatcatttatgtcactgccccacctacaacacaaactaacaagagaagaactgacaagaacatccttcatattgtgttactttcctgtttactggaatgctttttgtaggttgtttttgtatatttctaaactttatttttctccttttggtgtcaatcagtaaatctgctctactattcagtgtctacatagctgtctaatacacttttttttttatcctggatggttgagtttgctggaatattttgagacaattaacatttataacattttaatccagctatctgagcatttaatattcctgtctggattattaaggttatcttgatgattatgaagtgattttatttttccagtcctctaagttgatatattaattctgaatttattcgtttataaaaagaagtcttaataagctccagattacattgtcccactaaacataacccattttccttttctgatattctttgactattttattttaaattgagggtataattttcttctgtcttcataaactatgtgaatatcttaaaaatgacatctagtaaagaatattcttgtatctcagatagcttatgtattatatataatctttaattttgcgagatacagacctttatagagtgtgttgaagggaagagtgtatgaactacttgcaatctcttccttgactattttttagttcttaaaataattatacctacctatattcctgaggcaatattttttattttactttttcttttgaatggaattcagtatgtatttttatggcaaaaatgtgctttcatagaaagtaactttcatatttagaataaaatatatttgtatgtatattatgtatttatataaatgtatatcaaaggtaaatgacagtaatgattcatcaggtattaaaaaagtaaagtaaaatttaaatgatcaaatttcactagtgtaatattaggactggttaatattttttcttgaacataatgatttagaaatgaaaatttgtgattattacttgattacattaaaatagtcttaaagatatttctgtccacattgccatgtttttaaaaatgccaatgaaataagctatcaaaaattataataaaatattctatactattaagttatatcaatttcccaattattacaaaataaaacgtattgttctgaatgtaacgaagaggagatatttcatacttaaattctgaatccagctgttttacactatgaaatattaattgcatgatcttaaggataagaacctcttttatagtacttctgtaagagaaataaattggtcataattgtatttcattttcttgattgaatagatacatagaataaaatgcactgcagtcttctgacaatcacatcctgagactctgcttaaatagctctattataatcttacagcatttttagtcatttaaatacaagtttagttctgttgtagccttcagatattttgcaccaagatatttaactttgtagccttcagatattttgcagcaagatgtttaactgggaaaacccttagttattcatattcagatttaaattatttcacttacaaccatagctaaatatttaaaactgcaatgtcccactaaaacatagctgttataaatattataattatcatcataatagaactgacaggaaccactatcatttatcttacatttcaatacttcaggttatatgattcagtatgaaagtattgagatagatttttaaattctaaaaccaactaacctacctttcctttcttctttggttccttctacccttcctaattttctctagagaactaaaatgaatgtcatgtggctaagaaaactcatgaaatgttttctctgtattgtatgtaaatcattgttactctccagtatgtatagtattttaatctatatagtccagagcatattaaaattgggaattttttttttttgtggagcaagatgaccaaatggaaacctccactgacttgtctacacaaaaaagcacctacatacgaactgaaaatcaggttaaccatcctagtacgtggttttaactttatattgctaaaagaggcactgaagatggtaggaaagaaagtcttgaattgctgatgccacccctcccccattctctgacagtagctgcacagcacaggagagagaatctgtgcttctgggggagggagagtgagcaatcaggattttgcactggaagaactcagctggtacccatggagggagcatttagactagccctagccagagagaaattgcccattcctggggttggaacttgagtttcgacaagcctcatcaccattggctaaactgtctggggtcctaaataaacttgaaaggctcactaggccacagggactacaaatcctaggcaagtcttagtactatgctgtgcttggagcaagtggacttgggggctataaggagaggcctcttctgcttgagaaaagcagagatataagaataaaggggactttgttttgcatcttaagtagcagctctgccactgtggggtagagcaccaagccaactcttggggtccccaattttaggctttggcttttggacagcatttctaggcctaccctgggccagaggggagcccagtgttagaaagggtagtcttaggcctggcagcatttgccacaagctgactgaagagtacttgggccttacttcagtgaacatcagtggtaccctggcagtacattccatgggcccttggtggtagtggacacagggagaatctcctgcttggggaaagaggaatgaagagggggaaagactttgtcatgtggcttgtattccagctcagccacagtagaacagagaactaggtagattcctaaggtttctgactataagcactggctcctggacagcatctctggacccacctggggcctggggaccttgcaacccttcagaaaagaacacaaatctggctgggttcgctacctgctgattgtagagccctggaccttgagcaaacatagagataggtagtggctatagcaggccttggaaaagacccagtgctattctggcttcgggtctgacccagcatagtcccagtgggggtgaccacaggggtgcttgtgtcaccccttccccagctgcaggcagctgagcacagagagaaggacttcatttgtttgggagaaagtaagaacaagagtctctccctggtcatccagataattcttccagatcttatcccaaactgtcaaggtggtacctctctaagtatgcaagaactacaacataactgggcttgggtaccccctaatgcagatatggcttcagtgaacaaaactttagaccatatgcccaattctcttctaacacctggaaaaccttcccaagaagggtaagtacaaacaagcacagattgcaagggaatagaaacaaataacctacaatggagttctagtacatctgtcagtagacgcttccaaggaaaccttacaggccaggagataggaatatggcatatttaaagtgatgaaggaaaaaaaccttttaccctagaatagtatattcagttaaaatattcctcaagcaaaaaggagaaataaagactttctcagacaaatagaagctgagagatttcattaataccagatctgttgtacaagaaatgctaaagggagttcttcagtctgaaagaaaataatgttaatgagcaataaggaatcatctgaaggttctcactggtagtaataaatatgcagaaaaacacagaatattataatgttgtaattgtggtgtgtaaagtactcatatcttaagtagaaagatgaaaagatgaaacaatcaaaaataataactacaacaatttcagacatggatagtataataaaatagaaacaatgataagttaaaaagtgggaatacgaagttaaagtgcagagtttatattagttttctttttgcttattagtttgtctatgcaatcactgttgtcatcagtttaaaataatgggttatactatattatttgcaagcctcatggtaatctcaaataaaaaaataaaacagatacacaaaaaataaaaaacaagaactcaaaacataccagcagagaaaatcaacttcactaaaagggagacagaaaggaagaaaagaaggaagtgggaccacacaaaacatcagaaaaataaataacaaaatggcaggagtaagtccttacttatcaatgagaacattgaatgtaaatggattacatgcaccaatcaaaaaacagagttggtcaatgaatgaaaaaacaagaccaaacgatctgttgcctacaagaaatgtacttcacctataaagacacacctagacagaaaataaaggaatgtaaaaagatactccatggaaatggaaacaaaaaaaaataagagtagctacacttacatcagacaaaatagatttctaaacaaagactacaaaaagaggcaaagagggacattatttaatgataaatgggtcaattcagcaagaggatataacaattataaatatacgtgcattcaacaccagagtacccagatatgtaaggcagatgttagagctaaagagagaggtagatcaatacaatagctggagacttcaacacccaactttcagcattggacagattatccagttggaaaactagcaaagaaacatttaatctgtatttagattgaatagacttaatagacttttacagaacatttcatgcaacagctgcagagtacatagtcttctccttagcacagggatcattctcaaggatagaccatatgttaggtcaaaaaacaagtcttaaaacatttaatataattgaaatcatatggattatcttctttgatcatgattgaataaaactagaaataaataacacaagaaattttgaaagatgtacaacacatggaacttaaatagtttgtttctgagtgactagtgggtcaatgaagagattaacaaggaaactgaaaaatttcttgaaacaattgataatgaaaacagcataccaaaatctataggctacagcaaaggtagtacaaaaaggaattttatagctataagtatctacatcaaaatagaagaaaaacttcaaataaacaacacaacagtgcatcttaaagaactggaaaagcaaaagaagtctgaacccaaaattagtagaagaaaagaaataatgaatattagagcagaaataaatgaaattgaagaaaacaatacaaaagatcaatgaaacaaaaagttggttttgtaaaaagattaaaaaaaaacctgacaaacctttagcctgactaagaaaacagaagaggaaatccaaataaaaccagagatgaaaaaggggacattacaattgataccgcaaaaattcaaaggatcattagaggttactttgaggaactatatgcttataaattggaaaactgagaagaaattgagaaatccctagacacatataacctaccaagattgacctgtgaagaaatctaaaatctgagcagaccagaaacaagtaatgagattgaagctctaatgaaagggatccagaaaagaaaagcccaagacccaatggattcactgctgaatttttccaaacctttaaagagctaataccagtcccactgcaactactccaaatattataggaagtgggaatacttccaaactcattctgtaaggccagcattacctcaataccaaaaccagataagcatcagaaaaggaaaactacaggtcaatatcattgataaacgttgattcggaaatactcaacaaatactagcaaactgaattcagcaacacattaaaaagatcattcataatgaccaactgggatttattccagggatgcaaggatgattcaacatatgcaaattagtcaatgtaataaattgacaagatgaaggacaaacaccatatgatcatttcaattgacactgaaaaatcatttgataaaataataaaactgtaaaaaatactggatatagaaggaacacacctcaacataataaaatccatatgtgatagacccagagctagtatcatacagactagggaaaaactgaaagactttcctctaagatctggaacatgacatggatgttcactttcaccactattattcaaaatagtactggaagttctagatagaggaatcagactactgtctgattgaaagaaataaagagcatttaaattggatcatactatccctgtttgcagatgatatgatcttatatttggaaaaacctaaagacttcaaaaatctatttgaactgataaacaacttctgtaaagttgtaggatacaaaatcaatatatacaattcagtagcatttctatgtgccaacagtgaacaatctgaaaaagaaatcaagaaagtaattgcatttataatagctacaaataaaattaaatacttaggaattaatgtagccaaagacatgaaagatctcttcaatggaaactataaaatattgatgaaagaattggataaggacacaagaaaatggaaagatattccatgttcatggattggaaaaataaattttgttaaaatgtccatggtacccacatcaatctacagatttaatacaattcctctcgaaatacctagacatttctctcagaaatagaaaaaaaatgctaaaatttatatggagccacaaaaggctctgaataggcaaagctctactgaacaaaaagaagaagactggaggaatcacattacctgacttcaaattattatacaaagctatggtaaacaaaactgcatggcactggtgcaaaaatcagacatatagatcaatggagcataattgagaaaccagaaataaatccatacatctatggtgagctcatttttgataaagctgtgaagaacatacactggggaaaggatagtcttttcaataaatggttctgggaagactggatgtccatatgcagaagaatgaaactagactgctatctcttaccatatacaaaaatcaaataaaagtgggttaaagacttaaatctgagatctcaaactgtgaaactactaaaataaaactttggggaaactcttcaggaaattgaactgggcaaagattttttgagtaatactccaccaagcacaggcaactaaagcaaaagtggacgaatgagatcacaacaagttaaaaagcatctgcacagcaaaggaaacaatcaacaatgtaaagagacaacccacagaatgggagaaaatatttgcaaactgtccatctgacaaggaattaataaccagattatatatgtattagtccattttcacactgctataaagatactacctgagactggacaatttatatatatatatatatatatatatatatatatatattttttttttttttttttttttttttttaaaaggaggtttaattgactcacagttctagatgactccggaggcttcaggaagcttacaatcatggcagaacggaagcaggcaccttttttacaaggcaggagagagtgtgagtgtgtgaggaaggaactgtcaaacacttataaaaccatcagatctcatgagaactcactgtcacgacaacagcgtgggggaaaccacccctgtgattcaatcacctcccaccaggtctctccctggacacatgaggattacaattcaagatgagatttggatggggacacagccaaaccgtatcaatataagtagcacaaacagttctgtaggaacaatctattaatctgatttttaaatggtcaaacggtctgaatagacatttgtcaagacatgcaaatggcaaacaggtatatgaaaggtgttcagtatcattaatcatcagagaaatacaaattaaaactgcaaagatatatcatctcatgccagttaaaatggcttttatccaaaaggcagacaataacaaatgcagacaaggatgtggagaaaaggaaactctcatgcgctgttggtgggaatgtaaattaatacaaccactattgagaacaatttggatgttcctcaaaaaactaaaaatagagctaccatatgacctaggtatcccactgctaggtatattattgaaataaaagaaatcaatatgttaaagagatatggacactcctatgtttattgcagcactcttcatgatagccaagatatggaagaaaccttcacatttatcaactgatgaatagataaagaaagtgtggtacatatacagcatggagtactattcagccataaaatggctcacgcctgtaatcccagcactttgggaggccaaggagggtggatcacctgaggtcaggagtttgagaccagcctggacaacatggtgaaacctcgtctctactaaaaatacaaaaattcgctgagcatggtggcatgcgcctgtaatcccagctactcgggaggctgaggcaggagaatcgcttgaacccaggaggcggagtttgcagtgagctgagattgtgccaatgcactccagcctgggtgacagagtgagactctatctcaaaaaaacaaacaaacaaacaaaaaaaaacagaactatgatatcctgtcgtgtgtagcaacatggatggaactggatgtcattctgttaagtgaaattagccaggcacagaaagacaaactttgcatgttctcacttatttgtgggagctaaagattaaaacgtttgtactcatggagatacagagtaaaatgatggttaccagaggctggggagggtagtagtgggggtggatgggaagatgggatagttaatgggtacagaaaagtagaatgaatgaatgagatctagtatttgacaggctaacagggtcattatattcaataacaatttaatcgcatgtttaaagataattgaaagaatataattgtttgtaacacaaaggatcagggcttgaggtgatagatacctcatttgccctgatgtaattattatacattgtatgcctgtatcagaatacctcatataacccatatatacctactatgtacccacaaaaataattttaaaaaactgaagttttaaatcagaaacattttcttttagagactttattttgtggatgttaatgaagttttgtggtgaactcactaaaaccaagttgtatagttaatataacatgcaaaatcacttactgtatggcagtatgtctcgaacatataaaactttgcctctttattgaaaaacacattctgaggtcaatctcaaaacctgtgaagaattctccctgcttcacaagccaaactagtagggatagtgatttcctcttctgcaccacaccagaacaacatgagtaagagttccaggcacttgaaaaacatagaagaaaggaagggaaagaagcacctgtgcattcttccattctttcaagtggttacgtcttgtcaactatgttgtgataagagcagagaagataattattcaagatatttgcaattattcaagataattttgcatatttgagtaatgcaaatttaaaaactttttaaaaatttaaaaacactaatgcaaatttaaaaacaaattttgcatatttgagtaatgcaaatttaaaaacatctgtaggtgcatactactcatgtatgtttgtgagacatgaattcagtgattccaagtcttcaacatcatttcatgtccaaactccctgtctgtcccatcctctgagatttgggtaaaaaagaatttgtcttggggtagagctttacccaaactttaagaaaggacattggttaagggcacaagaggcatctctttagtggtagattcatgtcatcaggtgtggaagtcatggtggaaaaaaaatagaaaactaccagggagttgtggaatactggactttggaaaaaatagctcattaaagacatactgaataacattttacatgctgtgtgtgtcttttcttatcactttgtcattttgtttgcttaaatacgtgttatctatcagctttgctgttaagaaaactatgtcatggaaaggtagttgaatatttagtttgttactattgttcagtggtcaagtgagaactccagtaaagtttttagaatttaaaactagaattgggtatgaataagaggagcaaaatatatacatataatgtttcttttaatattttagatatgtctacgagatccaaagtatattttttataccttactttattacaattacaaagtctgtatttttcttttgcaaaatttgcacttgaccatcttggtcccagaatatcatactttcagaattttctaatgttcttaatattatgctttatattatatcacacaattactgaataaattaggtgaattcaaattttaaatggatacattaaacatatcaaaaggaaaagatcaaattagaaatagttttagaatgaaagattgggcttacactgtcttgctgtaagataaatatttctgcatagcacatgtgaagtaattaagacacagcagaaatatcctaagcagtgtaaaagcactaaaaatgggaaattggtaatcactttctatgagcaaatgaaattacttacaataccaattcccttccattgtaatctctttctaactttatcgtacttggaaaattgctatggtgacaaagaagtttttattttccctgggtagatagaaattcattggaagactttataagtagccagaacatggtctcataatcagttagcagatttgtatcctcgactactacttgtattctgtaaataaacatcttttgactagcaagctggattaagaatgagttttcaaacatgcagtcacataagtgtgacttttaagtcaatgtgtcttttaagcaattataatttcacgtatcttatgattagtttcatatacataaggattcatagtagaggagaataataaatacaaatgtgaaaataaaaggggcatactgaagaggttaattttgttaaaatgtgataatcgtaagcctaatttataaaaaaatgttcagaatgtcatcaccttgctaatgaaataaaacttttggtgataacattttagcaaggctgactgtgtaatttacagtgtccagtgaaaaaagaaaacgtagtgccccttcgacaaaaattttaagttggtgacaacagagagtttaccaagaagaaggccctgtgtggttgcatagattgtatattcatgaagcagatcttgcttgttagtctaaatttgctattagaaaagttttgaatacagtagataaaatatctggggaatatgcttggttgtcactcaggagtgtttatacaagtgtgatcaaaattataagtaacatcaggaaattgattatacaagcatattcactatacaagtgatgtcaaaatgatctgtaaggttaacgaaattcagcaaaagtgttaatgaaatatcaatagacctttgtgaaatataaattaaaattagtaatctaaattttatatactgaaatgaagtgtgagatgtatgcctaatttacagagagcattaaaagtttgggagaagagtatgatctcccatgagtggtctttacaatgtcttaaacataaggctatatctttaataattctgttgccttctagcccacaacctgacatatcttgatatttgatgagtctcaatgagaaaaccattttgtgtgtgtgtctcctggaatctttattactctagcaggaaagacttgaacactgttttctttctttctttctttctttctttctttctttctttctttctttctttctttctttctttctttccttccttccttccttccttccttccttccttccttccttccttccttccttcctttctttctttttctttctttctttctttcttctttctttctttttttttttttttggaaacggagtctcactctgttgcccaggctggagtgcagtggcacgatctctgctcactgcaaccttcacctcctggattcaagcgattctcctgcttcagcctcctgagtagctgggattacaataagtgccaccatgcccagctaacttttgtatttttagtagagatggggtttcaccatgttggtcaggctggtctcgaaatcctggcctcagttgatccacctgccttgcccacccaaagtgctgggattataggcgtgagccactgtgcctggccttgagttttctaatgcataatgcactgaagagttctctttcataaattcagaactgaggaagaggagaaagaagacagaacaacagagctgttattgaaaaatagacgtcttggtttcttttaacagtgttttgtcattctccttgtggagatatttcacctccttggttagatgcatttctaggtatttaatgttttgttttttttgtatgtggctattgtaaatgagattgtgttcttgacttgactctcagctagaatgttattggtgtataggaatgctagtgttttttatacattggttttgcatcctgaaacattactgaagtcattttcagttctaggagatttttggcagagtctttagagttttctaggtatagaatcatattgtctgtgaagacagatagtttgacttatttggatgccttttttttttctcttgcctggctgctctcactgtgacttccagaactatgttaaatacgagtggttagagtgggcattcctgtctaggcaacacaaataaatggaaaccattccatgctcatggattgggagaattaatatagttaaaatggtcatactgcccagagcaatttatggacttaatgcatttccaaactaccaatgtcattttttaacagaagtagagaaaactattctgaaattcacatgaagttaaaagagagcctgaataggcaaagcaatcctaagcaaaaagaacaaagccagaggccacacattacctgtcttcaaactatactacaaggctatagtatagtttgtatagtatagtaaccaaaacagcatggtactagtacgaaaacagacacataggtcaatggaacaaaatagagaaggcagaaataaagccaaatatctacaaccatctgatcttaaacaaactcaacaaaaattaagcaatgaggaaaagacttcttattcaataaatggtgctgggataaagggctatccatatgcagaagaatgcaactggatccctacctatcaccatatatgaaagttaacacaagatggattaaagacttaaacataagccctcaaaataaaaaaaaatcctagaagaaagcctaggaagtgctcttctcaatatcagccttggcaataatttatgactaagtcctcaaaaggcaattgcaacaacagcaaaaaaattgacaagtgaggcctaattaaagtaaagagcttctgcacagcaagagaaactattaaaggagtaaacagacagcccatagagtgggagaaaatatttgcaaactctgcatttgacaaagatctaatatccagattctataaggaacttaattcagcaagcaaaattcaaaaacccccattaaaaagggggcaaagaacatgaaagacacttctcaagagaagacttacaatggacccacaagcttatgaaaaaatgctcatcatcatcaatcattagagaaatgcaaatcaaaatcacagtgagataccatctcacaccaatcagaatggcttctgttgaaaagtcaaaaaatggcagatgttgatgaagatgcagagaaaaggggacacatacactattggtgggaatgcaaattcgtccagccactgtggagagcaatttggagattactcaaagtactaagtgttgaactaccattcaacccagcaatcccattactgggtatatacttagagaaaaataaatcattctaccaaaatgacacaagtacccatatgttcacgcaatgctattcataatacaaaaaacatagaatcatccctggggcccatcaaaggtggattggataaagaaaatgtggtccatatacaccatggaatactatgcagccataaaaataatgaaatcagtcctttgcagcaacatgggtacagctgaaggccattatcctaagtgaactaacccagaaacagaaaaccaaatacttcatgttattacttaccggtgagagtttaacattgggcacacatggacataaagatgggaacaatagacattgaggaccactagaaaaaggggggatggaagggggcaagggctgaaaagtttcctcttgggtactatgctcactacctgggtcacaggttcattcatacctcaagcctcaacattacacattatttacctttggaacaaacctgcacatataccccctgattctaaaataaaagttgaaaaaaatggagttgataagatataggtcaaacaagtgaaagtttgctctctttcattggttgttggcaaaacattgtctaatcagggcatatttaatgaccctagggtttttccataagcgtaggtttatacctgggaaagtccaggttatggtggaaaatacatagcatataagctgccaatttttcctttattgcccatgttttacattatattctataatggcacttttttcctgctgaacttgaatagacatcataaatattttcagtacttcactctacgtagctccactaattaaagttggacttgagataaaatctgtttcctatattgggcatggtgtaatctagtaatttctggaatgtataaaacttaattaatatacagatatacggacacttgtattctgctggagtcttgcattctgaaattcttggaaaatagactgtatgcacatagttttatctgggtggtgttggaattaggggagataagaataagaatatggattataagccaatccactatatggatgtgtggaatttaaatctaagagcttataaaatttattatattctgaaagaggtagccacatagaaatgctgcagagtaagcaatagcagacttctaggaaggtgctggaattcccaagatgagataaagaattgggctaggaattgaatgaaagatttagtgtactacctctggtatttgcacaatgaagccaactcagataaactctttttctgcttctcgctgcactgttttccagcatttttttctcattgtgtgcaagtagctaggacatagcaggatataccagataaaagaaatggtctagtatccagagagccttacagtcatacctactgaccgacctcccatttccaatgattagaattgtaatccgtatgctgttataggataaaatgttttagcactaccctctagatgtgattttctatttgaactagctgtggcctgtattaatgtatggtatgaatgaaaattgtatattttgaaacacaagtagatggcttgtgaatgctagttaaatattaagagcatactgggggactaatctttgacattttctctgccaagacaacccaagcaaagaatatttaattctcatgctttataaaaatgataggagttaagggatctcgttttaagtaaatttatatcaaagaaggagataaatatccttcagaggcccatgttaataaaatatgaagttatgaggagtttgttgaatactataaagaaaaaacaaattccaacaagttggtaagaggcaaataacaaactaatgaatctgattaaagtcttttccatatctgatttcaagaacctatagactgaagtagtaaagtcactacagtattccaaatctggtagacaaactgtaatgatgaatttttgggcacccagaaaatatttccctgaacaaatcatgaagtcaccctatccctttctccctcccttccttcttctctcccttcctctctctcttcattcatttctcccttccctccctccttccatctcctgtttttttcttcttcttcttctttttaaatcacaaggactcactgaacccagagataagcattgtcacagctctggatagtaaggaggaaagggaattgcaggactgtgctgtttcatcttacatgacaaatggatccccaataaataggcctctattttaataattaaattgtatggtgtttgattgattgaactcagaaaagataaccaagaatgtggaaagtagaaatcaagagtctataaatcagatctaacgtaggtctttgattatacatgcatataaattctccaactctcctctttcagtgagagttgccagagtgtttccttgtcagtttaaaaaattagaataagaaagcccagaatgtgctgacacttgaggaggagaaggtctttaatctaaatattttatcacattggttaaagaaccattggaacacttccaataatagagtcgtatttcagcttagattattattttagtagttccattccttttgccttgtaaatcacgtggtcacattacacagcccaatgttaattcatatataaagttatttgaaattaaataggccaaaaacatttgaaatcatactgacattttcatacatccatactattttccaacttcaaaagtattttaaacacaatggtctcattttggttactagacaaatctagccttgttgtagtgtggatgttaagaatttcttagccataaaaaagaatgagataatgtcctttgcagcaatagggatggagctggaggccattatcctaagagaactaatgcaagaatagaaaactaaacgccacgtgatctcacttatatgtgggagctaaacactgagtacacatgcacacaaagaaagaaacaacagacattggggcctatttaaagatggagggtaggacagggtttttcgtagggacagggtttttccatgttgccaggaaaggcaaggattgaaaaactacctattgggaactatgcttattacctgggtgatgaaataatatgtacagcaaacccccatgacatgcagtttatctataaagtcaaggtgcacatgtacccctgaagctaaaataaaagttaaaaaaataattttttccatattttatatattctgtaaagagtgtggatttgagttatatagtttcccagcctgtccaggcccaggtgacgttctttgttcattgcttaataagaaaataaaggtgaaactattaccatatgtagtaaagtgattcataggaatgaattactgccattctcaagtctatttttatctgtattagctttttctttatggtgttggaaagtctgaaaaccgtaattagtaaccagtactttaaaaagatatctatagattttgtactcatttacatttgcaattactttattatcctggactttcagacttgaacatgagcaaaattgtgttaactaagacagcattagtttatttattcaatgaataaaaatccaacttgagtcaccatgggaatacccgtgattgacttgcctatttggctgcatttcactctcacacattgtgatgggataaaaacactatattttctaaactgaattttcaaaaaggcactaaggatgactgagcaaagcattctgttatcaatagcgctgtactcagataccagcatgtgaaatctacatttatgtctgcaattttggagaactaagaaccatatggtatcttggttttatacttcctgaatcagcttaattgcatctgcataccaattaaacttgaataaatatgtttgagtgctttttagttgttgatattttgttataaagcttttactccaatttgactaaaagcatttttaactgcacttggtttataaatgggttatcattttatattaatacacatcatataccatgttatttctttttatgataaaagcactgtttggcgtatccatatttcttagcaagtgttaagtaaaagtgatatagaaagtatctaatccatctgtgaatcaagttaaattatatatatttatgtatatatttatatatgtatacatatattattgttattgttgctgttaatttctataatgcaatctagaacatgaatgaacttttaacttgttgacactgtttctagagcattttgagtggttaaataaatgtaagtataaatatagaactaaacttgaggcttatatacattgaaataattgatgtttcagatgctgctcatctcatcttacccaaattactgtaccagcagactttggttacaaatcactgaatactattggttaaagaaagtcatatacatatacctgtcctcattaggttactatagaggctgcaatccttatgagctttttggttaagactctttaaaggagttgcatcatttatggaggacctttattggtcactgtatttcacaagagtcagattaaggtccattactctgttcaatctactcttagatccgtttgatgctgatgagagttttctatccagggtaaagggataggtgagtactaagtgatcaaagtcacatcaaagcatttggtataaggaaacaaaatgattgtgatactgcattaatggaaggttgctttctcatgctttgaaaataaacggctttgctttacctgaatatttatttccagtatatttcttccttgcaatctactacatgaaacagagggggaccgttatctagtgataacatgtttttctagttacattatatgttaagcaaactccttggttattcatatttctaatagaaacgctaatatttcatggtattttgtgatttaacaccatccccgatcccatgcaccattttgaatgattatgtggcattgtataccactaagtattctattaaatagaatttataatattcaagttaagtatattttattttttatttgtatttttattatacatgtttttaaattgttatggatacctaacagttgcacatatttatggggtacatgtgatattttgatacaagcatatagcatgcaatgatcaaatcaggataattggaaaaatatcaggataattaggatatccataatattaaagatctatcatttcatgttaagaacattacagttccactcttctagtaattttaaaatatacaataaaatgtttttaactgtagtcaccttattgtgctattgaacattagatcttattccttatatctaactgcatttttgtactcatcgagcaatccctctttatctctgcctccttatggttgaataatattccattgtgtatatggatcacattttctctatccattcatatgttgatggacacttaggttgattccatatcttggctcttgtgaatagggctgcagtaagcatggaaatgtatatctcttttcgttgtattgatttcctttcttttggatgtacacccagcagtgggattgctgggtcacatggtagctctttttttagttttttgagaaacctccataatattctccacagtagctatattaatttacattcccactgtgtataagggttcccctttctccacatcctcaccagcatcagttatttcctgtctttaggataaaaaccattttaactgggatgagatgatatctcattgtatttttgatttgcatttctcttattagtgatgttgagcaattttcatataccagtaggccattttaatgtctttttctgagaaatgtctgttcatttgctgatttttattgtattatttttcttattacatttttgctattgatttatttgagttccttatgtattctgattattagtcccttgtcatatgggtagtttgcaaatatattctcccactatgtgggttgtcccttcactttgttgattattttctttgctatgcacaagcaagcttttttagttgacgtgatatcttttgtacatttttgctttatttgccagtgcttttgtgatcttactcaagaaatatttgcccagacacatgtcctggattgtttccccaatgttttattttagtagttttatagtttcaggtattaggtttgtcttcagtctactttgaattgatttttttttttttttttgagacaggggcttgttctgtcacttaggctggagtacagtggtgcaatcatggctcactgcaacctcagcctcctgggcttaagccatcctcccatcttagcttctggagtagctgggaccacaggcatgtgccaccatgcctgcctaatttttgtatttttcatagagacagggtttttccatgttgccaggctggtcttgaactgctgagctcaagcaatctgcccaccttggcctcccaaaatgctgggattacaggcatgagccactgtgcctggccttgagttgatttttgtatatggagagagatatgggtctagttttattcttctgcatatggatatccagttttcccagcaccatttattgaagagacagactgtcctttccccaaggtatatccttggcaactttgtcaaaaatgagtttactctagatgtatggatttgtttctgggttctctattctgttcaattggtctacatgtttgtttttatgctagtatcatgctgttttgggggttattgtagctcttgtttcaaagttattaatttgaagtcaggtaatgcaattgctccagttttgttctctttgctcagaattgctttggctattctgggttgtttgtggttcaatataaattttaatttttttctatttttgtgaagaatgtcattggtgttttgatacagattgccttgaatctgtagaattcttcaagtaatatgggcattttaacaatattgattcttctaattcatgaacatggaatatctttccattttgtgcatatcttcttcaatttctttcatcaatgttttatagtttccattgtagatatctttcacttgtaaagtttacttgtaggtatttaattttacttctagttattgtaaatgggattactttcttagtttctttttcaaattgttcactgttggtgaatagaaatggtactgatttttgtatgttgtttttgtatcctgtaactttactgaatttgtctgtgagttataatagttttctggttaagtctttcagtttttctaaatataagatcatattatctgcaatcaaagataagttgacttcttcctttccaatatggttgccctttatttattcagcttgtctaattgctctggctagggtttccagtactatatttaataaaagtgatgaaagcatacatccttgtcttttctatattatagaggaagggcttttagttttttcccatttaatacatagctagttgtggatttgtcatatatggccttttatcatgttgaggtatgttcctttcacactgttgagagcttttatcatgaagggatgttgaattatattaaatgatttttttggcacttattgaaatgatcatgtgtttttgtccttcattctgttgatgtgatttattgcctttattgagttgagtatattgaagcatccttgcattcctgagatgaatcccacttgatcatgatgaatgatctatttaatgtgttctgaaattcagtttgccagtattttcttgaggatttctgtatctatgttcactagagatatcggcctgcatttttctttttttgtcatgtcattgtctggttttggtattggggtaatactggccccatggaatgagtttggaaatagcctctcctcctcaacttttttggaatagtttaaacagtttatatttgttcttctttaaatgtttggtagaagttagcagtaaagctatcaggtcctgggctttttttcattgggagacttcctagtactgtttctctttcactacctgttattgtatacattttagaaatattttgcaattttattgtttgtaaaagaaagtgaagcagactatgatttcacataaggtgacaatttcaataaagcagaagaacagtttagttcattaaaaattttatagaattatttggatagtttgtgccacttacacagtttattgatggggatgcttttttataaaaattatttttcataaaggttaatataacataaataaaaaaatgacttgactcacaacttaaaatgtgatttcttatgcaaagtgaaattttgaagctttaaataatttaattttactgaacatttgtaacagatacattttctcagtcttggacagggctagtgttggcttagaaaaattcatacacttaacattctatatttattttgcattttcctttatgcctaatgcagatctcccatgtagtagtagaattttaataaagtttgttaagtcattaacttataaacagattttacattctttggaaatatcactgttctttggaaacttcaccctgtggcctgtcttcatgacttgatttcttaaactgctacaaagaggtgttctttctctgtctgcatggcctcaagtgaattaatcattgcagaatggagagagacattttgaagaaaaataatgtagtgtgattagacacatttgcctcaggttgctgcagccagagtgtgttgtggtggtaatttactaaatggtaccctggtggtatgaatgagtttttaggttttatgactgctttacttttttccaagaagcgatttacacataggactttgctactgctcctaaaagaagcaatagaatcattgatctgaaattcaaaaaagcatcaccttgggttcttacattaataattaaaaaaaaaccctacaaaatagggtcagccaaaatcagaagcatttaatgctataaaattattatttagaagtaaaatgtataagttactttatagtgatatagtaaatattgctattttaaatagccaatgattgaaactacctacatgttttataataggagaaaccttaagtaatttgtggtaactccttttaagaaatcctatctgttaaaactttcatgaagagttgataatatgtatgaaattctttagcaggatacaacattgcataggcactttatctcggtgactcctcactgttctgcattatttccatgttacatgagtctcatcagagttttcacaaagccattcaagatgaggacatagttctgataagaacatgtttcattcaacataatgccatgtaaaggattcctgcatttaaaaataaactaacatagtagattcatgagattagacgttttccattttttatattcttcatgtcccccaaaatttccaactttgatattagaaatgaatttatttttaaagagtctattttaggaacattttgctttaaatatgaaaaagaaattacttacaagtaaatatttaatctaatttgaaactttatgtatttatgtttcatttttctattccatcctgacttttccattgtgattgtgattttgagtagtatttcttctcccagttaaaacaaatagcaaaacaacaaaccaacaactttaaacaaacaaaaaccaactgaacaacaacaaaaaaaaccctgggcatttttttattcttttctttctctcatccctctatcaataaacaattattactagtgttacccacaagattaccaagtttgttatcttgtttatctgtaccatgctatttaagcgagaatgtcgttatctctcctttggattattgcaatagaatcctaactgggtggctagttttggcaatcaatcctgtacaaagaggctatctctcttaatttagctccctacaaggatctggacctctaagttcctgacacttcatctcaaatagttattccctttactcacactgctacttggaatgatcaggcctgccccagggagtttgcacttgattctgcctctgctggaagtgttcttctcactcttcttcattcagctcaaatatcaccacctccatacttgtcttcttcattatttatctcattacagtaattatttttgtaagacatacatcactgttaaagatcatctaatatgcttatttgttttgtttatattctgtctccctcattggagtagatactcctccagaaaagggactagcccctctaattcccttctgaatcctctgtgcctggaggagaatatgtttcctgtttttgaattatttgagaattcacttagtattttgtgctagaagagtggtattcagactgtagtataataatcagggtgtaaaggacacccctgccctacataggcatggataccttttagataactaatttctcaattctcaatttttatttgtgattttccatacaaattacttgtttgagaagcttctgagttttgtcagtcatcttcctcatgtttctttcacaatctcccactttacaaaaaaacaagcaaatttatgaattcagattcacttgtgaatctgtttaggatgcattgttcagtttctaaaaacctctagtgtatcaaccaagggataaattactcagggagtcttttgagggcttcctaaataaatattggaaggtgcagtgccctgtttcctagaggcaatattctggtgagccattctcccctttccttcctcctctcctcctctctccctttggattccagaagtgagaaagtaagaatgttgctgtggggtattaacaggtttacttgatgctttcttctgaagaagaattttgactggatgatttgtttgacaaagaggattgctttgccaagtgcattgtgacacacatttgcatatatttttcttaaatcaaataagctaaatatgtggcttgacagtattgatgaaaatatattttaagcccacttagagcatataacagtcagaaaaatatgtccttttaccttataggaaatttgttaatggttaacttttaggtcttctagagattatgtagattttcaaagttattttagtaaaaagataatttgaaattattgtgctagacaatgtgagcaacatcaaattgttcaaaatatctctgtataaagtacacttgatatagaagaaagtgaaaaagagagttcatctttcacatggaatataagagaccactatctttcctcatttccagagtatctgtacactcctttaccctaataaattttacagggatagtatctctttattcaaatttgtacaatcttaatttgtagctcacatagatgcaaataagtttattaagaaaacacagttctgtagagggtgctgattcagtagtttttcacagtattcagtcaagaatttgatgtcttaaactcttgactaaattaaaaaggttaaaacactttacctaattttgtaataaaaataatgacatttatcctttgcttccctttatgttgagcagaggtctaagccctcaacttctttagtccttataatagttaaatttcttatggtaggtgctatgtatgactcaatttcacacattgtgaaattgaagctcaaagggagattaaaatactgtagattgcccaaagttagtgagagcagaaaccaaaatccaaacctagataatatgtctccagaattttttattaatacacattaggtatacatatttttagggtacatgtgatattggatatatttatataatcaaatctgggtaattggaatactcattatcttaaatatttatctttatttttaactcctggtacatttgaattattctcttctagctattttgaaatgtatattccattaccattaactgtagtctggaatgttaacccatatattatacaggaccaaaccagaatgctatactaagatgtgcagaagaaagttaaaataatgttttgagcaacattgaccctcatcagtaattattttttatattaccgaacatttatatatagtgtatactatatgctaggaaatatatacataggattccaatgccagtatgtggtttttctacaaacaaagcaaatagggtctcttttaggttttccttccagtttctgggtacccttatgtttgttgtatgatattctttctccactctgtctaagctaggatgtctgtttctttctttgaatattttattttgaatcacaaaatgttctcagatcctacataagtacttgtttagtattcaattctgaatatgcaactgttagcctgaggaaatctgtaggacggtacaactgtctctctctctctcgctcgcttgttttttgttgaaattgttgctagtggctgcatttttttcccttgtggaattaatattttctgtatttcctgtgaactatagtgattggaaagtcgcttaaaacttttcttgattacctaacagtggatctgtcattggaatactaatttggaatactaagccacttccaatgaaacattcctagagcagcaatagcattcagaatattattttgcaatattatatgatgttattgttactgttgtatatgtaatatcaggatatctttcttgtgcattcatcattgttataatttccgaatttgtctttagcatcagcaagatctagattaaaatttagatttgcctttacttttctgaacccaaatttatttatctgataggaataattatattccttaaaaataatttttatttcaaagtcataaaaaataaaacaatattcaattacaagagatatcaggtgcttacagagcaagagtgtttttacttgattgaaataaggacatatctctggcagtgagagtctctgcttttatttgattggattagatttaattctattatcaggaatactgtgttctataaatgttagtgcagctactatttgcatgtttctgagtgaagtacttaactagtttaggtttccatttattatcctcaaaaaacaagttcattttccaaatataaaattcaatacaatagttggtcgccaaggcagaactacctaaatgttccaagatgcaaaatccccacttagtggccactcaagtcggtcacatcacccttgctactgggcacagctgaaaaggcccttgtgccataaacacaagtccttttctcatgaatgctttcttacctattattctgtcaaattagcaatatattagtataaacccaatatagtttagtcattcctgatagtgatatttgatgcagtcccatagtctcaaagaagacaatttactgaatttattaacaaagtttaaagggttttcttaagaaaggaaagaaatgagctaaatttgttgtatctcctttattataatcttcattatgtaactccttttaaaaaaacttttaaagtcaaagaacaatataggcaatatgctttaatatatttagtaaagtctactttgaaataaaatttatgaatttaggtgaatttgttaattattggtataatatttaacattgccaccaatttaaaacttatttctccataacttgaaacaatttcaatctgacactctattagaatgttatattatgtaaatatgttaattatcagacatacttccttggttctaaaacctatatccctgttctaactcatgaattacaaaccaaaacattaagtaatagcagaaatgtaagaaaataggtatatgatttggttaagcccattgattacattagcaattaaagtaaaagaggaaggcaaacttgtcatcacatttctaattttatcatataccagacatactttgactgtctttactatcattttgctctttttttcctctctttttctgtaacacactacatttatgtgttagtggtaatggcttataacacattatttttcccttcatatctatggaatattgattctagtttgttgttaactttgaactagaaaaaatgatattcagatatatatgagtatatatgtgtgtatgtatatttgtatgtgtactaaatttcacagactgcatgcatatgttttaataaatcagaggggctcacataattcatctaatcagttgtctaatcttaataatagagaaacagaacccaagagaaattatatccacaaatatattgtgaaagtgttattaatgaatgtgatcattatatgttgagttcaaagacagctcttttaaaaaagccaaacccaagattctgtttttcacatgattgtaacagaattagtacacaatgccaatacatgactgaatggaaatcagcatattccttaacatgctgcagtcagcattatataggagacacctataacagcacttacttaaaaaaaaagctgcaattgtttgtggatatactcatattttttttttcctttcaccagaccaatgctgactttcagttctattgatctaacatttgtgtttgaactagaacatgcactgaaaatgttggattccatattactgcctatactgatttttattgtcaggtatctgtattactgactctacacacacagacacagaaataattataaatgtccaatgtagccaccttttaatttactatcctaacatgtattccgattagtactttaaaattctttttctcagactttggtattcatcctatgttgatataagatagttttttcattttcttctttacgttcgtatctgttactattagctgctgtatggagtatgtttaatacaataaaaaataaagtgatacctaaaatttataatcagaataaaatgttaccatctttatacatcttttacactaatatgttttctacaaagcagtacagttttattttagacatatgttcatgatgtttcaaaaacaacaagaaactatcagaaaaatgaaaaataaatttgaattgatatatatatgagtgtgaatccctttaaaaatatagatcctatacatatttataagagaaaaactttagaaactctgatttttattattctgttgtttcaagctttcaagttgaatcgagtttttctttgatctaaaaggcaatttatttttatcagatactaattgttttaaaaagatttaatttgttaatatactttaaggattttgtgatatttttaataattaaatgcccaataagagttagaataaaaaattaactttaccgtcaaaaaggaagatctcctgcaccctctgctgctatgtaaatgaaactgcaggttatttattataaacttatttttattttataaaataaaaaaagaaaataaaaaatttaagaagattttttaaagatcttttcaaagattttttaaatttaagaaaataaaaaatttaaagaaaataaaaaatttaaggcaaatccagtcattttaatatacagtaaacaaacgaaccattatagatgtctcaaaagaacatgcatctcagatatatagtttacttaaaaataagtaaaatataaactgacaaactagctttgaaaggaagaggtataatggcatcaatttgttattaatgagaaaaagtcataatgctacatacttctaaatcatcatattacttaaatttattaaccaacatacaaaaatctattgtggtttattgtttgtaatatggaaatattaaacattaaaaagattgtgaaaaacctggagtgaattatttgtgtcttatggctcactgccattttagatgaattattgtgttgttaaaataaattgactttttttctaagaggcaggaaatagcttgcaatagtgaaaccagatagaatccgagctgttacaaaagttgatcccaatttataaacagataccacttggattgaaaatctatataaagtataaattttactattaaaatgtagtttaataaaaaatagtcttgccgggcgcagtggctcatgcctgtaatcccagctcttagggaggcagaggcaggaggatagcttgagcctaggatttgagacctgcctgggcaatatagcgagaccccgttctccataaaaaggaaaaaaaatacaaagtctttatattattttaaggattcttagcacttccatatgttttatttatttaaatattttatattaaactataaaaattgaagcagttattaaaacactaggaattgatgtttgtattttgtcgaacttggtgaaattatttttagaaaaggcattttctgatatgtccaatctcctattccttcccagtggaaaccactgttaataatttttgtgtatcttccaagttgcttttaagacatttacatgcgtatttctatatccttccatattttgtagtttttaaataggctatatatctcatactcccttattttgatttttaaagtcttaaatataaaagtaattcatgaattcattctgattgttgaagcatcgtattacatataacaccatgtccccgttgacgacaacctcaattcaaaggccctctttaagggtaatcactgttaatgctttgaagtacatccttcaagatttttttcaggaagaaaaaaaatcatacacacatatgattctgcagagtatttaatattatacatactatttgataataaattttgaattgacataaaatgtattccgaatagtatatcacttaccaatttgattttattaacacaatgccttggaaatttttcctttgtttgttcatatctttgaccttatatgtttagctcttatatattatgctgtggaataaatagaccatttttagaattttaaaaattctcatattaatgaacatttatattattttatattttcactacaataagcctgagtatccctgtacatgcttctttgagcagatctgtgagtattattctagggtaaatgctgagaagtagaattattttttcattttatactttgataaataattttaatttttaaatgactttaacaatttggatttctttgtaaatgtctgtccatatatactactttttcaccaaacctgatattattaagttttaaaaagttataaatgaaaaatattgtatttatttctggttgataatggagttgaatatctgctcgtaatgttgattagtgatttatatttccttttctataaatttcctgttactattctttgctcccttttattctttgtgttttctgtttcttactggctcataggagttctttctatttccccgattactaatgagtttgagtattttaaatatatattcattggtgatttgtatttcttctttcaggaattacttgttcttattctttgctcacttatttttgattttagattctttttcttattgatttatagttctttatatattccagatattaattatctgactggcataggataccaaagaccagcccctgtcttaatgtatcaattagtgctccagagctttcccatgggatcagtctgaagctagtgtccagttttgaccacatcctggcttagcttcttatccacatatccccagtgtccccatcttattagactttctttctttaatcagcttctcatgtttgaacaagaattccttactcaggctctgcttctaggaaatctatcctggacctgtgatgacattttttttgaaatcagtgttttaaaatcaagccaattctccaatggaagatataattataaaaaaaaacaactgctctttactaataaacatatattttaagatgtgtgctatcctctttaaagttgtatttttgttatactgacattgccaccgctcaacaaatttatcaaattcagcttttggaaatcatgttcagactctgagacagtctttgaatgttcataatattgtcagttctttgctccctgactaaactattttgttgacagtgaacaattattcagtcatgtgcagtcaaagtgatcaatgtggtcaaatattttgaaattatttgtaacagacggttttaaaaatgagaagtgtctgttcatatcctttgcccactttttgatggggttgttttttttcttgtaaatttgtttgagttgtagattctggatattagccctttgccagatgagtaggatgcaaaaattttctcctattctgtaggttgccggttcactctgatggtggcttcttttgctgtgcagaagctctttagtttaattagaccccatttgtcaattttggcttttgttgccattgcttttggtgctttagacatgaagtccttgcccatgcctatgtcctgaatggtaatgcctaggttttcttctagggtttttatggttttaggtctaacgtttaagtctttaatccatcttggattaatttttgtataaggtgtaaggaaggcatccagtttcagctttctacatatggctacccagtttccccagcaccatttattaaatagggaatcatttccccattgcttgttttcctcagatttgtcaaagatcagatagttgtagatatgcggcattatttctgagggctctgttctgttccattgatctatatctgtgttttggtaccagtaccatgctgttttggttactgtagccttgtagtatagtttgaagtcaggtagcgtgatgcttccagctttgttcttttggcttaggattgacttggcaatgtgggctcttttttgtttccatatgaactttaaagtagttttttccaattctgtgaagaaagtcagtggtagcttgatggggatggcattggatctataaattaccttgggcagtatggccattttcacaatattgattcttcctacccatgagcatggaatgttcttccatttgtttgtatcctcttttatttcattgagaagtagtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttatatcctgagactttgctgaagttgcttatcagcttaaggagattttgggctgagacagtggggttttctagatatataatcatgtcatctgcaaacagggacagtttgacttcctcttttcctaattgaatgccctttatttccttctcctgcctgattgccctggccagaacttccaacactatgttgaataggagtcgtgagagagggcatccctgtcttgtgccagttttcaaagggaatgcttccagtttttgcccattcagtatgatattggctgtgggtttgtcatagatagctcttattattttgagatacatcccatcaacacctaatttattgagagtttttagcatgaagggttgttgaattttgtcaaaggccttttctgcatctattgagaaaatcatgtggtttttgtctttggttctgtttatatgctggattacatttattgatttgcgtatattgaaccagccttgcatcccaggaatgaagcccacttgatcatggtggataagctttttgatgtgctgctggattcggtttgccagtattttattgaggatttttgtatcaatgttcatcaaggatattggtctaaaattctcttttttggttgtgtctctgccaggctttggtgtcaggatgatgctggcctcataaaatgagttagggaggatcccctcttttctattgattggaatagtttcaggaggaatggtaccagttcctccttgtacctctggtagaattccactgtgaatccatctggtcctggactctttttggttggtaagctattgattattgccacaatttcagctcctgttattggtctattcagagattcaacttcttcctggtttagtcttgggagggtgtatgtgtcgaggaatttatccatttcttctagattttctagtttatttatgtaggggtgtttgtagtattatctgatgttagtttgtatttctgtgggatcggtggtgatatcccctttatcattttttcttgcgtctatttgattcttctctcttttcttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctggttcttttaattgtgatgttagggtgtcaattttggatctttcctgcttcctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgaatttaaacccagctgttcttgtatcagagtctgaattcttaacagttatgcattcactgtgtctaaaccttagtacatggaaccgtaagattatttaaacataaatatgcctcttattatttacttaagcctgggtcatatgcttttacacttctttcttcttttaccactaacttctttctaaatctgaccaaagcccatctttctctatttctcttttctctctgtttcttctggtcattaaaaactaagattgtatctggctgagtatcaagattacgtatataaatgtgtaacttatgtctttctaaatatatatcatcatcccttaattaattaatccaaacgactcatctgctttcctaaatcctgctagaataatttctttcaaatgtgttcttcccttttgtagcttttcccattgtcatgctacttgcacaccactcaccctctttctctttttatctgggggattgatttatacaaatctaatcagagacagtctgtctttgcttatataccatgttttgtgtcaattcatttttaggagtgacccaaagactgacatttcttatataagcaattatttgttttggttattatgtttatttgttgagaacaacttagtgtactcaatatagctaaattatatacaaatttaataaattgttaattaaacatatctaatcaattatgtgatttctggctttttctaccttaggctgacaatctcattctcttttctgtgactgatcatccacttggtccagattagccatccttttaatgtgtctcatattctcctcactgaccttactggcagaagtggctttcgtcattgttgtgggagtcatttagctgttaaaagtgcctccattattttcccatttatttaaggggaaacagcaaaacattttggaaatgcatttagagataaactgaaaaagtgttgagatgtagatagcatggtctttctagtagaaagagcctggactgcaagaatcctcacaagtgtgagccctgtttaaatctgggttaaatgatataattaggtaagactgggaaattacttcaagctgatatcctacttattttagtaaaaaatgatcaatgtcctttgatatgtttacatattattaattttctgccatcattttcttaatgttaaaattattacctaggaaatatctgttgtttttttggggatcttcttttattttcaccaagtataatggaagattttctttttagtgtggtcattaaggctctaccaggttattttctgaatgtttttctgagaaagaatcttgctgggaccagatttaacttatgcagcattcccctaaacacttcaagtattgataatttgttttcaaatgccaataaaaatataaatttagggactttgattacaagaggtcagactactgatctcacattatatacgtcttttcagtattattttatgtcatttttaatagactggttgggacacatgttttgttaggtagatgattttcataactattctaagagctacaccaccatgtacctcttgtttgaatatatttcctcagaaaaggcagagctctatacctaatctgtgccaagcagtgtgttagtgtctttgtgatgtagtatcttctcattcttaaaaaactctataaaataattattattgatgttccagtttatagtcttagtaagtggtagtacttgcatttaagtgccaaccaactgcatgtgtgcgtaaaaagtaattaagagagacaaaaatacttaggattatctcatatatgagaccaggtgtcatgtcattagctctgactcataatgaaaaaatatgaggggtgtccaaattctaggaaaatatttgaaaagcaatgagaaagaagaaaagcgaaggcaattttgctttccttttacctgtacagacagatagacctatttaagtgtatggtagttagcttccaagatgatacagctctgaaaccctgcaggactgttttatgctgttggttaatgtatgcatttggaatcacaaaagaaagagtatttgttttttgagacagggtctcgctctgtcacccaggctggagtgcaatggtgctattgtggtttactgcagccttgacctccaaggctcatgtgatcctcccacttcagccttccaggtagctgggacaacaggtgtgtgccaccatgcctagttaattaatttttttttctttttttctaagagatgggttctccctatgttgctcaggctggtctccaacccctgggctcaatttatcctcctgcttcagcctcccgaaatgttgggattgacaggcatgaaccagtgaacccagagaataatttttaaaatgtcttaattatgtaatatattttacttttagtccaactttaagtaggtaacatattaatgatccatatccaaattatgaatcatttaactagaattcatgtcttcttcaaccatatcaaataagaaatttgactctaattttatttagaatagatcctcctataatgtggtactctgttcagggtaatgattgtgtttactaaagttggagaggtcattgaataaagtactgtactttctggaagccttttgttaaatcctggtgctaaagaacaaaagtactgtttcttcaggttgccattgtaaatttctaagagatcaaactgagttttatttctaatagggtctgtatacatttgtgtagtagtattgtcttcaagttaatcttatcttttgtttatttacatagcattaaagttataattaaaaaacacttctcttatgtaacaaatttgttttttcaaaataaaataacgtttatggtaataaagacccctagataatggataggtctagttcaaccttcatatttttaagacctattattattaaagtgactatgacttctgaattgagaaatattagataagaattgagaaaagatgtttattttatccaatttggaaatttataaaaatatatacaaggtttgctaagggattaaaggtaactgttataaaaacattgtagtaaaaagaaataaaattagcagttatgatgttgttacatttatctttcatgaataattgaagttgctatgatgacatattgtttcattaaacttattcagcattattttttcatgttttcaactgtttattagcaaatttcagattattgaactttttacagtttggaagacttttaataaatatgcatctctaaaagttgtaatttagcataattaccctcaggattataagatttattcatggcagtgagacagaaaatatatttatgtaggtttgaaatcctgaagtgttgaagctaaaacttcattttttaaaatctatgtattctataggtacaaattgcgtattttatcaggcactgggtattaaagcaaggagaaatggtttttggcattaagaagcttaagacaaaatagtaaattgagataaatatacagatgcttactatgtaagctaatacttgaggatatgtaaaggaggagtaccaggtccaaaatgagagacagtgggaatggggtgtcaggtagggaaggagtgtcagggatggcaacttggaagaggcaatgttataatagtaggaggcttttgccatggagttacaggaagggcatcccaagctggtggacccaaatctccaaaggtcttgaaggtgaaagtgattagaatatggcagtcatgaccaagtgcagtggctcatgcctgtactcccaacactttgggacaccgaggcaggaggattgcttgaggccaggagtttgagatcagcctgtgcaacatagcaagactctgtctctatgaaattttttttaaagttaattgggcatgatgctgtatgcctgtagtcccagctacttgggaggctgaggtagaaggatggcttgagcccaggaattcgaggatgtagttaactatgtttgctacactgcattctagcctgggtgacagagcaagaccttgtctccaaaaacaaaacaaaacaaaacaaaacaaaaaggaagaaagaaaaggaaaaggaaagaaagataagaaaatggcagtcatcagtgaaagcggagcatgaagtgtgacgagaggactaatgaatctggagatgtagacagcatccaagccttaaagagccttcctaaagaatatggataatcttgacctatagtctattttcctcttatttggctgagaaactctcaagggaaatacaagttcatattaaaaataaaagacatgtgaaggatatttacctctagtagatttatatctactccaggttattcaataatgtgcagatatcttttagtatctatgatgtttttacttaaagaaactaggacaaacatatcactgacctaaatagattatttgtgcccagtggaagtctggtggttttcattaagtatttaggagcaagagtgattttaaaattgctgccaatgactttctttacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacacagatatagatcaatggaacagaacagagccctcagaaataatgccgcatatctacaactatctgatctttgacaaatctgagaaaaacaagcaatggggaaaggattccctatttaataaatggtgctgggaaaactggctagccacatgtagaaagctgaaactggatcccttccttacaccttatacaaaaatcaattcaagatggattaaagacttaaatgttagacctaataccataaaaaccctagaagaaaacctaggcattaccattcaggacataggcatgcgcaaggacttcatgtctaaaacaccaaaaacaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagagaaaaccaaacaaccccatcaaaaagtgggcgaaggacatgaacagacacttctcgaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacagatgctggagaggatgtggagaaataggaacacttttacactgttggtggaactgtaaactagttcaaccattgtggaagtcagtgtggcgattcctcagggatctagaactacaaataccacttgacccagccatcccattactgggtatatacccaaaggactgtaaatcatgctgctataaagacacatgcacacgtatgtttattgcggcattattcacaacagcaaagacttggaaccaacccaaatgtccatcaatgatagactggattaagaaaatgtggcacatatacaccatggaatactatgcagccataaaaaatgatgagttcatgtcctttgtagggacacggatgaaattggaaatcatcattctcagtaaactatcacaagaacaaaaaacccaacactgcatattctcactcatagatgggaattgaacaatgagaacacatggacacaggaaggggaacatcacactctggggactgttgtggggtggggagagtggggagggatagctttaggagatatacctaatgctagatgacaagttaatgggtgcagcacagcagcatggcacatgtatacatatgtaactaacctgcacattgcgcacatgtaccctaaaacttaaagtataataataataaaaaataaaaaaaaataaaattgtttaaaaatgtttctcattagttgaatcctttgaatacttgctaaagagttatgggactgactctttcatttactgttgttgttggtgttttttatttttttttttgagacagagtgtcactctgtccacccaggctggagtgcagtggcctgatctggctcactgcaacctccgcttcctgggttcatgccattctcccgcctcagcctccctagtagctgggactacaggcgcccaccaccatgcctggataattttttgtatttttagtagagacggggtttcaccgtgttagccaggatggtctcaatctcctgacctcgtgatctgcctgccttggcttcccaaagtgctgggattacaggcgtgagccaccgcgcccggcctcatttactgttaatgctgatccaaatgcaggaaatactttaaaaatggccaataaatattttaatatacataaatttgagtatttcagtaatgatggttgacatcttgacattcatgcattgaagtctgtaggttcacaaccagctgcaaatcattatggttgattatattctaattagagcaaaattcttcaataggcattgaatggaaataaatgttgtatataagtgaaaaatatcgtggctgtaagtgatgttagttaaaccattttaaagaatatagtcatgaaaaaatgtattattcattgtatacactttggaaaatctaagctgtgaggaaaatcacacatttttatttgtgaaaaattgtaagagctaaaatgtctgtttatgttttaggttttcttcaagcaaagccttacaagaatactgaaatgttttggagtgtttcacatatagtttgatttaaattcaaattcatatggagaaaagggaactcttgcacactgttggtgggggtgtaaattagcacagcctctatggaacacagtatggaggttcctcaaaaactaaagacagaactaccatatgatccagcaatcctacttctgggtatatagccaaacaattgaaatcagtatgtcaaagagatatctgtactcctatgcttattgcatcattattcatgatagccaagatatgtaacaaacctaagtgtacatctgtggatgaatggattaagaaaatgtggtttatttatataatgaaatgctattcagcctaaaaaagaaattctgtcacatgtcacaacatggatgaacctggaggacattatgctcaatgaaataacctagacacagaaagacaaatattgcatgatctcagttatatatggaatctaaataattaaactcatagaagtagaaagtagaatggctaccaggccccaggatggaaggaccgggggctggggtgtcggggccaggggaatggggaaataatgttcagagggtacagagtttcagttagacaggagaaataagttttagaggttgattcgacagcatggtgactatagttaataataatgtactgcatatttcaaaatggctaaaagagtagattttaagtgctgtcactacaaaaaatgatatgtatatgaggtgataagtatgttaatttgcttatttcataatataaaaatatcaaaacatcacgttatacctcataagtatatacaattgtcatctgtcaattaaaaataaaatcaatttttaaaattaaattcattgactgtagtgaaaaatcatccatcaaaaatcttataatacaaatatgttagattttatgttgtttggagaaaaatattaaatacttatgaatgcatatctgaaagcaaatatttgtcatttttgtcacatacttgttcaaggaaatgaaagtattttacttgatcagttctcatatttatcaggatgataaaatagaggattttaaattttgtatagtatttgttaatttttagtcacgtagttttggttgtaaagactaagaaatgaaacagagtctgattcaatttacaaagggagagatcgtattacagttgaaggattaagcaaaactcataaacaaaacagcaaccaaatcaggtacagtttaaaaatcagtgaaaaatggcagtcactagaatagcaatatttgctgtacaagtttgaatccttgatgtagaaacatagctgggccttcattcagcagtaggagttcatgactaattactttagtgaatgcagtatgtatcatgctgattatgagctgaccctgtagggttttttattcctgctttaccaggtgttggctgaatgacattatgcaagttgcttttctgttgtaaaatgttcatagtcttattacttatttctagaaatataaggtgtgaaagagataatctgtgggaaagtacctggtacgtagcagttgatgagttgtagctgccacatctcctcactcgtgtcctcctcctcctttatcttctccattgataccctgaatatactgacattaatatggttcataaatgttctatgcttctgattctctcagtatgtattgtcacttctctcaaggttaccaactgtcttagtttttactcaagtattttcttcaactgatacctgtggttctctcataagtttaacttgtttataaccctatgttatatccttgtgatttagtttcttcttctaatggcctgcttatctctcagcttcccaaaccaaacttgtcctggggtggggggaggggggagggatggcataagagaattacctattgtaaatgacgagttaatgggtgcagcacaccaacatggcacatgaatacatatgtaactaacttgctcattgtccacatgtaccttagaacttaaagcataatttaaaaaaaaaaaagagaagaaaaaaagtctatagccattggcttttctttgagtgctgattgtagtgtcaggctataccattgtcttgtttgtgattctgttgagctcacgtcagtaacttgttgagtcgtgtggtgtaaaatgaaaatacttctagtggtctctgacaggagtcatggtggggcatttacccagacagaaatttttatgtctgtcacgtgcctactgcatctaaataaataaacataaaaagttaagaataaacagtttaccaaaattatggaacagctataagtaggaagtctgggtcttaaatacctggtgtctccaaagccaacactcttgcataaactttaaatatttctgttaatcttaaaatgtttgcatcattacaaaatatcaatactagctattgggtcatttttactacttataaattcaaaaaatctttattaggtatcagatttttgttatttatcgtcttagtataaactaaattctattttgtgtctcgaaaagcaatattttgttttaaaatgtattatttgtagttgaattctattgacttgttgtttttgttttaacctttctcaggctgcaaagttggctttcacagtgcaagcctttgattcccaatgggggactcaggatcaagacgatctaccctggtctcccggttgccaatattcagaagaagtattaacagaagacatgattctcttccttcttcaccttcttccagtaatacagttggtgtccacagttcctctccttccagcactaactcaagctcaggtagcacaggtaaacggaggagcatattccgtactccttccattagcttccaccataagaaggggagtgagcctaagcaagagcctaccaaccagaaccttagtatttcaaatggtgctcaacctggtcacagcaatatgcagaaactgagtttggaagaacatattaagaccaggggaagacattctgttggttttagtagttcacgaaataagaagataacaagatctttgacagaggattttgaaagggaaaaagagcactcaactaacaagaatgtctttataaattgtctaagttctggcaaaagtgaaggggatgattctggtttcacagaagaccaaactcgtcgttctgttaagcagtcaacaaggaagctactccctaaatctttttcatctcactataaattttctaagccagttctacagagccaatccatttcattggtacaacagtctgaattctcattggaagttacacagtaccaagagagagaacctgtattagtaagagcttcgccatcctgttctgtggatgtaacagaacgggcaggaagctctttacaatctcctttgctttctgctgatcttaccacagctcagacaccttcagaatttttagccttgactgaagattctgtgtctgaaatggatgcattttctaaaagtggaagcatggcatcccactgtgacaactttggccacaatgattctacctctcagatgtccctcaattctgctgctgttacaaagacaacaacagaacttacgggaactgttccctgtgcaattatgtctcctgggaaatataggttagagggtcaatgtagcactgaatctaattcattaccggaaacctctgctgctaatcagaaggaagtgttattacaaattgctgaactacctgctacaagtgtgagccactcagagagtaacctaccagcagatagtgaaagagaagaaaatatagggttacaaaatggtgaaacaatgctggggacaaactccccaaggaaacttggattttatgagcaacataaagcaatagcggaacatgtaaaagggatccatcctatttcagattcaaagataatacctacttctggtgatcatcatatttttaacaaaacatcacatggatatgaagcaaatcctgccaaaggtatgctgattttttttgtataacaaatgatatgaattaattttcattatactttattcagttttcttattccatctcatgaatggaaaccacatttttcttgtttttcactttcgaaatggtttcctattcataatttgtgttaaatgtttcccctgcttgattttaaacttacatcaattgtgttatgctgaaaatgtaattcagcaatattactcattttttctcacttatgttatccataactaagaagcagcctcttagttacggtgtttattggagcaccttcagaagaaagtgaatggaaagtaattgtttgcaatgtggatttctccaaagtaaggactgtcttttatagagtttattatagaggcattggtatttcttatttaatgaaatggatatattccagctaaaatcactataaaatttgtataatttaatacgaattttataatttcctttgttaactaagctttcattattaattaggatccatgtttcaacataaataattcctatctctagatacaataacagaattgtaagcttaaaaaaacctatctttggaagctggagacaggtttcaactctgcctctgacattaactaactgtgcaactttggacaccttccctttagtttaaaaaaagtgttagtatatgtccattactgtaatatggctacagaaaactttgtttttttaacatgaaattcagttcaagaaaatttttgaatatataccacctgctgggctatctttgacatattttaattcctttttctctactatcattaatgctactactgctactaataattttcccaaatttggaagtgattattatgtcctagatattattctgtatactttatatacattaattaaaatgattgaaattgctactattattataagctattttgcaggcaagaagatgggagcaaagataaactgtgtgtccacaatcacaaaactaataattcatttattgggatataaatcctatgaggtaggctcctatgtttcccattttacaaatgtgaaaacaggctaaagaatcatacagctggtaagtagtgcagtcagattacaactctctgaatccaaagctctggctctccataactatgctttactacatgtcatgacttaaaatattaaataaaatttatgtgacataatgtcacgagtaataggattataaagtttatccataaacatagaatttcaaagttttaaatgcatgagttaattttccagctgtcttaatacttttctcatttgatacaagatcacttttatgcacgtgaccatgtttgtccatttttggaactttgtattctttagtcatatatgcctagctcctttacctgtaatataatcatgagaatatgataatgatgatgatattaatgatggttacccttttgtataattaatatatgcccaaaaatgtactaagaagattgcatgcactgtttcatatagtccttataaaaattttgcatgtcatgttaataactaaaatttataataagttaaataactttatagggtcacatagttagcaaatgatggacttgatattgaaatccaggaagttttaaaattatataaaaaagagatagaaatgcaattatcctgacatatctaattcttatttagtaatgatgactttcctcaaagcctaattgaatactgcatatttttctctctctggaaattagagaatgatcagttatcttggagactattactatgttgattgggatcctatttgtaacacaataacacattaattttgctgatttgataatgtgttggctgttcttggataaataagctggtaatgtcaacaaactaaactatcctttagtttttgaaaatattcatgtgctatttataaggattttataattttgaagtttaaaattttaaaaacagctaagtaaatgtattttatccaataaagagttgctatagacactaactttcataatgctaaatttagtttgtattttgtatgaaatatttaagccagtactttatacacatctaagtgttctaggtgtacaatcatgtcagaactaatgagttatctggcaatttaacttttattcattgtcttaaaaagttatttaaaaagaactgctatatattggactaatagattctggacagtctttaaactagtagatgagcctaattagaacaattttttcatttactcattcattcattcagcaaatatttattgttttaacactatgttaggcactagggatgtagcaatacacaaaacaggcctagatccctgccttcctgaggcttactttccactggggatactcagttaacatgctatatatatcagatggtgataactgctgagggtaagtttaaagcagaataaaggcttaggaagcagaagtgggattccagtttgcatttttaaatgtaacaggatgatacccaaggtaacatattggtaaaggtttgaaggaacttaaataataagtcatacagatatttgagagaaatatattagtgcaaggttgtgagtcaaaggctgtgtagggctggagcatgccagtgatgtaccagagcagcaagagtccagtgtggcatgagcagagtgatggaggggagagcaggacatgagattgcagaggtgagcaggtgaacagggtgctcctcctgtccctggtttggggacagagagagcagtcatatgggtcatattatgaagaatttgttatgccatttgaaaaacatcaccttttggctagaggagtggtggtgatggccctcacttatgttttaagtatatgattctggctactatgtggaatgtagattgtgttgcgggtggagaggcagatgagagtaggcagaggtaggagaattgtagcaaatattgcagtaaccaagccagcatagatttggtccagggtcttagaaggagaggtagaaggaatcagattctgtatacagtttgaaggaaataaggacaggattcatttatgtgattaatgtgagcaacgaagcaacaaaggatgactccaaacgttttgggcttcaaagagattacatgattaagtgaactaaactgatgctatacatttaaaagttttcttgtgatagagaaactttgaataacactaagagtttttcatgatctttcagtgggacatttgtaaaaactacatttaaatatttaccttcatttttatttattttcctttccatagttcttgccagtagtctcagtccatttcgtgaaggaagatttatagagaggagactgcgatcctcgtcagaaggcactgcagggagtagcagaatgattttgaaaccgaaagatggaaatatagaagaagttaatagtttaagaaagcaaagagcaggttcttcatcttcaaaaatgaacagtttggtaagtatatacatatgtctgcctctaataaaataatgctgtctatatccgacatgttcatgtctcttgcaaaatgaacacagactacaggatagacacctcatatttgaagggaaaatttgtttccatagttgacattacaagtcagagaaacaaatttttcacctaggtcaggatggagttcaccatgacagctgtctttagttcctgtcttccttgcttccatggaaagtttgacattctttattctagaacaagacacttgaatacagaaactagggaaaatgctgaacatgaggctcccctttgacaccattatttcacatcttctctccaccatatagccctccagaaaatacccttttgtaaatcacacttactccagtaccactcttagtccctgtagaccctatcctcgctgtcctcctgcagtgcccttccacaaagggtgaggagttggtgtgaagcttatgaggaccaatgtgaaatgcccatccaatgcttgcatacattggaggtaatcaagataccctattcctggtccaaattgtagagcctgcttttagtatgagggtggaggtggggtgtgtggggagaggcatggtctgagtttgtatgtgtgaactagggtgtcacagaggcattagtatgaagctccctcatggtatgagatggacccaggggtgggaagagatgaggggcgaactgcagccttgggtccatgtggcctcaggtttcacaagtattagagtgtgattgccttttggagatcactttgctcaccttctcacaaatgtgtcctttttcagcagtgtatttaacatctattatctaaaaatgttccttaaaataatctttctacctacctatccatgcatatatgtgaaaaatgctcaaaaataaatcacttatgatatctctattgttttacataattgggtttcaaatgaaaatattaggtaattgagatctgataattattttgtgaagaagccttaagttagtaaggtaacattgtgtgatagcaaaatcactgtgcttgatgttagaggttttaatcgtttttttctggtgtgaccatttcttaatcctgggcaaatttgtaaccacaaaatagcaagtgataataggtgtcttgtttccattatactaaagaatgactatgtgagtatgtgtttacatttgtacatatggaaacatatatttcatgcttcgttttgttcttttgtgcattggctattatattattattgttgcagtggatatttttggtctaagtatgaaaatatgttaaagcggatttccaattgatgcaccattaaaagttaggactaatgaagtattacaaaacatttatcatcacaacattttcagtatttcttcatggagaggcatttatattaatagggttacactattcaacttgctcaaagttgtgccttttacatattctctcatatctcatgtgtttttcatactgcatttaatttaaataattctagtttgagacaagcctaggcaaaatattgagaactcatctctaaaaaaaaatttaataattagctagaagtggttgcacctgtagttccagctactcaggaggctgatgtgggaggatcacttgggtccaggagttggaggctgcagtgagttattgcaccactgcacttcggcctgggcaacagagcaagacctggtctcgataagataaataaaaaataaataaataaataaataaaatgtaaaaagtgcttcttataatatcacaaagtcactcttctcagatttactttttttttttttttttttttttttttgagacagagtctcgctctgtctcctaggctggagtgcactggtgcgatctcggttcactgcaacctctacctccccagttcaagcaattctcctgcctgagcctcccgagtacctgggattacaggcacctgccaccatgcacagataatttttgtatttttagcagagagggggtttcaccatgttggccaggctggtcttgaactcctcctgacctcaagtgatccacccgcctcagcctcccagcgtgctgggattacaagcgtgagccaccacgctcagccctccgatccgcttttaagatttaaaacttaagaaacaaaagtggttttgttcctttgaggccttatatttaaattttcaaaagtgtgcctgtagtattatagtctgtccactagatggcagaaagacaccactgccgtggtggtggacagtatatcagggttggaacagaaacttggtaaaatattgtacatgttcattggatttacagatgaaacttactgaaataaatactgaaacttttgaatttcctaaagagaactaccaaaaactacttcacgatcttaccatcttcctttggattttacaagttatgtctcatctttcagttactttacagtttattcattttttattttaatttttaatttttttaaggcagagtctcactctgtcacccaggctggagtgcagtggtgcagtctcggctctctgcaacctcccctccccggttcaagtgattcttgtgcctcagcctcccgagtagctgggaccacaagtgtgtgccaccatgcctgcctaatttttgtatttttagtagagatgtggtttcaccatgttggcctgattggtcttgaacacctgacctcaggtgatccactcacatcacctcccaaagtgctgggattacaggtgtgagtcaccgcacctgagcagttacttcacacttaattaattaatttaaaatgcatgaaatatgttttttaacttgtagcactgtaaggaagaaatggtagggattatttagttctagatacatgtgaaacaagtgatgtatatttggaaaattgtagctgtctgtgtgaacactggcacattttctatattcctcttccaaaataatttaagcaactgcatgtatttaagaatgtatccatggttcagttattttattttaaagcaattataatagaaacatgtgtttttaatgcttgttggaaccaagtgactacttttaatgcctgacatgtattatcacattcagtcctcacaacagtactatcaactaaatgattctgtggtgatcaaattttgcgaaagaggaaaataaggtactgagaagataagcaggttgcctaaaatgacatagctcataaatggcagagataagatttggatttggatcctttctaagttcaaatcctacaatcttttgggaaaatgtattcgatttaaaattaagttgagccatttttcaattgtttgcatcaatttggtgtaatgaaattaaaacatttaaagcaatctaaccttgcttgctctaagtctaggctgcagcattctgtaagagatacaaaagaggaaaacagaaacaaaatttagtgcttaatctgaacttaaaatgcggtcatgtttcttgaaatgctgatgaatagtatcaatgtccttactgagagatatcccatcaaaaaggaactttgtcacaaaagaggatattcatacttagcagttttgtaatacttctttactcctaacttttaatgttagcattaatgcagcccttcatgtagttcatggggatttcaattctcataataaaatatggctctatttattaagatgctgagcatttcctgaaagaccgaagatattacctgatggattagatatagttagatataccacagttctgttgtttttgtgtacttctggggtatttcaatctggaagcgaaaggacaggatgtatgaactcttcaaacatcaaatgccgagaacaaattgggattggcttaggtttattaaaggaatccaaagtaaatttggaacaatttgataagtgttcacatttattatattttttcaaacctctttatagtatttttccaatttttctctaatgagtagctttctgaatacatttcttgcgattgtccaaaaaatttaaaatgctgttctagaaaaaagttaaagaacatatttctttaaagaacttacttcaggaagtttctctccagactatggtatataaatgtatacatgtaaggatttctcatgggttctccaatggctttacatagggaattctaactctaaatatttacaagattactctctaaaaaagttaatgtgagagtagattcatatataatgaacaatacagaagacctggtaccgttaaaggaaggaaaaatgcctaagtggatgagtcaggataaacttggctaagtgataaaaaataccgctgggcgtggtggctcaagcctgtagtcccagcactttgggaggctgaggcaggcagatcacttgaggtcaggagttcaagaccagcgtggccaagatggtgaaaccccgtctctatttgcattttgtaaaaatacaaaaattagctgggcatggtggccagtgcctgtaatcccagctactcggaaggctgaggcaggagaattgcctgaacctgggaggtgaaggttgcagtcagctgagatcatgccactgcactccagcttgaacaacaaagtgaaactctgtctcaaaaataaataaataaaataaaataaataaataataacttccaaatctagcgacttatataatatagatttctttctcacttaggctacatgtttattgtggaaggcattggggttctgttcaatgtctcctcctcctgtattcaggctgtggaagcagctaactctgcaaacattgccttttaccatggcaaaaagaaagagatctctggaggtccctgtaataaaatactttgaattgtgaaactcactttcttctgctcacaactcattggtcagatctaatcatatggcccaaactagaaacaaaagcagccaagaataataatgagtttcctgtatctagaggcggagacttaggtttggtgaacacttaatgactcatattcccaaatattttgttgtatccaagttcttttaattaatcgagatttactgactgcctcctctttcccttttgtccagagtcatttaatgggccctgactttgtgcttcacactgtcctggtctttgtggttgaaaagatgaaaacatctctgtaactgaagaattcatatatactacaggttttattctttagaatattctctcttccttacttaaaggccttgagatgtgtatcttaagtgaactaagtttacttttttccttgactcaaggaatctttactatttttgtaagtatttattttcattgcaccaagcagttggttttgaaggttgcattatcttcagattactcagcaaatgcatttgcaaagttgccctgtactatttgtgctaagtgattcagacaactttcatttatggccaattttactctgacacagcatgttttctttcatttagcatcctgctgcttttatgtggaaactgtgaatgacacagtaaaaacataactgtaggactttggtagaagaacaaatccgatttatatttgattaataagaagtagttagttgcagatcgttagcatctcatatcacatttaattttttggtatgttgaactgcagaatttacttattattgataatagtagaataatatgactgtaccctatttgagatagccaaacactttactattcatttacttttcttctggggcctgctgttttctcatttattagcttatcctttattcattataattcttcatttcttcattcattaaaacattcacagtttcttacaataaatatttattgacaatctgctctgaagaatcaaagatgaaagagacagtgcttgaggatttttgagttcccaaagggagagataaggttaaacattatcttgccaatacaacagatttaaccattttgaccatctctaagttcagaatgggtggggcatgcttcatttggattgtgagcatcgaaatccaaagttaagaagagttaaaatgggcacatgaactcctgtttcccagctttgtctgtgccttatctcacacactcaatgacactgttaaatatatgcataactttcttgtgtcttttgttcatttctctaactgagacccagctgctagtgctgagcaggtttgctgaaagaaagttgggacagtaaagaagaacgtacaaaatgaatctcatgattaatattaaaacaaatcagtctcaaaacaccccacttgtacaatccgccaagcaaaagaatcccactgggctcatttggtatatacaccttcacacttctgtttcacggcatgaaagttgctcaagcttgaaattaaaaacaagacagcctgggtgcagtggctcaaatctgtaatccctgcaatttgggaggccgaggtgggcgggtcatgaggttaggagatcaagactatcctggctaacacggtgaaaccctgtctctactacaaatacaaaaaattagccaggcgtggtggcacgcgcctgtagtcccagctacttgggaggctgaggcaaggagaatcccttgaatgtgggaggcagaggttgcagtgagccgagatcgcgccactgcactacagtctgggcaacagagcaagactctctcaaaaaaaagcaaagatgataattagaagatctgattttgaaaatttcttaatcttgaaatccttaatgagactttccagtatgtaaaaatgttaatggctttggggagttaaaataacgattgcagtttttagtgtaactgactgttaatagaattaaagcaaatattgcttggttacagggacatctaataaaaatggaagccattaatatttttcaggaaatggagccatatgaatcattctcctcaattcttataaattttaaggaagaaaatcacaagtatcactcattaaacatgaaattacatttgttgataactggcatacattttaggttaatagccctaatcctttatgcttttatttgtttttccagttactaatcatattttcctttcagtacccttctaaattgtatcatggacgtaacactcaccacatagttatttgaatgtgtctcattttacctgaaaggtttcaatcgtttaaatggaaggagctgtgtatatactggcatttcttgcggtcattaatatagcacctggtggaaaaataggcatctaataaatatgaataaattaaaggtaaaatttctggttaaataatgatacatgtttatatagatgtgaattaaggcttctagtacaagaattgtgtgtggagtgcttatgcacagttttgacattttaacttattattcaaatatacaggtatttcttatgatgcattgtctgataaagctctggcttttttgacactaaatccttgatcaggaaggccataccaattatgacattgttccagtggaagcacaatttattttaggattatcagccttatagaatggtttctaggattatatgagtacgatagttataaactggccatacaatgaggacaagaaatagtcaaatatttgtggtattcattaagcccattaaaatataatatcttggtcaaatatgggtaagcgaagatttttaaaatccgctgctattttatctagtccagctcacttcgtttcttataagcttatagattcagagttgcctttagaagcaggattgaataaaaatattccattcatttttgtctttctgaactttgagatgagtcattttcatttagaagctgtcacaatttgtatgtttgttgggcaaaattagtaatagtttattcatacacttaactcacttcttaaatgatttaaagatcggtttgagtaatacttagcacctacattgttacctctgtgataacataatttaataattattacaggtacataataggtggatatatttatggggtacatgtgatattttgatacaggaatgcaatttatattaatactaatcacatcaaggtaattgggttatctatcacctcaagcatttatcatttgtttgtgttagggacattccaattccaggtttttgttattttaaaatatacaataaataattttttcactatagttaccctattgtgctataaagtactagatcttattcattctacataactatatttttgcatacattaatgtccccccaaccctccaactctttccagctcctgttacccatcattctattctgtatttctgtgacttcaaatgttttaatttttagctcctgtatatgagtaagaataggcaaaatttgtctttccacacttcattaattttatttaaaataaggtcctccagtctcattcatgttgttgcaattgacaggatctcatctgatttttatggctgaataatattctattgtgtgtatgtaccacattttctttatccttttgcttgctgatggacacttaagttgattgcatgtcctggctattgtgaatagtgctgcaataaacatgggagtgcagatatctctttgatatattaatttcttttttccgagtgcatacttagcagtgagaaagctggatcatatggtagctgtatttttagtttttcaaggaatctccaaaatgttctccatactggttgttctactttaccttttcatcaacagtgtacaagggttcccttttctccacatcctgttagcatttgttatttgcctgtcgtttggataaaagacactttttatatgcctgttgtccatttgcttgtcttcttttgagaaatgtctcttcagatatttttgcctatttttaaattggattatttagttatcttttctattgagttgtgttagctgcttatatattctgagtattaataccttgtcagatgggtattttctccccttctgtgggttgtctcttgactttgttgatagtttcctttgctgtgcagaagctttttagcttgatgtgatcccatttttccatttatgctttggttgcctgtgtttttgaggtcttagtcaggacatttttgccaagaccaatgtcttggagagtttccctaatgttttcttccatagttccatagtttgaggtcttagatttaagtgttaatccattttgatttgatttttatatatggcaagagataggcgtgtaggttcattctctgcatgtggatatccagttttccagcaccatttattgaggaatctgtcctttcctccatgtatgttattggcacttttgttgaaaatgaattcactgtatatgtgtggatttatttctgagatctctactctgttccattggtctgcgtgtctgtttttatgatactaccatgctattttggttattatagctttgtaatgtaatttgaagtcagataatgtgattcctccagttttattctttttgttcatgatggttttggctattctgggtattttgaattgttacatcaaaattttaggatcatttttctatatctgtgaagaatgtcattagtattttgatatggattgcattcaatctgtagattgcttaggtaagtgtggatattttaacaatattgatttttcagtttcatcttcagtttactttatcagtgtttcatagtttttattgtagagatctttcacttctttggttaagtttattccagtaaagtttacatattttattattattgctgttgtaaatggtaatgcttaccaggcaaagtctctttttctcttccttcactttcccctaaacagaaggagactctgtggtaaggtggcctggagctgagggaggggtaatgtaagtacttccattgccaccacagctggaactgcactgggtcatgcctgaagccagtgcagtactgggtcttacccaaggtctgtgacaactgctgcatggctaccactgatgtttacgcaaggtccaaatgttctttagttagcaaatggtgaatcctgccaggtctggatccttccttccgggcagcaggttcccttctagcccaggctgggtctagaaatgccatccaggcgctggggtctagaatcagtggcttcaggaatatgcagggtgcttcattttaatgtagctgagctggttaccagttgcaagacaaaatcctctgtactcctccctctcctttcctcaagcaggagtctctccccatgctgcacagcctggaattgggagaggggtgatgcaaggactcccttggctgccacaggtgttgtctcactgggtcatgtgtaccccaagtccactggctccaagtccagtgcagaactgggatttgcccaaggactgaagttcttgtgacctgtctttcaaagttatttgggaccccatgccactttggtcagctggtggtggagctagctggagctcagattcctacccctaggagggaggattctcctctggcaggaggggaaacctctaaatggtttctctgtgagcactggcagaatttggttctgtgttgtgttctcttgtgacaagacagcaccgagtcccaatgcaaagcctcacaatcacttcactctccctcccacaagctcacaaattttctgtctgtgctgccagaggatggagtaatggtggtttgggcaatgcaacagtgtctttcctatcctcttttttttttaaattttattattatactttaagttttagagtacatgtgcacaatgtgcaggttagttacatatgtatacatgtgccatgctggtgtgctgcacccactaactcgtcatttagcattaggtatatctcctaaagctatccctcccctctcttcccaccccacaacagtccccagagtgtgatgttccccttcctgtgtccatgtgttctcattgttcagttcccatctatgagtgagaatatgcggtatttggttttttgttcttgcgatagtttactgagaatgatgatttccaatttcattcatgtccctacaaaggacatgaactcatcattgtttatggctgcatagtattccatggtgtataggtgccacattttcttgatccagtctatcatggttggacatttgggttggttccaagtctttgctattgtgaatagtgccgcaataaacatacgtgtgcatgtgtctttatagcagcatgatttacaatcctttgggtatatacccagtaattggatggctgggtcaaatggtatttctagttctagatacctgaggaatcgccacactgacttccacaatggttgaactagcttacagtcccaccaacagtgtcaaagtgttcctatttctccacatcctctccagcacctgttgtttcctgactttttaatgattgccattctaactggtgtgagatggtatctcattatggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccgtttgtcagatgagtaggttgcgaaaattttctcccattttgtaggttgcctgttcactctgatggtagtttcttttgctgtgcagaagctctttagtttaattagatcccatttgtcaattttggcttttgttgccgttgcttttggtgttttagacatgaagtccttgcccatgcctacatcctgaatggtaatgcctaggttttcttctagggtttttatggttttaggtctaaagtttaagtctttaatccatcttgacttaatttttgtataaggtgtaaggaagggatccagtttcagctttctacatatggctagccagttttcccagcaccatttattaaatagggaatcctttccccattgcttgtttttctcagatttgtcaaagatcagatagttgtatatacgtggcgttatttctgagggctctgttctattccattgatctatatctctgttttggtacctatcctctttaatgcctctccttcacatgttattaaaaccaggtactatgattgctcacctgacttttggttcttatgaatgtgctttcttgcctgaatatttgttcagtttggtgttccgatgtggggacaatcactcggggttctattcagccacattgctctacctcctacattattaaacttactataaatagtcatgttgtaacaatagcagtatgaaatatgtatgttagaataaactgtacttatttattaagaaaataatttaaaaggacagcagtaaatgagaattagatatcttttacctgtaaccctacgaatctaggatatactttagatattaatagttcatatccctttaaaattaagaagttagaaaactaagattgtttatcttttatttttcaagttatattatttttaattggatcagttaagtttatctcttaattttccgtgagaggacaactgctttgttccttatttagctaactgaatgggctgggacagcttccatagcataagagataatatttattgattcagggtctgcgacagatctctgaccatctgaatagatgcttcacaatttgcagcacagaattgaccttcagtaaactaactacctgttctgaggtgacagtcactggaatctgaggtttgtacattattcattttagacaatgaagacgatttattttatacttattttatggtgttgaaatttaaacacattaaattaacatcaataaattaaataagtcaaagaaattctgactccaaaggtcaagaaatatagtactactgaagaattatattcagtattgaccattagaattaaaaaatatagaaatatctaaatatattcatactctttttaagtaattttaaaattgagacatttataattgtctcacaaactatcacatttgtaatgtaagtgtaaaacagtgtaatttacaagtgaatctgcatatgcaatttcacaatcttcctatgtgatacctttttttttttttttttttttgagacggaatctcactctttcacccaggctggagtgcagtggcgcaatctcggctcactgcaagctccgcctcccaggttcaggccattctcctgcctcagcctcctgagtagctgggactacaggcacctgccaccacgcccggctaattttttttgtatttttagtagagacggggtttcactgtgttagccaaggtggtctccatctcctgacctcgtgatcctcctgcctcggcctcccagagtgctgggattacaggcgtgagccaccgtgcccagccgataactttttgttttaaactagccgtttctaaattagagtagctgccatttttatcacttttataatctcattcattgattattttactcgtgctaaaagtttgctctgaaattccatatatatatatatatcttctgttgttcttagtttggtacatcccacctaaaacagactacctactaattcttttaaatctctctgttaggctctttattgtatacatttgtaattatatacaaaattattttcatactcagctagttatctcaataccacacagtgattaatttatgtgtcagtgagaaacattaagaattttattgccaagagagactcacataaatcagaattcttatcaggtttcaagagagataggtgcagtagggggtggtctggaatatccctcttgctccccaggccctttctttcggcatccgatgagccctggcccagggtattggatgaggtttggagggttgggtgtgtaccagtgacctcatttgtacaggaggagccatctcaatatgaagcatctccattttatactcagtgatacagcatagatggacatttttcagggaaccatagcctatatatttttagattccatcttcatttttcataagcaattcagacatattctgccaaaagcagtatatagataaactgccctagtgaaaacccttcagtttgtttgctaggaagtctgtcattagtatgtttccaaagagatcctaccaggtcatctgctttcttactttcaggaaagcagacaccattttcccctgtaagagggaaaatggatcacaggctagctgcttaactcaggcagcaagtggaaactttgaatgctctcctcaaaatatctgttctattcttgcaatccccctcacttgtatttttacccattggtgttcatttcctttgatcttagggaaatacttgttttctcatttcttctaagcaaaaattctaccacttgtccccattttaactgctcatctactttagaacggtactccatcagtatgtttcttctgctgtcttgagtttctttcccatctcttcattgctgtcagtttaaaacactgccaagttttccatctttgaagaaacaaataaaaaataatatttttctgtatcctacttgctcctaaagttctccatcctatccctctttttccctacaaggcaaacagtcgtgacacttgccatactcattttctcactgcctatgaattcctcgatttcatgtactttagccattataatacaggttctcaacatcagcattattgagattttgtcctggataattccgtgttagggggactgtgttgtgcattgcaggatgttaaatagcattcattacccctacctaataaatgccagtgggaccccctggttgtgacaactaaaaatatttccagacattgccatgtgtgccctggtagataaaaattgcccccagttgagaactatctaaaggtatcagtgactttgccaattttcttttttttaatcttaattttgtattcatttaacagtgttgaggactctgcgcacttactctctttctttcacagtgcgaaatctcctgtggttattctcattcttctttgctcttttcagattcctttggaggcttcttcacacccacactttaaacacagctatttctgccatttgatcctttattgcttttttatttacctgtcctatctaaaaacttaagatagaggggaagttataagtggattccaaacacaaaggctgggaatttctattatattggaaatctgacaaaattgaataggcacgacaatcacaatatattagatttatagaaatataatgagggcctatgaaaaattatttccatagggagaatagccaaaactctgaaggcaattatctttggagtggatatagagaaatatgcagtgattttgccctaatagttaatggattctctccttttttttttgatgtatattgctattgtaatttttgtttttatacaactatatttcagcctgcttttaaaatagtcaagtaattcttaatatccccttctgtgtctaaagtcactttggagaagcagcaattctgtcatttaaagtaggacctccctattagaatcagaaatgtaatacattgtaatactattttctactctcactgctatcactgaccattatgcattatttttccaaattgaaagcagcttaagtcaagcaaaaggcagtggcaaaagttgcgggcattgtgcaagcagcatgtattaaacaatccaggaaacttggcaacccccagagacacagatgttgcccacttctgccctgcagtgtggcctctgctactgttgtctctgctttgtctccttcagagcttcccagggactgtgcctcaggctgaattgtgcctcaggctggctctggtccaagaggagcttgtggtgtgcagagggcatgtgttggggaggggtgggaagttttgactatgactttagaaaaaacgaaaatctataaaatacctttagtgtctaaaaataaaaaaagtaataaagtaataaaatgtactaaattagtgaacacaaacacttttgtaatattttcatgcttttccacacttctttgttttttaaaggcttttggtacctcctaatctttcatatgctgtaagaatatgcacttgtattttatctttatgaaacttgtctgaaataaaagtgcattgtttaaaaatcaaaggtacactttcttctaaaacacaatatgaacaaagtaggaaaacttacaaaattggaatacttttttgtcagttagatgtgattttattttaatcaagtacatggtatgatgaaaagaatgattgatttgggaaaggacactgaactccaatgttacctgtttcagaagataataataatactgcccacctcatacagttgtcatagaatcaaataatatagtttatgtgaaaaggctttgtaagatttaaagtgctatacaagtgaatatgacagttgttttatcaataacgtgtcaaaactagaaacattgaaaaacaaatagtattgccttttaaagtagtgatttagaaaagaaatattttaaaagtcaaactcacatttagggtatatctttaccatgacagtgttagttcctttcagccacaactaaaaattcctaaatgttcaagttatttatctattagatctttataagggtaatgtgctatttacttgatttgtatttggctattttttgaaaagtcatacatttttcacagtcttcaaaatcgatttataatcacttagaaaaaaattaattgagcagtatgcttaagatttgaatgctatgatttatgttatactttagttagaaagtttactcaactcagttattttctgattattaaactgggaaaaaagcatctgctcagaagacaggtgtcttggctatttacagagaaatttaatttgcatttttttatttcttaaataaatacaagtttaaccattgtagacatttatgtgactacttatgtaacttatataataactcgataaattactaattttaaagtatcttttgtcaaattttaaggtaatgctattcaaaataggcaataacttcaaagaccaaaaaataacatagaagaaaataatgatagattatttattttcctttaagaataaattttgaacgtagtatatttagtagtaatggtcatttctatgataatttaagatctctaatcttttgtgagagaaacttttgtaacacactcgagtttttgcacttgtctttcttctttctttattctattggaaggatacttccaccagtaggttattcagcttgaatatttaaactatcagggattagaactagagggtaaccagctgtcagataattcatatcatgtattaggcttcagttgggatgagacagtatatctcagcatgctgttaccttcagtaagatttatgttccaaagtgtggatacattaatacaaatagtgattttaaatgaaaagcagatcagccacctagctatggttcatgaatcacagtgattctcactttatctttctctcttttattttttaataataataataaaagtacatagaaagtatctctgagccaagtgggtgccagagtacattgatgctaaagctttaacttgacccagccgtccactggaagttgctatagctgagaaaaaaagaagtgaggcatagatgctgggtttacatttagaaaaagagaaaggaactattaatgcgtgcttttctctaatagcatttatctctctaggaagtcctgcataacaaaagaagttgggatgccattaagttttatgaagtgatactatgatttcttgaagggaacttactattacgctgctggaagcctgtaaggtctgttaactaaagaagttcaaagatagccacagttgttcagtatatagttttgctttgtatttttttgattcagtgcagtggggttgaacataaaagatgcttgaatcttcagcttttcatgattctctgcttgttataaatagactattaagtaatttttaggaaatcagaacaagcgacctattcaaatgatttctacagaatttttttttccttttgtaaaacaatataaaatacagtgatttataaattttggtactatagctttgctaaaaatttctatattatttaaaaaataagaatacttttaccataagataggaaattattctggttcaataagcaagcctattttactgaaacaatagataaaaacttcactaaaaatatttttttctttttttttctttttttaagaagcatgagtgcataataaagtaacagtagaaatgctcaggataaaacagcaacccaaattaaagagagtgttaaaaagatgattttattagatggacttaatgtccacctaatggacaaataaagtaaattctgtttgacccagtgctaactatgtgcccgttatgcattaggtactattttagggcatggggatgacatagtcaacaggaagagaagatttctttacttgtggcagctgagttacatggtattaaaagaaactaaaagaaagtcttgaatctgaaacatttagatttcctaccagagtcctgaaatgcctgcattctgaaaatagaggctcctttcccacaaggacaccttactagaataagtaagaaattactagttctggattctattacagatctaagtaatcaatcaaatggtgaacagcccacaaccaaatctgaaaatagaagtgaggggatataattggcttataattattggtgaggtagagcaaaggtttaagtaaagtgagtccaatgcatttcttcagtgaacgttgtggactaccatgagccagaaactgggcattatgtcttccaagaaatgtaagacagcttttttttttttttaaactttgaaaggttgtattatacatttgttcagataatctgtttccacgaattgtcagattcacaaaacagaacttgtaggaagtagaactcagagaagtaaaatgaggtatcttcatctctatttttattttttcccctctgtcccctttttctgcctcttcttagtgtcaacttatttcttaaaaataaaagcattactgaaaataacaaaactcagttgcatattaatagtatcagactcaagagaacagataaattaggtattgcttcttctactgttcccgcatgtgaatcttttactttaaagaaaaagttaaccaaacttactttcatgctttatagaacgagcatcactttagttatgccacgtcgctacagttttcataagtaaattttattttatttttttgagatggagttttttttttttgctcttattgcccaggctggagtgcagtggcttgattttggctcactgcaacctccgcctactgggttcaagcaattctcctgcctcagcctcccacgtagctgggattacaagcgtgcgctaccaccctgggctaactttgtatttttagtagagacggggtttcactatgttggtcaggctggtctcaaactcctgaactcaggtgatccacctgccttggccctccaaagtgctgtatttacaggcatgagccaccatacccggctatttttatttaacaataatttcatagttacaaggaagttagatggattaagtaaagaactctcataggacctttagatagatttacaaattggtgatttttatcacattgtctttctttctctctccttctgtctctgtgataaaacaaacatatattatctatattatttttgtgaatcatgtgagtgttggttgtagacatcatgattctttactcctatatactttagcatgtattttctaagaagaaggatattctcttacatcagaaagtaagtatcaaaatctgcaaatttaaccttgccacagtattttatttaatataaatctatattcagtttttcctagttgtttcaattaaaacaaaatctaggctccaatccagaaccacgtgttatgtttagttgttatgtctcttttctctcctttaatctgaaatagtttctcatcattttttctcttacatggcactaacactcatgacagttatttgcagactaattcatgattgtctggtttttcactattagattcagcttatgcaatttttggaagagaaactacatgtgtaatatattgttcttcttagtggatcatgtcagggggtgcaaaatgtcaatttatctcattcctggtgatgttacttttgatcacttggtaaagaaagtgtttactagttcctcacctctctgtggaaagggacacagctgaagccatgccttttacatagggtgctctcttgcctacacagttgtaaccgggagtggttcaagacaagacatagactcaacagttttgatgatgaattgtggaaaagaacatagcactaaccaggaattagacaagaaacagaataacagaatttctcagaaacaaacacaaaacaaacaaaacgaaacaaaaaaagaaataaaaccaagaaaaaaatcagaagaaaaaaacaaacagaaattcagcaaacgtgaaatgctattgccacttgaaagtcactttgagatccaagaagagacatgcctggtcttaatcagaccgtgaagttacttctccagcaatgcagtttaagtggttctagcatgtgagtttacttcagcatctcagtgagttgtccacaattgtcaaagtgtaattttcaaaagtttaaaaatgattttttacaaatatagattggacaagaatcaaagatctactcaattcattaataagaaaacctgcacaatagtaaattggttcaaagagcatttgattaactggatatttatagcaatttgatagaagaatgctagagtaatattggaaagttggatacaaaatcggttcaggtcctgcaggacaattatcaattactagacaaaaacatttgtatcatcattggatacaaatttgcaagttaccttttaacttcactgagtcagagctcttacagtaaatagcaaaatcaaacaattatataatctattgaatgtagtaatctttgggaaagccttttaggtaatacttcagtatgcgatcaccttcttggccttctttctgttttgtattcttaacacaaccattaccttggtgagctcaagagaaaccaagagaacagcaatttagaccaagagaaattcatgtataattgcgataatgcacaaagtatttcagtaaggcaggagagttagaataaaggtgagatgctatgatagaaaggggtaggagatagagaagagctaggccagggagagtcactattatataatgagggtttgggtaggaagtcaggagcgattgactttttttaagcgattggttttaagcaggaaagtagcacaaacagataggccttctggaatcatcattcatttaattttaaatatattaaatgaattcattatgtggctataggttagagtaaaaaatactttacataaaaaaagacagtgttctttattattgtgactacagaacagcacattgcttttttgttgacatttgagataaactttatattgcaatttgtttgagatactttgctgccaaaaaaaaaagttttctctcagcatttagccaaagtttcatattatttattcaattatgcattgttttatgcttgttcttaaaaataatagagttgtgtatttaaaagctttcccattagtgaatagttacccaataatcatgaacttatcaattaaatctattagggagaatggcaataatgacgttcctaagagaaggacaccaatgaattatttatattttggctatttttcttttattcagtagtttgtgtaccattctaatattttgacttcaattataaaataccacaatttattagtgactgaagtcacacagcccaatttatgataaacctattttctagtcacaaaccaaactgtcattctgtaaaatatcctcatagtcttgcacatagggtagtgtgaaaggtgacaaaaggtaacaggaagaatttataaaagtcaaaaatcttatgtgtaggcagtggatgtgactatagggatttatacttattgtattgtaagtagcagcgggtttttggtttggctcctgtgtgttaattctgaaatcaactaccttattcaaaggcattattttttctaaaagacactggacatgaagaaacaagtagccagagatgcagttggcatgagctgattgcaagattattttctaattaaaatacgtcatggcaaagaaagaataattaggtatcatataggcttcttcattgacagaaaataaaagtgccacacttaatttttaaaccattcacaaatccaattcatgcgtaaagtgaacttaaagatgacagactaattaattaatgatgagtggattagaaatgagaaatacaaacaaacatgtctgaagagaggtagtaattatatataagcttgtaggttgtcaggattttcttaagtatttattattaggagaccttaagatgtttttcctaatacctaagaatatgagctttctatgacatttcatctataattttcatgattaagccttatataacattttcccttttcttttttagccctatgaaagcaaatatttgttccctaaatttgctcattgtcagggatggaaaatttggaaagttaatatttattggaagtttattatatatcaaaacttacatagtcatatttcccccatgaaaaactgtgcacttttagtaaatggatgtagtcattaaaattctttctcctattgaatcctacctccctgtaacttgtgtattgttctctgttgcaacacacaattctgcagtgttggccaggctggactcaaactcctgattttaagtggtcctcccgccttgtctttccaaagtgctgggattacaggcgtgagccatcacgcccgacatagatatttatagcttttttatatttttggcttttataaaatatgtatattctttcaatattaagaacactcaccatttctatgccatggatacactgttttgggaaataatctttaaaaacatgttacattcatagaaaaatagcataaatcacatgtctgaaaactgattagaaagtgataattaatcctttttttctagacactagaccttagattttctaaattttgttttattccaagagaatttggccttgactgcagaaatttccacagaatgattattttggctactgactaggttaactgacagttatgtaatcttgagttaaaggactaaagagacaatagtagatttatttattttggtggtatagatttagttaaagagttatccttaggatcactgataatgtggaggaacaatatttcagattccaaacataggactctacatgtgtcatgtaagaaagtgtaaaatgaataaaaacacttaggaccaatttgaactgacaattctgtgctttcattaatagactattgaatctcaaccagttttcacctgtcttcttcctagacttaatttgaagtgactgggtttaagtaagaatggtttaagtaagaacaggctgttaaagacttcaaaaacatttaataaatttatgatttcccttatcattatgtgagaagaactacaaatcagcttggtcctttccttgaggatatgtgtcctagatttgtgtctttgagtaaaggtattgcatagggagtttatttttgctttgattgtcaagaaagtagcaatcctggtgatgatggtggtgcgtgtatactttgctaaagtgaatccaatatgtaaaaatacacatttataaagcaagggaattcagccagtttttttgcatacaatttataataaatatactcaatagcaaatccttctgcattcgtcagcaatattagctgatgtttattaatggctgatgtttattaatctacagactggccctaagcctaaaatcaaaggtgaacacatcacaaatggtttatttacaaaacattacaaactgcaagacaaggtaatatctggcctagaaaataaggtgaagtagaaaaaacagaacttgcaatcagaatcaataaggcctgaatatctgttctctggctcttcccatgtaccagttctctactcacttccatcaattatgtttgtaaaaggtggttgaatgaagaaagcagaattgcacagaaggataagttgaaatgtaatgcagtgggaacagggcctcaactgatcatataatgaactctcagactgagatgagtcttcatatttgctctacatcagggcaagaggaagcattctctatacctccatattgatcaaggagtgcagactgctcggagaaggggttgtgacccacagtggacaaggcagtaagggctgagagctgaggccaagtcgtgaagagggatttagttgagagcagatagtagtcaaaacacagcagctgggagaatgcatgtttcagtcctgattgtggggatctggaaagtatagcacttcagccattggagtatctgtcttcacaaaaatcccttaaagttagacattattatttttcacatactacaaatgaggaaattgagatatatagatagtaattaatactaataaatatgctaatgtagttgtttttaatctttttttttttacaagatcccttaacattcttaaaaattactgaggatcaaaaagaatgttggtttctgtgagttgtatcaattaatacttacctaattaataatgaaaacagacatctgaaaaaaagtaagctattttcagataatagtatttaacccattatatgttaaataaaataattttttagaaacatctatattttcccaaacaaaaaaaatgatgagaagtgcggtattgctttacagttttgcaaatttcttcattgtctggctgggattttctctttcttcattcaatctggtgcaatatgttgttttgtgaagaatattagcccacacatagatatgttgttcgaaaagggtagttcctcacagtttagttgaaggcaggatctgaagccatattgatgaattttttatactctgaaataaaatgctgatactaatgtgaatattgtactcatagaaacacttttgactctttgttcttaaaaccagtcacattcactgctagttttgggacttgccccatctaagatagtggttgtcctcacctcccactatcttcatgcttcccacttcacttgctcctttctacctattcctgaatgtctaatgcaagttcttcaccccatgtgaaactctcctgaaatattccagcctttactgacttaaacttctgttttggacaaatgattttctgattgttttctttctgttgttttcaattttcttttccttctgctttttatcatctgcagttgtatttgtaacttgttttaaacaaaaagaattgaaaaattgaagttcctaacaatgttcattcttttgcagcttacacaggaaaaagaagcaaaacccacaatatatgtcatcttctgttgtgaaacaaagatatttcacactgattaccttatgagggcttgagtgtcactgattgttttactccagcatagtgcttaagcatagtatagtattcagttaattaatgtttattgagcttaattgaattgactgctttctagctctgcattttcgtttatacaaaaaataatgaaaatttgttattttaatcagacgtactcgccttctgattcagataaaattactaattttagtgagctgcaatagtgacaaaatctatctcctgttatgcctttgtatatgttgtattcttgactgttcagctattccacataaggtacatagctttttattgtattgacatcatatcaaagtccagatctaaaccatttcatgcaataaaataagtaagtcctatgagttccaatttgtagacgatacattcttggtagggagcttagtttctacaaggagtctcgagtaaaagcagcatttgttgaataaatgacatgttgcacatacatgtgtttctgtggatttaaaggtttgttgtagttttcataaattgtttatatatttatagcgtttacaagatgatttttgggaaaaataattttctttctatagaactccagactagtaaatccaattaccaactttccccgttactcatgccaaaaaacttgaacttcttcctgcctgtgttccttctctgagaactcacatttatgtcattcccaaattcttttgtcataagacacccagaatttgaccagttctcaccatctctgtcattgccatatgtcggggtggcctctctggctggagtcttgccatcgcctcccagctgctcccctacttttggttcactcttgcttgcttagtctgctctcctcagagctgctcaattgatccttttaatatctaaattaaattatgttatgtctgttctcaacacttcccaatggcttcccactatggcctgcatttccctacacaattccattccttgctttcgctctccagttatctcctattattttaccttcctttcgctccactaaccactttatccttcttaatttttcttgggcttgtcaagcaattacccaccccagtgtctttgcacttgtaattcttgctgcttggaacacccttcctccagattactgcatgttgtcctccctcattttctttgggtttctgctcaagtgtcaccttatcattatgtcatccctgaccattctctataaaacagcaactgctgtttttttaatctttccgtatctgctttaccatgcttccttttttctcaataatatttatcactattttacataatatatgtttgcttacttatttaatgtgaggctcacccaatactggagcaaaagatactttagagcatgtactattttatatatatatatataatgaaacatccccaaagcctagaacagggcatcaaacaaagaaagcatggaatacatattaagcaaatagaagaaagaaaaagtaaataatccagaaaaatattttctaatttgttttaaccttttgttattttatattttctccttagtgacaattaaaaattccatctactattatattttccccccaacacttccaatggttttctgccgttggaataggaccttgctaaaacaggcttttcataaagttctgaattacatattaatttctcttttggcctcacagtaggaggatgaaatactgcaagtggtagaagattatttttaccttagaatacacatcctagtgcatgttgcaaggctccaaatatatctattctaaagcgttgatttacatttaccctcaaaaactaaaagcaagcggagtttgacttctttgttctttcatagtaaatatcctgtgtaatgagagacttttgttttcttaaaaaaagtcctcagagaaagctgcactattactcaaattgtttctgtcaaattgaatttcatttgtgaatttgtgctagtttaaaacatttaaaaatcagacattttggcatattgtttttggattcaaaggaaattataattacagcagttacaaagcaaggaaaaaatagctgttgaatcatctatggagcatattgcataatttgtaattttagactctcagtaattcaattaatttaacatgacaacttttctgtgctttacaatttggcaatttctagcaatttaataggtttccccctttttatttccaaacattcccataaggtttacaagtctttgaaatgctaatttcaatcaaagtacagtttaatttaaaatttcattgttaattgtagttatttatccatttcagttatcgatgatccagcccagtggcatttgtcaaaatgagcagtcagttcatcttgggtttagatactaaactggaacatttaaaagttaacctaatgatatgtttagtaataataaagctgtaaacaaatttataatctatgcttaatacaaattgtaacataactttaaaaatactcaagacatgaataacagtaatgagttttcgctgtaaagagagctgtgatataatgtgggagaaattgaaattattataaatagaaaataattttgagaactgctactgtcatagaattaataattttgcactgtttttgaaaatcactccatttagaagatcagctggaatgtctgtttcctcatagataaatttttaacagaatagcatctttactgctgcatcatgcagtgaaatcagtgaaagtgttatttgttgaagtgcttagctctgtgatcttatgagagttttattatcttcttcctagatgaaaaatatctcttcttgtaatcatctttgacattaacttgacaatgtttagatggcatgtaaatcagattatgatgcctaaccattattaacacagcaaatgaatttttactctcgagttcataaatccacaaggagcattttttaaatataatatccttttaataaacctagatatttaaaaattaatttttacattatccccaaatactccaaatattatactttttgttatatttgtttttactagtctagacaactcaaataaaatagctaatcttctatgatatttatttaccaattctatttatatttatactgcattgtgttttatgatctatggataaaagctttaacttgtcaacctgactattaggctgtttagacattaaattcagtttctttttctctaggctgaatctgatttattattgcaccaaatacagttaataaatactcttttatggaaattatttattctgacctgaatctgccttaatcatggagattaaatgagactgacaaaaaatagaaagaaccttaaggtgtctggttacatattttgttgtagaatgtttaccttatatgcatagatagactaataaaacctcaatgtaaatataagctttagaatgcaggggtttatttggtggattagatggcactgatctagtcttttcatgactacctccccttgaggtaccgaaaatctggattatctttacttccagaagaaattaccagagacccactggcaaagtatttaataagacaattattttcttttaagtgcagtaaatgcaggcagtgtgtaaaatctgaattgaatacaagagatttgaaagcgagggatatacaaagagagaacatgcttattttctggtttctttagtccaagaaagataatgttgaactgagaatgggtgagaacaaggtaactgacctggggatctcacagttttgtggaaacagtgatttgctaccaatgcatatatgaggcctttacacttgttctattcttattaccatttgggcaatttcacgtctcttgtcatcttgctctccatagctcactgttaagtcttcagacattgactatcctcacccttacgccatcctcctttctcagaaagtaatcatgcctacctttcttttcacagagaaaatggagacaatgagagttctactcactcaatttctggcaatacttcccacatatacatttctatacttttgcattcagcattatttttttcattccagtcataaaggaaaggtcatttatcaagaatcttgtttgcaagtgaaagaaccatagcaccgagtatccctctgtcacctgctcattttcccgtaatagttaatcactctgaaataatattcttattttctcttactttctcaccatgaagttttccatactccaggactttgtggaaactgatcttgttaaggatgtccatagtttcctcattgttaccatcggtggacttcatcctctttctcttctctgtcatgttatattgctgattattcctttattcttaaaacatcctttttggcttttagatcatagtattttttaagattttttcttatcttattgctcttttcttatcagttgccttctctagtatcttttccttaggtattgatgtcctccagatattgattctgggtgcctctcttcttcttcactgcattttcccccaaatgatttaattaacttcaattctcaattgatgataataaaagtctctttcttcaggtcagcctctttatctgtatgacttgcaggcatgtcatctttaatatgttcaaaataaactatccttgctatcttgcaaactttctcttctattttttgggggcctttatcaacttgcttatcaaagtcatttatcatatccttttaattataaagtcttatttatacagcttcttaattaaaacttcagtctgccttccttccattctcactgtcattacctaaattcagggcccattatttatcacctaggtgattgcagtagccttaaaactagactctaggccgggcatggtggaggccaaggtggatggatcatttgaggtcaggggttccagaccagcctggccgacacggtgaaaccccgtctctactgaaaatacaaaaattagctgggtggtagtggagcgcgtttgtaatccagctcctcaggaggctgaggcaggagaatcacttgagcctgggagacggaggttgcagtgagctgagattgcaccaccacaccccagcctggcgacagagtgagaccctgtcccaaaaaacaaaacgaaacaaaacaaaactagactatattttttagacttgatggactttggtgtattctcacaccagactttttggtaacacaaagtgtttcatgttacttttctgcaatttattttatttttcttaatttttgtgggtacatagtggtatatatatgtatgaggtacatgcgacattttcatacaggcatgcaatgtgtaagaatcacatcatggaaaatggggtagccatgccctcaaggatttatcctttgtgttacaaaccatccaattatactcttttagttgtttaaaagtgtagaattaaattattgactataataactctgttgcgctatcaaatactaggtcttattcattcttactaactattttttgtacccattaaccatcctgactcccctccccaagtccactaacctccccagcctctggtaaccatccttttactttctatctccatgagttcaattgtttcaacttttagatcccataaataagtgagaacatatgatgtttgtctttctgtgcctggcttatttcacttaacataatgacctccagttccatccatgttgttccagatgaaaggatgccactcttttttacagtcgaatagtacttcattgtgtatgtgtaccacattcatttatttttctgcctaaatattcttgacatacaaataatttttccatttagtatcatatttcaagatttaacttagtcttctcctaaagtgctgtgttctgcacgtgttcttattatacttcttatcacacttacttgaatctgtttgtgtaactttttttttgactggtttctcagtacatcataaatgtagagactgtgtggtacagatacttctcgccttacaatggggttacataccaataaacccaatagatattaaaaatattgtgaaatcggaaatgcatttagtacccccataaactccttgtaaagttgaaaatttataagttgagccatcaaagatccagatgctccttgacttatgatggggttacatcctgttaaattcatgataaggtcaaaaaattgttaagttgaactattattaagttggggagcatctgtacttatccatctgccctcatgccaggtatagtaacttgtgcttaataaaactttaatacacctctgaatgaatgtatgtgtgaattgtctaatagatgtaactaagaataaaatgaggataacttcaaaagagaacatatgtatattaaatatgctatttttacagaatttattcaatgagactactttctcgttgtgtataaaatattgaatgcatataaattcaatttcctcgtaacattcatttgaccaacttcagccagacagtccttgattcccatgtttgacagtttgctcatctgcttagaaaaagggaaaggaagaaaaaaagaaaaccatgctctttccattaaaagagttggcactatcaactgttttattgtcaaaactaaatataattttaccaatgatgatgacatttaagaatacacgtttgtgtgtaagctggcctttaatacaaacatttaacagaaatatgtgtaggaatgtagtaggagaaccaccagcattgaagtcattgattgccatgttactgacaaagtatttaaatggaagaaacaagagattgagttgtctcccaaacagtaagggtactatgtgtgtttttgcaggtttattattttggaattgaaaaattttaagaaaaagttatcatttgggatgacaaatgctaagtgaagaatcctgtagcagaagtttattgttggttactgctgctaattcttcccagtgtggtactttataaaacaaattttaaattctacttggttattctcaggaccaaaaggtgataattttttgtgtgtgtctgcttgaaaatatgcagtatgaaaactcttaaatcaatagtttgtagtacagagaaataattactgcttggaaaagagtaattttcaatcatatactaaatgaacagacaaattaacaaaaacgtttattgaacttatgctaaaggcactgagcacaaccatgaacaacacacatggcccttactctcttcgaacccagcagcataatttatctcttagattaattcaatagcctcctataagatctccacatctctctatcttctaaaccatattttagagtaattattgtaaaacagaaatcttatgtaatctcactgtttaaatcatttcagaaatcatttcagaaattaaccattactcttagaattaagagaaaaagtattttattttttctctataggctgtgatggttttggctctacctgtcttcatagtctcctttaataccctcccccatttatttctgtggtctaaccactctttccttccttaatttatgtaaataccctactttttttctgccatatgacctgtgcacattctgctttttctatataaaatggtgtttaaatattttaatgaagttaaaacacattttacccaaataatggatgccgcttggactaatggttatagaagctgttacataaagaatcctttgtaaatttatagaaatgtcatagcttaaccaaatatttcttgcataaatataaataggcaaaatgtgatcaaaacaatatttaaaattatacatttaatacagatttcttattattcagttaagtggtatatttcttaagcacttataaccgtgtagatctctcttctttattgcagtaaaattatggtaatttatatttattttgttttgtggcactttatataattatgtgatatttcaattatagctagattgtcagtgaaagcttagattatactcaatataattctacttaagtataagatttaatttgaatactaaacctgaaagcttcttaacttcgaatgctttccattatcaagtaatgcttgatttttaatttgtctagatttatgaagagctttagagtacttgatgaaattttatttgaaagcatcaatatggtcacaattttctattactgaaaaaatgtgtgcctgtgtatgtctgtgtttgtggcatgccacataaataatgtattacaatacttgtatgtacataagtactggttgctttggaaaatatattgctcttctatctagtttgacttgacaatgaaattacaaagaattgttgcagttttaaatttattatttttaatttcatcttattaataaaaataataatgtaaatggtcacagaatttctttccccagtaaccttttattgaggctacagtagacaacatatttactttcagtggaagaaatagtaaacttcccatgaattaaagtagatcagattttatagaaatgtttctatgccctatgcaggtgaattcaatatggatagctctgatctttccgaaggctctttgtttgaaggttaaagaaataaggttattttgtttgtatgtttataacttaattttatattcctgtagtttttctatatgattaagtacattatagaagcactacagagtataattggaataaacaaaagcataaataataggacagatttgcctataatttttacttgtttatcaggctgccaatttataaggaactaatttcacctcataagactaaatactatgtattttttaaacattcagtgataactattaacataagctctatctatctatctatctatctatctatctatctatctatatactttattggtagaatagaatgagctttttagtttacctaatagggactatctcttggattacagtggctatctctggtttcacttttggcaggtggagctatccacagtcatccacagtccaaaaatatgaaatggaaaattccagaaataaacaattcatgctttaaatttcaggctgctcttgtatctcaccctgaccttcccagaacgtgaatcatctctttgtccagcatgtgcatgctgaatatgtcccctacattttactctttttagtagctgtcatgatttatcagaggcccaagctgaggtcccatcagaggcccagttgaggccacagcagcaacctcaccagagaaactggcagagtaactgatagaagagggaaagaaagaagggaaagatacggaaaaataagtagaagaaaactagaaaatagaagaaaatgttcagttgaagtaaaaggcaaatgtatcaaacactttaagcaccaaaggaatgtgagaagcaaggtttaggtggaaaaacataggtccactggctctgatatcccagtaaacaccatggaatattatgcagccataaaaaagaacaagatcatgttctttgcagggacatagatggagctggaggacattatctttagcaagctaatgaaggaacagaaaaccaaatactgcatgttctcacttataaatgggagctaaatgatgaggacatatggacacatggaggggaacaacacacactggggccttttggaggctggagggtgggaggagggagaagatcaggaaaaataacaaatgggtactaggtgaaatacctgggtgacgaagtaatttgtacaacaaacccccatggtgcacgtttacctatgtaaccaacctgaacttgtacacctgaacttaaaataaaagttaaaaaaaaggtatcaatgttattctaaaatgaaagtttttctactctcataaaatatttcagtatttttgttatgtgtacgtatttgaaatcatagattatataatattattttactatgttcttttatccatttcataaaaccatattattcaattattcacatgtatcttggacattaacattcttatctcaatagggcaaatttttaattttccccaaactgtttttcagggcatgctatattccagctacattgtattgcacatagtactgtctctatctgtttttaattatcagtggacttttcatctcaataaaaattactcagtatattaagacaattgttcatttgattattttaattattctgttaatgtacactgattaaatgaaaggagtttataattccaaagatagaattatattttcagattaaaaaaaagaaaaaacgtagtgaatttagggtttagcattatctgaggtttctgacatccactggtggtcttttttcccacaaactattatgtgtatcactgccagaataattgccctaagcaacggtcttaaacgttgttgtgaaccacattttaactatctggaatgtggctttgtccatatttttatatatcttttttctattaatctctgagtttatagaaggtagaaagcattttttatttatctctgtggctagcactgtatctgatgtttcctaaatataagtttatggctttgaaagaatgagttccagtgtgcataaaaatcctaatggggtccctcctaacataaaatggaggccaaactgtaagggattctgttttatttgcctaagagacaaaaagtcagtctatattagggaatttgggaaggtgaaatttgaagtaaacaagtatattgactttctagttttaggttatcacttatttagtaggcatgaaattattttttaaatcatatcctgaacttgtatttattcaacagatatatttacaaataactcaggtaaatacgtggcaaaataattttgaaacctagcccttgcattttagatttctaattatataattttagcagtcaaaagatcttaggaataataaaataaagtaattgtataaaggcattggtgagcacttgtttaggatataggatagaaacgtggtggcatacaattctagaatttacttttctatcttgtctcctggttgtgagctctaattttagtgaaacaaattcatttctcagaatggcatgttcttatttttttgtattccattcaccttgtatatactgtttcttcctctgtaatcttccatcctttaaaattctttacccttgtttgtcacgtatttcattttcttcttttcataccattactctctgctttcctaaaagactccttatctcttagtatacattgtgtgaacctctaacagtgcttaactctattaattataacaataattagagttacaacagtaactaattttcattcttgtgctcagagctgttcaagcactgtcacgtataaccacaggaaacctctgtgagtaacactcttcattcacgtgaggtaaatgaggcatagtgagtttaagtaaagtgttcacagttccacagatggaaagacttagaaaccctaaactgtcataacccaaagtgcataatcataaacactactccatgttgtaaaagaagataaacagttctgcatctttcattgtacttttagccctggaaatacaggaatgatgccatttcaaaaatgtttaaaacaaaagtatcagattcagggcctggcacataatagatgaacaatcattattgaattaataagtcatgaacaagtaagtaaatgtatcaaaaatacatgctagagggatgactatagggtgattctgcaaggtagagggactgaagaaactcttatagagaagacgaatatgaactgagcattcaaatatgtatgtggaaaaaagagggtgcaggtaaacccagcagattatttgcgagtgttataagagaatcatgggaaaatttttggaatcctggcaatgctcagggaaaaatccagttttcccattactatgaggaataaggcaagtatattcttgattatgagtattatttagtgttgttttgaaggtatatgctaaagtaattggacaagatgaagaaataaaaattggaaaggaagaggtaagattgttattatttgctaagcatgtaattgtttacatagaaaactaaggagagtaatttgaaaaacaacaaggccaaaataaaaaccaacaatttaattaatatggcactatataatactaatctacagacataaattaattggctttttatattcaaacaaaaagtatttggaatatgtaacggaagtaaagctaccatttataatggcaccaaatataacaaatatagctgtctataaaacgggaaagatgatttcaaagagaaattttaaaagatcttgaagtacacaaaaggaatcttgaagaaaagcatagtcaaccatattctctgataaaagaatctgtttcataaagataataaattcccccagttaatctaaaaatgtattttactgcaataaaatatcaatggtttttaaaaagaattatacaaatctaaaaatttagttaatctaaaaatgtattgcactgcaataaaatatcagtggtttttttgaaagaattatgacaaatgacttatagtactaataagaaaatgaacaaataagataatccagggcatgttcgaaagggaaaaataacaagagggcactagccctatcagatattaaaatatataaagctgctgtaattaagaagggatgctgttttaacaggtattaaaatatattgtaaatctacaggtactagtgcacatacagtcaatcagattgatggaacatttttaaaaagcaataaatccaaatacagagagaaattcaataggatagtaagggtgacatttctaatcagcgggcaaagataccttgtccagtaaatggtttagggtatcttggtgttcacttggagaaaaagttgtgtctccccttttcatgttttataccaaaaggaattccagagagaagtcaaaatatgaagccatgagaagctgtaacaaagcatgcaagatttctatggagaaatctcaagttggaaaagatatttctaatgataccatacacttgaagaaatgaagtaaataataatttgagtatatataaatggaacagaattccacttataataacaaaaatttttttagaaaatagtgaataagctgaaaacagtgtgtatgttcaacaatagtgtaaaaaaaagtacattgtgtgtatgtatttctagaagaaaacaaaataaatatgtagcaatgattgactctggaaaaatagattatttatggactgggtagtaatgaaacacacacacattcttctgcagattttgtctacattttatctttgcataaaattttttgttttttgtctacttttttgtctacattttatctttgcataagaaattatgaataaaactacttagtcataataaatagaaatgttgacaatgagtgtgttgatggcagatctgtggatggatgacttccatttatactttttttgtgtgtgtttttaaatagaaaaactctataattgtttccaaatatctttatatcctcaactttataatttatgagcagtgtatcatatttctaaatctatgttctcattaaaaaatacggagattaggccgggcgcagcggctcacgcctgtaatcccagcactttgggaggccgagccgagcggatcacaaggtcaggagatcgaaaccatcctggctaacacggtgaaaccccgtctgtactaaaaatacaaaaaattagccgggcgtggtggcgggcgcctgttgtcccagctactcgggaggctgaggcaggagaatggcgggaacccgggaggccgagcttgcaatgagctgagattgcgccactgcactccagcctgggcgacagaccgagactctgtctcaaaaaaatcaaaaaccaaaaaaacaaaacaaaacaaataaacaaaaaatacagagattggccaggcgcggtgactgacacctgtaatactagcactatgggcagtccaggtgggcggatcacctgaggtcaggagttccagaccagcctggccaacatgatgaaacccgtccctactaaaatacaaaaattagctgggtgaggtggcaggtgcctgtaatcccagctacttgggaggttgaggcaggagaatcacttgaacccaggaggcaaagggtgcagtgagccgagatcgtgccattgcactacagcctgggcgacagagcaagactgtctcaaaaaacaaaaaaaaaacatatatgtatatatacacacacacacacacgcagatagtaacaggtagcatgatttagtaaacataacattgaataactgtttttcctgtaaaatgggggaataatatataccttgaggactaaggaaaacaatgttgttaaggcacttagtaaagtatactatttttgaatgtctatgtgtttctttagataatatttaatttgtttagcttactgctccccagagccatttttgatgtttaactgataccacctgtgattgtttacccagtattgatagcctgcaatatgcagagctattttaggaactgaggaaatattagcaatcatcaggcattctaataagtgatacaagtggaagatgttatgaaaaaacagaagaggaacatcacgaatgtaggagtcaggagatacttctcttcccacttccttccctgaggtgtggacatctgaggctatatcttaaatctcgagtataacttaaagaaaataattatttatactgggcatttgttgggatgggcattgagatgtatctggaaagaacctgggatttgaagtagcatacatatagctagagtgaagaatgtatgcagaaacatggtgagaattgaggattaaaaattatgggaccacagagaacactatttcatgctaaagacattgattctcagccttgaatgactttttaaaaactactttgtcagattgaacattaaatagtcactcaagaagttttcagtttggacaagatgtcatggacctgtttttctctgcttctttctgctaagtacagctataaactctgaaaatgatggaagaggcaaataaaggaaaattcttaaagatggtaagaggaatgaaaattggtttgagatcacagaatacaaataagagcacagaagaatggcatctcacatcctctcacccaacaaaaggttgtgatccaggccttaattttcctgactccaagctagcaacagaaaacaaggtaggcttatgtctcctttggaacaataggagtctttctgaaaacacaagacaatatccactgcaggaaagcactctcctcctctgtaggatctgatgcttccttctacaatgaatagatatgaggcagctaggtggtactggccggaggaaccccaccagaacaagtggcctcatgctggaagccattatggaaagagtatgacattcctcaaaacattaaaaatagatctgtcatatgatccagtaatccctacttctgactgtatatctgaaggaaacaaaattggcttcctttgagagatctcaaagagatatctgcacgccgtgttcattgcagcattcttcacaatagctaatatatggaaacattctatatgtgcaccaatggataaacagataaagaatatgtggtatatattaatgtaatgaaatactatttagtaataaaaaagaaggaattctgccatttgcaatcaattgagtgaaacttgagaacattatactaactgaaataagccagacagaaagacagctactatatgatctcacttatttgtggaatataaaaaagttggagtattaacagctgagagtaaacagtgtttaccagcagattagggggctagggaaatgaggagatattgatcaaagggtataaacgttctaagatgaatataaatatttggcattatgtatataaaataacatgagatgaatatgttccagggatttaatgtacagcatggtgacagtagttaataatactgtaatgtatagtttaaatttcctaagaaagtatgtcttaagtgttctcaacacacgcacacaaacacacacacgcacaatagtaactgtgtgatcaacttgattatggtactcatttcacagtgtgtatgtatatcaaatcatcatattgtacaccttaaattaatacaattactacttttcaattataccccaatacatctgaaataaaaagaaaaataactaaataaaggtattaatgacttccatttgatggttctcgtgctaggtattttttacagacttttatcattttaagtactacaagaaccaactagcatgtggccttagaaatgttcaaatagaatttagataacttctgatttttttttcctagtggaacgattctatctctattagaagttttgccatattgcaaatgcgggcttttctcagtttctttattctccttcccagtgctctttgtggtggtggtggttgtgttttgtaactagaaataaatttctatcttaatacaaagctttctttaatccctcagtgccatattactctccttgtttctaccatttgattcttctagtctatctcattaactctactaaaaaagagtatttgagcctcaaatagtttatttcctaagaacaaacagttaagtaatatgcagactgaagacttctggataagactcaaatctttacctaatatattaagctgtatttataaaaaggaaattactctttaaaaacaatacacatgctataaattgtttctttggaataatggcacacattcttcctatttatcaaatagatacatttcccagaaggaagtgggtaatgatatattatagtaaaagaaagaaagaaaagaagagaaaagaaagaaaaagaaagaaagaaacagtatttaattttatcagcattcctattacacagctggcatagatttttaacttactttgtgttaggtctcctgctttatgcaatttataatcttattttatttactttttgtaatcctataaaggctgttaaaatctgtctgtaagcattatgtatataaaataaaatgagttaccatacctattttcatatcagaaaatccatgtttggtggaagtcaaataacttgttgaggttcccacatactcctgctacatagggaagctgagataggatgctctgtgttaagattctaaagactgacttcttcctctgtgccatagacagtagagaatatgaacaggtctattactcttcttaatctgtaattatatattttacaacattattgacagaaaaatcaccttgcttcttggcatttgttcagatgctgatttaatgccacttatgatggaatatacagacttctgcacttgctgaacaaattggaaagtaaaggtttccaaggactttatggctgccaaagggatattgtaaattattgtaaatataaattatccccttgccagactacagagattacttttatgttagaaataggcaaatgtgaattggcttatttggtgggcattagtgaaaagtccattgtcttaattggccaactacaaatcattatatttagaaatttttagctgtatcatttgattcacttgacatcgtgtatctttataaaagtatgtaattaacaagaactcttctgtaattatcctgacaaatttcctggtttcttttaataaaattaatagtttgcccaacttacagtatatcaaacacactatatatatctattctgtgtttagacattgtaatgtctgtgtagctatactgttttataacgtctaatattttaagtcttataacatttcttccatcccacagctttccttttaaaaactaatttttcattggttatgaattggatgaactaattatcttaatgtgattgcaatatatgtagttattttaaatcataaatattgaaatgattgtatttataacatttcttgaaatagacaactatatgtattttatgtaaaaaattaaactctatagtttacagtgtcttgaataacaactagtgtttgggaatgagactatgttaaacatttattagctatttgacattggaatatcaggttaaaatgtgtaagcctcattttctttatctacaaaatcaggataataatccctacctcatagatatgaagtgagaattaagtgaggtaataaatttaaaatcttatagggagacaataaactttagctacgatctttatttttgttgcattttaatattattaaatcgtttatgtatccaatactgataccatataaattcatgcattaatcttgtaacctttttatttttaaatattttctgggactattttagacggcaatttagatagtatctaatctgctagaaaatatcaatgaagctgtctgatatttacaccataacttactaagattctctgtattacagattctgaaaactcaggggatttaagagggaaataaagtgagcttgttgaaataaatgtatacataaatagacctgcagaaaacattcctatcaatcaaatgtatttggaatatttaagtatattataaaactactttttgcgggtctggtaaaaatggtggtgcctgcctcttttaactcaatagaaaaagaaataattggagatgaatttaatgttctttggcctttttatcatgcaacccttatttaattatagaatttcagtgttatattacataactgtgcaaaatattacttaataatcacttctgagatggttttaaaaaaccatattatgcatgtttatcatagttccccatagcaggtataggccacttatcaaaggaacttgcatttagtaattctgtgcagttagtcttattgaggtccacttgatggcagtattgcacttggtaaggtcagtctttttgcgtgatttttttatacttgatttcccgtgtaatggtggaagtaaacttttcaattaaaccatgaattatgagagacttattttctgctaatacctcagaggttatgattcagaaatgttttgtggaggaaccaaatggaacatagtaaaattgttacacgtcagaggagagatactcttgggaaatgagaaaatcaggattttccaatttttaaaattcatgactctgaaggattttagctttcatcatttttaatagaattttcacttataggaaaaggtaaccaggaattgtattaaaaaaggaatgtgcattcattagttaagaggtcaagtaacaaacttaaaatttgacaaatcatggtgtgtaccacaaaaataattgacctcaaacatcaggataaatgtttctgcttctatccaattgaaatgatttagaaggtcaattctaaaactatcgtgtcagcttctttgctagcaagaagcagtaaaagggcatttcctgcttctcagtttttaaagctttactgaaagcaaatctcacaaatgatattcaaaatattatagtcagaaagaaaaaatagttactcctgtccttattgttaaaaggccttatcccccaaattaaatcaatcttccataaagtccctaaaaaaaatatgaagtccttgggaactcacttggttttaaaacctaattaataaaactttagtgagataacttttagtttttatctgaagtgtaactataaggaaaatgatattataaaatgatattttgacaaaagatgttttaaaaataggagtaaataatacatcaaatattcacttcaatatggtgatttttttgtttatctatttaaacttttgtctagtacacatttatattacctctacttgagtgttaatgattcagatttaaaatgaagttacacattccatgtagtcaaagtgcttctgtctctagtctagtcagctaactccactgacttttacatcctccaccaccaactagctctgtatgactttggtcagattacttaatcacattttcctcacttcaaacctgatagtagtattgatattaattagtacatggaaagtacttagaaacagcagcgagtacaaaataattctcagtaaatgtcagttattttctttatccagcacttgatgataatttgtggacttatatatttaaaagcatatcttaaatacattttattaggagaaaagattaaattgatattttatgtggtcttgccaaatttgttgtatttataatacaaaatatgagttatattattaaatatggtatatttgatgttttgtgaagattacatttgggggagaaacaaatattaaacctttgtaacaaaataagcttagtaaaatgtcagtataatttgagttaataaattgcaaacaggcatcagggaattgtcatttttgactctattggttgggatgccagttatgaatgcttaatcacaaacatcaacaaatattcattcattactttataaggcacttaagtcattgtagagcatgccaggaattataaatgatcatttcatccataagttactcagaatatagttggagatatattgactaaaattcatgaaaagatacttttaaaaatgtgatgacagtaatctggtgtcacatggtatcatgtatccaactgccaaatgaacatcataaggcacgatgtgttacgaattcagagagaagatatgacaggcctaaatgttgctgaaagagattaacagaaggggtgatagtctagttgagcctgagcaataagttttgaataggaacaacagaaagaaaagaccatccagagagactattgttagtccacagtactcaaaaaggggagtaatgttaatatagcaatttaaataaaaatagtatatgagaatgctttcaaaattgtaagctaatataaaaatgagttataactgtgtacttttggaaaccatttttaaattcagtagagtatacctctttcatttatttatttgccaaaactagtagtttacatactgagcatataacctctggagcatggcttttagagtacataaaatcagtcctctgggcagggcgcggtgcctcatgcctgtaatcccagcagtttgggaggctgaggtgggtggatcatgaggtcaggagttcaagaccagcctggcaaggatggtgaagccccatctctactgaaaatacaaaaattagccgggcgtgatggtgggcacctgtaatcccagctacttgggaggctaaggcagagaattgcttaaaaccaggaggtggaggttgcagtgagccgacatgtcaccactgcactccagcctgggcaacagagcaagactccatctcaaaaaaaataaaaataaataaaataaataaatcagtcttatctatggttttatggtagataacttgtaaaaactttatatatagatatgtgtatatatatgtgtatatatatgtgtgtatatatatgtgtatatatatgtgtgtatatatatgtgtgtgtgtatatatatatatatatgtatataattttttttttttttgagacggagtctcacactgttgccctggctggtgtgtgggagcaagatctcggcttgctacaacctctgcctcccaggttaaagcgattccctgcctcagcctctcgagcagcaagggttacaggtgcccgccatcacgcctggctaattttttgtatttttagtagagacaggttttcactatgttggccaggctggtctcgaactcctgacctcgtgatccgcccgcctcagcctccgaaagtgctgggattacaggcgtgagccaccgcgcccggccacaatattcttataataaaaaaacatccacggccagacgtggtggctcacgcctgtaatctcagccctttgggaggccgaggcgggcggatcacgaggtcaggagattgataccatcctggctaacacggtgaaaccccgtgtctactaaaaataaaaaaaaaattagccgggtgtggtggtgggtgcctgtagtcccagctactcgggaggctgctcgggaggctgaggcaggagaatggggagactgctcgggaggctgaggcaggagaatggtgtgaacccgggaggcagagcttgcagtgagccgagatcacgccactgcactccgtccagcctggacgacagagcgagactccgtctcaaaaaaaaaaaaaaaaaaaaaaagcttccacatgggatgcgtccaagggagcttggaaacgtagaagcttcgtcgttcttttatggtctttgtctggtgaggtttaagagtccattctgcagaaaagagttgttcatggatgtatttctgtcaacatccattggcctagctgatcatggtcaatataatgcttcatggccaacataatgcatatgaattaccatacggttaaagatcaccatattttcaaagaaaagattgtataccttctgatataaattagacatttcaagcagtactcaactttagtttattttatagtgcacaacttttgtcatagtattttcatttactctgagaccataataaagataaataaaattgaatgatttttatgatattaatttacataatttacaatggtacatccatagttcattctgtctaggtaaaggctttaaaggacctgtaggtgacattatctaaacatactttgagtctaattttctcaaaatgaatcaaatgttgttttcctaagaaatgacaatctatattttttcattcccaatgataggcactctttaaacatatacgatggtttctatagtagtagagaaatagtttatgatagtagctaaaaagttaattattaatttacctcaggtttcagcaaatagcaggttctcaataattattagcaactattgtgagtggtacaaatcctactgctctccatgttgcttctgctccacctctccctctctatttccatttgttttacaatatctaactaaaataaaattacaacttactttcttctatttgtcctttttgactatttctctgggaattttagattatgtccaaattggacaagaaggcctatgcctcaaaattgacttagaaaacactctttttaaaaaattttaagttttattttgggttcgggggtatttgtgaaagtttgttatatgcatatattatgtgacactgaagtttagggtgcaattgagcctatcacccaggtagtgagcacagtacccaataggtagtttttcagcccttgccctcctttgcctctcgtctagcagtccccagtgcccattgttgcagtctttatgtccacatgtacccaatgttttgctgccatttttaagtgataacatgtggtatttggtttagaatgaacaattaaccaatattatggtggagccaagggataatgggagacagttctctgtgagtctcttgtgtttctgcaagtcttgtaagcagaggcactgactatcttcaacttcaaactacctttccaggcaagtttatataggaatgtctgtttagaagatatatacagtttctttcttgagcaaaaagcaggttgttcactctccactataataatgtgtccttctagtgcaaaagtcaggcaggcttactttctacgttaaaagattctgagtctcaagctcaggattcttctcttgtgttaccttaatgaaaattagggctcagagaacccaagcaaatactgacactctggttattattgttgccatgagtagtaaagttctttgactctcacacagggatcttgtgtcttatgtcaacatgcatgaaattatttcatgaaatttaaattttggacgataatactgtcatgcatggtaaaatctcacaacctttacagttcttgatagggtgtagggcaatagagaaagttttggtgaaaaacaattcagaatgccaaaatgacatgctgaaggtatttaatataaacttatacagttaaaattacatccagaatttaagaaaacatttagtgtttttcatatatcaccacaaatgtaaaaatgatgctagtcaaatggtttagaagcattaatcaatacataaattctttcctttagaaaaaccaaaggctaggtgtaattgagaatgatcacatattgatttctagctcttattcaaaatctcatttcttcagaaaaggagaatattggaatattagaatgggaccaaattagttagaaaagagtcctacccacatgctgcctgaatatttctttccttttccgctggcttctccacttttcttgccctgattctgcagagaggctaccatagccacagacgtccctctgtgtttttgatcctcagtctactcttctttgatttgccaggagtttctggtaaagcagaaaggtatcattccatgggctacattctgattacaatgaaccaggcttcctcctttgcagttaacagtataatatcaatagtttcatacaagggatgcctttctaagttgtgtgagtacatttattttgtcaatctgtagacttacagatttgctcttggataattgcaaattgagtaaatttatattattatttagagtgaatatggatctgggatatttatttattaaacatttaatgttgtactgacatgagcttatcagtattaagtcattaatccacacaataattctgttatccctcttttacattatagaaagcttacctaagattatacagtaaaatatggcaaagctgagacaaatatgaacaaaggaacatagagtcgaaatagctgtggttcctgttttctaattttctacaaattctagattgcttctctccttgtcaattgcttatcaagcacttgtcatagtattttgtagtcatttgattttgttgccttcttaaaataaatagtacgcacactgacaccaagaatatatttaatttttctgttaaatttgtttttctttcatttttgcattgctaatcctgaagagaaaatcatagactttttgacatataatagttgccacataaattggtgaatgaatatcactgtggcacctaaagtacaccagatctgttggggggttctctttgttttatatttcctgactttaagtgcactcatgtgtttgagagttttattctaaaaagactacttatccaaatgcaacttggctgcctaccatgatttggcaaataaagactttcaagggcagaaagaaaaaaaaaatcttaagattatttaataacagcatgtaccttccaaagaagctaaagaaaattgtcaagtgaaacagaaaactgtgacattattttattaaaatatgacctacagttttaaacttaacgtatcttataattttatttttcagtaattgtatccatttcattttcccactcattattagagcagagcctttctgtagtggtctgatgttgccaggtagagtgtggaaaaattttcctatagatacatgttcattctgcaaaaagatgggattatattctgtaatgtaaagtgaatatttatgcttttgtggtatcccataaaaaatgtttgggaacaactttgcctttttagcttttgaaaatgagcatttttttatgtgaaagtttgctttattgttggaaagcaagagcaagaaaaaaaagtaggaaatgattttgctttagtaaattgggtttaccaagtctttcttcttctcttgaaacatagtgggaggagagagctttatattcaagctaaaaataatctttgggtaacacctacatttttaccctgaaatagacaataaaatacattcccagggactgaccataaaggggtgtggggagtagaatacttgagccttttcaaattgtctgtctctctcccccaagttcaggaaaccatctgtctccctctactcacatttttcccactaactgaatcctctttattccaaggattaagttcagtgtctttaaatagaaaaatgtggagattttatgaattgccaaatgaaaatgaaaggttcggaatcactaaaattgatggtgttctgattttagaagttagaagaaaattgcaattaaaaatatgatattcaacttattcattggtgaaaatataagctatggaataaaatgtaaagccaaatatatatttatcaaaaatctgcttaaacattgtatagagtttatataataaaaagcattaaagtagtttgatatttaaaaatatgtagtcagttctactttaaattgcatttttattactatgtactcagccctaattcacaagttggggaatattaatgttttgtgcctaccagattgattgctgtaaagaagacagttagtgtgatgatgtagatattaaacaaagtaaaaggcagttaatgcctgaaaatgggaagttcttaaatgtggagctcacactgaaaagaaaaacataaaagagaatcttataggtcaaaataaaattttgaaaatatgaaacaaaaaattataaactaacctatttttttttcattaatccatacaatgactgaacattttacagcagtatttcatggtgtgataaagaacctaatgatagctatttttaagaaacaccatcagtatggaactttgaaggcctaaactcaggacaaaatatatgagatgttgacagcctatggcagatttttaattgatattgcaatcagtgaaattagtagtattgcatatatttttgaggggaaaaagataaaaggaaattatttttgagtttgaagtttagtgtgtgctttagcctacagctagtattcacagaagattttcacagtctcagttgtgtttaatgtgaaaaatttaaagcataatacataaggttaatacagaattcaatgagcaacataaattttatatttttataacatcccatttggctgtcccaattcatgttgatgtgtgtgtattctaataccatatttacatatgtatataaatatatatgtgcatatatacatatacacatatatacatacatttctaatatgttccttctatttccttctcaatttctacttgaactaatcaaaatatgcagactttaaagatcataatttaaggaattcgtgataatttttaaacaattgtatgtacataggatgattttaaaattcatgtgtgcctgtcagttaattcactgctttgtaggctcctatttgatgctcaaaattaataggtaaacactggatatgcaaagggttattggacaagacaatcctttgaatacttactattttgaaatacttgaagaatcagaaaaccataaatatataagcaactgttgaactgtgaataaagtctgagtgagttaagagaaggaaggtgatttcgtcttttaaaccatgtttaaagtaaatacatatttaaatattcctgcttgataatcataatcgataagtgagcaaacatttgtttttgcaatgggcaaagaccttgctatcaattatacatgtgagattatctttgttttagttttccttctagcatattattgtaaaattaatagtatatagaataacagtttcttgcatactacagcatttttgtctgattttttttcgtagtagccatagccaaatattacatttcaatgccaaaaaaacatgaagctcaatatttctataacaggcgtaatcaaagtatgattgaaaccttggttaccagtaaagctgttcagtattcatagccatggtaacagtaagatttaaaataatagcaatagcatatctatcatgacattatattcatgttattcttattagtcattgcatttataaaattataattatgtttccaaataaatatcttagcaaatactactttctattcaggttcatttataacagctgaagacaaagatgttagtatcttaatcactttggaatcaatatcattgtgtgtgtattttctctttttcttctaacagagaactgggtttaactttttaaattgtaaattaacaattcataagtgtataaatttatggggtacaaagtgatgttataatttatgaatacagtgtggaataattaagccagttaatatatccatcacctcaaatacttaacatttattatggtgagaacatttgaaatttagattttgaaatgtgcatactctattattaactatattcaccaggctgtgcaatagaactcaaaagggaaaaaaaatcccacatttctgagattttgtaccctttgaccatcatctcattctccccacctccagcctctgtaacccattgtgtattttaaacacaacatttgaggtaagtgtttaattatttgggtttttagtatacccagtgaaaactggatttaagggacacagttcaggagatttcattaattttgtatggaatagttgaactaactaaataaataagtggatattcttagaaaccatgtgtagagtaggagtcttttgtgatggccaaataaagagagatcatagaattcccttagtacgaaatttaataaaaggtatgtataacttaacaaaatcaaaacaaacaaaatattttttaacctgtttgcatacaataccatgtctctaaaatgaagcatataggggtagataagcaatcactgtggaaagccaatgaaaatttacatgcgctcattggaatgattacatggtattgagagaattgtcagcattaataaaaccaaagagagatataaaatgaagaattgtgataactaacactactaaagcaaaaagacaagagacggtaacaaagagtggaacaaacaaacatttaaaaatgcattctggaagcaatgacaaatattctgttctggaaaaaaacaactacaaacagaagaaaattccctacaaaaagtgctatgcattttagggtagcgaatgagcatgaaggctttataagccggggatcccttatgatcttgtacaataacttaaagtttctgtgtttagtgtcctcatatataatatgaggtaacatgaaataataataataacattttcctccagaatttgtatgtaattagtagtggtatcatatggaaaacagtgcttggcaaatagtgcttgtgttttagctagccatattttgtctttagacaaacttaaaagaaaaaaagaatttaaaaataagtaaaggaagaaagaatttagaaataaggccacaaagacaaaagaatatatgcacaaaagaaagcagaatttgtacagctaagaatataaaatgaggaaaaaaatgaaacagaaagacctttgcaagaataagtaattaaatataagaacaaacatgaaaattatgactgaaaacggagttggtgacagaggtgaaaggttccagaaaacagtccggttgaatgcagagggaagtaccagcaattaaaacatgtaaaaaggacaaactagatggacagagttttccaaatgagcatgcttggggtccctgaaataaagaagttaacacatttgagcagaaaataatcctcaactatttactaatatagaaaattactgaaaaaaagaaaaatatatggattaaaagagttttacagtattttagggaatttgatgcaaaatgtttaacaggcctttcctgttaggttctgaaattcaataataaataatcataaaaactttaggcattaaactcaaatgcccctcagaaaaaattatgaagtttctcagacttctacaaaagaacactccaatgctataaattaataaattaacagataggaagttctgatgaacagaaagtgtgatctgagagtttataaatacctggttgtcattcaaataaagacaagctgttaaacaggcagaaactcaggcaaggtgactccctcccatggacccatgagcacttatgagaaaaaccaaaaacaaatgaaattttgtcaaccatgatatgaatgaataagtttttgcttaaaaaaagggaatgcggcttggcatggtggctcatgcctgtaatcccaatacttttggagaccagggcaggaggatcacttgaggccagggattcaagaccagcctggtcaagggaacaagaccttgtctccacaaaagaaaaaaatacctgggcattgtggtgtgcacctgtagtcttagctcctggggtggctgacgcaggaggatcacttgagccaggagtttgaggctgaagtgagccatgatggcactactgcacttcagcctgggtgacagagtgatactctgtctcaaaacaaaaacaaagtctttactcaaatgtcatctctcaattaggccattcctgatcatcatatatgaaattgaaacttgtctacctcgccttccttatctctgttttatttttatccatagcatcatataaatacgcacacacacacacacactactaaaaaaatttaaatgacaaccaaaaagtcttttccatatagatcaaataaaaataaaatgaaaaattttaatttgtatcaatcattattagaagcaaaacttatggatgttgctgtctgtgtcagaaagaaatacaaacccttaaccatttattccactaatcaataaaataaaaattaattaagctctaaaataaattagaaaacctatacaatgaaacaattgaatgccaaagaaataaattttaaaaattatacctgcagaaattttaaaatcagtaaataatatctgtggaattaataaataaagccaaaagctatttagtaaaaccactggtctggctaattaattggaaaacaggaaggaaggagaggaggaggaaaaggagaaggacaaagattaggatgaggaggaagaaagaagaagaaagaaagggggaggaaaaggagaaggacaaagatgaggatgaggaggaagaaagaagaagaagaaagaaaggaggaggaaaagaagaaggacaaagatgaggatgaggaggaagaaagaagaagaagaaagaaaagaggaggaaaaggaaaagaaggaagaggagagaaaagggaaagaaagggaagaaaaagaacatgtaagtgggagcacagaggtataaaaaaagagaattgaagaagatatagggagattgagagtaaaataaaagaacattagaatacatgatatatttatttacaagtatatttgagaagttagatgaagtaataattttcttggaaacctttaactaacagaattcaacaatatatcaaaaatgcagttcactccagaaatgtgaggtgggtttattaattgggagtgtactaatataaatgtatctattaagacatcacaggagaaaactacatgatcttacagatcttagataaaaattgttaacattacttaaggctctgaaagttttgtcctccacctacccctccagttctaacttatattacactctaagaaatattttgctgctgtttctttgagatactgggaagtgataaatgtgttgcattttcttagcagcacttttaaacttaatattacttgacaattaactggtataatgaaaacttttcagtttattagatgaaaataaaattcaaagaatataatagtattgtcttttatgtcgttaatttttgttttatttaatactaggagttttacctaacaattatttttaaaaccttactcaaagaagcacagcaaatgtttgtcttcttgttttgtttttgtttacttttccaaaaaagccaaatgaaactgtatacaaggaaacatgttggttattaggtgtcatgccatctggcactgacatctgccaccacattgaccccaggttattttggctgctttgcctggcaaggagggcacctgcctcttacttcacagctccatgctgggcattccacgtctgcagtttccgtgaagatgtcaatcttcccacatagaggagtatgttttaaaattaaggttataggaaaaagaaggtagctttctagaacttctaagtatgctatggagtccataaaaagtatgctgattttcacttatttctagaaaattaagtataaatggtaggttggattttcactttcaactactgaagccttaagaagaggttatattgtaatcttgaatttaaaataaatggattcacatgtttcatatgcttttggtcatctacatttctccattttaatagtaaaattaaacattattcataatttaccttgttttgtatgtcttctttgggagacttgcttataaaaatcacatcacaaggtttgcaaggtttgtgtttccttttccagcctattacacatattcttttaagaaagctcattttaaatgagccctttcaagaataaaagctttttagattattttttgtatgaaatatattcaaaagttacacctcatgcacctagcattttaaaccatggttccaaaggattctgcagatttaaaggtcctaccgttttttattgttatttttattacttattttctttttcctttgaagtatttaaagttacagaaggtggaatatttaactttggccatgaattattcatatttgtttagaattaacattggcttaaatggcttaacatttttctttagttagtgattcttagattttctaatgcagctcataaggctacatttctcagctgggtacaaaacttgatgaattagcagctacaagctatcacaggaaacaaacccagaccttgcctataaataactgtctagttttaatctgattttcttgcatcatataaggtacagctgcatataggtttatatgttgtgtgttcatatctacttttgagtagatagtggaagcaaatgaatccaataaatctccttaaaatatttctgcttcaagaaattcagtatccttccagaaaataattgctattttgtcttttttttaaaataacaaattgtgaagtatatagataatatattcttcaggaagtaattcttttgattctatattttataattacactagcatctataattgaataattgaataaaatttgtttacaaatatattgctatgccttaagatatgacatattttgcacattttacataacttgaaattgtgagataacatcattattcaaaatatgagtgggagtttatacataatgaaaataaataataaccaactcccttaagactagtaataagccaaagaaaaaaaacagttatgaaaaaggttaacttaaaggcaccatggaaacaaaaatactgttgtttttataatcaacatcataattaggaataatttggaactacaagaggtcctagccatcatttagttcaatttgtttttattgtggacaaacagacttggttaatagcaccataaactaaaaacagtgttaggatcagggtcatatcacaggtcaaatgataataagaatttccttgctaataatagtttgatgagagccatgggaaaaactgtccttaggagactgcctgtgtcaatctattataaacaaatgtgggtggcctcaaaaatatgaatgtgaatgtaattaatttagaacactaatgaataaactgtgtacactaacctatatatatgttaaagagaaaatatgaaaataaattacaaagatcaatctaagaatgtgttcacatattaacccatacctgtggtctctgaaagttgacgacttgttcaactactgatcaaaaatcgtttggaactctgtggatatgcttgtttttttcaattgctgtatacctccatagagtacaaaagactgggggacctagtttctgccatcagggagctcaaattcctcctgggaaaaaatgatgctgaaatctaaaataaaaacataacactctgtggcttatatggccacataactctgtggtctaatctaaataatttgttcaataaaagtttaaaaatggtaactcactttgaatggaccaataagagaaagtttaaaatttgagtagcaatgaaatagtgggtaatgggagaagaaagcaatattgtgagaaggataatgtaagtgaaggacagaaggggaaatatctgagtgatattggagcatggtgtgagagatgtttagtagatcatttttaaaagctagattagggggctgggcgctcaggcctgtaatcccagcattttgggaggccgaggcaggcagatcacttgaggttagaagttcgagaccaccctggccaacatggtgaaactccatctctactaaaaatccaaaatttagccgggcctggtggcaggcacctgtaatcctagctactcaggaggctgaggcaggagaatcgcttgaacctgggagatggagtttgcagtgagctgagattgtgccactgcactccagcctgggcaacagaatgaaaacccatctgaaaaaacgtataaaaaaaaaagctagattagggttatacttttggggttttgaaatgccatgtcaatagcctgggaatcaatctctcattttattataagtgattatgatttttttcagaagagaaatgatataagtctgatgcttaaagatatttatctttagtatgtggagcacactaaagaaataaaaggataaaggagatgcaaactgttgcattagccatggtataagatattaaggaccccaactttattaagtcacactactattcaagcatccaaccatccatctgtccattcaacacttatctgttgagagttgactgatttttaggtagtatgctggagcaaaacaggactcaaacagatatctcatcctcaatttaccttgagtttacagatgtatagggagtgtatgtgtgtgtgcttgtatgtttatggatggtatgtaatgaagtgacgagacatataaagtgaaaattatcatatatattgctctaagtgatatgatagggttatatttgggcgtaaagacccataaccaccatgatgaggaagattttctagaaataatgctttatggactaaaaaatcaccttgatttacagaaatattggaagcagtgggattagtatgtggaaaatatagcactggagagtattaaagacttgccaaacttaatatggtgcaatatggttggaataaagttcatagtgaaataataagtcatgaaactggaaacagttgcactccttgaaagtacagttaaacaatactcttctatcagaaacatcactccattatttttcattttaattaggtcatttatttagtgatcaattgctttaagacatgtagttaggtctatatttaaaaagtgtgaaaaaatgatacaactgatgcataattttgggggaacattctaggtctttcatgggagacaattcttcatgggtctccagcattttttcatgtgttgtgagtaaacttgctgtttttgttatggaccgtcttttcaaggatatttttacaaggaaagctatagaagatatagtgcctccccttggaacaaaggacaagtatgtttactacccatggtaaaatatttgagtttataaactcatggttcttctcctgtaatgcaaaccactgcatgtacagatgtccccctttgcattcccctgggggagctagggcactgaattggcaaagaaaatgccgatactctagatactgctatagttgtgactaataaagtccttttccttctgacccaggagtcttgtggcttttgccaacatccacgaaactgtagcaggctaacttattagcttgcaagtaaggtaaaatcttagacccttcatagttcctgacagttttggctatgaggatgtgaaaataaaaaatgttttatttctagaataggatcgatgagacgcttgtgggtcaattaacagaatttgaagaaagtgtataagaattggcagtaaacatgttgatcacattaatggtcaaccaagcaataaattatccttcacttcattgctctttaataaggagaaattggaaagttattagcagatagaatactggaaagcgtgcataaagagagctgcttgaacagtgctggacttgttgcaaattcgcctccttttttgggaggggggatttccttgacaatcaattcaactgatgggattcaggcaaggtttgcagtggagcaaggaatctaaaataatcttgtgagtgaggccctttgggaaaattctatgtattgttttggttgctgtcattctgaatatatattagaaatttgatgcattatatgctcatacttccctgtcccatatgtgtcaggtaaaaactactgatgaggaattacacaaagcattgtcctcacccactcatggtacattgacatcattggacaattgacctcctctcagggcacttagtagtacctcactgctgatggtattttttcagattacaatgctattccagttaaatcagctgactttggccatacctttatggaccttgcaactaatcattgtcatgtactttaattttcagacttttgcagtctgatattagtgcttcttttattaccaaaaaaaccccaataattaatgggctgatagttaaagtatatccagtggaacttccacactccctaccatccacgattatctgttgtttttgagctttggaatgggctcctaaataatcaactcaaaaataattctcactctactcccttcacttcctcctggtcaataaacctagaaagaagattggccatgaagtgcagctgtcaacagaaaaggatcttagtttggcagcctcactttggcctggtttatctaccctctgagtagtatctcagccaaaatggggactcaaaacttaattctagttcatccaactggattcttttgttagactgacatgcttctagattggttatgttgctcactaggtcctcctggaatagtccacatgaaccaaaatgggcggtacatcgggtctgtgttggatttaataaaatgtctttgccctttctcactcattccttccagatgacagagctaggcatgagttggggatgactggaaaaaaagtaaaatatagctactagaatgggacacatgggttttgtgttagtagaaggagagtaactgcagaacctggagagagaacaacttagaccctgacaggtacagaggaggaagggccatccgtgatccttctcttcagaaccactcctagatccttcctcgtagagcaaaagaccctgctgtggctctcttaaactactgaaatatccctaaacttaactgaatgctgggtcctctgtgccccaccacataactctaaccatgatttgataatcatttcccttaattgtagtgagaaatctgttggatgcagctggaattgccccagattttccacctcccatgcaaaacattgccaaacctctggatgtcctccacatgctgatttcagtagctgtctccagtcattttgtagagcagacacataccatttgctggctggcatggacataaatgcaagttggactgattaacctgaggcagtccctccaaaaactaggactagattcaagtattcaaatttaaccggagactgtaaggcttcctggccagctgggaggccatgttggaggcactgccagcttgacctccacatggggaggaaaaacagttgtaaaaacacttgttctaggggcactatgtgtggccctgggactgtacattttgtgtagatgccaggaattaacttgcctctcttctgaaaacacagtcatatgcattatagggtgatcacaattgaccttcaagtgtttaaggaaaacatcaccagtagattatataatcttcagatgactgcagagatctcttcaaaattaggctgcctgtggttactcaggggatcttcttggaagagtgtttcattattattgcacaccctatgtgaagttatctctaaaatgggattcactaatctgaaaaggcagtacaacatttctccttgtcttcagctaaagtaatcagtgacatagctttggctcttgaaggcattcagtctcagcctcaattaactggacatggcagacatagaagatagatttgccctagactttctccttacttccaaagctgagcctgtgtgatttctaatacatctttctgtacacctggattaatgccttggatcaagtggaaaggtcaataaagaaagccatttggctttttaaggtagtccctgatgggttgtaggatttgtccagttgtctgtgtctggaaccctggggcacatggttgagatcatttctacaagtcagtctcttattgctgctcacagtcctgtgtaactttaattaaatgctttatgggataaattgaatggatatggtcccagcctctgtcagattaatcagagtggctgacaggtgatgcagtcatgggaaaattctccaaaagttaagacactgtagaaggagtttgatgttaaagacacaattctccatggatctctcatacttcacttcttgcaagcagaggcactcacataatatttttaaggatatttgtacagtgaacagactttgaaggtagagataatgtctccttccagaatgaacagcaggtatggttactgccagtcatcaaaggtttgcgtttcacctgcaccacacatacagtgcttgtctcctgtaacacaacccagagcatgtgcaagtatcatctagttcttcgtgtttacctgtgaaaatggcactcagggaacaggcacctaaaaatgctgtcactctggttattgctattgatctagaaaagttctttgtgtctgtaccaggatttttatgttttcttctagcatgcacaaaatcatggtggactaatagcttacagatgggataaaatttcagacactgcacacacattcttcacagacacattatttttgaagttataaaataatattaatgtgttgttaaagctaattttcagagaggggattctattccaccaacatttatgactaggtaataaaatctcatttttactgaaatttagctccataaaatgcattctatttaaaatctgaacatgtgccaaactatcatcaatactgtataacaccagtataattaggtagaagtactggataaactgtatgtaatatgtgcagcagaatcctaaatcattctaatggaaaacagattatgccagcaacatgtaaatacaaagaacagtggtctccaaggaaaatatcagtagcacatcaaaatctattaatttgttgaagaaatagtatctaagagattcaattaaacaaaataaccagagaatacatgccttatttttggaaacgtaaatattactaaaattgtattaattagcaatctcatgaatattatgttttactaagatgtaggaaaccccatgtaactcaatgtaatatttcataatagatctgattataactgagatgagcatttttacagggattaacaaaacataattggaaataaatgataattagataaattaactgtgggtggaaaattttcatagaaaataattgtcattcatttaaaaaatgtgtttttattatgaagatggggcaaattatagaaatagtgtcattgtcttttgttgttaccattttaaaatttcatctctaattctcctagtcatttagtttttatttcttccctgtccacaaattatattaagcatttgttcattcattaattcattgccttattcatttggcaagtatttatggaacatgtattatttattgaacaatgcttttcagctctttatggcattgtttagaatttaataatttcaagataatcctaggtctgctatcactgaacctacctctgccttcagtaatctcagtgcttgtaaatgaaacagctatttttagctctgatagaactaaaatctatacctgtcttggaaactgcaataattaataacctgtacttgtaaaatactttatagttttctgtcagaattttatgttaacaacaaatgtgagctagaaaagcagaaccgattgtttctattgcacagagaaagagcttaagtctttaagagggtaagtgacccaaggctaggttgcagagtcaaaattagaatttcatttcataataaattgtatgtcctttcactatgctgtacttatactggcaaatgatagagtgggttcagagatttctaattgcattgtgaagttaatccttatatccttagtggcttttggaaattacagtttaagactggatctgactgaaccagcattgaggacataagcttattttactggcaactctgtgatatgtcaaatatgcctaagacaatgtatttgattttgaagttgagaattgcataagtaaatcaagaaatcgtttagtgttataaattggcacctggtttctgacatagttgtttaggttattatttttagcaaaatagtacattataaatgtgcagataccctagattgttttacaattgagacatgaattcttctcccatatgagtttatattattaatgtctctctacagagaatagtactttatcccctaatttaaatatatagtaactcagttcttgccacatcccattgttcatggatgtgaacaggaacacacatctacctagtctcttctagaaaaataattatcaggaaataacagaacttaaagacaggattagaatagagagcatatcagataagagcgaaaacagagtgaaaatttattataatcgactgagctatataatgccaagaaataaaccatgaaaaatttctgtagtttaacagcaacacagatttatttcttgctcacacaaagtttcagttgggtccggcagctcttcaggactgctctcttctatattgtgactcagagagccaagctttccctattttgtactcccatcattttaatgtgtggatttcctgagctatctggacaggggaagacagtattaaaggtttatacgggatgtttttaaggtcaaaacctggccacatggctctaacataactccaaaggaggctgtaatatagaggttaatgccatctataggacatagttgaggctctgaggttaagcaacaaaaataaattttccctcgcgtcagataacaatgtgaggcacactttcaggaacttgtcaaggagcttggggatcagtgattgcaatgctttcccacatgattaatggtgatatagaagatagaatattttgattataggggaaggaaaaaatggtatatcagaggagccattatcccagtagagtgaggcaggattggtgatgatagagttaaggtgttatgactgaaatctataaaataaagaaatggcaatttaacttctacagacactgggatatatatgatatggtataagaaatgggagattgtgttagtctgttctcacattgctctaaagaaatatccgagactgggtaatttataagcaaaagatatttaattgactcatggttctgcaggctgtacaggaagcatagtggatttggcttctggggaggcctcaggaagcttccaaccatggcagaaggcaaagggggaacaagatgtctcacatggcaggagcaggggcaagaggaagagaagggggaattgctacactcttttaaacaaccagatctcaggagaactcactcactttcctaaggatggtaccaagagggatggtgctaaactattcatgagaaagccaaccctcatgatataattacctcctatcagaccctacctccagcatttgggattacgattcaacatgagatttgagcagggacacagatcaaagctatattaaagatcttctcagggttataataaaagcactagtagttgtgataagcattgtgaacgtctcagaaaagtggttaacaaaaataagtgatactttagaggacagatgtatgatgtggctaaagtgagaaagcaataaaatgaattcctctctctttataaaaatacatataaattaaataaatcttcaggttctaattttgataaatcctaaaaagtaatattttagttacttaattattaagtagttaatgatttttaactatgttcaaagcgtttgatatgatatcattattggtgtcttcatatacttttccattcacttttgattgtttgcttattcattatgtacggaaagatacaatatttagcctcgactgaaattgctgttgtccctcagaatacatttaaattgtttgactttgtaaatgtacaagttatttattcccttattcttctttgtaaatttgccttctttgtattttctgaaaatatttcaactattttcaggtttctgttatctggatctagccatgcaaagaaaagttgtcattttccatacctttaaaacttaaaattgacaaccattcccaatttatttcaatttctaggtgagatttagagtttcatttatgatggaatgacctccttagggacagacatctaattaatagttaattcatttaagaaattcaaggtactgtgtttcttctccctgctcccaaagagcttatagtccaatcagggaaacaaacaggaagtgattgcaattcagggctgtgtgctaagtgagaaataagcaggaaacgatgcgggagcacaaagatgggcactagcctggaccagagttgggcactgatggcacccaggagtgctggcccagccagtgtcaaaatcttcaatgaatgtagcaagaacagaggaactaacaatgctaaagcatgtgcctcctatgagcaaggattgttcagtgagggcagagtggccatgacctgaaagcaagcctgggaaaccagtgctgatcgtgccccactacccacccttgtgataattaatatgcaggataattagggcagaagagaatgaccaggcaggccttcattttaacatcctgaattactttggattattcattttagatgtaaagactttttaatttcatatttatgcaagacttttctcagatttatgaaacaaatttgaaaagtcagaatattttggaactaatggtatattttacgggaaaatggtgaaaacaacagctttgtaaaaatataaaggctgattacaaaaggctgaatacatatatattttatattatatatgggtgagtatgtttataaaatgcaaacaaatttatatgtaactattgagaagttttagtttttaatattttcattccatagaataccatggtgtacacagtattaatcatggtcactttgtttcagaaatgtaatgatcctgttgctgtaaaggaaaataaagaaagagggggaaaatgcacttaataaatgcgttccagagtaatgttcatagaaataaatcttagtccataatcatgagaatgaagggttgataagttgccagaggaaaaaatgatttacagtaatatgaattttaacacaactgtaattacatttaaaatttcaatttgtttaattgatgtttctccaaacttattatttttaatactcatcattatttatataccttcaataattattttttaaattccactaatttatatattaatgaatttgaattgactggtttgtatctgtgggtttttagtactgaactagatttctgttaattgtagagcacttcatccatttagaattttttagtctagttagatgcagtaaaaactggtgtgagtggttggacaggaaacaatatttcaattttgtgtctaattttttgagtgatttggataaaataaaaacatttgtgatgatctaatcagtgggataaattcatctgaaaatctttatatcaaataggtaagttagcaaacatgccaaactaaagaaatgaaccacttctattttagcttgactttcatttgctacaattattttttatcctaataatattttttgttctctgcattttagatgaaatgaatattgacatgtatatatttatgaatacatttatgtttgactgtgtttgttttattttagagtatatgtcaatattgtgtgttttaaactaatccttcaaagactaggaaatagaactctataccttaaccgatcagtaggtacttaagcactaaagaaattcctcttgataataaaatacttccaaactactcatgtttgtatattaatattgctgaaatgtttgtccttctttctctgggatgaggtagcaatgattttattttagtaattgaagtataattcttttcagaaaatggaatataaagttagtctttcaaatgaatgggaaattctaatttacaagaaaaataaaagcactctgtaattgcctatgatgtactacttctgcctgtgaggttgcatttctctgtaccttaatacaaagtacagtaatagaaaaatgattcagtaagtgtaattctattactttctaatatgacaccaatatgatacttttaatgaatgaaatacaaagttattttaaaaactgcagatttgtcattaactaaaaaatgttacattttatgtgttagagtgttcttattcaactatttattgctgagtattaaattgcacacttcaacaccgtgtgttattgcacagtacttaacaaatagtaagtccagaataaatagttattgactgaattaatttattaatatattcaaggctgttccaggtgttgtgggagctgcaaagggtgagtaatacaccatagcttctttcaaaatgaatgatacaagtaagaataatatgagatcacatgggaagaaattaatgttgaccgtagccaatgagagaatctttataaaagtcatagaatataagttagatattgaggatagggtaaataaaagagaaatttggctaaatttgcaaccgtggaaaagaaagaaaatgtcaagtaaaatcggaaaggttaggcttaaaaaaaacattttgaaacagcacagtaaagtatcatttgaatacaaaaggaattatagataggcaaaatgaattacagattatcatgaataatacgatcaactttaccctcactttacagcaaaaagaatcacaggccaataggtgagtttacatgtttgagattccatagaaaatagtaaaaatggtagcataactgtttgggaagtcataaggaaagaagtcaagacttctctttcaaaactttccaaactcacgtatattcaaacatctggaaaaatgctagcagccttctaaagaaatggctcttagtatttgagaagattacctgtagtattaccaaaggccacacacacacacgaagggaagcgtagtggagaaagttttattcttcaggccaaaaacacatatatttaagtcttggttcagccacttacttgtgttatggccttaagcaaactatataatttttcttcctttcttttttttttcttttttaaatacaggattttgttttgttgcccaggcttgaggacagtggcacaataataggtctttgtaactgtaaagttctggactcaatcattcctgctattgaaggctcctgagtagctaggactacaggcctgtgtcctgccaccatgcctggctaactattttaaattttttatttattttcttatttttatttttgtagagacagggtcttgctatgttgtccaggctgcgcttgatctcctgggctcaaacaatcctcccaccttgacctccccaaactctgggattaagtgtgaactaccaggcccagccaagctgtttagtttttcgaaccctcgttttttttgttgttgttgtttgtttttttggtgcaatcattttattttattttattttatttttttaattatactttaagttctagggtacgtgtgcacaatgtgcaggtttgttacatatgtatatatgtgccatgttggtgtgctgcacccattaactcgtcatttacattaggtatatttgctaatgctatccctcccccctccccccaccctttgtagggacatggatgaagctggaaaccatcattctcagcaaactatcacaaggacaaaaaacaaatcaccacatgttctcactcaaaggtgggaattgaacaatgagaacacttggacacaggaaggggaacatcacacatcattttttatttttaaaacaatgtatgcctttctggctgttaggatccatttagaaaattttttcttgcaatgcattcttagaagaatgggctaggtgattttcctaaagtgaatatctgagtatcttacattctggtgatttctaaacttcttaccggcctgaaaggtattacaagacctagacactgtattcctctctaacttcctcttggagccactcctctctgttccagtcatccaaggcttctctatgccccactaatggaccaggcttacacacactttacattttaatttttatttcaatagatttgggggtgcaggtggtttttggttacatggatgaattgtatagtgaggaagtctgaacttttagtgtacctatcatctgaatagtgtacctgtacccagtagataattcttcaaatctcactcctccttgcaccattcctctgagtctccagtgtctattataccactctgtatggccctacatatccatagcttagccccaacttataagtgagaatatgctgtatttggttttctgttcctgagttacttcacaagatagtggcctccatttctatccatgttgttgcaaaagacattatttcattcttttttatggatgagtagtattccatggtgtatatgccacattttctttatctactcatcggttgatggacacttagattcattccatatctttgcaattttgaattgtgctgtgataaaaatataagtgcaggtgtctttttgacataatgacttagttttctttgtgtagatacccagtagtgggattgctggatgggatggtagatctacttttagatctttgagaaatcttcatactgtttttcatacaggttgtactaatttacattcccaccaatagtatataagtgttccttttttttttttaaccatatctgtgtcaaagtctaatgttttttgactttttagtaatgaccgttctgactagggaaagatggtgtctcggtgtagtttttttttttttttttgagatggagtctcactctgtcgcccaggctggagtgcagtggcgcgatctctgctcactgcaagctccacctcacgggttcatgccattctcctgcctcagcctcccgagtagctaggactacaggcgctcaccaccacacctggctaattttttgtatttttttggtagagacagggtttcaccgtgttagccaggatggtcttgatctcctgaccttgtgatctcagtgtagttttaatttgcatttccctgatggttagtgatgttaagcattttttcatatatttcttggccatttgtatatcttcttttgaaaaatgtctattcatattgtttgcccactttttaattgattttttcttttttcttgctgatttgtttgagttccttgtagattctctatattagtcctttttcagatgtatcatttgtaaatatttttcccagatacctgagagtatgtttaaccaaagaggtgaaagatctctacaagaagaactccaaaacactgatgaaacaaattgtagataacacaaacaagtggaaaaacatctcattctcatggattagatgaatcaatattgtgaaaatgaacatactacccaaagcaatcgacagattaaatgcaatttctatcaaaataccaccatcatttgttcacagaattagaaaaaacaatcctaaaattcatatggaaccaaaaagagcctgaatagccaaagcaattgtaagcaaaaagaacaaatctggaggcatcgcattaccttccttcaatttacaaggctatagtagcccaaagagtatggtactggtataaagcagatacgtacacaaattgaacagaatagagaatccagaaataaagccaatatctataagcaattgatcttctacaaagcagaccaaaacatactgggaagaggacaccctattcagtaaatggtgctgggacaattggagaggcacatgtagaagaatgaaactggatccctatcactcactatacagaaattaactcaagatggattaaagacaaatatatgacctgaccccataaaataccctaaaaattctaaaaggaaacttaggaaaaactcttcaggacaatgacctacaccaatgatttatgactaaaaccccaaaagcaaataaaaataaataagtaggaccaaattaatctaaaaagcttctgcataacaaaagaaacaatcaatggagtaaaaggacaacctacagaatgggagaaaatattcacacctactttagatgaattgcacctgctgtttcctattttgggaatctttttccttctgattttcatatggctgctgcttatcattcttgactcagcccaaatgacatctttagaaagacattctcggcccacctaatgtaaagtagctgtttcctgcaactaatatggtgtttttttatgtcatttatcagtagctgaaatgatctgttcatttgtttatatatttgtttattgtctaggttaggaaacttttctttcttgttcattgttcagaacttagtactatcctagttggtaagccctcataagagttaatgaataaggaatacgttaatttttattaccagaattatgagttcaatatggaagatttggcggaaagacataaagaaaaaccaggaaggctttaacctagacatatacaaacattttggttattttaacattatgttactttagtaaaatatttgtttttatttttcttaaaaaataagcaatgattaaaaaaaaacctctatgatactccttacctgcagatatggctctaaaatatgacaaaatagaaaatggcacctttttttaactttaggcttaaataatttaaataaggctagattagaagaaagccatgcagagcctatggaaacatagtgtatgtgtaacaaagaatttgaccttgccaaagaaaagaggtctgtcctttgccctcggtttctgagaggtaatctgtgtcatacctgataggagtgtctttgtttagaatggaggctggccacacttaataatcttagagtagaggctgactaagccagaaagatcaatcatgtgatttaggatggtggctttgggtcatgcaatatcagtcaacttggaggctgagattaaccatgtagtcaatcaatcaatcagtcaatgatacctgagtaatgaagccttatgagaaactctggacattatagctcaggcaagcttccctttttggcagtactccatctatgttgccacacatcaattccaggagggtaataggtcctgggtacaacagaagcttacatttgaatccttccagtttctaccctatgtgtcttttcccttggctggtattttatctgtaccctacctccataataaaccataaccaaaaacatagctttcagccagttctgtgagtcctttcagtgaatgattgcattagagggtggttttgtgaatcctgcaatcttgctgttggtgtcaaaagcaaggacagttttgaggactgtgctctcagactttgagtttggctatctcttgctagtatatcaccatgagaaagaagatgttggttgtcttatagatgttaacattttagacttgaacggcttgcaggtaatacctattctaatatttcattttatggaaaagcatgaaggagtttatgatttgctttagttcacaaggctgctttagtgactgggtcagagttagaaatcaggtttatcaatctcattattttgggtttcccactatatactgtgttatttgacacaagagtgacatagtaagtatcacttgagtacaagtgatgtttgtttgtttgtttgtttgtttgtttattgagacagagtctctgtcacccaggctggagtgcagtggcatgatctcagctcactgcaacctttgcccgctgggttcaagcgattctcctgcctcagcctcctgagtagctggtattacaggtgcctgacactgtgcccggctaaattttgtatttttagtagagacggggtttcaccatcttagccaggctggtcttgaactcctgacctcaggagatccgcttgccttggcctcccaaagtgctggaattacaggcgtgagccaccacgcccggcccatttgatgtttatttttaaatattatgataatttttttttttgagacgaagtctcattcttgtcacccaggctggagtgcaatgtcgtgatcttggctcactgcaacctccatctcctcggttcaacggattctcctgtctcagcctccaaagtagctgggattacaggtgcctgccaccacatttggctaatttttgtatttttggtagagactgggtttcaccattttggtcaggctggtcttgaactcctgacctcaggagatctgcccgccttggcctcccaaagtgctgggagtacaggcgtgaaccacctcacctggccctatgataaatattaacttataaattagtaagatgtttatctcatagtattgtatattcaaagataaacttagaataaaacttgtatcttaattacaggaaaaatatccatgccacaaaaatgtccattttttaagaactacaacgatttttaacaagaaggtcttaattttgctttgtgattaacattatggccactggtttaacaagttaatgtattaggttctctttggctaactccagcatatgatgagataataacgtgatgggaaattcatacaattttcagaattatacacactgacagttgtgaaaaataaacatttccagtgaggctgacatgacaactttagggaaaaaaagcaagcattactcggaaatgctaagacaactaagcaagtatagggctatatagcaagtaaatgtctttaaacattcctctgtattacatatgagtgctttttctggataatgtattttcatcaaaataaccaacatattataaaaaatgatgctttaaaaaggaaactgctgttcttcatcaaaatagtttggaaacatgacatctcatttcctgtaattaaatgagttattattatcatttagtgacatcataatgggatattattaggtaaatgagatattattttctttacattatagtgatacaacagtagagactctgaaacctcaagaactgatcagatggagcacaaagagtgagatagttatatttctccagacttttctagcaggaagtacaataaatagtccgtatttattcctttgtaactatcttctacttaagtggacacagcacatggtgtgtctgttctgtgagtccagcacatgctgaacataaaaacaagtattttttaatttctagtttttttttaattaaaagtattatagagatgcagtcttgctatgttgcccaggctggtctccaactcttggccttaagcaatgctctcataaaggtaattcttttgagaaaagctttttaacttgtctgtcattatcatgaggcatttttagcacctattatatgtattgtaaagaaaatctgtcatataataaaatctagatatattaccttgtgtttactctaccggcatttgagaaaaggggatacactcagtaaaggtgcaatgaaagaaattcaaatgacatttttagaaggcagtatgtttggctaaagtctgcaggaatcaattttgcagaggtagagataatgtaggcatttgagtaacaagggatttactgtttagtgttctgtagacacataccatttacatctttttgtgtgttgggcagtgaatatatacaaatgagaactgtatttttcatttcttaatttcaacttttattgaatattcgggggtacatgcacaggtttgttacatgggtatcatgatgctgaggtctgaggtacaatagatcccatcacccaggtaggtagcattgtacccagtggttaggtttttcacccttctgaccctttatctcccacatgccaagtagtccccagtgtctattgttgccatctttttgaccagtattacccaatgtttatctcccacttataagttaggatatgctatatttggttttctgttcctgatttaagttgataatggcctccgcctccatccatgttgctgcaaaagacatgcttttgtccttttttatggctgtgtggtattccatagtgtatatgcaccacattttctttatccagtccaccattgatggggtcctaggattattccatgtctttgctattgtgaatagtgctgcaattaacatagatacaagtgtatatatctttttggtagaattatttattttctttttgatatataccagtaatgggattgctgagttgagtggtaatttcgttttaagttctctgagaaatctccaaactcttttccatagtggctcaactagtttacattcccaccaacaatgtacaactgttcctttttctgtgcagccttgcaaggatctcttgttttttgactttttaatagtggcccttctgggctgggcatggtggctcatgcctgtaatcccagcactttgagaggctgaggcggacagatcacctgaggtcaggagttcaagaccagcctggccaacatgatgaaactcccctctactaaaaatacaaaaaaaaaaaaaaaaaggctgagcatggtggcatgtgcctgtaatcccagctactcgggaggctgaggcaggagaatctcttgaacctgggaggcggaggttgcagtgagccgagatcgtgccattgcgctccagcctgggcgacagagcaagactctgtctcaaaaaaaaaaaaaagaaaaaaaaagaaaaagaagtagcccttttgtttgtaacacaaagaaatgataaatgtttgaggtgatgaataccccatttagcctgatgtgattattacacattgtaggcttgtatcaaaatatctcatgtaccctatatatataaatatatgggggtatatatatatatatatatatatatatatatatatatatatacacacacacagtgggtaaatatatatatatatatatatatatatactgtgtactcataaaattaaaaataaacaatttaaaaacatcaatagtaataatagccattttaactagagtgagatcgtatgtcattgtggttttatattttacaaatgggtaatgagtagtgtgtagaacaaattataaatgagagttgaggaactagaatggtggctggcagaagtttatgggaacacagattagaaggtaatgaagtacactttgttactgaaatattcaattcctctagtacacaaagaagaatgaaggttagaaataatcacttttcccagattttttttatatgtgaaagttttaaatattttaactcttatattattttcccccttaccatgtttatcacctgccaaagaactacagtataattgaggtattttattgaagagaaatgttgctttcagtggagttgactattttataaagaatatttaagtattgctttattgaccgtgatacaaactcatgcagttaggtttagaatcaaggagatggtgtctgtgatgttagttctactttgtcatgagagtagaacctctattatttttgtttttcttctctaatattttaagtgataaaaagaaaaaagcatgaatttttaaactaacagcagtcattaaattttaactttgaaataggaagttttctacttaagtaatatatttatactcatcagttttctttttctattacttaataataaaattatatttactttattcccatgcacacattaaaatgaaagtgttctgagtttagttttaaattttgtatggattcagatattggtttaaattcatataaattatgaatccatataaatattagctttttctaaacagcaaagtattatagcataacttttaagttttagtattttagtagtgtgctacttggaaaaattaatattgtaatttaccttttctcagcataagaggaagaatgaaaaattctgggcatacctttcagaatctcattttgctagatatttcacatttaaatacaaaaacacacagcaatccaaactaaatattctcctttgcaaaaatgtataatgacatcatattataataaggaataacataagctctctattcatatttgcaaaatatatgtttttggacttgtaatgggacttgcctccagagcaagaattcatagaattaagacacatttttgaaaatattcatgaaagatgtattttgagttactcaaaaccataaggtaaatcaatacttagcaaagaacaagtgaaaatactttgtggctgctatgctgagagtttaaggcaattctatcataaggattgagtatgctttcttaacgcaatccagaaatcagagccaaataactatcctcagagcagtaattatataatattgccaggttaattgtcttttcaaaaaataacagtgaaatcacagtattaaaaatatatgcactactggtgtattgttttctcttctccactgcatacgtagtgtgtacaactcaacttttaccaaactgtatgtacccagtctattcctatgtcttgctcttgactgtgtcaatgatgaaatcttgtcacttgtacatctctcatttttttgcaatttataatttatcttcctgggataatgtgatttacttaaggacacttacctaattagtttatctctttttttcccaagtaaaaaggcaaatgtaattaattgtaaggtaagtctcagaatgtttgtgtttagactgacacagggaagtttgactgaggatcttctacaataactatgtcacaagtgttttaataataaaactgtgtttccctgtgagtcactctgtagaatcctatggttggaatagtggagacggaaatgtatatcttggcagcacctgatcgtaaggtagaatgactagaagaatgctgactaggctgtaaacgtcttattaatttaaataatcctctccatttttagacctcacaatgattacagcagttatactatgtcaagtaaatataaaataaaaaaccactgaagtccaaagcagcatgtcaaatattgcccttagatattttaggcctgttctgatagttatttgactaaaatataacagtatagatatgtgattaataacttctctatgagacataattaatgactgttttagtaatttaaaaatattaataaagagattcatgaaactactgggttgtttgggaaccgactttatacaatagttatatcttccttttttttttttttttttttttgggacaggaccttgctccatcgcccatgctggagtgcagtgtggcacagtcatgactcactgcagcctccaagtcctgggctcaagcagacttcttgcctcagccccctgcgtagctggactgtaggcatgcaccaccatacttggctaattaaaaaaaaaaattgcagagaggggggtctcgctgttttgcccaggatggtcttaaattcctggctttaagtgatccttgtgcctcagcctcccaaagtgttgggattacaggtgtgagccactatgcccagctgaatggttacatcttacttttttttttttttttcaattctgtagcttcagaaattcattatttctgccattaggaacaatgatctggagaattgattcacactaaccaaacataaggggctgatttataaatcatatttgatttacttatgaaaggcattgctatttttttactagaatatagttatctataagatatatgaggagagacaccatgccctttacattcattgtcatatccctagagcttagaaaattaattcttgaattacttcactaataattactcagtttagtcttaatgcctcttgatatcaagtcatttgggagattacatgagtagtcagtatggctgaaagatttgtaaatgtctccttttgaagagaatacttcataacattgtgtttggtttagtatgtaatttactaatcttttgacttttgttaataattagcatttccttacagttaaacaaactcttctaaaaatagctacataaatcttacataccaattaattagaacacgtattacataacatttttgatggcctttatatatttgtttaaattttatataagtaaattctttccagtgtgtaattaaaatgcccagtgtaatatatcaatttatcttaaatgctttaaccactttaatgttatttattttatacatatatctttattttttatgattctatgacatttcatgttattagttgaaaaataaaaattctgttttatggattcatggtgtacaacatgattttgatatatgtgtacactgttgaataaatcatatttgtcttcctggataaataacatagccatcacctcacatatttatcatttttgtggtgaaaacattttactttctcagcaattttcaagtatacaacacattattattaataatagtcaccatgttgtacaacagatcttcagaacttacttctcctaactgaggctttgtacttttgtccttgatctcccttttccacacatacctcagcctctggtaaacaccattcaactttctgcttctctgagtttgtttggctgtttaagatttccacacccatgtgagatcatgtggtatttatgttctgtgcgtgacttacttcacttagtgtaatgtcctccatgttcatccatgttgttgtaaatgacacgatttcctacttttagccacttttaaaggagaaaattgtacatgttacagtgatccaaaagcaaatcagtatgcttccattaaaactgattacaaatgtattaatgctaggcatttatatttcttttcatctttttcttgtttttacattttgcagatgtagcatttatatttctctgggatttcagaaatgtaagacaagtccattttttcactttcttaggctttaaccaaactaaacctacatgaaagccatctcttaaatgttaaaattctgagttgtcaactagatgactgtttggtctagtgattggaatttgctgtatattcagagaagcttcaaacccaccatactggccataatgttggagtttgcttttacaattaaactctacttgctatgtgctcttatgtcttttttttttttttaagttaaagcccaccttttaattttgtgtaatatgggtgtcctctcacaaaatgattttctttttaaatcccatttgcttgtgttatttaacacttttcttgttcctgctatgttaacattattaaaaccttcatgcctgtaatcccagcactttgggaggccaaagcggcagacatgaggtcagaagttcaagaccagcctggccaacatggtgaaaccccgtctctactaaaaatacaaaaaaaaaaaaaaaagtagctgggtgtggttgtgcatgcctgtaatcccagctactctggaggctgaagcaggagaattgcttaaacccagggggcagaggttgcagtgagccaagatcgcacccctgcactccagcctaggcaacagagaaagactccatctcgaaaaacaaaaacaaacaaacaaacaaaaactcatggactttcattattatttctttattatgtagggctatctagtgattttatctaccaggagatgagaaactattttttcttagttatcactctacttctacattctgctaatttatcaaatgtctgaaatgcataattgcaccctcttatatttgagatatcatcattagtgttaatcaattgctggatttctttttttacctgattcctacatgtgaccattggtgctaaacagttttttctattcctagtacagtactacttttggtactactggtttacttacagatccttggctatacagacagaaggaaatacatgactacattttataaacataagtataataagaaaaacaaaatacccatatataaactgtaaaaccaatataaattaacaattttctactcaatttgtattttttaaattagtagtacctttttatatccttcattttttcttttctagaaaaaagctaaccttcaacagtctcaaattattctatttagtcatactgattacttttttttcatgctcatattgccagagattacctagggagaagccatctaagttgctttccttatctagcttttgaaaacagccactaatttttttcttaggtgaattttgttttctcggcaacaaaatgattgtcccagaaacattgttttatgtctttcttcttttctttctttctttctttcttttccctttctctgataagtaaaggaccttgatttttattagcattatttattaatagatattagtcagcaagtatccagctgctaggactgaccaatatcagtgctagctgtcggcaaaaggactgttgctgctattggtgactgttgctgctattggtgtcttttagggagagatctggaaaagatgtttttaggtttatgaattcaccattgattattttctgtaacatatcatgttgctgcatctactgttattttattatgaagtttcaccagcttcaaagattctcctctacagtaacaagaaagttgctttgtaagcacaatatcaaaggaaggcaatttagaataagtagatttaggaagcaattcatctagaccagtggcaaatggaaccctgctagtccaagtgtcaagtgttacctgcaaaaggaaaataaaatgagaacaatgtcgtgaattttccaaatttagtttgttcactttattggtgttgctgtcttatgtgaaatgttagaatagcagtggcagagattttaatatttccctgttcaaaaaataaaatattttaaaattttatttcaaattgtgggtgaatgtattaactgtcagaattcaaaaaaggattgaacaaccaccttgaaaacatcatgtatgcctctggatctcaggaactgctggaaacaggaacaacatgacctacctatgacattttttaatttttcaagtaggcttagactggtcttgactacacaattaaatccatagcccctgtgatgacagtgttttgcatcttgcagtatgtatcaccagacagagactttttttcatttctgggatggggctttggtcaccaagtttggttaagatgtccatcttggaccgttcaccaaggagaaggagtttggctcatataagaatctggtagctccctttatagctagatggattgggtagggtggttccaattaaaaaggaggaatgctgtgaaaatctttttctagaagtttacaatgtctaagatgtcctcacttggtataataaaaaatggtagttatgtgctttgcattcatttatttcctttgttctgtccttcactgctttctaagtcttgttggttgtattggtttgccagggctgccataacaaaatactacagactgggtggcttaaacaacagaaatttgttttctcacagttctggaagctggaagtccaagatcaaggtgatggcaagtttggtttctcctgaggcctctctccttggcttgcaaatgacctatcttccctccctctgtgaattcacatggttcatcacatctctgtgtcttcatcactctctgtgtgtgctgtctgtgtcctaatctattcttataagaacaccagtcccattggagtgcccatccatatgagcttgtttaacctttattgtctctttcagggctctgtctccaaatgcagtcatattctaaggtactgggggttaggattttttataaattttggaaggatacaattaaatcccatgaattcaaaatccaagtgtaaaattatttaccccaattagaaattggataaattagtatcctttcactataaaatgtattttgactaatatattattaactaccaggttaagagtctctcatttggatagtgtgtttgataaacactcacatcagtgtcttcacaaaattctccctttaaaaagcttttccttttccacaacttcaattatgttttgttgttgttgttttaattttctgttttgcatttttagtacgacagcttatcttttgctgcctatattttctcatttttaaatgtatatagataagtagtttattcttattggactatcgctgacactgtatggaacagagcttccaataaacaagtgattttatttatagtttaagttattcattaccttcgtttggagaaagaagcacttagatttgggtatacttatcacctttcaaaccatggtatgtgcactattcatggatcccacgtgtttttaaagtttaataatgtttaatttgaattgttaaagaggtttatttaaaagccccagtgtccttacttttaaacccaaggactaaagtgttcactgtctatttgaaaatattattagctttccgtaatgaatactactttaactacaaattatgctaacattcgaattagctgaaaagtgacctgagatggcatgccaccatttagtatttaggctgtttttttgatgtctttgatgttctatttttctgtacatttgttatttcattgttagtctctaataagttcttacttttcttaatatacttatcacccatttatatatatacaaatatacaaatcaggactttattccttcttcagcaattcctgcctgtgcacttcagcacattaccatctcttctcaagacttctcagtgtagccttctagtttattttgctatttgccctcttgaaaataaaataggaaacataatctcagctctgatatattatggtataatgcaagtcaataattaattttaatcgaattaatatagattgttttcctgcccattcttcctgatgtaaaacaaataattggcaaatggtagccaaattttcacttccaagcatggtctaaattaatatttcacagttgtcacaatatacaaaatttgtttgaaaaacaattcattaaatgtgttagaagaatgttacctacatttgaaatataaatattagaaaaagtaactggagtttcatttcacagacttctatttgaaaaatgtgtatatactttttatgtgtttgcagtgagcaaattcctttttaatatcactaaagaagtttttattcaaataaacacttacctgtatttctcatatcaagaaatcatttcctgacttctaatatctttcatatctgcccatatgtacttccatttaattataagttacataaatatcattaaaaaagaaaaaaaatgaatgtgcagataattggaaaagttaagaggttttagaataagtcttggaattttttattggactgataattttaaagcccataggtgtcaaatgatttctgagactcagttaaaacttttcattctgatttggaattcatttttgcttcacggcttccacatatgagtatttcctcatttactcagtgttttggtttctaattgttggttttgatttttcttcaggatgttttgaataatttgggatcttgtgaactggatgaagatgatctaatgcttgatcttgaatttttagaggaacagagtcttcacccttctggtaagtgttaaagagatgaataatatcatacaactcctaccctggtcagtagctttcactgatagcctaaacactgttaaggctgccttctatcttttcaggcctcagtttttatagtctatatgcaaagaacatgctaggtaccatggagacataatttgggtgcgttaaatgattttaaagccttttatggaaatataaatcctgttggaagataattataaataagaaaaactataaaaaaatctttccaaaataggaaatattctagttaaataattaacaaaaagtttaatattttcttctgttttgtggaagaaagcaataattataatctcacttttcatttattttatataaccaaatggaagttttgtggatctaagatttactgctccaaatcttagccacttcctacataggttaatgttgatgcaataaggttgatctcaaaagtactaattaccagtagcagtcacaaatgcacactcataaacatatacacacacatagagttagagaggaggtaaataagtttttgttgaatgacttgagggagcctgatatatttgtaatggcttaaatttatattaaagcataaaatattatgtctccaaattccagaattactctctttaaagttggttataggaattattggtcgtccattcaaatttagatatttgacagcaaaagtaaacatttacacttaatttttttgttgctaataatgtctttaacatagtcattttcaagtggatatagcattaaactaaagctttagaacgttgggacctactgcatacatttaagaaaatcagtctcttatatggtagtgtctttatttttaattcgtggaaattagacataacctctgtagttatttttagttgtaaaactttatgatgaattttcatttatgtagtatatttggataatagataatatcatattatcaattgtcaaaagaaggcaataacaatgttgatattttcttacactctattttaggctaataccaaacaagaaactgcatttaaaattttttcggttgaataccactttatgataaaaatttcttgggacatttttcctgtagttgatttgacagatatccttctaaaaatgtagattttcacacttttatgcagatggtttttacaacttagatccaacaacttaacttctagatatctaattctatgatactggcaaaagacaaaatagtacatgcatataattattcactgcaaaatatttataatggaaaaatattggaagcacctgaaatgctcatcaataggatacttgttgaatatacaatggtttaccgaacagtcattaaaaaggaggaggacagtatccaaatctgctatggcattattgtaaggatatattatttgtttttgttttgttttgtttgaaacaaggtctggctctgttgcccaggctggagtccagtggcgtgatctcagctcaccacaacttccgcctcctgggctcaagtaaatctcccatctcagcctcccaagtagctgggactgcaaatgcatgccaccacatccaatttttgtattttagtagagacagggtttcaccatgttgcccaggctggtcttgaactcttaggctcaaaagatccacttgcctccgtctcccaaagtgcagggattacaagtttgagtcaccatggccacccgattgtaaggatgtattgttgatagagaacttttcttttcaaggatggattagatagggaataccaaaaccaaacccactgatcaattctctaacatcacaaaaagtgtaatgaatatatagtttgcccctcttgatgcaatgctgactgaagtacaacagcacaacctctgaagtgttcgtgtcctctcaccccttcctatccccgtcccagaagaaataatccattcaaatagttcaaactttgattttataggaattattggaatgggtggagggaaaatgttaaatgtcataaaaagattgtgggcaaccaaatataggatttggagattctgcaagataaatggtctggtttcttcaaaagataaatggcatgataaaataggaggagttggagttgtaggttaaaagaggcaaatgcaattgacattcttgttggtatacttatctgaaatatataaactttttctataaagttgtttctgagttaatcagagaaattagaggattgactgttactgcagaattatagttaattttattgggtgttgaaatggtattttgttttgtttagtttttttcaggaaaactttttatagagataaatgtggtggtaccaatatcgtatataggctttgctttaccaacaagtatgagtaaggaaatagatgaaacaaagtagacaaattcttaaaaattgtcaaagccgggcaagagttgcatggggtgaaaagttcatgaattaattataatattctctctattttgtatattttttgaagattttcattgtaaaaaataaaacaaagcaacaattagaaaacactacagttaacatagcagtctcaattatgtttggtagtcaaccacaatgacgagaaaataatgatttaaatatctgaagacttatttcagtgtgtttacttggggacaaaatcaacctctttaaactttagtctctcctttacgaagtaataatggtactgtgtacttcattaatttattttaaataaaaatgaaataatttttacaatgaatctcttgagtctactttaaggtgtaggttgcttagttaaagctcaaaccagggtacctgatgaatcaactgagtcatataaattgttcacaagataaatggtattagtttgcatacatgaagtgcaattctaatagataaaatattacttagagtgactttggattgtttaatgtcacttaataaactgtcttttgaaaatctatttcattttagatgccatgttgtgtggtttttaaaaagcagcaaacacgtttatatactttagctgagaaagaattatttccagttgaattggttttatacaatttattttatttattaagcaacataattaaagacctcagattaggccgggcgcggtggctcacgcctgtaatcccagcactttgggaggctgaggcgggtggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccaagatcccgccactgcactccagcctgggcgacagagcgagactccgtctcaaaaaaaaaaaaaaaaaaaaaagaaaaaagacctcagattataagaagcttatgattgataattgatattgataaaaatcacagcattaaacattcaaaaatgatgtttttaataaaagaacagcgattttcaaaagtctgaaaagtgaaataatgatatcattatattccactgcttatattactgaaaatcattaaaggggttgaaaaaatacttcttaaagacaatgcatatgaatttttggctacagagtcttattatggtagtttatagtagggcttactataatggccaagattgactttttaaaagaccacagaagacaagattaagattgcagatgggaggaaggactagcttgtagctcctgcttggatgaacagagcagggtgtggagactcacatcatgaacttttgctccaagaactaccgcaggaacataccaggaaagccaagagaatccacagacctttgaaggaattggatcaccgccacaggctccctgagatggcaaaaaactgtgagtctgcttgctttctcaatgggaggctcgtggtccggggcaagttctcagttctggtcactggctgcttggaaaatagactcagtgctgttgtgggacacgatgggagtgagataggcccttaagaccgtgggctgcatgggagtggggtgaggcatgtgactgacagctttccccagcttccctggcaaattatatgactcagcagaggcagccataatccccctgggaatataactccactggtctgggaaccacacccccattccccacaaaagtcacagcaagacccgctgcccaaggagaggctgagctcagaaatgcctatccctacccccacctggtggtctttctctaccctccctggtggcctaagacaaaggttataatctcttgggtgttctatggcccttcccacggcctgagaaacctgaatacttaaccaagtgtccctagggcaagtttgcatcctctctatagaactgcagctgatgccttcttgaaagtgttacttcctggctggaggctgaccaacacaaaaccagtgcactaaacaaaaacacaaccaaggaccatcacagagtccacttcactcccctgctacctccaccagagcaggtgctagtatccaggtctgaaagacctgaacatggatctcatcacaggactctgcaggctcagcccagaaccagcccagagcccagtagctctgctggttggctagacctggatgggcaaaaacaatcactgcagttcggctctcaggaagtcccattcctaggggaagggggagagtaccacatcaagggagcactctgtgggacaaaagaatctgaatagcagtccatgagtctcagatcttccctctgacacagtctactcaaatgagaaggaaccagagaaacaattctagtaatatgaaaaaacaatattctttaacgttcccaaaagaccataccagctcaccagcagtggatccaaaccaaaaggaaatctctgaattgccgtaaaaagaattagaaggtcgattattaagctaatgaaggaggcaccagagaaaggtgaagtccaacttaaagaaataaaaaacatgatacaggatatgaaaggaaaaatcttcaatgaaatagatagcataaataaaaaataatcacaacttctggaaatgaaggacacacagaaatgcaaaatgccctggaaagcttcagcaatagaatcaaacaagcagaagaaagaacttcagagctcaaagacaaggctttcaaattaacccaattcattaaagacaaagaaaaaataactaaaaaataaaaataaatcctccaagaagtttggcactgtgttaaatgtccaaacctgtgaataattggtgttcctggggcagaagagatatctaaaagtttggaaaacgtatttgatggaataactgaggaaaacttccccagccttgttagagacctatacatctaaattcaagaagctcaaagaacaccttggaaattcatcacaaaaacatcatgacctacgcacacagtcatcaggttacctaaagtcaagatgaatgaaataattttaagagctgtgaggcaaaagcatcagggaacttataaatgaaaacctatcagattaacagcagatttctcagcagaaaccttacaagctagaagggattgggttctatttttagccttcttaaacaaaacaattatcagacaagaattttgtttccagcaaaactaagcttcataaatgaaggaaagataaagtcttttccagacaaataaacactgaaataattcgccactaccaagccagcactacaggaactgccaaaaggagctctaaatcttgaaacaaattttcaaaatacaccaaaagagaaactccttaaagcataaatctcactgaacctatataacagtaacaaaatgaaaaaaaaaagtatgcaggcaacaaatagcatgatgaatagaatagtacctcatgtctcaatattaacattgaatgtaaatagcctaaatgctccactgaaaagagacagaatggcagaatgggtaataattcactaaacaagtttgttctgttttcaggaaactcacctaacacgtaagaattcacatgaacttaagataaaggggtggaaaaagatattccatgcaaatggacaacaaaattgagcaggagtagctattattataccagacaaagcaaactttaaagcaacagcagttaaaaaaggcaaagagggacactatataatgataagagtagtccaataggaaaatattgcagttctaaatatatatgcacctaacactggagctcccaaatttagaaaacaattacaattagacctaagaaatgagatagatggcaacacaataatggtgggggacttcaatacttcactgacagcactaggcaggtcatcaagacagaaagtcagcaaagaaacaatggacttaactataccctacaacaaatagacttaacagatatttacagaacattctacccaacaactgcagaatatatgttgtattcatcagcacatggaacgttctccaagaccataagacaggccactaaacaagtctcagtaaatttaaggaaatcgaaattatatcaaatattccttcagagcacagtggaataaaattggaaatcaactccaaaaggaatcttcaaaaccatgcaaatacatggaaattaaataacctgcttctgcatgatcattgggtgactaataatatcaagatggaacttaaaaaattatttgaactgaatgataatagtgataaaacctatcaaaacctctgggatatagtaaaagcagtgctaagaggaaagttcatagaattaaatgcctacatcaaaaattctgaaatagcacaaatgggcaatctaagctcacacctcacggaactggagaaacaagaacaaaccaaacacacacccagcagaagaaaataaataatgaaattcagagcagaactaaatgaaactgaaacaacaacaacaaaaaagacaaaagataagtgaatcaaaaagctttttcttcgaaaaaaataaataaaattgatagaccattagcgagattaacctagaaaagaagagagaaaatccaaataatctcaattagaaacaaaatgggaggcattacaactgataccacagaaatataaaagattattcaaagctaccatgaacacctttacacacataaactagtggagatggataaattcctggaaatatatgaccctcgtagattaaaccaggaggatataaaatctctgaacagaccaataataagcagcaagcttgaaatgataatttaaaaactgtcaacaaaaaaagtttaggaccagatggattcacaactgaattctatcagacattcaaagaagaattggtcccaatcctgttgacactattctgaaagatagagaaagagggaatcctccttaaatcattctatgaagccagtatcaccctgataccaaaaccagggaaagacataacaaaagaaaactacagacaaatatccctgatgaacatagatgcaaaaattctcagaaaaatactagcaaactaaatccagcatcatatcaaaaagatgatccagaggtggagccaagatggccgaataggaacagctgcagtctacagctcccagcgtgagcgacgcagaagacgggtgatttctgcatttccaactgaggtactgggttcatctcacgggggagtgctggacagtgggtgcaggacagtgggtgtggcgcaccctacatgagccgaagcagggtgaggcattacctcacctgggaagtgcaaggggtcagggaattccctttcctagtcaaagaaaggggtgacagacggcatctggaaaatcgggtcactcctaccctaatactgcacttttccaacgggcctaacaaacggcacaccaggagattatatcccgcgcatggctcagagggtcctacgtccacggagcctcactcattgctagcacagcagtctaagatcaaactgcaaggcagcagcaaggctgggggaggggcacccgccattgcccaggcttgagtagctaaacagagcggctgggaagctcgaactaggtagagtccacccagctcaaggaggcctgcctgcctctgtaggctccacctatgggggcagggcacagacaaacaaaagacagcaataacctctgcagacttaaatgtccttgtctgacagctttgaagagagtagtgattctcccagcacgcagcttgagatctgagaatgggcagactgcctcctcaagtgggtccctgacccccgagtagcctaactgggaggcatcccccagtaggggaggactgacacctcacacggccggatactcctctgagacaaaacttccagaggaacgattaagcagcagcatttgcggttcaccaatatccactgttctgcagccaccactgctgataccgaggcaaacagggtctggagtggacctccagtaaactccaacagatctgcagctgagtgtcctgactgctagaaggaaaactaaccaacagaaaggacatccacaccaacaacccatctgtacgtcaccatcatcaaagaccaaaggtagataaaaccacaaagataggggaaaaatagaacagaaaaaccagaaatctaaaaatcagagcacctctcctcctccaaaggaatgcagctcctcaccagcaacggaacaaagctggacggacaatgactttgatgagttgagagaagaaggcttcagaagatcaaactactccaagctaaaggaggaagttcgaacaaatggcaaagaagttaaaaactgaaaacaaattagatgaatggataactggaataaccaatgcagagaagtccttaaaggacctcatggagctgaaaaccacagcaggagaactacgtgatgaatgcacaagcctcagtaactgatgcgatcaactggaagaaagggtatcagtgatggaagacaaaatgaatgaaataaagtgagaagagaagtttagagaaaaaagaataaaaagaaacaaacaaagcctccaagaaatatgggactatgtgaaaagaccaaatctacatctaattggtgtacctgaaagtgacagggagaatggaaccaagttggaaaacactctgcaggatattatccaggacaacttccccaatctagcaaggcaggccaacattcaaattcaggaaatacagagaacgccacaaagataatcctcgagaagagcaactccaagaaacataattgtcagattcaccaaagtggaaatgaaggaaaaaatgttaagggcagccagagagaaaggtcgggttacccacaaagggaagcccatcagactaaaagctgatctctcggcagaaactctacaagccagaagagagtgggggccaatattcaacattcttaaagaaaagaattttcaacccagaatttaatatccagccaaactaagcttcataagtgaaggagaaataaaatcctttacatacaagcaaatgctgagagattttgtcaccaccagacctgccctaaaagtgctcctgaaggaagcactaaacatggaaaggaacaactggtaccagccactgcaaaaacatgctaaattttaaagaccatcaaggctaggaagaaactgcatcaactaaagagcaaaataagcagctaacatcataatgacaggatcaaattcacacataacaatactaaccttaaatgtaaatgggctaaatgctgcaattaaaaggcacagactagcaaatcagataaagagttaagacccatctgtgtgctgtattcaggaaacccatctcatgtgcagagacacacataggctcaaaataaagggatggaggaagatctaccaagcaaatggaaaacaaaaaaaggcaggggttgcaatcctagtctcggataaaacagactttaaaccaacaaagatcaaaagggacaaagaaggccattacataatggtaaagggatcaattcaacaagaagaggtaattatcctaaatatgcatgcacccattacaggagcacccagattcataaagcaagtacttagtgacctacaaagagacatagattcccacacaataataatgggagacattaacaccccactgtcaacattagacagatcaatgagacagaaagttagcaaggatatccagcaattgaactcagctctgcaccaagtggacctaatagtcatctgcagaactctccaccccaaatcaacagaatatacattcttttcagcaccacaccacacctattccaaaactgaccacatagttggaagtaaagcactcctcagcaaatgtaaaagaacagaaagtataacaaactgtctctccgaccacagtgcaatccaactagaactcagcactaagaaactcactcaaaaccgctcaagtacatggaaactgaacaacctgttctgaatgactactgggtacataatgaaatgaagcagaaataaagatgttctttgaaaccaacgagaacaaagacacaacatacgagcatctctgggacacattcaaagcagtgtgtagagggaaatttatagcactaaatgcccacaagagaaagcaggaaatatctaaaattgacaccctaacatcacaattaactagagaagcaagagcaaacacattcaacagctaggagaaggcaagaaataactaagatcagagaagagctgaaggaaatagagacacaaaaaacccttcaaaaaatcaatgaatccaggagctggtttttcgaaaggatcaacaaaattgatagaccactagcaagactaataaagaagcaaagagagaagaatcaaatagacacaataaaaaatgacaaagaggatatcaccactgatcccacagaaatacaaaccagcatcagagaatactataaacacctctacacaaataaactagaaaatctagaagaaatggataaattcctggacacatacacctcctaaggctaaaccaggaagaagttgaatcactgaatagaccaataataggctctgaaattgaggcaataattaatagcctaccaaccaaaaaaagtccaggaccagatggattcacagccgaattctaccagaggtacaaggaggagctggtaccattccttctgaaactattccaatcaatagaaaaagagggaatcctccctaactcattttatgaggccagcatcatcctgataccaaagcctggcagagacacaacaaaaaaagagaatttgagaccaatatccctgatgaacactgatgcaaaaatcctcaataaaatactggcaaactgaatccagcaacacatcaaaatcttatccaccacgatcacatgggcttcatccctgggatgcaaggctggttcaacatacgaaaatcaataaacgtaatccagcatataaacagaaccaaagacaaaaaccacatgattatctcaatagatgcagaaaaggcctttgacaaaattcaacaacacttcgtgctaaaaactcaataaattaggtattgatgggatgtatctcaaaataacatgagctatctatgacaaacccacagccaatatcatactgaatggacaaaaactggaagcattccctttgaaaactggcacaagacagggatgccctctctcaccactcctattcaacatagtgttggcagttctggccagggcaatcaggcaggggaaggaaatagcgggcattcaattaggaaaagaggcagtcaaattgtccctgtttgcagataacatgattgtacatctagaaaaccccattgtctcagcccaaaatctccttaagctgataagcaacttcagcaaagtctcaggatacaaaatcaatgtgcaaaaatcacaggcattcttatacaccaaaggattataaatcatgctgctataaagacacatgcacacgtatgtttattgcggcactattcacaatagcaaagactttgaaccaagccaaatgtccaacaatgatagactggattaagaaaatgtggcacatatataccatggaatactatgcagccttaagaaaggatgagttcatatcctttgtagggacatggatgaagctggaaaccatcattctcaggaaactattgcaaggacaaaaaaaccaaacaccgcatgttctcactcataggtgggaactgaacaatgagaacacatggacacaggaagaggaacctcacacactgaggactgttgtggggtggggggaggggggagggatagcatagggagatatacctaatgctacatgacgagttgatgggtgcagcacaccaacatggcacaggtatacatatgtaacaaacttacacgttgtgcatgtgtaccctaaaacttaaagtataataataataaaaaaaagaattttgaatgttaaaaaaagatgctgaatcataaatataaacatcaaaaaaaaaaaaaccaaaaagataatccatgatgatcaagtggttttcatacgagggatgcagggatggtttaacagatgtaagtcaataaaagtgacacacaagcaaaacagaattaaaaacacatatcacatgatcatctcaatagaattagaaaaagcctttgacaaaatccagcattgctttatgattaaaatcgtcagcaaaatcggcatagaagggacataccttaaggtaataaaagccatctatgacagacccacagacaacatcatactgaatggggaaaagttgaaagcattctccctgagaactggaacaagacaaagatgctcacttttactactactattcaacatggtactggaagtcctagccagagccatcagacaagagaaagaaataaagagcatccaaatcagtaaagaggaagtcaagctgtcagaaataaagagcatccaaatcagtaaagaggaagtcaagctgtcactgtttgctgaagacatgatcatatacctagaaaaccctaaagactcattcaaaaacctcctggtaaatgaatttagcaaagtttcaggataccaaattaatgtacacaaatcagtagcccttctatacaccaacagttaccaacctgagaatcaaatgaagaacacaacccctttcacaatagctgcaaaaacataaagtaaaatacttaggaatatacctaaccaaggacatgaaagacctctacaaggtaaactacaaacagtgctgaaagaaattatcagtgacacaaacaaatggaaacacatcctatgctcgtggatgggtagaaccattatcgtgaaaaaaaccatactgctataagcaatctacaaattcagtgcaattcccttcaaaacactaccattattctttgcagaactagaaagaaaaaaccctaaaattcatatggaaccataaaagagctcacatagccaaagcaagactaagcaaacaaatctggaggcacattacccaacttcaaattataaggccatagtcaccaaaacagcatggtactggtataaaaatgatacggggtgtgaatgtttagtttttgctgattgtattgaataatttgaatagtttcataaatccttgtaataaagagtcctaaattaatatatgttcctccctcacgcctgtaatcccagcactttgggaggccaaggcgggcagatcacgaggtcaggagatcaagaccacggtgaaaccccgtctccactaaaaatacaaaaaaaaaaaattagccgcgcgtagtggcgggcgcctgtagttccagctactcgggaggctgaggcaggagaatggcgtgaacccgggaggtggagcttgcagtgagccaagattgcgccactgcaccccagcctgggtgacagagcgagacaccgtctcaaaaaaaaaaaaaaaaaaaaaaaaaaaaaaaaaatatatatatatatatatatatatatatatcttcttcctaaaaggagcagtagtacaaataatgatagaaataaaatatgttttatagtgcagtaagtggatattattatttttatgaaagccaggaagaacaatttcaatgaaagaatggtatatgaattcaaagtgagttcctaaaaggagatagccttgagaggaaaaaaatttaaaaataaaattaaaaatttcaataatttaccatgatcttggcattatctaattttattgttttaaattctaatataaaggctaaggttttcaatttaaaaggttttagatttaaaggatttttttattatattttcttgagtttctgaaaaatgttttctggaaaccattttttgtgaaataatacacattatgtttcaaacacaggattataagttttttactaccagacatttctattttcttgtggtaaaatattacatttattgtttctcctttaaataaataatttataaagcatatatgatcaagcacagggattttatgttagaaaatatgagatgctagcatttatactttgataaactaaaaagtatattagtgacccttcacactttttatctgtcctcactttcttattcatgtttgtatagtattgtttttgtcacaaattgagtcatgcaatatgttagcagcgaggttcgttagataaacctcagcatatttttttaaaaaggggttttaatgatatttactagcatttaatatttcaaagacttgaccttgaaatattcaaggtcaatatttcaaataagttcccttgaagttttcttcacagtgaagtatatgttatgaactatacaatttgtctaaggaaaaataccagcaatacatttttgtttgtttttctttatgtagtttcacatttgttttgaggatatttttctattcacttatgcatcttgcaaaatatttataacacagataaaataataatcatttaaggaaaacaaagtaaccaggatatgaaaaaaaataagatgaggctatggataaggttaaggcacaaaaagtttactagtgttatgacggtgaattgaaaatgttattttgagtgtcctattagcatgtatgaagaaagaaaatcagttgaaaaatcaaaatatatatcatcaatcattcaatcagtgaatgtattttcttaaataaaataattcttgttcctaagaactgaaatgtattttgctcacatgtcttcataaggtgcacatgatttgaatcgggaataatttgcttagcaacccccttcagtacaagctgagacatcatgctgccagttcagtattaacagttctaaacggtgccacgtcagtgtggcaaaagcttggagccttataaggaacgtacttaattcaaaataaaatcgattaactttttttatactttgtattcctcaaataatttcaatatggaaattaggtaaagtaaatattgtcaagaattttagtcagacagaaagtaattaccataaagcttaataaaatatcagatattaagcaatgttatttcctgatgaatcctctgaaatgagctgttgatgaaagataaccactgggtaacaaataagacaattttgcaaatggctgttatcaaataactggttaaatattaagcaatgcatattctaaataagaatttgggtttgtgttttggaatacttaatctttagctatttaatccatggtaaactaaaacaaggtcctgtttctatttcggctactcataggattatcttcgtagtggcagaagctgatgggaaatatgcacctgggtaatgagagtgatgcatcataattaaatgaattaaagttaaaagagggctaaaacacattttagtgttacccatttggagtatattacttacaatactgtttctttaattcttaccctgacttctgtgttagtactggggtaggttgtacataatcattggcaatttatagctggagatctcagttgatgggagtagaactagcagtggcttcagggtagggaaatggagagatgatcaaaagatacaaactttcagttgtaagatgagcacattctgaggatctaatatacagcatgaatggtgagggatgtgttaattaatttgtggctatcactgcacaatatgtacgtatatcaaatcattaccttttttttaccttgactatattcaatcttatttatcaattaaatattttaaaattcataaagttaaaaataggttgatggaaaggaaaattgaatgcctataatgagccagtctctttttgtaaaccctctcaacttaatcctcacaataactctgagagaaaattgcaccttaatgattcattcaaaataaagaaactacaaattaatatcaaaagagagcaggcattttaaagataggcatatccaagttagaattccagctctgcccacagttgctttcaacaaatgatatttctgagctcagtttcctcatttgtaaaatgacaataattatgtctgtctcaaaatataatcctatctaaatgagtgacatgcaaagttctattctcagttgcccaaaatagggtaagagcccagtacaagttggttaccattcttgaaattttagacagttttaattccttgttaaagacgttgtcccattattggttattttttgtagaccctagtttcttaatgttttatcattattataaattattttaaaatgtgctttctgatttaaatgttattatctaaattttatgtaacattttaagtgataatttactagtactaaatattcaaaaatcaaataggacactttgcttataataggtggtatatttctttgtgttaaaaccagtgcatttaccataaaaaagaatgagttcatgttctttgcagggacatggatgaagctgaaaaccattattcttagcaaacttaacacaggaacagaaaaccaaacaccacatgttctcacttataagtgggagctgaacaatgagaacacgtggacacacgcaggggaacatcacacaccagggcctgtcagtgggttgggggcaagaggagggagagaattaggacaaatacctaatgcattcagggcttaaaacctagatgacgggttgataggtgcagcaaaccaccatggcacatgtgtgcctatgtaacaaacctgcaccttctgcacatgtatccctgaacttaaagtataataaatataaaaaaaatttaaaaaaaccaatgcatttaaatgcatgaactttttttctggttgttagtcaaatgtccaaattgccatagcatatttaaaatagaaatttatttgaaaaagaataaatttctattttaaataccttaaaaattattaaccattaatattaaccattaatcattaatactcaaagagaaattatggctgttactttgtattaaggttgatatttacaatttgcagaagagtttttaaattaaattaaaaatatatcttacttatttaatgtttttggataaaaagaatgtaatggtcatttggatgatagaatgaagatattttatgttgttttggttatttatttagtatattagatctgaaaacacctagggcagtgtctcttggtatatatccaaaggaaaatggggaagtaatggcccaatgatatcaatgaggaattaattgcgtagttgctaaattattttgagtttgatgaacaagcaatataaaaattctgcagtgagttaggaactcctcctgtgcctattaattagggagataatttttgttattaatttttaatgaataatagtacagcagagcagagatgaaaccctagtggttttcctaatacgaatggtaatgtacagagaattgcaacaacattcacacagggaaaattatagaaatcaactataaatttctacaagctctgatgtgtcttggtcagaaaaagtgtgtctaaagtatttttaatctgattatataaaactaagaaacatacagcacttaatttttgaagtataacataatggttaaaaatatggatgctggctctggaattagacaaatctcaaccaccagccaggctatgtaaacttgagcaagttatttaatcttttgcagcttttcttcttcatctgaaaatgggcgcgatgatgtatctacctcataaatttgatggagaaacaataagttaaagctttgtagaatatgcaatctcatgtccagcatatatatttttaagaactactgctaataccattttaaaaatatgcatgtaaaatgtgatatacctgtatgtaggccaatcagcatctgattctgacagatttagtgatctttccagtctctattagtggaaaatcttaacatttttaaatatagaatttctcaaattttaagtatagaatgccacagcacatgcaactaatttttatcatttatttctaagcttataaaattatagcactaaataaaataatgggataataaataatatttattgagtctaggtgccaatttatgaggtaaataacatcactttctcatttgagaaagttggagctttgagtgataaagcattataggaataaatatcccagctagactcaaacatggtatttctgactctgaggctctgtaattagccattttgattctgttgactaataaaattaattcatgtaaaatgttaaaatcacatgttcactgaagcatttgttttaaactgaccttctgttctaatagctttttaagttatgggcatcacttaatatatatttgtctttgacttcacctaagaagttggaattaactatgtttatttattgaagcatatacattgtgctgaccactggcctgggcactttgttgtttcaggttttgctttagttttaagctataatttctaagcattttggattatctaatttaatcctcacagcaattctcagaaagtgttatcattctctcttcatagatgaaggaagagaaacccagaagagcactgttatttgtgcatgattacagagctattcttgggtttcaattatgcctatgtggctttgatacccacttactgtttccactataaaagctctcaatgatgtttagttactagaaggagcagttataatagcgtttccaaattttctattacactacaattttgataacactttagtgaggatgaaattgtgatctcagttgtcactttgtgtgtttcatcagcagatcctattactctgtatttctacttcaaaagggatacaatacctgttatctgcttggttgccattagatggcaatcttgttcttctaacgatgatagtaatcctgtcatacatttgtattcagctttatagtttacaagctatttcaaatatgttatctcatcaaattatcacagtaacactctgaaatagatgttaatatacatcaagtacagtggagggagcaaatactctggttaaagaacttattcagccagtattaacctagatcttaacattaaatggcagtttcttttaactgtttttctagaccttgatgcttctaattttatgtacagttctaatatacttggttatatgttttccaaggcactgaaaatcataataacatcttagaagaggagagagaagaggagagagaagcagcagggaatgaagtattgctgtattacaatgtggcacaccattactttttaaaaactattattgtagttcttaatcatcaagaaaaaatacattctgcattattctgagatggagagctgtataattcactttggaaatatatctaaactcttatttattctttaatttattgaatgaaaataaaccctcagttcttcatatgctttaactatccaggaagtgtcattttataatgattccccatggcaaaaatgtgaatataccttaaactttttatatgttttttatgtttttccccatattctttccccaggttcttgcaaaagactacttagatataaggatagctgtgcgaaaggctttcctaattgtcgtacttgaaaaagcagtaatttatagtctactaattgagtatggggaccatgatattccttaaacacaagactatataattatcgataatacatttttagtgtagatatttcaaaatttaatattttttattagctgtttttgctcgaccaatttacaaattgaccaattgattaattcattagtttgatacattcttttacactcccattaaaaaatattgaacttattaattaaaatagtaacattcacctgggtgcactcttttcatactctgtgttaaatgatgtacttaagtgacagaataatgttctaactgggagagaattttagaagtagaagctcctcctacttcttctcctatgaatattaatagttttaaatgttttgttcagggtcacatagtttgcttgtaataaagagatgactcttaagtaagaaattgactagctccatgtagtaagatggcaattatttgatttttatggtagttgccaacagactaaatcatttgcatttcctgatttaaaagtgcttctgcctatctattttgcctttcagactttgctatatttttaagaggattgcttcagtgacaaagaaggcttttagatggaacagttttctaaatccaatcaacagtagctgaaaaatgtttatacatcctgacctaatttagtattaaataacaacaattttaatgaagtcatagtatttacttgtaacctgctattgtagcatttcctactgacataaactctcttctgctgcacaaaagggcagtcaatggcccaagttcattagaggatacagtcaaaagaaaagatgtatttcattcggcatggtttttctggtgcaattagaaaagaaaatatgtgtctcaatataaaatttcatggcctcttacaattatgtggtgacatctccatacaattgcttgaataatgccaggaacatcagctgtcactatcaaaatgaacaagtaattaagaaagcaaacgctggtctttcttctaaaggaatagaatatttatgtatttaaagttgttcaccaacaagaaaaataaccactgacatgaaacataatttcctatcgtgcctgaggcagaaaagagaaataataatgaagattcacacaattacaacaaattaggttgcaattgtgcatactaaaaacaattatagactttctattcatcaggtcatatgatagcatcttatctcttttatttattttctgatactctatcttattaatcacattttctaaaagcttatgatggaattgggaaactcttactcttatcaagaccacattttctgtacccttacatcataacgtgctagcataacctaaagtaggctaagccttgtctggatagtagaatgatagtagatctgattgaagccataatagtgttaaatgctggctcttcaaccttttgataagacagtgttcagtttattgtttactgaggtaagggaaaaacgctaccttgactgaattctggtagttttctgtagaggaaagtacaagataggatttactgagagtatgaatgtggtttaaggcagatgtttcaattgaagggtttgtttgaattggataaaaataatgatttttttatccttatatctatgtagtcttttgcaagaacctggggaaagaatatggggaaaaacataaaaagcatataaaaagtttagagttgtaggattggcggaaacagtgaggggaggattttaacatgaagaatttaatgactcttaggggttgaactctctgttgatgctttttattgaaaaattggtgggtctttggggacagtcagtggtgtaaaatgttttggaattgttagggtacaccaaaaagacaataaaataggaaagtgatgttaaagtagacagtctgctgtttgtgggttggtggttttgggcctcagtctccctactgagggagggagaaggatagaacatttttaactaaaggcataatcaatccagattttcactaatgtttgaggtgttacaatcacatatcagatttctagggctcattatctcaaatgtccatgaaagtcagttttttcctcttgaatgacctttttctttgttggagaacttgacagggcagcagatgtgcaaagtcatttaagactctggaaatcacatctctgaacacaacaacacaaatagaaggattattatcagggtttgtgtccactccttggccagtggccaagagtgctcaattcaacaacggaataaatttcatccctattctgaagagcccatagaaccagacacatgatcctccagcactttgggaggctaggctggaaaattgcttgagcctaggagttcaagactagcctagacaatatagagagaccctcatctttacaaaacataaaagaaattatccaagcatggtggcatgcacctgtagtcccagccagttgggaggctggggtgggaggatcgcttacacccaggaagttgaggctgctgtgagtcatgattgcaccactgcactccagcctgggcaacagagtgagtctctctctctctctctttctataagatcaatgtcaagtcatagagaccctgtttcgaaaacagaaaaaaaaacaccaaacgaacaaacaaaaaaacaccagatatgggattcttaaccaaattacctaattttctgctatgtttatttttaggcaggcgactttgggtaacattacagaagcatcttcaggctgtgtctcaaatggatattcgggataaggtttagatggaaagaaatctctcatgaactaaaatattttcaaactttgtcccaagtgcagtacactctcaacagcctcaaaatgacagggtaaacaggagcattactgagagatggattaaatcagcttatcgttgtaaattcttccatattcgataatgatgacttgggaagtctcttttgttttctccttgtgagattttgtctacttattgaacatcagtatatgcactgaaagatctagtttttttcacatatcttggcatcaatagtaacttgggcctgctcccatatgtagagcattcatagatcagaaaataattaaaatatatattatttggtgtaaataatgataaaaatattgaatgaaaatggaaataaaaattatcaattttaccaggtggttctttttatttatttatttatatttatttattttgagatggagtcttgctctattgccaggctagagtgcagtggcgtcatctcggctcactgcaaccttcacctcctgggttcaaacgattcccctgcctcagcctcctgagtagctgggactacaggcgcgtgccaccatgcccgaataattttttgtagtttagtagagacagggtttcaccatgttggccaggatggtctcaatctcctgatgtcgtgatctgcctgccttggcctcccaaagtgcggggaatacaggtgtgagccaccgcttctggctccaccaggtgattcattttctttttttattaacctccgcctcctgagtttaagtgattcttctgcctcagccccctgagtagctgggattacaggcaagagccactatgcccggctaacttgtttgtatttttagtagagacgggattttaccatgttgcccaggctggtcttgaactcctaacctcaggtgatccgcctgcatcggcttcccaaagtgctgggattacaggcgtgagccactgcaccaggcctaggtggttcttttttaataacacattttaatgaatgaaatattgggctgggcgtggtggctcacgcctgtaatcccagcactttgggaggtcaaggtgggcggatcaccgggtcaggagatcgaaaccatggtgaaaccttgtctctactaaaaatacaaaaaattagctgggcacagtggcgggcgcctgtagtaccagctactcgggaggctgaggcaggagaatggcgtgaacccgggaggctgaggttgcagtgagcagagattgcgccactgcgctccagcctgggtgacagagcaagtctctgtctcaaaaaaaaaaaaaagaaaaattcacagtattttattttttacatctatgatattgatgtgttaataaggtgttttagcattgattagcaacttttttttctttaaagaggtacataaaatgtgcgtcttgcaagtaatgctgtcttagttccaaaaatatattttagataagaaatacaggaatctgaaaaatccataggggtgatttattaattcatgtatcattgccttcagatcttgtccatataaagaattgtgaacagcctccatttctcattatacatccttaatagaatcatgtttgcttttttgttttattttcaaaggtaaaatatgtatcatcctcagtataccgctaactataatactcatatttctttacatgcatacatgaattatatggcaaactttattgttttatgcctatagatgcatttatatatgtagattttgtccaatccctacttactatgatcttcactattctcacatataagatactacacttgagagaagctttgattactaagaattacattactcatagtctacatttttatacccctgtgaaactagaagaagccagcttcaaccatcccttagaatgattgtctccaaagtctacttccagttcagtcctctttcctgatgtgcacatacatgtatttcatggcctgctagcaattttatcggatgtcaattatatgcatcagatttaacagatccaagattaactttattcttcctgcccataactttgtttttgcttcatatttatttcctcttttgtgaatagcaccaacatcagtgctgacttcaaaatttgaaaccaggtgtcactagttttaacggattctactttttacctgttcttaattctcacatttctttttataatttttgttttagtctttattcaggccatcgttttcctctaactaactttatgtgatccagttggtcttttacggcccttggtctggcatcagtgtccattagtgccatctttgttgttttttgttttgttttgtttcttcctctcattcttcatacagaactcagagcccctctcagattttatcttttaacccactctataaaaactttctatcatataaacactttcatgattagtatttatttcattttagattttggagtgatagggaggaatcacctggtgcaggtaagagcacagcagttgaaaatgcatgaaggagagagagagagagagaggaagagagagacagagagtattcaagagtttcattttgttatctcttctggactttactcagtttcttccttgtagccatgttcttttccaaattttgagcactttgaattcttgcttttcttaattcaagcaatgtacatctatagtcaactttcagagctaagtgtagactgactcaatgagcccaaaggcacagtctccgccatcaaaaatagcttagcagagaattttctcaacaaaagcaggtctttcccaaatggattttcataacagctgccagagtaataatctagcctctatctccagtttgacctcttatcatccattctctgtattgtccacaaggtgtgctgacccaccaaactgatcttgatcattaacctatttaaaagtcaatattacccattactttcattataaaatctgattttgttggcagagcttacaaagttctcaagcttcaacaccaccactttttctacacactaaacttgacttccagcaaatatttattgaagatttactgtaggccctaggattctagtaacaaataaagctgtgcagcatacagtctaatggaagattctattttttttaaaaaaaaaacgttaatgaagaaaagagcagtatgcaggacatagcagttttggtggtaagaaaagacatcctagagaagtgacgtttttccatgaaggataagtgggtattgataaagtggcatggtgccagagatggtttagaaacttggaactcttcgtggaaagtgcgatacatggtaggacttcacagaggcccaacattccttggcagagtagggagtcagtggcatcagatgaatgacgaatgcagcacattctttctcatctataaaatatttcaagtgctgatttcttaccctgaaatgatctctcttcatttacagttatatcactattcaactaacaaaatagagctgatactcattgatttatttgaagtattaatatttgtccatgaggaagaaagtataatactaggcaatgatgatcagggctaaaataatgtattatattcaggggaaagagatatttctgtgggccgcattaggtgggataggccttagaaggggttgtacttgaactatagtttaataaattgcaatagaggttgggggagtggtgacatattttatgagcaggaatcaatatagggaaaagactgaaggaaaaattccccaagtgtagctgaaaaacaatagaaggtggtaccaacctttaaaagccgagatttcttaggaatcatgtataaaaatttaaatttcataattctttgtctgttttttcttaaatagaaacaaaatacagctttgtttataacttgtgatatgaaataaaatactgagtatgtaaatatttgaataattaaagagtttgttcttcacaattatatgactctattctctatatcagtaaaagccatcatcaagttattaaacagaagtgatagctctatgaattgggagctggcaatatgcttttctaaataatgctctactttatttctactagaataggcttcaagttgttctgaaccattttctcaatgaaaatactgaacaaaacttctagatgattcttctaaaaagtctttaaaaatgtgtgtttataggataagaaaatgatatatctgcaggaaatgaaaataaatgttaaataggaatccttaaaagtaaatacttatcaaagacagcttcctttctaaccagatagtagccaatttataaacgtttagagacaattttgtgtgtctaatagccaaaactgtattcatgtgtttttccctagtggaaactaatatagatagttttcctagctcagtcacttagttcttccaggaatttttggtttgatttgtaactaacattggagaattcggacaaaaattattaaattatgttaaaaaataatagtttaggaaaagaagagacattagatatatttcttgtcttacactctttatatgaggaaattaaaatcatgttactgatggtacatcactaagtaccatctaactggcaaataacagaatataaaatggaaggatttgaaggaatcttttgtttatatgtttttaaaaaattaataaatattataaatataaaaattagtaaaagctttgttaagtgattatgactaaaagtaatatactacaaggcccttctatggcactgtttaagaaatttgtcattcactatctaattgttgttgtcaaaagctatagtgattattttcatgaaacatcatggaacaatcagtggaaagaagagtacagttttaatgtagttttatgcaagcgtatttctttagcacctctatgatctttagagaatatgcacatgatcaaatgtagatctaaaattccacgtgtattttaaattttattttaattatattcagtaatatatatttatatgtgctaattttgaacttaaaggcatgatgaaatttttattctagaataaagcaaaactatactcttaatgattagaatgcaatgttattcagccctattttgtaatctagcttttattatagccatcaggaacagaaactcatttctgtaagcagcatacctatggttttgttatattagctggatcttttattattgatgggtcctgcttgacacattttgtagataatatgcccataggttctgaatcaaacaagtgttatagattgatgtgctaatctaagttttatcttttctttttctattttcagtagtcctcaggaaaccaatatatctgctaaaagtataaaagctttagcctattatgaaaaatgcagatttgttttattatgcagaattttaaagctgaatctgtcctttttattttcctccttctacattaccatctttccctgacctttctctttttccctctccaacaacatcaacaaaaagaaagaaagaaagaaatactttgatgcatttaataagtaacagaattctgtaggaaaatacatacagttagaccttgaactactcagggttgccaaacccccatgcagctagaaatccatgtataacttctgactcccccaaaacttaactcttaatagcctgttgttgattggaagattaatgataacatgaacagtcaactaacatgtatttggtatgttaagtgtattatatgctgtattcttataataaagtaggatagagaaaataaaatgttaaagacaattaaaaggaagataaaatgtatttaatattcattaagtagaagtggatcatcataaaagtctttgttctttcatctccatattcagtaggccaaggaggagaaggaagagaagggattgttcttgctgtcttattgggtgcaagaaatttctcttataagtgaaaccacgcagctgaaacccctgttgttccagagtgaactgtatttatttttgataaagtaaaatattaagtaaacattatgaacatcagaatgtctaaattggcaagattatcaaaaacaaggaaagtctgagaaactgtcacagccaagaggagcctaaggagatatgacaactgaatataatgtggtatactggctgacatcctggaatagcagagggatattaggtaaaaactttggaagtctgaacaaaatatgacctttagttaataataatgtgtcagtatttttgttctttgaaacaaatgtatcacactattgcaagatgttaatatggtaacatttgtgtatttgtgtgtgttggggggtattatataggaaccgtcagtactatcagctcgcttattttgtaaattcaaagtagttttaaaaaaataaagtctattaatgtaaagaaaataataatgcttaaaaattatttgcttagtgttcactttcaaaattagggtcaaatgtgaagtattgatgaaaaaaagatgtagccacattgccattgtagaagtcctcacattattgtaacgacacagagccattggttatataaaaagctgtttggatggcacagtctgttggcaatccatcagaagatagtcatttgaattagtaaactatctgcacatgtgaaatttgaggaatttccgcatgtaatgtttataagcatgcataatatgaaatttaaaggattaagggtgtaagtctttacaattcaggaaaacctactattatagcttatttattttatttccaagcattatagaacaatataggaaaagagtttgtgatagcaactggcatttgaaaaatattgtcagaaaactgtaaattgttacaaactgaacttggtgacagtgttacggacaagaattagttgagactatattttaagtgacataagcagacaaagacttatagttcagaaaatatagagtggacaattattctgaccataaaaatcaacaatatatcatgttgataaagattatgtggcttgtcaaaatttaagtaacaagattttccttagtctggtaaatgtataatttgaatggtttgtatattcgttttccattttcaattgtttagttagagtgaaggtagtagagattgggataaataaatttcatcattttaaaaattttgtttcatatttcacataatttcagcagacactatgtgttgaggaaagatctttactaagtctcacatataattcttaaaatgaaacaaacctgatgttcgtagaatatacaggtagactttaagtccgctcaaaaatctaactctactctccagtgaagtaaatgaacaaacagaggaagaaatacctagtacactctcaaagaggctttcaattgcattttcttctttgtataaattgatgacattacagttacaatttgtacttattttatccaataactgaatttttgataagttatgcaagtgaatatttatgtatcatgttatagctaacatttgaatttctatttcagatttattctcactaaggaataacatctttccaactacactaaaaagtgaaatgtaaaaagagggcaaaactcactgtgacaatgtcaaaattcattttcaaggagatttcagtctttgtaaatgtggagtcagtatgcattgaaatttccaatacaagctctgagtgaaattcattaaaagggaaatcaatccatattgtcttagtactctttaaagcatatgtaaaataaaatatattgcatagcgaattctaattttattgacacttcttactgcctctcagggatttaaatgtttaaatattttagcagccacactggttaatgtttcaggaatgtcagtgcttcaaaagtataacaaaactttactgctgtgaaaaccatacagcaaactttttttcaagttttttttctaataggaaaatatgtgggttctgctagtaaataatctcacttttgtaaaagaaaagatagaaaaaagttgacaacagattgcaagtagaaataacaaaataggactaatgaaatttgttttaattttagggaattatatttatggactgttaactatctttctgtaatgctggcttaaaaaggcatatgctcaaattttaataatttaaatttttagtaggggagtgattggtgatgtttggtgtaacatttttaaaatgaagaacagaaccctttgagctaatttttctcatgctgaacacaaattttttaaaaggtaaatggatggcctgtttttagtttcacaggagcctggttttgttaaggtgattgaaagattcatgtttcattttagatcctcacttggcccaaaggaagtaatgtttgttaatataagttaatatggctctatctttatttagacagatataatggaggaatgttaatttaaaggtggagacaaagagcactgtcattacaacatagaaacacagatctcctaacagctcagtatggagaaaagttagcctttacttgaaatctcagctgttagtgaagttaaagttatattgtgttgtctagctctgtagaggaattagtatggctagaaagagtgtgtaaaataaagccacatgattcatctttagaataccttttataaatccaggaaaattccacaaatgcctgccttttataagaatagtacaccagagagtcttagtgtggggaaagtctcctgttactgatagttcaagaaataataaagtaatgaagtcctatgtcagcttcctactcactgtttcttacgatgcttattgttttaaaacccagcaattttacaactaaatggagataaaatttagaaatctttctgtagctaggagagtgtgtaagaaataaaatagtattgacttgttgctttttattagtgtagccctaacgttcactcagtatttgtatatcttccaacttaatttcatgtagcattgttgggttaggggatgcccctgtatcagcacttatcctctagttgaaataaagagcatatgctctttaaagagtaactttaataaatcggtagtgaatgtttatggctgacaaatgaccattcccacctcctcaaatttgcatttgtcatcagtccttccactagccttggacagctgaatacagttgttctcccatttggtcctctgtccatggacactaatgctggcaaactctggatttcttggaatatgtcactggtcattggtgactctgctgcacggcagtccaccttctttaatttttaaccccctagatctccccatgggtctagaaatcttgggtagtgccagagaataaatgtgttctggcacatagtcctgaaaaatactgttttgaaaggatcaataaataaaatttgagttattacatgatagagtcattatgcaaagtcttagtaactataaccttaaaaataatgacataatacttatggtagtaatcttcttatttcataaaataaagtcttaatcagaggcagttgtcaaaaaaatttgctatttgttgttcaaaaaaatgagagatgggcttagcttttgctgtgcagtcacctgcatgtatggttttctgtctgggataaatgaatcaggctcttatgtcagccacaactctttgtgaactccagttctgacactaactttgtgaacataactagttacttaacgacattgtaatgttttttcttttcagtacaatgttcataacacatgcctgaatcataaaatatttcttcttttcttcttcctccaccttcttgttcttcttccccttgctccctcccttcttccttccttccttccttctttcctctctctctctctttctttctttctttctctctttctttattttcttttcttctgtttggagactgggtgttactgtgttgcccaggctggcctgaaaatcccacaatcaatcaatcctccccactcagtctccccagtagctgagactatgggtatgtgtcaccctgctgggcttaaataataagacagttctaagcattattttcaacaatgaacattaaaaaccaagacattcagcattgagtaaatactagttgttactccttcctcgaattcttaatttgatttctggggaagtatattcttctgtttttctgccttcctcaaaatctccctacctaggtacctcccatctccacgtttggtatgttttaaagctcagttcttagactttcttcctactttgcttatacctacaactttgatagtttcatcaaatctcctagctttaagtggtggtaaatcacaaagcctctaagtttctatctttatcccataaatttcccctgcactgcagacatatatgtatattaactatctacttgagatcttcacatggatgtttacgaggcctctgaaacatgtcccaaaccaaactcctgatttttgtgcattagcgccccacattttgctctttccattataattaatctcaacaactattaagtctattctttcagttgctaagtgttcgggccacccttgactcctcctttttaagttttacatgttctaatatcttgataaattctacaggctcttgtaatagggataaaattgctcattattgactaatctaccaaggggattgaatgacaattattaatttcttagacctatagttcttaaagtatggtcaagggactcttaagagtccccaagaccatttctaggaattcatgatgtcaaaactattttcataatgataccaagatattaaaaaccctaatgtttccttgtctttagcatgataatgacagcagtaccatcaaatcttagcatagtgactcacaccgagtatacattaaaatgtggactacacagcaagttaggtagcctgatttacaaagtcaggctctttactataatgctatagtctatcaaaaaataaaatatagcaatttatttaaaaatctgcttaatgtggaacctttgatggttttctatcttttcttctaataatatcataatttaaatcttttgcataaaattgcaccctaatttcttaggacagcacatataatggtatttttgaatgaatggatgttcataattttgatttcctggagatatatatatatatatatgcaaattgtaagacaagaggtttaaataaaattataggccaatagctgcatatgacaggaactattttaccatattctctttaggattgttatcatctttaagtttttaatatttttatagtttaaaagattatatattattcgaagttacaactttttccccacaattatggttgaaggttttttgtttctctttgtcagttttctcttttgaattttatttgtcttttatatctgtcatattgtccttaacagaattctagtttatccctagtgataacagattatgcatgagctttttcatttatttctcttcatatccattttttccttttaagttaagcaaaaataatttttgatattttattttcagatgaaaaatgtattgtaaatggttagataagaaaatagaacaatttactagtagcccctcatatttaaataattctaccctgccctgttttaaaatggcaagctgaatttttaacccttttctacctgtatgtattcttagacatagggaaatgtggccatcattttttccaggcttatagcctcacatggtggtaaaatttattgggagccacaacaattactaaaacccagcagaactgaagaacttcaaaaatataacatttgactttagttttaaatgataagaagcagtttgttgagctgagaaggaaatgaagcaccatattaaaggcagagagaacagcttgggtaaaaagcagaaacataaaagaccagagggtatttgggatacagcaagcagtttggtgtgatgagaaaggaagatgggagatgagcctgtgaagctagtggtggctgatttgaggaaccttgcattcaatactagagagtttttgctttatcttattagtagttggggatttggtaaagattttctatgtagggacagactatgatcaaacttgtagtttgaaggcattcataaaattttagcagcgtttagattattttacttgttaaatccttttccccacttcttttcgtcttgtcattttcatatcggacaacaatgtggttggtattggcctctgcgtgaatgtaaatggtacctagggagcctccagccatgtcaggatcatgagctttctcactgcttcttcttctttgttttgattttgttcttttaatacaagcaaaagtaatttttgacctttgattttaatatgataacacattaaaaacaagcaaatagtacagtttcctcagctttactaactcagatttcattactataaaaagacaaggaaaataataaatatatatgcgtgaagaataggaagaaagctaaatgtattaatgtttttgtcagaaaattttctgcagactttttaaagcttctgtttattgaataatagcttaaataaagatgttaaaaatatttgtaaatatttcatattgatattgggccattcaattcaaaattaatttacttcttagtaaaataaaaataaaagaaacagaagccctgtttctcctagagagggatctcatctcttaaaatatagatcctatgattatcatgtactgaggaagaaactaaatgaattaactccaatattgtgctccttctattgataaattctgtggaatgtttatctcttgagtaaaagaataatagagtaatagcattataatattctcgtaacttaccactaggctagtaaaaattattcctttggccttaattaagtttgaatctctgtaagaggttgggagacatttagtgatggcaaattaacagtgttttacttgtgctgatttatgtataccattaatgtggcagtattttaatttaactgttcttcacctaagctgtgtaatacatgactgcctcaggtaatgatacgtaaaatttcaatgagtattaaggtttattccagggcagcagataatagagactagtatgtttgaagtatttcttgttggtgaatacttcaaaaaaatcttagattttttttttcaatctatatatgttagatattaaattgtttatggactataaaccaatcaaacacaagggctattttaatttttaccttgcttaattttaactgctttatttcatttaaatggcgtataatgttcccaacttgtttaagtcaaaatgcaaaaatgttaatattcatgatattataaattactagaaaattatgtttcacttacatataagatagcttgacacagataaaaattaaacttgaattaaagcacataacagaaaaaataatagcaatctttacaaattagggttgtgtttttacttaggtatactagcataatcagttatatttaagtgagagatcatgtcttgattaatggtgttattaatcatgaataagcaaatatgtctttttctggaacttaatttgggttgtcttttaagaaaatctaacaaacaaaattctaaataaaatttagatgcttataaatttgttgtgtgaactttcagcagaaaactaagttcaactcaaaatagaaaacagaactgtacacagcttagcagtgatgtaaatattgtgaatgcaaggtgcaaggcacatttgaaaataccgcttgtatttcaaacctcaaagcagagcaataataaaagcttacagctagaaggaaattaaaaatcatctaaattttagttttcagtgtattaagtgaagaaattgagacttaaagttatataagcagttaaactcagatatgtttataagaatccgattttcttttagtctactatgtttatatcacaaaaaattgattcatctgacacaattatatacacatctatagaatgatgtaagagtatatgacatataattatgcatatatgcatattagtaatatatgtacacatatatgtattatattagcatttgtaatcatggagaatattagttccttttttttttttttgagacggagtctcactctgtcgcccaggctggagtgcagtggcgcaatctcagctcactgcaagctcttcctcccgggttcacgccattctcctgcctcagcctcccgagtagctgggactacagcctcccgagtgctggcacccgccaccacgcctggctaatttttttgtatttttagtagagttagggtttcaccgtgttagccaggatggtctcaatctcctgaccttgtgatccacctgcctcagcctcccaaagtgctgggatttcaggcgtgagccaccgcccccggacgagaatattatttcataaagatgaatacccttaaaattagaaacaggaagagaaacaagtactcatttttattttatgttagatttgaagatttaatttataattaaaacacacacgcacacatgcacacatacgcacacatgcacacatgcgcgcgcacacacacacatatatatatacacacagatataggtgttttagtgtacatatataatctatagtgaacaatatatttttatttagatacatgtttttatcttttgagtgataattgtcattgctaaatgtagacagagataatatgatgagataggaatacaaatagtggaagcaaaaaacttaaatttagatttccctttttacttactagttggatgtctttaaaaattgattaatatctctgaatccattttgctttcttttctgtataatgaggataagaaaacaaaatttcctggttttgggaaggttccagataatgcatataatgtggtcagcatagtcatttcatgttgtttggttggtacctaccagaacataccagaacatagcagagagacatcccagaacactgaggcaagcaacctcttcatttgtatctcatcatagtagttccaatgtactaatatgattcaaacctgaaaaattatgatatactgactacttgggtacataattactagaaatgaaattatattaataatattagtatacatgaaatgatccttgagaactgaatagccagaggtgatttcatgtttattctttttggctaattatgatctgagtttttatcaacaatagttaaaaatatggactttgagataagagaggcttggtttaaagtgctgggtttaccacttagtagctgtgtgaacattttatctacatctccacagttctgtaaaatgcaataataataatatttttctgataaagttattgtgaaattaaagaaatagcacattgaaaaagcttattgctatacttgatacagaaaagtcaatacatttcaggtgttatatcattgatgttattactaaggcagtggcattttttgtttctcttaagaaaccagacttgatctttgcacaactttagaagtataaatcttatggttaacaatatagatagcaatgcttttggggcaagatatataaattaagagattcattgctattaatagggtaaaacaattaatggagtaattttattttaagggtcatcacattttgactaagatcctttcaaaggctaattcattcattattttatagtttcacttgtgttcttatgctgccaaatattggtgaatttctgtatactataagagaacaggattataaataacattgttaaggtgatttaccaaaaaaacaaaacaaaacaaaacctgattagtactatagtagggcaataatgaaaagagacaaatttagaaaaagtaaaggaaatgctaaatcatgcacttagacaacatacttgtgaaactgttttactgacataatcataaagtctaatctaaaaaatgtagatacatacatacacaaagatttattgaaggaaaacaggatatgtcatggtagatcagcatccttgacattaatcaaaactgatgatgtcattaaagaatttatagattcttttgatatcttctatctatctatctatctatctatctatctatctactttctgtcagagaacttgattgccctttgattctgaatcattagaaaaattacattcttatttggcacagtgcagatagtgaaataattaattgatctatataagcatattggaaatgagaaacagcactttttatactatttgtgattttttaaaactggcatgctattatgctattattcatttttttaaaaagccttggctgggcacggtggctcacacctgtaatcccagcactttgggaggctgaggcaggtagatcacgaggtcaggagtttgagacaggcttgaccaagatggtgaaaccccgtcactaataaaaaatacgaaaattagtcagtcgtgggcacctgtggtcccagctactcgggagtgctgaggcaggagagtcactggagcccgggaggcggaggttgtagtgagctgagatcacaccactgcactctagcccgtgtgacagagcaagattccttctccaaaaggaaaacaaaacaaaacaaaaacaaacaaacaaaaaaaaccagccttagtagtaaacacacgcatttctaattttatttctatatcatttaggttattgttgttataaactttgaaagaatatatcttaaaatactatttttagtaactataaaacattcttttaactcatttgcaaaagactatacttctaatatatccctaccctaatctttgttgattggagttagaaatcagtttattctgagtctcattctgctctctgccaaggcttttccaaattgtccccttagatattttgcttctatatatcctaattctggcttaaagacatttactgaaaaaagtacaggacaaactggagtaacttctgcttcagtatttacctctgcttgctatctaatatagaagaatctatccctaaagtcttcaatagactaatcctttctttgcttgctggactggattagagtgcagtttgtgttcacaggaatgagtttggggatagcctccaaaacatcttctttcagagtccagatgttctaaaccttttactttttgttctatgcaacttggagtattttatgtcaccctcaagatcttttttatttgttaaaacaattatttttcttttcctgagtgtatagcctatgaaacaattgatatagacccaggagtactggattatatcttcctagtaatgttttgttattttatttttttttttagacagaatcttgctttgtcacctaggctggatggagtacagtggcgtgatcatagctcactgcagccttgagctcctgggctcaagtaatcatcccacctcaacctcctgagtagctggggctacagtagtgtgccactatgcctggctagttttttttactttttgtagagacagcatcttggttagttgcccaggctggtcttaaatgcctgggctcaaggaatcctcctgtctccacttcccaaaatattggggttacagttatgagccactgcatccagtccataggaatattttaaatttctgtgtaaacatgtttctattctgtctaactaaataaaagacaaagagagactctctaaaagccaatgatacttattcaggaatggacactgacatgagaaacgtatgccatagtaagctgtgtatgtattcagggaggtaaagaaaggcaatggcttaggaggattacataattgttttgagataattatccttggctacaagaatcaatagcaaacataactccagtcaaaggttggacaggcagttggtgggcaaatgttcttgcagaattattgttttgtgtaagggtagggtaggctttgtgcagtgctgtgggttttgcagttttttgtgacagttctttttattacctatttgtgcatgagaactcttccttgacgactttccccagctcagtttatcaagatttttaacacaagcgactcatgtttattttgagtttaaatattttaaatttctctgtgaatatctttctattctgtctgagcttcagaaagtcttaaataatcgctcttagctcataacaagaccagggcttaaaatttaagttccttaaaagaagacacttgccctattctcagagagctttaactttaagagccaatttagcttcgaggattttcttctgactagaaaaaaaaaagatagtagggttagaaaagatagcagtgcaaggtaatgaatgcacaagggacgagggaagacaaacaatggcataaaggccattagttagatttaagtggtgttttgggaggatctgaaagagatggtttgaaatttttcaacttagccaagcaatcctttaagaagataattttagaatcagagtttcttttggcggcttcctcacgcaagaaaatctagacacctgaatacttggaattttcctctctctgcttgtgttaaacttccccaaagttgcctatattattgtcgtttttagttcatcttgccataacaaaatagcatagactaagtggcctaaacaatagatatttattttctcacaattctgaagattagaattttaagatcaaggtgccagcatggtccattgctgctaaaggctgtcttcctggcttgtagatggccacctttttgctgtgtcttcatatggtgggggaaagaaagaacaatctctctggggtcttttttttaagggcactaattccaccataagagccccaactttgtgaccttgtctacacctgattatcttccaagagccctgtgtccaaataccatcacattgggggttaacacttcaacataagaatttgggggtggtgacacgattcagtctatagcaattatctgtgttgctactatgccatttagaatgatagcacttgaattgacttatagtgtgaatgtattgcatgtaagagacaaacgtgggagggtccacaagtacctcgtgtctgtgctcctgaacataatagttggctgtgtttaatagaaaacacaagaaataactaatctctgatggatgaatgattatagatgtgatatatctacaattaaactgttctgaataaaggaagactagctaaggaaagttctcataagttttggatagttgccctaaggcaaagtttgtcctgtatgactgttatttaacaagacaatttacttgttagtcctgtgggatggcacacatttcagtcctgtggaacctctgtctactctcggccctatgaactaatctctatattactcacaaaagaaaaagatgaacacaatcaagaagaacagcagtttttttttagtaacaaggcagatttccaccaaaggggagtcttaaattctgatcagacaatcaaaagttctcacaacgaggggggtcatcattcttaagagctaaaataaattggaaactcaacaaaaaaatgagacatcagacttaatacaggatctccctcactgtcacagtcagagaaacccctgaggaggcctgatgtggcctcaggagaactccctgcttacaagttgagggcactaatccatggcaatcaatgacttttactggtgaactctaggattgtctacggtccccaaggaccaccagaaaaacctattgatcaagtaaagctcaatttattaaacttacggcaacagggaaaactctagttccacagagttttcagagtgcctcaagaggagaagttgaggaaagagatttataaatttgagtatctgggatcaaatggtattaagtgttttggagaaaattgagttaaattggagaacttgattaggttgtgggaattttgtcatctaatagttaagaattggtagacacaggaaagcaagaattgaggcaagttttgacgatgtgctgataagtgagcccttggttcatgtaaacaaatagttctcctgataagtaatctgttagcccatataaaatcagtgtttacccagaaatatttaacatatctttccagaagcaaacagtgaattatttattggcaagtaattttatcctcctgggagggaattactgggagaggattatgctgacagagagagtgccggtccttggtctagttaagtggtattgctgcacaaggtctcagttcttacccaaatacagtaatagccccttatcctcagggatacattctaagacccccagtggatgtaagtcccccagtagatgtctgaaaatgctgatagttccaaccctatataaaccatattttttcctaggcatccatgtctatgataatgtttaacttaattaggcacagtaagagattaacaacaacaataataaaatagaaaagttataacaatataagattcacttttatggagagaagattagttctttccatggatcttaggaacctcagcatatgattttttttgtttccttagtaagtcaagaaagttcaccttttcacttaaagggagcactttacagcttctctttggtatatctgaatttccagcatcattattcttctgcattggggccattattaagtaaaataagggttatttgaacagaagcactgagatactaccacagtcagttaggtaactaagatgtttactaagtgactaatgggcaggtagtatagacaaggtagatacactgaacaaagggaagactcacatcctgggtgggacagagcaggacagcaggaaatttcatcatgctactcagaatggggttatttctggaattttacatttaatatttttggactgtggttgaatgtgagtaactgaaaatgcggaaagcaaagccatggataagggggactactgcataagagtagaacatgtgggattacttgtttgctaaaggataaaatatattttatatttttcattggcttcatttctattataagcatataaaatatgatttttcatacattaataaagattgaagtcattaagcgagagcaattcatccaaaattacttattcaaaaccaaatatactagatgctgttttagcccctgccttcatgaggtttaaatttcagaaaacagaggaggttattggtactttataatgaatgcacgcatatacatatagtttatataaacatagaatacagtaatacagacacatataaatataatctttgggaagattaaacttcattctaatgactttttagagtatgcatgctggtaatataattaaatattatgtagggtgtagaatttgtgaatttgtgttttgggacaactgttggttggctggccttgagggggaatggggtaaagaatactataaagttattaacagagaaaatactcaattgcttcctagaatgtgtggaatttcctgcttccttttatcttttgagattcagaagtggtatggaattattttggcacaccgaggtaaaataagttactttaaaagccaggatcaatccataacacgatatagtactatggccagagagagcattcttcatgctttaataatgtcttactgccattctttgttctttttcaatatgtcaaagaaagaagataagtaagggggaagctagaatgcacccacacgtttgaagcattgaccctgtgccacctccataacaattttacaaagttgtcatttttctcatagctatttttagttggtttcataactatttatagttggtttttgccaacttgtcaaaaatgtcatgtttcaaatttcttcagcgtatttagcatccagtatatgataaggatgcattttggtttctgtttgttaatatttacacttcccatggtaaatgacaatactgcagttactgtgatgtcatattctatgatggcaggttagtattattaaggacatttgctgataataatatatctcattttattttctcttgtcacacattttgccatcaataattcaagacagaaatagtctgtatatcaaaatttgaatattagaaactcatgttttatgtacatatagtatttcgacaatacctttattaaaagggtgaaaaattacgggcaactataatttctcaaccaacttttaactgaaaataagaacacatgtcccttaaagtctcatttctgatgtttaacaaacataatttacagtgaacgcatgacatttattatattggaatctaatataacagttccaaaatggtatttactgacacttgttattcatcgtgaagctgatcactgactagtagtcatcacagataaacatcttccctcaattaaaaaaaaacagttacagattagtcattcatgtaactttatatagaaaaagcattagaaagacttgggttccttgccttgaaggagcaagcctggagaaggaactgttaggtcttcaacttcaggatatacattataactcattgcatgccacacctcatgaaattggaactactcacattgttttcataccaagaatctggaacttcatggatctataacacattatttctcatgtcaaagaatttaaatattaaccagtcatattaaatatcgcttcaaagagtgatactttctctgggaagagatcaatagctttttggaaatggtatttcaacaaatacttaagtggaggtttgtgattgcagtgattatttcaagatctttgtggactgggagtcttccattcaacctggggtgtgaattaaattatgctcatgccttatttagatgtacgtgactgcttgatattgtagtgatgtaaaatgtagacataacttccataccattcaggaaagttagcggggcttgagaaaagggagtgttgtaatgcaggaaatgccattcttaagaatttaaaaatctgttagtaaagtatgaaaaattaatgtcctttcaagtaactaaccttttgaagagaggcctagaagaagttaagagaagttttatattgttgatgatgttatcattgtttttgttctcttcttccctattagatagcatgacattcctgtggtaatattgggttattacagttacatttgtcatatttgattgaatgcacagaatgttgctatatatcttgacttgattatgtatttctatatcattttatttaactcattgaactagcaacacatattactcaggattagcttctctggaaatttagcatttgtttatgaattgagaacattggtccaacaggatgaaataccaacaacttgtcttgctatttattgctctgaatatcttggccctattagcctatgcaattgtactccctgcttttcaccaaacacttcacatgaagtgggatagaaaagggcagagggaagaaaatttgtatttttggcaacttagaatctgttctatgatagaaagtggtgagcaaactaaaagcattagctccagtatatttgagttctttgtgttatttcaatcacccattaaaactgtacacttagcacatttctttttggtttgtaattaacatattaaaaatccagaagaatttgagctttggggagataattgaatattttatttaatttcttaaaagtgaggatggacattatgtagattatatgactgttcatcattttgcaaagtgaagcccattgaattactgtcagtattacacaactaaagactaatcaactatgtctcgtaacctgagagagattcttgatatagctaacattgttttttcaacaaagattaataattaatttgatacttattctttttattttggtcagcccaaaaggtagtgcaaggaaggagcagagaaaaggaagatgtaggggaaagagggaggagaagagatggaatgtgacttgtcataaaataatattggctagattatgtttcaagtaaaaggaaatctcttaaggaaaaatataaatacagttgacccttgaacaacatgggttggaactatgtgggtccacttgtgtacagattttcctcaatacaacttttgcggaatgtgccttcctttcctgcttccccttccaccttatccaccttatccatccttgagacagcaataccggcctctcctcttcctcttccttctcagcctacttaatgtgaagatgacgaggatgaagacttttatgatgatccacttccactcaatacattttctcttccttatgattttcttcttaacattttcttttctctagcttactatattgtaagaatacagcaataatgcatatgaaatacaaactgtgtgttgatctgctacttatattatcagtaaaacttcctatcaacagtaggttattagtagttaaatttttggctggtcaaaagttatacatggattttcaactctgcagggattgaaaactgcacgttgtccaagagttaacaaccctgtattgctgtgtagttttgttttcaacagaaagacttagctgtgagaaaatggtccttttttgtatttatttaataactacctgttaattgattatattcaactaaatagtgacaccagagtgtaaatatgtagtggtgcaaaaagtagacaccaaatacgtgagagaaaatttacttgtggtcttcctggggaaaaaaaaaaaagaatgaaatttactagaatgcattctcttactagaacttgagtagttcagctgctacctttctggctgttgaaatcaaatagcaaaaattctctgaaggggcaggaatttctgtctgctttgtgtactattgtattttcagagccaagaatatggctgtctaaatatggactcaatagtagtttttgaataaattgtgttgtttatttaattaagtcacatagactaaatatgtaaagtgactagttatattagactataaattccaggcagattaaaaactaaaacttgcattgtatcttggtttatattgtgttgtgtgtaataagcatcagtattaaaaacaagcaaacacctaacaaaatacccaagtcaaaacaactttgggctgataggtgaaacaacgttaatggatcataacagctgacacacatgaaaattagatatatttttggtaataaataacatttgtagaaaagatatattcaacagttttatttgcatataattacaaagaatattttcttatgcataatttttaaataattgcttttaaaatattatagagttaatttttcagggttttttattgtttccttggcaaattcaggtagaatatgtttcctaacagtgtgtaattttgacatacttctctagatagaatgacagcaaaatgcattttagttaaaccacccttcccctgagggcattgtttattgcttatgtgaaatactttgcaaattctttttattctaatatatcaagcaccttctttttctcctttaaaaaattattgttttctggactctaggatatcagattatagcaattttaagttaagcattatttaaataaaataggccttgtcatacatgttttcttagaatggataacaaccatgattttatcttatgtttggataattcacaaagcattgttttgagtggagagcaggttcttatttatatgtacttgctatagcaaaactgctgcaaggatagctccagggatctttctaagtttgaaatgagaaacataactgggagagtcagcatatttatcagactgctttttttttctctaggtgaattgaatatatatatatatatatatatatatatatatatatatatagcacttttcttctattgttttctacttctgtagtattaagctgtagacaactgctgaatgagaattttaactatcactcccttgaaatcttcgttcataaattccacatacacataacatggacaaatcattgtggcacttatgtcaataattttttttctgtatcatttaggtaccaaatttaatgaaagtctgcctggggaatcaaaatctatttttgttgttaattataaatgctctttacaagtgtatagtttgatactgggccacaagagagaaagcgagaagggctgcagctcttctctccttctctcttttgtcttctttctcatgtttacaacaaggtgagcggagggacgtgtttcaaccctgtttgtgttacagctcttttggtccctccattaggcaggtcccgagttcttgtcctgcatccaggaagaatgaggtatgcagacaactggagggtggacaaggcaaagaggtgctttattgagctacattacacctctcaggagacctgaagttggtagctcatttctgcaggcagattgtcccaacatctgttcagctctcagctaggagggaaaccacagtggatagctcctctccacaggcaggtcaccctgacatctgctcagctctcagctggaaggagacccaatgtggatagctcctctctgcaggcaggtcatcccaacgtctgcctagctcccagctaagaggagacccacagtgggtatctcctctgcaggcaggctgtcccaacatttctttgagtctggctgagtctggggtttttatggacttcacaggggaggaagtgagtgctgatgggttcatgggtggccatgggcaggcctggaaaaagcacagtaaattttcactccagttcacaaaactggcagcccagttcccaggtttcaagctattcccagattcaaggtggggcttcactggggatccacccttttctgcccaggagcctgtcttcctcctgcttccatcaacctgccattcatgacgctcatggtgcccaggctgtttctgccgaggagtgcctgcaggctcgtgtgagctgcccacaacccttcccttggcctccctcccatgctcatcagctctgaaagtccaaagaaggctgaggcagcagggagctagcatatcagcaccaccctgagtgtgtgcacacctggctgggtcataacagttgtcaggcttggcaacaactttgctccgaaatcagagcaggcaccaggtgtggggagaggccagacagtgggaaggtcacttccaagcctccaagagcagagaggcttcccagagagtgcatggatgccagggtccacagccacagctgggtggctgcatctttaccaaggagggtgaggctctgcccctctaacttggaaggggtggggcttttgcctgttcctagctcctgctggctccatggagtgtacagccctggctgtacttccctcatcgcagctggcatcttctcagtggctgccccacacaggccactgttgctatcaatcccccttctgaagaggtacatctaactgctgtgaggatagggatgatgctgctcttcactgcttcgtgctgacaagggacattgttttggggaaaacagcagtcacatctctctcagaggcctatgtaagggtccctggtagaaacggagccattatccaaggctccagttgtatgaccacttggagcatgatggcctctaggtgagaagaaataattttacaaggaggttaaatatgtgaaagaaagtatctagtgctggagataacacaaataagaagtaaaatagactaatcattctgaaaacaatgttgtcactagagtcgtttcacctttgtgaaagaaattaaatcttgtataggtgcagctaagctttaaaggagaaataactgtttagggctgtagggaggtcaagaataaaggggccttgacaaagatgccttatggtgaggaacagaacaaaagcggtaacagtaagcgtagggtatccatggagggttgattgttggtacttatcttttgtgattgttaagttgagatccctgatttctttactctggtacttcgggtgctctcttgggtcaacagaggaaattccgtcagttccctggtcttttactaaagtgtaatgaatccaagaatcaatttcagtgacctttactgctgtaggagtagaaagaagtacacagtaagccctcacccccattctgggactagagagagagaaagggaaggaggtgcctttaccagtgctaagtcccctgggttgaatagaagtggccttattcatgcgattgggcctctgatagttgttgcagtttgtgttgcaaatgggccaaataagttgtatgcttaattaaatcagagctttttcagtctagcaagaaatcattggtgagaaaagtctacaccattttgaagggacttaaatccagctttgaaagggtgtttctaacacatagtagggctatggagagaagagtaatccatggaatatgagtatcttgagacagtttactgaggtgccttttaataatctcatttgtcttttctacctttcctgaggattgtggtctccaagcacagtgaagatagtattgtatgcttattgccttttatacccgctgggtgacagctgccttgaacaaggggccattattgctctgaaggtacttgggaagtccaatgtgaggaattatttcattaattagtgcttttatcacctcagagcctttctctgttcatcatggaaatgcatctacccagttagtgaaggtatctacccatactaggaggtactggatgccccttgtctttggcatatgggtgaaatccatctgccagtcttccccgaggtagactcccatcctttgggttccagggggacacgccattgactgaggggattatttttgaggcaagtctcacaagcattaacaacctgtttgaccatttttagcagattcttacctgagaacaacctttgagcacttgacaggttttatctttatcaaggtgaaaggcttggtggaggatttttaagaacccagctggaacccagctggaagctggtagatgaagcttgctctcctctaattgcagccatcctgaggactgaagtgtgtatccctgagatacagcccattctatctctgcagaggaatactgaggtttcatttcttttatggagtactcccagatcagagggcttcaagtggatcagatatatgaggccctcttgctgccaatttggctgcttggtctgccaacttatttctttcagctattttatgcatccccttttgctggcctttacagtgtattactaccactttccatggaaagaataccatgaataataatctgttaatttcctgatgacacttaatgagagacccattggctgtgaggaagtttgtctctttccagatagtagcatagacatggaggactaggaaagcatgcttagaataagtataaatgttaactgctttccccttgtttaattcaagtgccctcatgagggcaattagctcatctagttgagtactcgtgcctgaggagagaggcgtactctcaataacatcattcagggtgactattgcataccctgccttatggaccccttgctctacaaaggaacttctgtctgtaatgagagtccagtccaggttctctaagggggtttttttgaggtcctctccggctgcataggtttgcactactatctgttcgcagtcctgttcaagctccccagcttcgtctgggaggaaggtggctgagtttagggagagacagtttcttaactatactacagatccctctaatagcagagcttgatatttgagtaggtggttgtctgttagccagaggctccccttagaagacagcagtcctcccacattatatggcacataaactgttaagttattccccatggttaacttaatacctctggttgcaaagctaccactgcaactgccaagaggcaggctggccattctttagctgtcaaaacaagctccttccttaggtaccctatggggtgctgggctggacctcgggcctgggttggaactcccatggccattgccttcctttctgagacataaagattgaacatctcctcattgggaagtctaagggctggtacctcaagcaagatttgttttaataggtcaaaggcccttttagcctctggttcccaagttagggagtggatctggtatttcaccgtgccatgtatctatacctgcagaatactgtagtgcccaagaatgcctcagttgcttgagggttttgaggcaaggaaagaaggacatgggcttgattctttcttcacctagtgcctgggtcccctctgacaagactagacctaggtacttcaccaaagtctggcagagctgagccttagattttgagaccttatatcctgttatccagaaaattaagagctttactgcctccctaagagatttcatcagagttgggacataaaggataatgtatacatattgtaaaactttaacctgagaataaaggaactcagagagatcttttgacacaccttctcaaacaggtgggggctgtctcagaattcctgaggtaacactgtccaggttaactgggtggcctagttggaggaattcttgaatgcaaacaaatactgggagttgaggtgtaggaaggaaaaaggaatcttttagatccaggactgtgaaccatttagttccctcaggtatttcagttagcaggttataggaattgggaaccaccagatgaatagggaccacagcctcattaatgaggcagaggtcctagaccagtctccattccctgttgggtttttgtatccccaatatcagggtattacaagggttgttacagggtttgagaaggccctgaatcttcaggttatcaatgatggcttctagtcatttcctaacttctggtttcagaggatattgtctctggttagagaaggaggtgagatccttaaagtggaccgagaccagtgtggcaattgtggctcagccaattttccctggagtagtccaaacttctgtgttaatattggtctctactatggggagacaaagagtctgtcctggagccataaagatagtggttcccatgtgagccaaaatatccctgcccaagagaggagttgggctttcaggcatgattagaaagcatgagtaaacaagaggtcctgccaactacaactaaggggttgagaaaactattgggttaaaggctttcctgagacaccccttatggtagcactaagagagaagggagtgcctggactggagtggagaacttaaaggactacttcagtgtccaggaggaggtcccctttcctcccttcaactttcagaatcaccctgggttcctggaatgtaatggtggtctggaccaccagagccaggtagaggagccctgggatgtgtgagtcctgctggaccacttgagagactagctctggacctggtgacctgtgtctctggggatagtcttccctccagtggtctccattacctactggacagggtcaaggtggctttctcatgttgcctgggcagtctttcctgaagtgccttggcttgccacatttgtagcagttaacaggtacatctaggggactctggggtttgtgagcctgcaaagagtccattagagcctctgccttttcttttgtttcatgtttttttttttttttttggatttcctcctgatccctattatgaaagaccatggtggccaatttcaggaggttctctaaagtactatctggtcctacagcctatttttgcagcttccttctgatgtctggggctgcccgagtaataaacttatccttcaggttcagttatccttcaactgaatcaagagatagagaggtatgctttaccaagaccccttttagcatttccaggaaggcagtgggtttctcattgaatcccttttctatcatgtttagcttggagtaattaagaggcttagttctagtccttcataagccctccagtatgcacacctgagagtgtttcctcttccattctcccatttcatcattgatgtcccatttattatcctccaatgatactactattcttctaattggattggcactctatgacatacaaagcttatcccccaaattatctgctgctttctgggtggcctgcttttccacagtagtcaggatctgattcaaaagtaacataatgttcttccaggagagttaaaatacttgggttaaattctggaaagcctctatatgcaaatgtcagggtcatttgaaaacttgccaagatctctcttaatctgccttaagttccgtagagaaaagcaaatttggaccttaatgagactatatttgccagcctgttgtaggggcaaaagtgcctaaaactaagatttctaggatggaacaaacttagagagaacctggataagggaagtggaaggagatgattcccccaatggaggtacctctggggtttgcttctctatttccctgggattgccccttgcagccttttctgaaattgccaccaggagggcagaatcaatcctacaatgttggcaaaggtccgaacttccctgcaaggcaaagaaagtctgcacatgtgggacttcaaaccatttgctctcatgtctacagaaaagttccagcttcagaatggtattaaaattaatacttcatttctgaggccatgcttctgcctgcagaacataattcagccacaccttagtgcaaaggaatataaggcagattttctccagagtctgagtattaaggagtcccaggaattcaagatacactctagaggagtataggttaaagatggttgtttacccttctggaagagagaacagaggaggaaaaggtgatttttcttctctccagagtctgagggtcaaaggggtctcagtgattcaggatgcagtcaagaggagtgcaggttgaagatggttggttacccatcaggaaagaggggtaaaaagcatccctttgttcctttctctttccagcaaatacccagggtaggtgaggctaagaaaaaagggcatccctttctttcttctgaccttatatccctaaatccccgtgatctttgcaggtgttgaccatgtgtgcaagtgtgacttcacccatgaggtggggaggcatacccaacaggagtattcacacccacctatatggtgcctaatcctcctgcttttggtaacctttaaattccctagaccttatctatgccatgggtaggaggatgacctccatccacgatgcaggagggcctagttggcaggagttagtcatgctcacctgcgccgtgccccctaaacttcactgtcatgtgcctttggatctctcacatctagtttttctttctagggcctcaaaactaaacttgggacaaaaaaatgcctcaggagggtgtatggacccattaaattagtggcctcaccaaattgcagccagaaactggtggggcagcccatctcttgcttccttattatgaataggtgaagctgtgggaccaggtcctctgcaaacaagggaaagaaagggagtcctgggaattggggacctggcctaacaagatgcttcccaaaagaatgatttaagttcaggggtggggaaggtgcctggggaaaaaaccttttgccctgtgcaaatgggttccttcaacaggggaaagaaaactctcaattgttacatccttcttgcttctaagaatagatagacatcacattgttctgatttacacttctgatgaccaagccaagtgcttattctacccggtattattatctctgtactttgcaacaacacccttatcattgtatataaagaagagataggagccacgacaaccttgaaagaaagaaagaatgataggaaagactggaggtcctagtgctgacaccctaacaggcagtcggggactggagttagttcagaggcctttggataacactgagatatagcctcagccagataccctcatttgccccaggacctccttctgatcccacacgatggctagacctccatgaagggaaactggattggaacaaagccaacattcccaacacccaagggtgatgggggattggcagtgtcctccccagcaagcctgtcctcatgtcttaagtccagcagctatgctagtcactttcaactggccaagagaggcatggcatttttctttcagtttggttgtagtggagtttagggattccccaaaaaaggacagaaagcagcaagtttgcttttactcacccttttgcagatcctggatgagccccccaaaatgtcataggatcctcagggtgttgctttgccagctagaaatctctgtggctggtggtgcctttgcccaagttttgctcaggaccactggacttgatttgctcacttggcctggcagtctgcactcggcttgtactactggctcagatccgatgcctgccaatggtgagccaggcatgaagcggtgaggagtgtgtaagcgagcgatcccagggtccggccactgtgtacaacaaggcacactggctggggctggcgggctgctccaggtgctggcacaggtgctggttccctgcgaggctatggctggaccaggtgtaccgcaagtggcttccactgcaggcaccagggaacactttgtcacccagcagcttggagatcccaggaactgcagaacgccaaatagcgtgtaagagccctggctcagggaactcttagagctgaactccccaaagagcctcaacttttctctcctcttttctctcttttttcttctcctcttctcgtgctcacaacatgctgactaggggggcatgtttcagccctgtttgtgccattcagcaggtcccaagtacttgtcttgtttccaggaagaatgaggtgcgtgggcaactgcaaggtgagcaaggcaaagaggtgttttattgagctacagtacagctctccagagacctgaagtgggtagcttctttcaacaggcagatcatccagatgtctgttcagctctcagctgagagaagacccacagtgggtagctcctccccacaggcaggttgtcctaatgtctctacaaatctggctgagtccaggcttttatgggcttcaaagaggaggaagtgtgtgctgattgttccatgggcggccatggctgggcccggaaaaggcaccataattttcactctgctccaagcaactggcagcctggcacccaggcttcaggccatccctagcataaaggtgagtcttcaccagggacccacctctttccacccaggagcctatctgctttctgccatcatcaacctgccatccacagcctgcagacccatgccaaccttctctttgccgtccctcccatgcttatcagcacccaatgtccagaggggctcgagacagcagggttctggtgtgtcggtgccaccctgagcatgtgcatacccagcagggtcatggccgtgcccaggctttgtcacaactgtgctccaaaattggagagggcaccagaatcagggaaatttcaggcagcaggagcctgctgagatcaggggaattcctgggccctcaagagctcaggaattcctgagtccatagccgcagctggtttgctgcggctcttaggagagcccctccaacttgtaagggggcagggcctccacctgttcctccttccacctgctccatggagtgcaccgccccagctacacctcccacactgcaaccagcatcttcacagccaccactccacatggaccactgctgccatctttagaaaatagagtctgccacaataagttttttttttttgagatggaatcttgctctgttgcccaggctggggtacagtggcaccatcttggctcactgcaacctccacttcctgcattgaagcaattctcctgcctcagttcctgagcaattgggactacagacatgtgccaccatgcctggctaatttttttttattttgagtagagacagggtttcacccttttggccaggctggtctcgaactcctgacctcaggtgatccacccacctcagctccccatattgctgggattaaaggcgtgagccaccatgcctggccttgccacaataagttttaatggtcctgccaatattaaaatgaaatctttaatgaacaacaagtcataaaccttctatgtgaactacttagaaggagcagactacagatgatgatgccattctaatattatgtgtggaatttttgtcagtgatgaaggacttcacagacctccagtggtgctaaagttcttacacatcgcttttgatggaagcttgaaaaccacttaacctaggtagcatcttctgctctaactggtggctgtgcaatggagaaaatgccgataaagtttttaatagctaatttatcagcaataataattgtttgtgactctgttctttctaatgctatctattgtatgcatatgtatgtgtttatagtatatattatatatgttatatatgcatacatgtgtatgtatgtgtatctacatatatagatagtgtatgtgtgtacgtatatatagatacagatataaacacaggcaaattcttacaactatacacgatctagttttaaatacactaaaagcttatgtcacattgggaaggagggaaccataatgacaaggtaacgtattttccagcattagaattattgaagtatgaactggacatctgtcagagatatttggaatgggagaggataggagtagtagcaatgtagattcagccattaggtgggagtttggagtagaactctgagatctttttatttaattattaatattagtaaaagtaattctgtccccctaaaatgctctttaaattagtttgctagggctggcataacaaaaggtattattgtcttggtggcttaaacaacaaacatttattatctcacagttctggaggctagaagttcaaattcagtgtgtccgtagagttgatttctcctgatggcttctttctgtgtctctagacatcttctcctgatggtttctagatggcttctttctgtgtcttcgatgttttttccactatgtctgcctgtgttgtaatctcttcttcttaaaagggcaccagtcgtactggattagcgcccaccataatgacaatattttaacttaattttctatttattaaaataaatgacactttattcataatttgttttactttacaattagtagggactttataaatgcttatttcatgtttgacattcaagaacaccattggctatatcagcttatatttgaagtgaaggacacttttttgccagccccaaacatactaaagtgttttgagttttaataataagataggtaagcttacaaatggagttcataacttttgctatttttctctatcacttgtgagctttcaattttattgtagaaaaaaatttcacaacgaaatatttgtgaaaagaactattcaaaaactaaggcggccgggcgcggtggctcacgcctgtaatcccagcactttgggaggccaagacgggcggatcacgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaactaaggcaagaaaaaaactgagattaaatgggtcaaaaatatgcaatttcaattataatagacctgatatattccaaccatctgtcataaaatgaaaggttactattggcacacagcgacaaagttaccagaatttgggtgatatgaggtaagcctgaccaaatttaatattttcattttcactttatagttttgtctgagtttccagggtatagttattttcatctgtttttcatattttaagaagtttttacttcaggatattgacagttttacgcaattccttcacatcttaacaaatatctcaagatgatattagccttaaataatatggttgtatagaatacttttaaatttaaattgtaaactaaattgtctcctaataatttgaaggtctttgctttcttcttttgatggctcttctctcacacccatctgtactgtggctgtattttctgattttgtaatgtgctgagaattgtatttcatcttaataaagaaaataagtagatatagactgtgactatatatttgaaatgaagtgttaacatttctgaatactctgcactcgactttttcccctctagtccactacactgctacttcaaataataagaagccctcaccatttctcactttgtttatttcaatagtgctgtcagtggtttcactcagtcttgttcctgtacttaggtgttgcccaggctattttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttttagccgggatggtctcgatctcctgacctcgtgatccgcccgcctcggcctcccaaagtgctgggattacaggcgtgagccaccgcgcccggcccggctatttttaaaaatatataaagctgatcatgttgctctttgtttaatgatcggtatcaattcccattaactttaggatcaaatactaatgtttttaagtttttaagtttagaaggtgtttaaggtattgccgatgacctatgcctccagctcagtcttccttaacttcttgtgtcttgtgtcttgtctaggccccaatcacattgaattatttccatttctcaatatatatataacattttctcatatctcaatgccttttagcacactctttcctgtgcttggctagcatcttttcttttcccccatgcctcacttcacttttcttcagtctctcattcatttaccaaagattattgagtgcctcttttgtgcctggcactctactaagtaacaggagtgaacaagactgcaacagtcctactgttttgatcctgccagttactttacttggctggcttctatgattacacttcctaaatggtacaatctcctactacactttaagttactgcaaggcaaatgttttatgttttatcttcacaagttcagcacctactacagtgtctggatatggaatagttcaattaatgctactaaggaatgaatatatatgcctgcttttgctcaatgtgtgctatttacagtcatgatgcaatggcttgtatcttatctgcttcttttttttcatttcttctttcaattctggattaatataatttcatcaaaaaactttgtataggcactaaaaagaaatatttactggttcagtaaatatttactggttcattttggtatttacaataccaaaatgtcattgttacttatgtatttatcaaccaggaaaacagaccagtaaaagatataaagaagtttcttttgtgtatttgtttttgtaacaagtaatcaacgtatgtgattttggagaccggttaggtaagtccaaaatatgtagagctgactatcaggcagagcaggagggaacttttgacaaggatgggatttctatcttcaggaagcctcaactctgctttaagccttttttaactgattgactcagacccatccaggttacctaggataatatcacttaaagctaacagactatggactttacatgtagagaagatattttcacagcaacacttgggttagtatttgaataattggggcttgtagcctagccaagttgacatataaaacaaacaaacaaacaaatcagccaggtatggtggtgtatacctgtagtcccagctactcaggaggctgaggcaggcggatcgcttgagcccaggactttgaggggtagtgcatcatgattgcacctgtgaatagccaccagactccagcttgggcgaataataaaacaccatctcataaagtaaaacagttataaataatatttgctaacattttaaaagaatatcattttcctgatattatactaagcactttacatgcattaattcatttaatcatcaccacaacccaagtgcaagattattattcatagtttactaatgggaaaacaaatgcaaaacactcattctccagtggaacaatagaacaataagtcaatagacttataaccattgttataagtcattttgaaggacagagcttagaacccaaagtatttgtatggtgagtcaaagttgtgatatgttctgatatggattattttttaagaagtttttactttaggatattgataattttgatgcaattctttcacatcttaaaaaaatctcaagatgatattagctttaaatcataaagttgtacaaaatacagtcttaaataatgtggttgtaaaaccaggctgcttgacgttttcacagtttttcttagaataaagaatccagatgtagggatattattgagtataaacaattgaaaaagataaactattacatttacactattacttcagagcagttgatatatttaaatgagaatcagcatgaagtatgttcaatagcatgaggactagcgagaaatagatcaaatttgggtttttctatactcaagctgtgtgaccttgaaaagtgcaatgacagtaataacaatatgccatagaacttttctgaagggtaaaaacaatacagtaagagtaaatgcacagttagtgcagaattgtgtctatcttgtcatttaaatgtttgttaaataatgtattcttttgctaggttaagctttatcagcgggttgttatgtggtagatacatggatcctggatatttggaacagaaaatggaaaagtgaacactctaccaagtcaaaagcaaattctttttttttaaggctgcaatttgccaattaatagtaaactattttggtgaattggagtggtgatctcaaatgtaataaatatgtataaataaaatataatacaagaatatcaaaaacacattacttataactactctaggcaccttcagtcacttaaatgttttaattttgcatgaaagacaaaaatgcctctctgatgaatccttagtagttttgcgaaatttattaaaatataaaatatactgcttttttatgctttaacaatgattttataaattaaaaaaacgatagaaattcagttattaaataaaattattttgatgtagtcaaactggagaaaaggagtaatttaaaattttagtgtttaaatttggcatctcagtttaatatgaatctggaagaaacattttagggaatacagcaataatagaaagtcatttcctgtaatagcatagtttttgtggtgtaataaaaggttacatgacaaggtcagactacttcatttcaaagctaaaaatgatttctactctgccctgaggtttgcagatttctgactgagtggtccctggaaggcttgttcattttgttgtttatatatttaataactatctagaaataaataagactagtgcttagaaccaagttttaggataagcaatttttgtgactatcaagtattttttcttattttaaagtccctatttgtataattaaacatcggtttctcaggcctgaatcatccttttcttatcaactgatggttgctgataaatgacttctactaggtacagttccagtagttgtttagtgaccctgatcttggccaaaaggcctcatctgtctagaaacacatggggacttttattttccaggtatccttgctctgacactctctagtgacagaagcctaagacggaatattctgcacttcatgcaatacattaacaacaaaaattcttttcacagaagagcaaatttagcatataggtttttatgttgttgcctcaaactgttatttatatctatggttggaaataatcgggaaaaatgtattattgatttttcaacccatggatgctgcaaatctatttgaatatggaatggcttgacactgtctcatgttttttatattacattataattgtctgctgttccataattaacctttataaaattaatatgtgaataaaattttttatgcattattaactttttaagtgcaattaaataatggagtaattaaaatttgagtgtttctgtttgttgtactcagtttttatatttgattcaaatgtcacatcagcagtatccattttgttttcgagacggggtctcgccctgtggccaggctagagtgcagtggtgtgatctcggctcactgcaacctccaactccctggatcaagtgattctcctgcctcagcctcccaagtagccgggattacaggcacgtgccaccacatccagctaatttttgtatttttattagagacaggctttcaccatgttgaccagaatggtctcaatctcttgaccttgtgatctgcccacctctgcctcccaaagtgctgggattacaagtgtgaaccaccgcctctgcctcccaaagtgctgggattacaggtgtgaaccaccgcgcccaggcagcactttccgtgttcttttttttttttttttttgaggtgcagtcttgctctgtcacccatactgcagtgcagtggcctgatctcggctcactgcaacctcagcctccccggttcaagcaattctcctgcctcagcctcctgagtagctgggactacagacgtgtgccaccatgcctggctaattttttgtatttttagtagagacagggtttcactatcagtttttatttcttttctctactttcattttcattggcaaattttttccttacctggtctattttttataaaatgtcacataaattaatcacggggagacaaggaagcaatgcaagtacacattattatttatgtgcttgaactgaataagtaatgcctagttatcaataattgacagaatttgaaagaagtgatgtgtgtgtgtcactgatcatgatgtacctcttttgtttacatagtggtttgtgtactgaagtgctagtaaagaagtttgtactttatacaattactcacagttgatataccatgtgaacttcagtttgaaccctgtttttggggagtgactgatgttatttaactaaaccatgtaagtgaagtttttgcatattagaaccatgtaaaaagaggactgaatatacagtatatatattcaatttcattcattatcaggaatatataaattgaagtaacaatgccatactgcactacacacttaaaagaatggctttggtaggcagaattctaagatgacacgtgactccagcccttaatttttatttactgggaagatgatagggcatcactgctgtgattatcagttggcaaaaaggattttgcagatgtaattaaggctactaataagttgactttcagttaatcaaaaaggaaataatgtgggtaggcctcacatgagccctttaaaagcagaaagaatgttttttccctagttggtagcaaaagaagaaatcagagatatttaaagcatgagagggcttcaatgtgaaggatgttccccactgctgagatggatgggccataggccatgaacctgtgagtagccctagaagctcagagtggtccctcgtcacaacagctagcaaggtaaaaggagccttgaatcctgctactggaaggaggtaaattctgtgaacctgagtaagtctggaagtggattattcacacagagacattagataagagcccagattcattgataccttgattttggccttgtaagaccctaatcagggaacccagttgagcccatctggacttctgatctctagaactgtgaaatgattaatggatattgttttaagctcctaagtttgtgttaattttttatgctacaatagaaaattaatataatattaaaactttaataagaaaaaagtgacaaaaccaagtgttggtgtggatgtgaaacaactgaaactctttctctattgttggtaatgcaaattagtacagacagttctgagttgtatttggcagtgactactaaagcagaacataaaacatgactatatcctagaaacgattacagcttattgatatttttccaatataaataagtttgtgcactgtttaaaaaagtacaagaatgttcatagacaattgaaatagccccaaactgaaaatagcttgtgttcattattaacgaaatgtataaataaatcgtggtatattcaccagtggaaagccacacagctatgagaatgaaccagctactactagacatagatgaatcttataatcacacattgaatgaaataaaaaacacataaaagaatatgcgtgggccgggtgcagtggctcatgtctgtaatcccagcactttggaggtggaggtgggcgtatcatgaggtcaagagatcaagaccatcctggccaacatggtgaaaccccgtctctactaaaaaatacaaaaattagcttggcatgatagtgcgcctgtagtcctagctacttgggaggctgaggtaggagaatcacttgaacccaggaggcagaggttgtgttgagctgagatcatgccactgctctccagcctgggtgacagagcgagactccttctaaaaaaataaaaaataaaaaagggcctggctggtggctcatgcctgtaatcccagcactttgggaggctgaggcgggccgatctcgaggtcaggagttcaagaccagcctggccaacctggcaaaatcccatctctactaaaaatacaaaaattagctgacacggtggcgggcgcctgtaatcctagctactcgggaggctgaggaaggagaatcccttggacttgggaggcggaggttgcagtgagccaagatcgtgccactgcactccactctgggagacagagcgagactccgtctcaaaaaacaaaacaaaaccaaaaaaaaaaagaaaagaatatgctcacaaaagaatatgatcccatttgtgtaaaggtcagaaataggcaaaacttatttatggttctataaatgatgataatggttaagttcagaggttccagtagtgtttgggaaggggtaccacaggaggatttagggtgctggtgatgcactgtttattgatcttgatgctgacttagcaggtgtggtcatgttgcaaagattcatttaactgtttatgtataacttaagcacttttcattctttgatgaaaagcttttttagagaaggactataaactgttggcaataccttttccaccctgggatttaaaaaagaaaaattgcccaaggtcatatagctagtgagtgaaaagacttagagcagaaaatatttaaggataatttaataattaatgttttattagaattagatcttttattagactaaatatagaaaggggaaaaaggagatgtgagactagttcataaataattttgacatttacaattcctcggtttttttgaacagtttgccgggaggactcatatcactctgtcgtctcatgtgccgcagtagttcttactcctatggaaccaatgatagaaatgaagaaaagagaagaaccagaatttcctgagccttccaaacagtgagttgttcatttaatttttcaaggccttgtaaaatcaattagataactgataagaaaatgtgatttataataaatgtgttaatattagtataaagaaagaagaaataaattttatgggttaaaaaatcatctattctatattatcttaatgaattaacttctgtgtctcctaacttcatgtctttgaaccatgtgtcattcaagtttcattttgttaccttatcttaaggacatgggcaagtaggctgatgtactttatttccctactctgtgattgtgggtacactgttcttggattgcttactatataagctgtaggctttaatgatataaaatgaaatcagtttttaatataaagtttttaaagttggtttgcatttttataaggaatgtaagttattattttaaaatatttttactaaattagaacaaatttgaactttatactattttagtgttttcatattttttccatttaaacagttcaagctttaatttaaattaaaatttgatcttctattatataaatgataaacttgtactcttataatgactaaagaggcttaagttcatgatgataaatgtaagcttatgtagatgtcaaatattaaataaatggggattatttctgcttatatattaaatacatgaaaaggaaaaaacctgctgagtatttttcagtgagaaatagtatcatgcctcctttaaggtttctggttagtgattaggtgatataaggggctgccaaggattttgggctgaccaccgtaggagtaaggcggaagatatatcttgatgtacctaccatttttctccattggattacactgtgttatagttatttgcttcttgtatgtctttttactagataataagctcttaaggcataattgtgcttgatactgtttgtgaatagggcaatgtatatatttgattgcatgaagatattcagtattaatattcttattatagagggaagaaacactgaccaatttagaaaataatgattttaattcagttttaatacaatctaaaagtcagttaatttaactgctcttcatatagtcttaatttttaagttccaaaagccatttttgtctaatagataattgcatcatgtttgccaattgaattatattagaaagctcaaatgtgttttcctgcaaaacacacacacacacacacacacacacacacacacacacacacatttccttatcttttatttagggtgatatcaccactctctttgttagtattatgtgaaatgatattgagaaaggacctgaaatctaataatccataaagttctagttatgttgaccattctatagcttcagctatcaacattatgggtgacttatggttatatattcttttcatgaaggctcttctgaatgcaaatgtaatatttaaagttgttcatcagacttgtctaactaggcatcctaccgaagtgtcatgcaggttgaatgtcccttattcaaaatgcttgggagcagaagtgtttcagatttcagatgttttcagattttgcaatatttgtattatattagttgagcatcctaaatccaaaaatatgaaatttgaaatggaacatgagcattttctttgattgtcaagttaacactcaaaaagtttcagattttagaacattgggattttcaggtttgggatcttcagtctgttgtaaatatgtctgaagacaaattaataatctcctctaagtactccgtaaattctcaagttgttccatatttaagtaaagctaccatcatttttctttttttaaaatcttggtatgttttcttcctcacatctcatattcaatcagttatcaattacttgattaatgtctccattatattttcttatttcagcagacctggaaggtatatatatcccatattttaaatatctcctaaaatatatcttcagttgtaatcttaatgatgccatctatcaaatggaaattgtttatgtcctacatacccaacactgttattttgagaattaaaagataggtgtgaacatatggcaagaacagagtataaatgcaagcacagtgattaactcaaaactcttgtttgccagtgacagaagccaaatgctaactggtttcagaaaaaaagaatcaagagtgctggtggttattggctcatgtaatttataaagtacaaaggtagcaatttcttcaagtacagttttggttctcaaatgatatcatcaagggtcattctctctatctacatgttttttgcttgactcttctgtctgggcttttcattttctgggaggttcctctagtggtgatattactgccttcagcagccactgggattgattttcattttctccacaaatccagtggaaggagataatttctcattccttttaatcaaagcaaaaaaaaaaaaaaaaaaacaaaacacccagatttgagtgtcattggattggctttgactagcttgccttgtttgacatggcaattctgaaacaatcactatatccaaaagtatttggtggcgattgactagataatttgttgatgttgcatgacaagccctggaacacagaatgaaatttagaggggaaaggtgattccacaattgacatattggtgatattgataaaagaaggcagagatagatgaggtgtcaaaataatgaatgttccatataggtaataatattattatcaccattaattttaaaagtcagaattctttattatatttaaatcataaacattgatatactgaaatataatgcatgtatctttatttcttattttaaatgattttttacctacttaattttattttatgttatttgttctgggtgtgctattgagaggcagtataacacagtggttaggaatccaggcattgggcagattctttccccccaacccccaccaattttcttaacccctgggcactgtggcttgcacctatactcccagatactcacaaggctgaggggaaaggatcatttgaacccaggattttgaggctgcagagagctatgaccatgccactgccttactccagcttgggtgacaaagcaagactgtctctaaaagaaataataaataaataaagcttcttaaccttagtttatttgtttctttttaatatgggagatactttacctcataatgcaatgcctaaaacataatagagatgcaagaacatataaattttgtaatttttttgcaacaaatatatttgttaaatagccacatcaactgtttataaatggtgttactaatgcccttatgatatcagttttgtgtattttggatttcccataagaaaaaaaaaatactagatagggctggacgtggtgactcacacctgtaatcccgcactttgggaggccgaggcgggcggatcacttgaggtcaggagtttgagaccagcctggctaacatggtgaaaccctgtctctactaaaaatacaaaaaaattagccaggcatggtggcagtcacctgtaatcccagctacttgcaaggctgaggcaggagaaccacttgaacctgggaggcagaggttgcagtgagctaagattgtgtcactgcactccagtctgggtgacaagagcaaaacgccatctcaaaaaaaaaaatagtagacataaaataatcacccgccaatataatactaatgctgaaagttgagacactgtctttggataacaaatatttctttttaattttggatggaattacttctttaagtaaattttccccttgaattttacagtcttcacatataaattcataaatcattgagtctttgaaatataggattcatagagtcatctgattcagaacccagtaaattcattgctaagaataactgaaatagtcatctcagaatatgtaagattgtacataagaaagaatatgtaatatataattacatcactttagaaggtaagaaacattttatgactgagatatttgtattatctaaccaatgtttagttatattctgatgataaatattttacttttgactttttttattaaatattctcatgtatttattagtttttagacatttgataaggagaaacaagaattaggaactcctactaggaatgaagtataaatttttcagcatagcaggtgatagggagaaactaactaaatcgttaagaaggaaagctacattgctcattacagtggcggaggaccagagctttccacttcctgcaatatctaaaattcatcttaattcagaaaacaaaggtggggattttacttcacttctgagtttagtttggtatgtaactcagaataccatagaaaggataaactttttaaaaaatagaataatctatgtaatccaaaaagagtgtacaattttcaaatatttaatcataagcatagaatgctggggtcaaagctttgagagtgactgttcacaatagcagagtcatgaaatcaacctaagtgccctcaacagatggttggataaagaaaatgtggtatatatacaccataaaaaagagtgaaatcatgtcttttcagcaacgtggatggagctggaggtcattatcctaagtgaaataactcagaaaatcaaataccacatatccatacgtaataattgggagctaaataatgggcacacatggacatacagaggggaattataaatttataaaaatcctactgttaaaagtataaccaagtatccagctacactcagcatgttcctcaaaactctacatttctcaagtcagttctatgtaaatgagcatttcatgaaatgtacatagaactcaaactctgaagagaatgaaagaataaccatgattggctttggattatattttgtattaatacttttttagaaatgtgcttgttgaaatgcaaatattctgtacataccataactcaatgtctgaatgaagggatttttgtgaccattgtaaagttagaaatgcagaggtaaaagaaaaattattctattacttctttgtccatttccacatttttatattattttatataaataaatctaaccttaggaatagatttgatttattgtttactcttgcatagatgaagcattacttaaacatattgtcattctctccaagtttcaatacctctttgtaatgcttcagtttcttgtcatgaagtaggttctgtaagctccttctgaaaggtaacagacattatcatttagtacaaacgtctcatttttaaagaattgctaacactaacctattttattcttagagggtacttaacacacaggcttaaagttttgtcagctctgtttgtttatttatctgaatgaatagtatatgttagatttggaacagttaagtactctctctaaggtcacctctttagactctctaaagttgttacacaaactctgtggttatattggagacatatcaaagaataatattactagctgatctccaattttcctttaacaatcttcaggagaacatatttatttatgcttttaggcagatatttatttgttaatttatcaaaaataggtaattcttcagtgtctgctttgtttttggcactctgcatagtgctaggggttttgtgttgaaaagcaggtgaaatcccttctgtactaaaaatacaaaaattagctgggcgtggtggcgcacgcctatagttccagctacttgagaggctgaggcaggagaatcacttgaacctgggaggtggaggttgcagtgagccgagattgcgccactgcactccagcctggtgacagagcaagattccctctcaaaaaaaaaaaaaaaatgcaaaagtgtagctgtggctataatgtagatgtgtatctcattataagggctgtagtaagaagttgtaacatagccaaggaggtcaggtaaaacgtccctgaggaggtgactctcgagctaacatccacaggctattagttaactaactgaaaaaacaaaatagcttcttaaagtgttctgtgatggatgggagtgtggagaaattgaaggaaggctcgtgggaggaaaaggaagccaaatcatgttagcagggccaagtgacatggttagatttgccttttgaaaactttctctttgtttgttatagagaacgaattagatgtggttggggtaatggtgaaatggagccgacttgggagagccaatttgatagcagttctccccagctctagattcagtgatttcacagtgaaagtttgaaatcagccatggtgggtgtatttacatcatagcattgggaaattctataaatgaggactttcctcctcccctggagagctagttaaatatttatcagcacattagtaaatggaggatagactgagtggctacagtgagaacatttaggtgattgctgatagtagcttgcactaggttgctggcattgggagtggagaaatgtgaaaagagaactgtgtcaatatgtatttatgaaccttggcaagttaaatatagttattaaactaataacttataatacattactaagtatttgcaataaggatgaaaatgagaaattatctttattactaattgtaattatgttaaatatataatattgtggaaatcctaacatgttatcttgaattagtaatagtttaatgaatggagagtcatgatattcttttaatttatgttgagtattatatcagttgaactataagtgtaacatgcacacacacacacacataaatgcactttgcataaaattcctgtctgaatcattgtcattgattttcactgaaaatgtccacaatataagtaaattccacttaggttcttatgtaaattcttatgattctttactaacaattttccttcatttaccctccatcacttcgtgccttcaaattcttccatttaaaaaattcaatactgaggcatggctaggataaatatcaggataatactatgattaggaaacagccttcttcctcatgcaggcattcaaaagaaacggctagtgtttcatgattttggtcaattcaagggtggaagcagcatctgaggagatcagtgaggagataagatttccatggtgaaagctgttgcctaaatataggtctcttccacagcttttggaggaagttagggatgggaggagaaactttctaacctcaagtctatagtggattttcagaagaatcattcagtgcttcaaatgtgttctctgcagttggaagcacaagggacagatgtggattcatgcctgagaaacttaagcagactgcccagaaaacctcgagggtgaaaaatcgctggccagctgtgaaagcagcaccatctaggactctagagttagtcagggaggctgtagtgtttttgtgaattatctggaggatgaggatacccccataaagaggggcaaaggactctcatgcacccatgactagggaactacagaatactggcccagaaggagacctttgaaaagatcacttgtgggccaatttgctagtctctaaagccaattaaatctccttaaagctcctctgaccgagtaccactacccgctacctttcaccctggtagcaggaatgcattagctgtaccactgaggaagtttaatcttcaggggtcagctttacaatgggccccacataaagccctagaagcaatcctggaaatttttccttcttttctcgtgtgtgtgtgtgtgtgtgtgtgtatgtgtgtgtgtgtgggtgtgtgtgtatgtgttttgagatccctccagatttcataaacttcagggctcacataacctggatttatccctttgtaccatcgcctttagatctgggcactcaggattcttgccttaggccctgcatgtgagagaactgtgtcacatcccttctccagctgctccgccttacataagatgcatttcctgaaagccaacagctcccaccactaggagactatgccttcaccactcactctgtccagaaatcgctgctcaaatggccctaggtcctaccctctggaggaccacataacgcacaacccatgggctgcggaggaacagtcaatcactggtagtggtggacagagcttagagggtcggtgggggcattcacctttctgactgccaggccttggtggaaaggcagccggctagatgttttgtcaactatgctgtattactggtaccttgtgaaaggactgattgccatcaatcttctgtatttttttttatcatctctattcaaccttttggaaagatatgagctcattattcgctggtttatatatattgaaaaaaactaaagaaggttttcaaacgtcaagaaccaatagattttaatatgaaaaataagaatgtttaaaaattcccagagaaactgctgcccttgattgacagtgttgttattttatctctctgctgtttattgctccttagtgagtcataatatttggtcccttgtgcagttaccctgtcaaggcaagaaatcctattgtaacgtttgcatctagtttgacaacccttctttgtacattgagcacacaaatgctatttttcagataagttgggacaacccgataatatgactgaagtgttttagctcaccagtgcagtacagttatcactgtactctttatagagtactataaatacagatttgtcagatcactgaaaaagattgcaggtgcatcaccattgttttgaaagtagctcttatgtgtgcagaaaaagcatggtgccaactttcaattccccgtgctaacctcatcccatgaaaaaaatcgatttgcaaatatataagatattttatttgaatgtgttctataatttaggttttagtataagtcttctagtaatactataaataaatgctatataatccaatattgattttctacttttccccttccaggggagactgactagcagaaaaagcagaaactttgaaatctgaaacatctcatctctatttggcagttagatgacatggagcaaggagcgggtactactgttattgaagtcaagtattcttatatatataataaagacaatagcacctgctttgtaaggtcattgtgaaagtattcaattttcaaagtaaagcaggtagaatcatgctgggcaccaagaggaagcacaataaaaattaccagatttaatatctcttgaatgaggaagttgggcataagaataagggattggatctctaagaatacataatgttctgtggcatttatgcttttagatatttcctcaaatttgcctattcacaatatgtgattatttgcccatttttaaaagaaagtattatcttttttttcctctggtatattaagcccttttacaacaaatgtttcctggttttttttttatcttctattttacttagaatagcaataactagtaggtactcaaaaaatacctgagaattggttaatttttatttacttttgaggtaaaacacattttcttttatttcgaaggtagaaccaaccatgatagttgtccaacattatcaaatttttaaaaattagatatgaatagagcatatttactgttaatattttaatattaacatatttaacatttgaataattaatattgaaaatatcacagggaattaaaacagcaattttgtcatcagtattgaaaagaaagatctgaaaacttgaagtctagaaacctgattgccagccctggaaaagtgctatgttttgctgcatgctaattctcttaactgtgaaacaaacattagcaacacagtgaaattctaatgagcaaaagtctgggaatgcctgttgtaaaatgtgaagtagcataccttacttctttgttttataggggtatctaaaataaacattcattaatatttttaattctttgagttaaagggttcccctgattgatggaaaaatcaaagtacttgtagacagattgattcctgtctgtttctataatatttgaacacctctattatagtactcattagacagaattacaattgcctatattcttcattctctctcactagatattaaagacaggtattttttgaaggacagatgtttctatcattttctttttgaaatattgtgtgtgtaggatgaaattttacattgtaagcataattacgtgttgaatatataaattagggttgtaaactattgtttaaatctagtctttaaaataataaattggtttattcagtaacacttaaatgtatttaatattaggcaccatactgtaatctaagctttgcaaacacgtatccatttaatcttcccaacaagattatatgttgttattatctgcaagctacaggtcagacaacaaaggcacatggagattaagtaacttgtccaggatgacaatttaaaaaaagaataaattgtactttctttctttcttttttttttttttttttatttttttggagatggagtcttgctgtgttgcccaggctggagttcagtggcgcaatctcggctcactgcaacctccacctcccaggttcaagcaattctcctgcctcagcctactgagtagctgggattataggcacgtgccaccacactcggctaatttttgtatttttagtatagacgaggtttcaccatgttagtcaggctggtcttgaactcctgacctcgtgatctgcctgcctcagcctcccaaagtgctaggattacaggtgtgagcccccacgcgggcctgtactttcttttaaattactttaattactaaatttagaatctgacacactgtgaaatcattcttttttttttcaaatgcagttctttttgtagtcttttgtaatctaaaaaatatgaatgtcattataagcaaataatgcttaagatgattagcatttataaatcaacataatataaaggaagaatataagtaacaaaattcttcactgatgattatcacaatcagtacctcttcatttatgtgtatgtttttctctcaaatgagccaggaggaaaactttttttcatgcttctgttctacttagtgtcattagtgtcattattcattttactagctatttctttttcgtctttttatactttaagttttagggtacatgtgcacaatgtgcaggtttgttacatatatacatgtgccatgttggtgtgctgcacccattaactcatcatttacattaggtatatctcctaatgctatccctccccgctccccccaccccacaacaggccctggtgagtaatgttccccttcctctgtccatgtgtactcattgatcaattcccacctataagtgagaatatgcggtgtttggttttttgtccttgcgatagtttgctgagaatgatggctgccagcttcatccatgtccctacaaaggacatgaactcatccttttttatggctgtatagtattctacggtgtatatgtgccacatttacttaatccagtctatcattgttggacatttgggttgggtccaagtctttgctattgtgaatagtgccgcaataaacatacgtgtgcatgtgtctttatagcagcatgatttataatcctttggatatatacccagtaatgggatggctgggtcaaatggtatttctagttccagatccctgaagaatcgccacaccaatttccacaattgttgaactagtttacagtcccaccaacagtgtcaaagtgttcctatttctccacatcctctccagcacctgttgtttcctgactttttaatgattgccattctaactggtgtgagatggtatctcattgtggttttgattgacatttctctgatggccagtgatgatgagcattttttcatgtgttttttggctgcataaatgtcttcttttaagaattgtctgttcatatccttcgaccactttttgatggggttgtttgtttttttcttgtaaatttgtttgagtttattgtagattctggatattagccctttgtcacataaataggttgcaaaaattttctcccattctgtaggttgcctgttcattctgacggtggtttcttttgctgtgcagaaactctttagcttaattagatcccatttgtcacttttggcttttgtttccattgcttttggtgttttagacatgaagtccttgcccatgcctacatcctgaatggtattgcctaggttttcttctagggtttttatggttttaggtctaacatttaagtctttcatccatcttgaattaatttttgtataaggtgtaaggaaggcatccactttcaactttctccatgtggcgaggcagttttcccagcaccatttattgaatagggaatcctttccccattgcttgtttttgtcaggtttgtcaaagatcagatggttgcatatgtgtgggattatttctgagggctctgttctgttctattggtctatatctctgttttggtaccagtaccatgctgttttggttactgtagccttgtagtatagtttgaagtcaggtagcatgatgcctccagctttgttcttttggcttaggattgacgtggcaatgcgggctcttttttggttccataggaactttaaagtagttttttccaattctgtgaagaaagtcagtggtagcttgatggggatggcattgaatctataaattagtttgggcagtatggccattttcacgatattgattcttcctatccatgagtatggaatgttcttccatttgtttgtgtcctcttttatttccttgagcagtggtttgaagttctcgttgaagaggtccttcacatcccttgtaagttggattcctaggtattttattctcattgaagcaattatgaatgggagttcactcatgatttggctctctgttattggtgcataagaatgcttgtgatttttgcacattgattttgtatcctgagactttgctgaagtttcttatcagcttatggagattttgggctgagacaatggggttttctagatatacaatcatgtcatctgcaaacagggacaatttgacttcctcttttcctaattgaataccctctatttccttctcctgcctgattgccctggccagaacttccaacactatgctgaataggagtggtaagagagggcatccttgtcttgtgccagttttcaaagggaatgcttccagtttttgtccattcagtatgatatggctgtgggtttgtcatagaaagcgcttattattttgagatatgtcccatcaatacttaatttattgagagtttttagcacgaagtgttgttgaattttgtcaaaagccttttctgcatctattgagataatcatgtggtttttgtcattggttctgtttatatgctggattacgtttattgattttcgtatgttgaagcagccttgcatcccagggatgaagcccacttgatcatggtggataagctttttgatgtgttgctggattcggtttgccagtattttattgaggatttttgcattaatgttcatcaaggatattggtctaaaattctcttttttttgttgcatctctgccaggctttggtatcaggatgatggttgcctcataaaacgagttagggaggattccctctttttctattgattggaatagtttcagaaggaatggtaccagctgctccttgtacctctggtagaattcggctgtgaatccatctggtcctggactttttttggttggtaagctattaattatagcctcaatttcaaagcctgttattagtctattcagagattcaacttcttcctggttgagatttgggagagtgtgtgtgttgagcaatttatccatttcttctagattttctagtttatttgtgtagaggtgtttctagtattctctgatggtagtttatatttctgtgggatcggtggtgatatcccctttttcattttttattgcatctatttgattcttctctcatttcttctttattagtcttgctagtggtctatcaattttgttgatcttttcaaaaaaccagctcctggattcattgattttttgaagggctttttgtgtctctatttccttcagttctgctctgatcttagttatttcttgccttctgctagcttttgaatgtgtttgctcttgcttctctagttgttttaattgtgatgttagggtgtcaattttagatctttcctgctttctcttgtgggcatttagtgctatacatttctctctacacactgctttgaatgtgtcccagagattctggtatgttgtgtctttgttcttgttggtttcaaagaacatctttatttctgccttcattttgttatgtacccagtagtcattcaggagcaggttgttcagtttccatgtagttgagcggttttgagtgagtttcttaatcctgagttctagtttgattgcactgtgatctgagagacagtttgttatactttctgttcttttacatttgctgaggagtgctttacttccaagtatgtggtcagttttggaacaggtgtggtgtggtgctgaaaagaatgtatattctgttgatttggggtggagagttctgtagatgtctattaggtctgcttggtgcagaactgacttcaattcctggatatccttgttaactttctgtttcattgatctgtctgatgttgacagtggggtgttaaagtctcccattactattgtgtgggagtctaagtcactttgtaggtcactaagtacttgctttatgaatctgagtgctcctgtattgggtgcatatatatttaggatagttagttcttcttgttgaattgatccctttaccattatgtaatggccttctttgtctctcttgatctttgttggtttaaagtctgttttatccgagactaggattgcaacccctgcctttttttgttttccgtttgcttggcagatcttcctccatccctttattttgagcctatgtgtgtctctgcacatgagatgggtctcctgaatacagcacactaatgggtcttgactctttatccaatttgccagtctgtgtcttttcattggagcatttagtccacatacatttaaggttagtattgtcatgtgtgaatttgatcctgtcattatgatgttacctgattgttttgcttgttagttgatgcagtttcttcctagccttgatggtctttacaatttagcatgtttttgcagtggctggtaccggttgttcctttccatgtttagtgcttccttcaggaggtctttcagggcaggcctggtggtgacagaatctctcagcatttgcttgtctgtaaagtattttatttctccttcacttatgaagcttagtttggctggatatgaaattctgagttgaaaattcttttctttaagaatgttgaatattggcccccactctcttctggcttgtagagtttctgctgagagatcagctgttagtgtgatgggcttccctttgtggataacccaacctttctctctggctgcccttaacattttttccttcatttcaacattggtgaatctgacaattatgtatcttggagttgctcttcttgtggagtatctttgtggcattctctgtattcactgaatgtgaatgttggcctgccttgctagattggggaagttgtcctggataatatcctgcagagtgttttccaacttggttccattctccccatcactttcaggtacaccaattagacgtagatttggtcttttcacatagtcacatatttcttggaggctttgttcgtttctttttattcttttttctctaaacttctcttcacgcttcatttcattcatttcatcttccatcactggtaccctttcttccagttgatcgcatcggttactgaggcttgtgcattcatcacgtagttctcgtgcgtggtttttggctccatgaggtcctttaaggacttctctgtgtttgttattctagttatccattcatctaattttttttcaaagtttttaacttatttgccattggttcgaacttcctcctttagctcggagtagtttgatcttctgaagccttgttctctcaactcatcaaagtcattctccatccagctttattccattgctggtgaggagctgtgttcctttggaggaggagaggtgctttgatttttagagtttctggtttttctgctctgttttttccccatctttgtggttttatctacttttggtctttgatgatggtgacatacagacgggtttttggtgtggatgtcctttctgtttgttagttttccttctaacagtcaggaccctcagctgcaggtctgttggagtttactggaggtccactccagaccctgtttgcctgggtatcagcagcggtggctgcagaacagtggatattggtgaaccgcaaatgctgctccctgatggttcctctggaagttttgtctcagaggagtacctggccggctgtgtgatatgtcaatctgcccctactggggggttcctcccagttaggctactcgggggttagggaccctcttgaggagacagtctgctcattctcagatctcaagctgtgtgctgggagaaccactactctcttgaaagctgtcagacagggacatttaagtctgcagaggttattgctgtcttttgtttgtctgtgcccagcccctagaggtggaggctatggggcaggcaggcctccttgagctgtggtgggctccatccagttcgagcttcccagccactttgtttacctgctctagcctgagcaatggcgggcgcccctcccccagccttgctgccaccttgcagtttgatctcagactgctgtgctagcaatgagcgaggctctgtgggcgtaggaccctctgagccagttgcgggatataatctcctggtgtgccctttgttaagcccgttggaagagcgcagtattagggtgggagtgacccaattttccaggtgctgtctgtcacccgtttctttgactaggaaagtgaattccctgacccgttgcacttcccaggtgagtcgatgcctcgctctgcttcggttcacgcacggtgcgctgcacccactgtcctgcacccactgtctggcactcccccgtgagatgaacctggtacctcacttggaaatgcagaaatcaactgtattctgtgtcactcacgctgggagctgcagactggagctgttcctattcggccatcttggctccaccccccccccccaatttaacttttatttaaagtttaggggtacatgtgcagttttgttatgtaggtaaacatataccatatacctatgtgtcatgggggtttgtgatacaggttatttcatcacccaggtattaagcctagtactcattagtgatttttcctgatcctttcctttcttccaccctccagtctctgataagccccagtgtgtgttgttcccctctatgtatccatgtgttcttatcatttagttcccacttgtaagggagaaaatacagtatgtggttttctgatcctctgttagtttgctaaggataattatctccagctccatgcacattcctgcaaaagacatgatgtttttattttttgttttgttttgtttttttaatggctacgtatatactggctaacttctattcatcttttgttttgaaaagtcacttcttcaactcagaggactctgtcatgtggtctacattctgcaaatttcttttaccttatttaccacagaaacaaatatggaacctaatcaacaattgtagatgttcacaaatcagaggtcctttattgtttcacttttccttgatagtcaaataaaacattcatgggctttgattccaagaactgtgttaagtacagtggtccccactcccacccctcaatctaggaaaattataatcaattcttttcctcctggttgcatcttttcccaatattctcttttgcttaaattcttgatctatctggactattttttaacctcttatgtataggttccatgacattattgtccttaagttccattaaagtcctgacatggactgcttctctcttgctataattttcctcagtcttctatcaggacccttcttcacttttctacatttaccccttgagtgcctcatagtcacttcaaagttgctacttgaaaacacattgtggcaagtagtggtggttgtctacacagttttcagctttcttgaagtaaatgctttctgttttgggatcagcaatgcacttgccacaggtgatgaatcatgtctggtctaaaacttcactagtcatgaaaacctcatttctactttctaggtttttgtcttcaggtgggtatctgagtcagttatggacaaagagacataataggaagtcagccaagggcttccaagaaatattttcctcttgatacatagataaaaactgctttttttgcctcgttctctcccttatgatttgggttttgtctatgaagactgtataattgggcctagagcaccaatcttgagactggaagactgcatgtattgaagtaaacagtaagctgaaaagaaagccagtccaacttttagctactagactttatgctagctaaataacaataaatgtctgtctttctctctatatatattttgagacaaagtcttgctctgttgcccaggctggagtgcaaaggcaggatctcggcttactgcaacccctgcctcctgggttcaagcaattctcctgcctcagccttctgagtagctgggattacaggggcccaccaccatgcccagctaatttttgtatttttagtagagatgaggtttcacaatgttggccaggctggtctcgaactcctgacctcaggtgatccacctgccttggccttccaaagtgctgggattacaggcgtgagccactggtcccggccgtctctattttttaatacctctttacaggatattctgttatgtaataatcaacacagccagaattcctgcttattttcttgaacagagcaacttaacttttgtttttagttgtctgacttagatcatgcacagaaggtcatctcattaagcaacagaatatatatgtcactttgagacaatcataagtgcacttccctgacaattttaatgtacagtagtcattttatctctctgtacataatattcctttctatcatatacttgtttgttcagtatttatcatataggttttcaaatttgatgaaagcagggattgttccccttatgcatgggtgcgtttgcaggtctttgcacaacaccagattctaaaagggcctcaataagcatgtatggaataaacagctgaaagaatgaatatttaatctagtgtttctttgtttgtttgtttgtttgacacgaagtcttgttctgtcactaggctggagtgcagtggcacaatctcggctcactgcaacctgcgcctctgggttcaagcgattctgcctcagcctctggagtagctgaaactacaggcacaagccactatgcccggctaatttttgtatttttagtagagatggagtttcaccatgttggccaggctgttctccatctcttgacctagtgatctgcccaccttggcttcccaaagtgctgtgattacaggcatgagccaccgcacctggcttaatctagtgttttaatgagttgcagtggagaagtcaacacttagtagattgtcttcttataaggattgccatttgaacagtcttgaatgttcagaatagttcataacccagaagaaatggggaaaattagaccttcagagatagcatgttccctgttcctgattcatcaattgtgaggaaatttaaaatgagtgtctggactacatgattgtttaagtcctctctatttttattttattttattttatttatttattttgagacggagtctcgctctgttgcccaggctggagtacagtggcgtgatctcagcacactgcaagctccgcctcggcctccatggttcacaccattctcctgcttcagcctcccgagtagctgggactacaggcacccaccaccacacccagctaatttttgtatttttagtagagatggggtttcaccatgttggccaggctgatttcaaactcctgacctcaggtgatccgccccactcggcctcccaaagtgctgagattacaagggtgagccactgcaccaggcgacgtcctctctattttaatatatttcaatcaagaaagcctcatacatctaaagataatatgtattaataaaagccctctaagtatgaatctagtaaatgtggagaccaaaattgcataagaaataatgagaaaaggtttaaatggtgggaaatgagacaacatgaaaataatttgtttagccttacattttacaaaacttagggtataattgcaatgtttgaaaggtacaaaatagaatgctcgctctgaacatatgacatctgtcacttcaattgtatataatgatgttaaagagggtaattttcataagattatacaaggatattgttgattttccctgaagtcttttagaaccatcaattaatgtaacaattatatttttaagcaccttgtgcagaggagagggataggcatgtcaggagaggtttgaggagggattaattttgtaggtagtcagttcactagtgaatattttattgtatggaaaattttacttctctacacagaatcataaatataacaacttggataatacataccagaataatgagactgccttgtactttactgagtttgggattaataattaatactatgggtagacagttttccaaattcatgattaagttttctctgataacaaaagccatttttcaacttttatttctttcaagaagcatacccttgattaatgtttcagtatatcctacagggtcattaacaccagtgtaccagaggaagatgaagagaaaatatttctgcatagagaaatggtatatgacctcaagtattaaaaatgaattctagtatcttagataccaatcttataagtgaaaatcctcttttgagctgcaaaagagaactagtgtgctattttaagatatacccctttaaaacagttttagggagtatataggactggggtaaagaacagagtcttgggagtcagcattcttatatcaattgagtttgctaatcttgggcaaagagggaaattattaataggtagtacgtcacttctaaattctttttttaatttttatttattatacttcaagtgctagggtacatgtgcacaatgtgcaggtttgttacatatgtatacatgcaccatgttggtgtgctgcacccattaactcgtcatttacattaggtatatttcctaacgatatccatcctccctccacccaaccccatgacaggccctagtgtgtgatgttccccttcctgtgtccaggtgttctcattgtttaattcccacctatgagtgagaacatgcggtgtttgtttttttgtccttgcgatagtttgctgagaatgatggtttccagcttcattcatgtccctacaaaggacatgaactcatccatttttatggctgcatagtattccatggtgtatatgtggcacattttcttaatccagtctatcattgttggacatttgggttggttccaagtctttgctattttgaatagtgccgcaataaacatacgtgtgcatgtgtctttatagcagcttgatttataatcctttgggtatatacccagtaattggattgctgggtcaaatggtatttctagttcgatatccctgaggaatcaccacactgtcttccacaatggttgaaccagtttacagtcccaccaacagtgtcaaagtgttcctatttctccacatcctctccagcacctgttgtttcctgactttttaatgattgccattctaactggtgtgagatggtatctcattatggttttgatttgcatatctctgatggtcggtgatgatgagcattttttcatgtgtcttttggctgcataaatgtcttcttttaagaagtgtctgttcatatccttcacccactttttgatggggttgtttgtttttttcttgtaaatttgtttgagttcattgtagattctggatattagccctttgtgagatgagtagattgcaaaaattttctcccattctgtaggttgcctgttcattctgatggtagtttcctttgctgtgcagaagctctttagtttaattagatcccatttgccaattttagcttttgttgccattgcttttggtgtttatacatgaagtccttgcccatgcctatgtcctgaatggtattgcctaggttttcttgtagggattttatggttttatgtctaacatgtaagtctttaatccatcttaaattaatttttatataaggtttaaggaagggatccagtttcagctttctacatatggctagctagttttcccagcaccattttttaaatagggaatcctttccctatttcttgtttttgtcaggtttgtcaaagatcagatggttgcagatgtgtggtattatttctgaggcctctgttctgttccattggtctatagctctgttttggtaccagtaccatgctgttttggttactatagccttgtagtatagtttgaagtgaggtagcataatgcctccagctttgttcttttggcttaggattgtcttggcaatgcgggccctttttggttccataggaactttaaagtagttttttccaattctgtgaagaaagtcattggtagcttgatgggaatgccattgaaactataaattaccttgggcagtatggccattttcacgatattgattcttcctatccatgagtatggaatgttcttccattttttgtgtcgtcttgtttccttgagcagtggtttgaagttctccttgaagaggtccttcacatccctcataagttggattcctaggtattttattctctttgaagcaattgtgaatgggagttcactcatgatttggctctctgttggtctgctattggtgtataagaatgcttgtgattttcgcacattgattttatatcctgagactgctgaatttgcttatcagcttaaggagattttggcctgagacgatggggttttctaaatatacaatcatgttgtctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagggagtaggtccagtttttggccattcagtatgatattggctctgggtttgccataaatagctcttattattttgagagacgtcccaccaatacctaatttattgagcgtttttagcatgaagtgttgttgaattttgtcaaaggccttttctgcatctattgagataatcatgtggtttttgtctttggttctgtttatatgctggattaagtttattgatttgcatatgttgaaccagccttgcatcccagggatgaagcccacttgataatggttgataagctttttgatgtgctgctggatttggtttgccagtattttattgaggatttttgcatcgatgttcattagggatattggtctcaaattctctttttttgttgtgtctctgccaggctttggtatccggatgatgctggcctcataaaatgagttagggaggattccctctttttctagtgattggaatagtttcagaaggaatggtgccagctcctccttgtacctctggtagaatttgggtgtgaatctgtctggtcctggactttttttggttggtaggctgttaattattgcctcaatttcagagcctgttattggtctgttcagggattcaacttcttcctggtttagtcttgggagagtgtatgtgtccaggaatttatccattttttctagattttctagttggtttgcatagaggtgtttatagtattctctaatagtagtttgtatatctgtgggattggtggttatatcccctttagcatcttttattgcatccatttgattcttctctcttttcttctttattagtctggctaggagactatcaattttgttgatcttttcaaaaaaccagctcctggattcattgatttttttgaagggctttttgtgtctctatctccttcagttgtgctctgatcttagttatttcttgccttctgttagcttttgaatgtgtttactcttgcttctctagttgctttaattgtgatgttagggtgtcaattttagatctttcctgctttctcttgtgggcatttagtgctataagtttccctctacacactgctttaaatgtgtcccagagattctgatatgttgagtctttgttctcattggtttcaaagaacatctttatttctgccttcattttgttatgtacccagtagtcattcaggagcaggttgttcagtttccatgtagctgagcagttttgagtgagtttcttaatcctgagttctagttttattgcactgtgatctgagagatagtttgttaaagcttctattcttttacatttgctgaggagtgctttacttccaactaggcttcagaagatcaaacttctccgagctaaaggaggaagttcgaaccctttgaaaagaagataaaaaccttgaaaaaagattagacaaatggctaactggaataaccactgtagagaagtccttaaattacctgatggagctgaaaaacatggcacgagaactacgtgatgaatgcacaagcttcagtagccgattccatcaactggaagaaagggtatcagtgattgaagatcaagtgaatgaaatgaagtgagaagacaagtttagagaaaaaagagtaaaaagaaatgaacaaagcctccaagaaatatggaactatgtgaaaagaccaaatctacatctgattgttgtacctgaaagtgatggggagaatggaaccaagttggaaaactctctgcaggatattatacaggaaaacttccccagcctagaaaggcaggccaacattcaagttcaggaaatacagagatgccacaaagatactcctcgagaagagcaactccaatacacataatggtcagattcaccaaagttgaaatgaaggaaaaaatgttaagggcagccagagagaaaggtcgggttacccacaaagggaagcccatcagactaacagctgatctcttgctagaaactctacaagccagaagagagtgggatccaatattcaacattcttaaagaaaaaataattttccacccagaatttcatatccagccaaactaagcttcataagtgaaggagaaataaaatcctttacagacaagcaaatgctgagagattttgtcaccaccgctcctgccctaaaagagctcctgaaggaagcactaaacatggaaaggaacaaccggtaccagctactgcaaaaacatgctaaattgtaaagaccatcaaggctaggaagaaactgcctcagctaatgagcaaaataatccgctaacatcataatgacaggatcaaattcacacataacaataaattaaccttaaatgtaaatgggctaaatgctccaattaaaagacagactggcaattggataaagagtcaagacccatcagtgtgctgtattcaggagacccatctcatgtgcagagacacacataggctcaaaataaagggatggaggaagatctgccaagcaaacggaaaacaaaaaaaggcaggggttgcaatcctagtcttggataaaacagactttaaaccgacaaaggtcaaaagagacaaagaaggccattacataatggtaaagggatcaattccacaagaagagctaactatcctaaatatatatgcacccaatacaggagcacccagattcataaagcaagtacttagtgaccgacaaagagacttagactcccacacaataataatgggagactttaacatcccactgtcaacattagacagatccacgagacagaaagttagcgaggatatccaggaattgaagtcagctctgcaccaagcagacctaatagacatctacagaactctccaccccaaatcaacagaatatacattcttctcagcaccacatcacacttattccaaaactgactacatatttggaagtaaagcactcctaaattcttgttctatctcatgagagtttggtcacctttgaaatttgaacaaactacaaaatttctttgaatctcagggatttatccttttggaaatttatgcccagtttgtagacttcattagagggataaaaacaaatgtctgcaacgtatctggtatagttggtgctcagtaattttattgaagactacctattttttgcaaataaaagttaaaataaaattctattactaaatcaactccctataccctaacacctatggtcctaagtccaacatatacacttttacaacagttcacgccatagacaggaaatggatatcctggggtagattttttttttccttcaaaatactagtctttttcagctcctcgtacagctttgttgatgcctatatcccttgttttggttactgaccctgggtctccttgcctgggcacctgatttctgtagcttctgttcattcacattcatttcagatgctcttataatttctagttcctaatcttaatctagcttcaacattgccctgcttgcaaatttactaccttttaaaatgacttgaatcttctctattttcacagttcttgtctattttttccctgtaacagtttgtatgaacactaatgtggtgttcaaccctccctttcaattttagagaattggattctatattggaacgtcacttaaatttttgagtcctcaaaaccaaccttgttgaaatggttaataactttgtgaagcatgttgtgactagagaatagtgctttaaaagctataaggattagtgttgttatgaatttgacatgcattaacatgaccattgttaatggacagcttggtacttaatctcccaggttggttaatttatttagacttttgcctacttactttagaaatggatgtctagccatctgctaggcaattacagcttagctgcattgacatctgctttccttcattcttatagacgactgggtgcttgaaaaggcaaatatataaataacttctccaaaataaacagtactctaaaatataatacaattaattacatttgtgcttaaagatgcccactaatttttatatggatacttaaagaaattgcaagtaattataatagaaatgaacaatgatttatagattatatcataatgtcatttatttttagtgacagttctgtgaattatagcagagatcatcatcttccataaggagatattaaggatccaatacattaaataagaggcccacatttatacagtttggggttctagattataaatagatatttctataattatcaggcccctgcagcaatgcaatagaatggcagggaggaggaggaggaataatcaaaccactttgcttttaccacagaaagacagtcagacattaaaatgaattaaagtcaattcatgtttttatttagctcaggaaaagcattcatttaaatgacttttgcaaaaatctttttattatggttatttgctcagagtttaaaataaacagaaacctctcaaagaacaaacattacttatttaatagtgtaactttacccgtactggggaacataatttattaatagataacattggttctgagtgattcagcaaaaccacgatggatgccacttgaagtcacaacaattaaagaagcttaacagaatggcctcagtttctatggtgacagttacagaactattcagggatagcatgaaacacataaaatattgtgttcttttcagaaaatgatctgtgacagatttatttaaaaatagaaaatagaaaaaattatactcaaacttatttcactcaataacatctgtatttaggagttagaatttaatataaatacattcagtatggagatttgcctcagagattcacatggaattaaaaccaaaaagtttatcaccagatttcctacatttcactgtttataaaagacaagtaggttttattgtcttagaattgatttgtcctcataaactaggtgtgatttcaattttttcagatatttatggagtcttcaggttaacattgaatgaatgtattgtttattttagttaaacacctctcagtttaatcaactatgattcattcaatcaatattttcctttaaatagattgaaggtaactaaagaaaccttaaagaaaataaaagtcatcggccaggcacagtggctcacgcctgtaattccagcactttgggaggccaaggtgggaggatcatgaggtcaagagatcaagaccatcctggccaacatggtgaaaccccgtctctactaaaaatacaaaaattagctgggtgtggtggctcatgcctgttgtttcagctactcaggagtgctgaggcaggagaatcgcttgaacccaggaggcggaggttgcagtgaaccgagattgtgcctctgcactccagcctggcgatagagcgagactacaaaaaaaaaaaaaaaaaaaaaagaaagagaaagaaataaaggaaataatagtcatcaaatacatagaaggaaagagagaccaagataaatcattatttatttgttatgatttctaaggtaacaatgttgaaatgctaataatcaaagtaacattacaaagttatattttattaaacaacaaacttttaacaacagtactagtcatccacattttgcatggtaccttgttaactgaaaaccaggcatattggaaccatgtccttgctttgatttaattttagttacacagaaccatgcaaaatgagaacatagttctgatacatatgagtttcagttaacatggtactatacaaaaagaagcctgtttgtatttacctgttagataattcctatattatgctatgaagacaaagcaagccagaaccattcatcagtattaatatatatggggtgtatggagagtattttgttctttttttgttattacatcctcctcataactaagaataaaaacacatgtttacaatatattttagctacagaatttttatagtacatcttaaacaatttacttttacaaactatttaaacttgttgtttttaaccttgccagattccacaaaagagaagaagtagctcaatgcaaacatatgtaacgtgataataacctagaaattgaataaagaatatcaatataaagccaaagaagtacactaattactgtatttgttatgcttcactaacgttgcataacaaacagctacacatctcaatggtcactggtctttggaataactgtggttctgttttgcttgtctggattaagctaaagagatgtaacttggctttatctaaaggtgggattcaggtctagtatacctgtctcctaaatctggcatcagcagctattcagggaaggttcttctcatgagggagtgcaggaggacaagagggtgagatggaatcatgaacagtctcttttttttttttttgagatggagtttcgctctttttgcccaggctggagtgcaagttttgatatacttgctataattgagccttaatgtttattttggttctagtaatccccacttatccatgggggataaattccaagatccccagtggatgcctgaaaccattgttcatatcaaatcctatgtatgctatgtttttgcctatacatacatacatagatacttatgataaaatgtaatgtgtaaattaggcacagttggagattgacaacaataatgaataattaaatagaacaataataacaatttactgtaataaaagttatgtgaatatagtctctccctctctttcaaaatatcttattgtttgtaatattttcagactgtgatcgactgtgcagtctgaaactgtgattgactgcgcagaactgaaactgcagaaagcaaaacaaaagataagtgtagactactgtataatgacattaaaaataagctgaaacactgacatttacatagttcttattatgttcagaatattaacattttgataaagtttaagttgagagtatcctcatgaaatctgatacatacaatagacttgaagtataagttacaaagtcttaactgcctcattgtaaattataatggcatgattattccatcaacaattgtttggtttaatattatttcagtgaagacaggtgccatgcattttagatgataaaaattctaagtcttgtctgtgttttccctgaaatgaatcaagggattaatgttttccatgcctcatattctttaagtcttcatattcacatcacaaaaagaattaaatagaaaagaaattctttatatgtgttttaaatacttacaagtcttatattgttttagaggttacaggtattatagagaagtgccacttaacaatttaaatagaggcagaaatgaagacaaagattaaaattaggcatcattttctcataaaacgtgaacagactttttaaaactccacttataagttttaaaaaatctctctgcaattgatgagttgattatgtaataaatattgaagccctaattaattatttggaaatctttatcaataaataagccctatgtttctaaaaatagttatgaaatatatatgtgtgtgtatatgtatgtgtatatgtgtgtgtgtgtgtgtgcatatgtgtgtgtttgtgtgtatttgtatgtgacattttaaggctttattaccatatggctgaatcgatgccctaatttcaaattgttaatttggtactgtcttttaagtgcctactatatgcaaggtacatataccaaatgtatgtcttccaaattcccttgttaaaaatcacctgcctcttactcaggaactaccaagagatctatttcatgtctctatatatgaaatgctgcccttaccaatgctgaagtgtctcccattttctgcctatttaaatttctttgatttcttagcaaaaactgtgcatgtgtaatgaaatttgggacactagttaatggtgcttgaattaaactcttcatttttctttataagcttctcttggtttctggacatgccttgtgattaatatcaatatatatgaattactcaatggttttgtttttatttttttcacactatctatttgcctgagcttgtatgtcttcataaccagttatgaccaaacctgttgttcaaccctggttcataacaatctaaccaaaatggtatcataactccaggagcagaagaatttttgtcagatcttaatgacaattataagcaaggaaaaggataaatgaaattacatgatttctcatgttccatcatagcttgagcttttagggcaccctctaaaagaactatttggactattttgctatgaccaagccatcagttgtttctcctttggggttaattcagaaagcagctaggaataagtttatttcatggaaaaacacaaacatggagggaccaaattagtcatttatggggacaattagattttaaaattgcaattttatacactacataaaatcaaagaagagaaatttaaaagtactgcatctaatgttcctttcttattaatggtgttttctgttccagtcaccattttggctttcttcagagtttgtaatcaataaagaccctggcgtttgaagggcatattattctttttccctttttttcatgctagaaacatcatctctatgagttcatcatgtactcgattaattctcaacagctgctctttaatattattttgaagccccagatagttgatctgtgttttgaattacccacagtgttctaaaatgggcatctatatgtgatttttataatcaggaaaaaataagagtgagaaaaggtcatcatacttgatccacattttttttttttagacagttttgccctatcacccacgctggagtgtagtggtacaatcacagctcactgcaacttccatctcccaggatcaagtgactctggtgcctcagccccctgagtagctggaattacacacgtgtgccaccacgcccagctaatttttctattttaacagagtttggatctcactatgttggccaggctttttttgaactcctggcttcaagtgatctacccgccaactcctcctaaagtgctaggattaccggcgagaaccactgctcccggcccacatcttttgtttaaatcatatttatatcattttacctggaaatagcattacagcatagacttggaagagaagcagccaagaaaacaaacaagcaagaaaacaaacaaacaaataaattaatatttttattataaagtttgaagacctattctggtggcaatgtgctatgtgatttcgaaattatgcccaatataggaaattaacagtagccctgcattgcttcagagttttattatttttctaagtaaaatatatatgatgataataattgggaaacaaaggaaaataaaataaaattctgactaaaaacaaacaaaaaataagattgtttctgaaggagaatatggctctatatattctatataaagaatatatagagcaaacaagtatagtctaacttaatgaagtgttttcactcttgtcattttaattggaaaaaatttattctagaaagtaatatagaaagataataaaatgacatatcgatgaggaatttatccctttgtacctttgctgaccttcattacagattcatttttaaatcattttgttattgatggtaataaatatatttgatattcacaggaatttcacttgaaaaagataaaagatttcatagtagtaatagaatgttggctaagtagctaattattgcatacttaaatttccggtctttaaagtgacaaaaattctagatcttgcaattaacgatattaatatgtgttgacataaaatgagactgtgttgatctaggggtgataaacactgccatttttggaggattatgttttagcaagtaaattgtgtcctttgacttaataataattgcttctcgtttgtctccactcttttcgttttgcttcgactgtccacaacaaccagctttgtcctctagaagcattttaattttatctatgacagttcaactgttactctctatgctcacagtgggaaaatgtcagtggaaaaatatcagtataaatatgatttttgtaagatgcaaacattttgaaaatataatctatatgcccacttgtcatgtgtttctaagctgtactatgttgttgtggaaaacattggaaatttattttttaaagtcgcctagcagatgaaggaaacacaattaagatgatcttttcctaaatatactttggccctttatatgtagactgcagttatatttttatgtattgtataccttgttaattatccaaaattatttttttaaacttgatgttaaattgctttatagaaataaatttatcatcttttatcaacggttagctgtcataattgctgataggactaatgtaataattacatttttatcttaaagaattctgtaggtttgtttgaacaatccagacacaaaactctaccatatatatcaatcaaatattttacaacatataaaattatagagcaaaatatgacattttaaaagctgaacattagtaattttagattttctgaatacatcaattctcacactgctatcaagaactacctgagactgggtaatttataaagaaaagaggtttagttgactcacagtttcataggctgtacaggaatcatggctagggagacctcaggaaacttaccagcatggaggaagtgtgaaggggaagcaagcaggtcttcatgtggcagcaggagagagagaaagagagcacaaggggaagtgcaacacccttttaaacaatcagatctcttgagaattcactaactgtgaggagaagaacaaagaggaaatctgtccccatgatccaatcacctcccaccaggtccttcccttaacattggggatttcaattcaacatgagatttgtgtgggtgcacagagccaaactatatcactaaaagtttgtgttctctaagtagcacagcaaattgtacataagaggatctaagcaaatattctgctactattgtcagaagcggtggacaatgcctcaggtggatgttgagggtggcaagatgacagactatagaaataaattacttcactgggaaaaacaccactttttctcaaggaaaaaaaacaagatcgaagaagagaaaatgcataaaagcatttgagaaaaaatatacatatatgtatatatcttggatatttatttttaattaagctgacttttaaacacagagctcttttaaaaataatccttttaaatctctttataccagacagactatagccagaacaaatagctgaaacttctggcttttaagccatttttttttctttcctcaaaggtgttttctcaagtgaaaccaataagcatcactaaggttttctgacttaaccacagatgcacaagatgacttcggagagatgccaagcatctagaatcaccgctaaggtagctcagagaaaagaaaattcacgtcagaaaatcagaaactgtacatggagggaaaaagaataaataaatgcaaaagtcctacaagtgtcaaaccagaaaaaactgagtccctaagccaggaattgaaccctagccatcattatgaaagagcaaatctttagctactgagctgcagtatgagatgagtgttatattgttttttcccagaagaaggctagaacagtcatttttgagcttgcaaagggtacacctttacaagggaaaagaaactgatgtaaagctgagacgtcttaaaacagattttagaattaaaagtcagtatttcttgtggtcttactataagcgaaccaatacttaaataagaaaacttgttttaacacaggggaccaaaatttagaaagattattattttttctttttttaattatactttaagttttagggtacatgtgcacaacgtgcaggttagttacatatgtatacgtgtgccatgttggtgtgctgcacccatcagctcgtcatttaacattaggtatatctcctaatgctatccctccccactccctcaaccccataacaggccccagtgtgtgatgttccctttcctgtgtccatgtgttctcattgttcaattcccacctatgagtgagaacatgcggtttttggttttttctccttgcgatagtttgctgagaaggatggtttccagcttcatccatgtccctacaaaggacatgaactcatcattttttatggctgcatagtattccatggtgtattataaataaattttatttcagttatggctaatttaattatatataatttttaaaataagctccctttttataaaccttatcatgacttacatagatcatctatgacatgcttagactttttgacttatcgtatacttttttctttcctaaaaagtcattctactttaggacaagaatttaccacacatgatcctttctcatataacatttatttccttttacctttatcaccaaaaatacataattgtattcataacctttgcatttttctttcctactgattttttatctttttcacttatttctgatttcttcttaaatcgatattttaagacccacttttaagtaatgtccaattggccaattttttttcaataagatcatatcttctttggcatatttcatatacagaattatatacaaatttttattaatcctaaatttccatgaacttatcacatgaacttgaaaaatgcttggacttaacttatgaatggtcttttatttataagcctgtttggcactctgtagacacaatatataacataatgaaatgtacatacacataaacacatctagatatgtatacacacacataaacaaagatccaatagcttttatcttaggactctagccatgaaataataacacaaattcactgttttataaatgatagctggatccaaattctctctctaaaaaactgggacttttccacatggctaagcttgatttctaatttgaatttttctgattgcctaaaagactgcctagtgactagttcttcgggactggccattgtctccatgtctaataaggatctattagacaaaagtttttctaagtctagcaagagctcagttattttcctctcaaattctcacctcatatagcaaagtgtaaaataaagtgacaataagaaaaatggtaaaaatgtgtaaatttgtagaaatgctattacagaaaatgatgactttaggatagaaaacaagaaaagggaaaaccatgatgtccttagggtggactctaactcacaatcctagagagaatgccaattccaaacattgcagagcatccaggggcagccagtggtattaaatgccaaaaaacccagagtatccaaatatcaactaacaagggtccctgcaccaaatgccaaaaactgaaacatctttgggttgccaatagtgaaccccaaagacactaggcctaaaacaactggggccacagaacaacatgattttggcattgcaaggtcaacacaacaggagacatctcacaaccaagtgtcctgccttaaaccattgcccaaataggtaaagcaaagactacaaacacgataatgaaataaacataagcatgcattttggcactaagaacagaaaagtaaaattgccagttattagaaatgaacgagaaaaggtctgagagaaggggcaacagatgggctacaaaggacttggctggccagacgtgctcccatctggggcacccagacaatggcagactgcaactgggcttcaaagccagaagccttacggccacttccccatctgtccaaaataaagaatgtagggaaagacagaggaaccaaaatcaaagcggggcagggaaaagacagtaagttgaatctagactatgggagacccacccaccaattaggtctaagtgatgctgattgatcttaatttggggtcttgggggatgtctccattgtcacttcatcagtcatcagaaaagatgtcacagagtgagccctgagggctgctgctgattggctacttttatggtttttttgatcatgtgctaaacaaggcgtggattattcatgagttttggaaacggacagggcatttttgaaactgagagttcatctttctttcagaccatacagagtaacttctggatgttgccatggtatttgtaaactgccttggcactgatgggagtttcctttagtatgatagtatattataatttgcatataatgagcagtgaggacaaccagaggttgctttttttgccatcttggttttggcagattttcgccaacttctttaccgcatcctgttttatcagtatggtcttgtaaaacaatcctgctgaattcctaattcactcccattaaagtctcttagtcttatttaaccgtttgggtaaaatttctccccctctctccttccacagtactttgatcttatctctgtaatacacttacaactttgtcttgcgattctatttgcatgtctgtttagggacaaagggatgttttattcaacttctaccctctgtaccttcctcagacctagcacatgttgttgctcagaaaatgttgaattagtgtatgagcacaagaagcagagttttaaatattctagtcctctatgtaggttatctgtatattgaaggaaatttttcccaaagggataacattaagtaaagccaatgattattaaaattttttttcagaattttcatctagttaattttcttataatcagaaaaaaatgcagttcagaaaatattttttcatgtcatgagcaaaattctagtaaagaaccagaagtaaaatataaaatatgcatatgtttcttgtttgtgtttttgaaactgaagaactcttgtggttggcttgtatttcaactcacattttttaattcatccaaataaatgtttttcagcatttaaatattaactttaggccgggcatggtggctcacgcctgtaatcctagtgctttgagaggccaaggcaggtggattgcctgagctcaggagttcgagaccagcctaggcaacatgatgaaaccctgtctctactaaaaaatacaaaaaattagccaggcatggtagtgtgtgcctgtagtcccagctattcaggaggctgagtcaggagaatggcttgaacctgggaggcggaggtcacattgagccaaaattgtgccattgcactccaacctggatgacagagtgagactccgtgtccaaaaaaaaaaaaaataaataaataactttcaaaaataacaagaattgttaaacattgttaaactaaataataggttctatgctacattctatatttcactcacattgcttttcattttggacatcaggtattctttttaagcttgtatgccaataatttggttctgttcctaaaaaataaatgaatagatttggttgacgcactctcgtttcagttctcttgtctcaaataaaatctttaactagttattgcatacgtttactatcttttattcaaaattttgacaactaacaaggaaaactgaagaattaaatgaagcataaaggaatgtggttttgtacacagaaataaaatccaagcatgaaagaacacactagttttgttcttaacactgattgctatttgctaaaacagcagtgattacttctttcctgcatccgcaataaagtcataatggctcagaacaaagcttaaaaaaaaatagacatgttgaaagttgtgccattattccttactgcccttcctttgtccctgaaaaatgcaaaaaaaaaaacaataagaggcttgtaagagagaaaggagaaaataataaagaatgatagaggactttataccgtctaaacattatttgaaaaaaacatacaactattaaatttcaaactgtgacagttaatctctgtgatttttatagtttatttttcttacatgaaaaattgctacattctttctggacaagagaaattgagatagagatagaaatatatatatatgtatcatatatagaggtagaaaaagacaaaaatacaatcatttcatacattttatagtctataatggtcaatttaagctatacagcagttattcagtatggaatattggagagaaagagataaaggtatgattttatgtatatccattaccattcttttttaatcaaggtaggactgttcctcatctggccacttctcttcagggcctctaaattgtgaatgccaggagcaaatgtaaaggctaatttcgatgattactttgaattcttttttagttgtgctagctttcatttctacagaaaatctgcttttaaaagatgatttccattttctaacaaacatttgacaactcagtgagaagattcaattttattttatatagatattttatattttatatggatataatattagtaagcatgaacataaaagaactctgaaaatgaagaattttcataaatgtaaccgataatgtagtgtgcttatatagaaataccttagggctgaaatgttaattcatgtgtgaatctggtttcattgtgtggttttaggttaaatatatttaattgtttatcttttggttggatgactgggaaagtaatggatgcacaagaatttttaggattttggaaaaattgtactgaaaattgcctctcagaaaagcagttacgttgggtatacagtgagtataagaatgaagttgttcataaaatctaataaaggaggaataaaatttggttagtttggtctatttatctatacattcatttatctcaccttgaatgtccttcaacaatctggtttattaaaattaaagttgtcctttttctggattttttttcatttagacctcacagacttgttcagtttgtttctagatgaaacaaacttgttatcttgctcacatgaggtttcttccccgctacatttggaatcatttaaatttttctctacataggaatcctccaatctttctcagcgttatagcatttgggcctaacctccctcaagaaaggagcaaactctaagtgattccatatgtcctcctattgaaaatcattaattccgagctttagtatagtgatgagacatttagggaacatttgggtattgctgtcaagtaattttattgcctccttcatgaattagttccactacagtatcagatgtaatggagactgttgaagtttcattactggtaaccgggtgatctagcttaattatagtataattaatatcttttttatttaaaacataatgctgattttaacataattaagcacttaagctcattgacaatagaaataactttatcttaaaggttgattgtcttatctcaaatactataactaaatttggggtatctgatttcttgacatttgctaaacaaccttactaaaataggattagcatatattgttttaatatatttcttttttaggaaactttgaattttaagatattttgttaagctaatatgtgtgtgtaaataaataaatcacacacacccatttaataaattaaaagattcagtctcaggtggaaatcgcaatcatagaagagtttgggaattaatacgtttttgctattgtgtattttcacatatgtgtgtcaatgagtatgtggatgtgtttgtgtgcaaaaagagcgttttttatagcataaagtaggtaattgtttcatttaatatctaagcagaaggccaagttttacttcacacttcctttttagaaggtttagacatatgaagtgcaaggattcttctgttaaagaataatattccaggagactttgtctacagcacctgggaagtgtaataaaaaacaaagaataataagagtgatgcattgttccatatcctataaaagaactttctgaaatttgctaagtcgtttgccatctacatgtaagaataagacagttatactgattaaaacaaggaattgagtcatattttctaccactacaattgcaatcattttttttataactatgtgaaatgcaatttccttaagccaagtaccatctttaacctgaaagtgtaaacccttgacttagaacaattttagagattaaccttttcattctgccttcttcctgtcagctgatttctggatcattgtgcttgaacgttattatcacaattatttcctgattttttcccctcatttattagttccagttgcatcctgaattacagcagaatgatggttagatgtatattgggtttactcatgtcaccttcactgctcatagctgggtgggctagcacattgattagcatacttgaatatttaaaacgtgctttatagaactaaatatttgggttatgaatattaacatattcaatgaatatagaaacaattttatctaaccaattgttttgctatctcaaaaatcataactaaatttttatgggacatagtgattaaatctgtgtctaaaagcaattaatgccctatatctgtagtaatgtcagattttcatggtttattaatctcacagtgtgctagaactttaacatttctccttagatgtgctcattcacattggaacataagatatgatattgaaagaattcttaaaggacaaatgcaggcaaaaataaatgaaatggaataaatatatcctataatatgcagaaaaatattccattaccaataacgtcatgcattttaaaactctattcttttaggtatttattgctttttaaccttcgctgaaatgagactgagatcaataaaggtattaaatggtttctaaatagccaaaatacgcaagtatttttgttttctaaggtgaattctttagtgaactttttgaaatgtaataattggcattgtctttcaagttaccattacaaaaacaagtgagaattaaagtagaaactataacattaattttttttatgtcttatcttaaaaataaacccttggaacatacatttcaactggcttaatcacatatgagacaaagaaatgagaagttataactaggcaagtcctggacttcaacgttgtcttttccagcttttccatgacactattgcaatcaaatgttatctttctttcatgctttggaacattcctattgcaacaatgaggagaagaagatttggggaaatatagcagattaagagcttgagctgtgtgctgctgccatgagcagccataaacacctgctcactgatgacatctcatagctagtgttataattgaagttgtagtgatatctccagagagatcatagagcaaaggataggcccagcagtagaaaaagactctgggccttcgtggtgctcagtaagagttgatgatgagtcacagtagcagggtcctggcccagacctccgatgaccacatggacaaggaagttgatgcaggggaaggagtctgtgagccattgtggcccaatgagcacatcctaactcattctaatatgaaaagattagggagatgaggaaaaaccagcaaagagactggaagggagttgccaatgagatggaattggaaactgttagcaggaaagtgtttctaccacaagggagtaatcaaccaactcaaatgttactgagagatagagtaagatgaagctagaaatcagtctgggtgcagtggctcatgcctgtaatctcaccactttgggaggccacggcaagcagatcatgaggtcaagagattgagaccatcctggccaacatggtgaaaccccgtctctactaaaaatacaaaaactagccgggcgtggtggcacacacctgtagtcccagctactcgggaggctgaggcaggagaattgtgtgaacccgggaggtggaggttgcggtgagccgagattgcaccactgcactccaacctggtgatagagcaagactccatctcaaaaaaagaaagaagataaaaatccttggtaacttcaacacagctttacgttggtgaagattcaagtgctattcgaatgagttcagagacaatagactaaaaggagttagagttggtgcatataggaaaccctcaaccagttttgttgtaaagtggaatagataaatgaggcagtatcttgagagataattcaggttcaggaatttttctaaagataggtgatatagagctcctgtttggatgctctgcagataataaaagatgaaagatttatacaatctgaggagaaagcagagtatgtgcttcaagtaataacgtgtaaagagaacaaaatgatggtatgggaggcagaaagaaaataattgatgagagaggaatttctcaaataggtataaggggaggtaatctagttaacctttagaggggatggcttaaccacaaagaacccagacaaagaggtaagcaaatatatgataacatccttgtaggtatgaatatgtggtggtgggtttgagaaagttttgtttgttctattttctgtgaaacagaaagcaaggtcatcagctgagagtgaggatgagataagaggtactggaggtttgagaagagagaaaaaatgaatacccagtggtccaggacaaggtcggcaaactgggcaacatacatatttttccgtagatatgtggtcacagatcattttttaaagttcactttcaaaatcctcttcttcatgatgtcatctctaaaactgatctgcctgagaatggagatgcaatataggcttttctttcccacctctcctttcactgtctctactccataccccactccttttctgggttctactatggtgccttgtctctggttggtaaaatttcttgaattccaagcaaaaaaaaaaaagaaaaaaacagtatcaggaacaaatccttttgaaaatcaaatggtttataaattctttgattttatcaatactgaggaagggcttaatcaatataacatgtgttagataactaggtattacatttgatgatttattgttatgtgatttttggcattcttagtagttcaacagactgacagacatgcctataacaagactccttccattctcttctactttcttattcttatgtctgtaagatggataatgaggatagaaatgacatgaacctatgttaattttagcaataattcaaatgtgaatcagaaaaataactgaaaatatgtttgtatcttacactgtgatatattccaataaaatgatacctttgtacttgataattactaatccaatcacatttagaataattactgatctaatcatatttagaatatgtttatctattttgattaactgtaaactgctaataattgcaataagtcattatagtaggaaacaatacttaaagcttaatggtcacaaaaataatttgtgtaagtaaaacatgtcttcttctggacaaataacacatttatttatcagaaattaaatcatttataattattgaatttatggtaaaattcattgatttcatattaacaaatgttgaagttatagaattttttataattattttagaagattcacaagcaaagccgcttgtgggtaactggtagaggagtgtggcagaatgtgtggactagggacatgaagtaaacttgtaaacttgcccagcaaaacataagactcacttgaggttaaagggcatgaatgtaagggaagtctacttagcatggttttatgtttttcttccatcatgttcagttgcgtaggtacacacatggagtataaatagtactgcattttaacaggatggttaggccaaagaaattgaggatgtatgaataaagcggtatggtgatgtaccatggaatttatgctgtgcaaagagggaaggaagacaggtaataggtaagaaccactgaaacaactgatttcatcaatgaattgtagctctcttcaaggtagaaaaattattgcaatctggaacctctgataatgagcatgtcaacactggaatgtctgaaattgcagtatttgcatgagttgcagttatgaaaacaagatccaaattttactgatttcatagtattttgtctttttctctcgattagaatgcagaatatgttagggcaggtatttttgtccctcctccccatctgctgcattctcagtgcttgattgattcagagaagctgcacaatggatctttgctgaaatctttgttgaaagatgaatgaagagtgtatgactatgggaaataatggctgaaattgggtagatgaagagttcataattctaggagactgggcttaagaacgggggaggtatgagagagaatttgaataaatcaggaaacaaaatttttaaaaattgagaaggtgtgagggacatgatggacaactacaaagatgaggagcggttggtgtgatctgatgttacgagtttcaaagctgtgggtggattacagaggtaggaggcagaataatctgaaaaataaagaagcagcctgaagaaaatctatgctgcctacaagtgcaaggagaatagggggatcggagagaaaacagctgccatttgagagaatcgtgggagaagctgtgacttcaagcaggagccagatttcagctagagctcatggagaagaacatttacaaaggagaagttgagatattgcagataactgatctgaaatttcagaggagagaatgaaatggttttagaaattcagcaggaaattggggattcttagataatgaattctttcataactcttgaatttgacgagattaagctctggatgaatgattactaaaatgacctatatattttctaatacaattttataattattttcagtgattaaagataaattttatcagtgcattgcctttgatatttattttagatggaattaatcatacatcattttctgtggtgtatttctttaaataattatagactatagatgtaaaatgatatagttcataggacaattttaatagattatagctatagaatgctatgaagatacagtttagaaaacattttaggccagacacagtggctcacatctgtaaatctcagcactttgggaggccaaggtgggtggatcacctgaggttaggagtttgagaccagcctggccaacatagtgaaaccccatctctactaaaaatacaaaaattagctgggcatggtggcaggtgccggtaatctctgctgtttgggaggctgaggcaggagaatcacttgaacgcaggaggcggaggttacagtgagctgggatcgtgccactgtactccaacctgggtgacagaggagacgccgttgcaaaaataaaaaaaaagaaaatattttaaacctttataataatatatatgattacatataggtgtatgaatatataattcatagttaatctctatattacattattacatagttaattactttttttttttttgagatggagtcttgttcctggagtgcagtggcgtgctcttggttcactgcaacctctgcctctcaggttcaagcgattttcctgcttcagcctcctgagtagctgggactacaggcatgtgccatcatgcccggctgatttttgtattttttgtagagatggggtttcaccatgttggtcaggctggtctcgaactcctgaccttgtgatctgcctgccttggcctcccaaagtgctgggattacaggcctgagccaccgcaaccggccacatagttaatttccatgtatacaattaatagttatttctatatccacactacaaaagaggtaaatacaagtataaaattttaaaaatgtctgttctatgcaatgacatttaaaattcttgttgattatagtttttggtcttagtgcagtcagtttccacttcataaatactgtcttgcctagcttgtgatggttcacaagttttacatgccccacataatgaatcattgatattttcttagtacattgggcaacttttgaagcttttgcataacttttatttttatgtattatcagaaagagcaggttactggtttagtggtgccctagtgatattgaaattatttttatttaagcctttattctctccactgggaaatcttcttaaatttagttttgattgtgtcttcattgtcttctgtattgttcacatgacatgatagtaataatgataatacttacatagcacttattctaggcctgtaaatctaagcactatacagatgttaacttgttcaagtcacatatcaagtacatgtgataggttctattattatcttcccccacccttatataaatagaggagaaaactgagacatagagtgagtaacttggttaaggtcacaaattgttatatgtcagaactaggattcaaaccctagggtcacactgcagagactatacctttaactatactgtctctatagggtacatagctggtaaatattttgtagtaaatgatggtgaaagaaaggactcttattgatcttttctcttaataaatatttagcaggcacctacagtgtcaaatgctctgttttacatttaataaaacagaaatggcttcatgaagcctggaatcaagtgagagaaacagaaatataatttgcacgtgcaattgcaatattgtaagtactaagaacaaaaagaatgaggtattataacacgcccttctttggactgtgtgggtaggccctttttgaggaattggtatttaagacttgaacaatgatgagaaggaggcagccaggtcatgaataagagaagagttcctagcagaagaaatagtatttaagaagaacaggatttctggagcttatagaaagggtgcccttattttgtctttcacttgaatccaaacaggaaacagatgacataccaaaaagtaaaatattttatggggattcatttataaagaaagctggatacaggcattatttaagggatggtgtagaaacttggggtgagcgttagaagagctagtatgtactaccccagggcctgaaggagaagcaagttgttggagctgagaaggagagggttatagagggcagacttccttatgagagccttatgaatctcttcagttgagggtcacactcagctagagcaaatccaaataaagggaaacaggaaaatagattcctgaccctgctttaccttctgccctttcatctcctaatgaggctgatcatctattgcctaaacacaaagggaaagggtatgagagcccactgattaacccattcagttcagtctcccgggacggagtgtagagcgcaaggtcaaagaggttttggatatccattagaatttttggccgctgaacgatcatgctatgcctttagttcatgttatagaatcttttattttaggcaaaatggggaatctttgaagtggtgtgcttttggaacagggagattataatacttttatgaggtggattttgctttgaaaatggcacacattgtagaggcaattgcacaaatggagtggggagatacaaagttatttggtagtttatatggtggctttgattacagatgcttctcaacttacgatggggttacatcccataaagccaccataaattgaaagtatcctaattcgaaaatacatttaatccacctaacctgccaaacatcatagcttagcctagcctaccttaaatgtgctcagacacttatattagtttacagttagcaaaatcatctaacacgaagcctattttataataaagtttgagtatctcatgtaatttattgaatactgaactgaaattgaaaaacagaatgttgtataggtacttgaagtacgacttctactgagtgtgtattgtttttgctttatattatatagaaaaatcttaagtcaaaccatcgtaagtcggggaccatctgtagtgtggttgcaaatctgtttaaaaggtataaataacaggacttgattatagattttatgaatagcttggattgaaaggtcacagtgactctcgtgtatctgactcacataagtagataggtgttggtgccacaaactgccacagaaaaaaaattctatgaacagaatgagttaaggatgttgaccaataatttagttttacacatgaaatattcaagtggaagtgtcagcaggttgaatatacagatttaaactggtgtgatccagaggcatacatttgggagccctctgcaactagatttaaagttatgtaatcatgatatcatttaagctaagagtgcattgagggactagaaagaagaaacgactaaaccttgtaaaacttacacattcagagaaggctagttagagaagaagtcagcaaaggaatccaatgttaggactaagctcgcacttgtgttatcccacttagattataataattctgtgaggtgggtattataatattttgaatcaggatctgagaatcagattaatcatcctggctttgatttttgcctcactccaaaaccatgcatttttcatgacaccaggttgtctgttacaaattataaatacttgtggaagtcaacatcttcctagaatagtgatagaaagcaagcattaaaaaaaacataatatgaataagggaagtagttttaaacactgcttaatttgtaaattacttctgtgatgtataaattaaattataattgactatccttgttttccagagttagttggaatgatatggttttaaatcttttaaataggctaactcatgtaactaaaacaaattttaaaataaatttttccacagaggtgccaccaatttggttttacctcctaatggataaaagcttaatttcagccctgatctggatctatgaagagctttggtacttacttccaacagcttgttcctaagaactgagtgtgtaatttattaatagagactagagagtaggtgtttgaaatgtacagttgaaaacaagtcttgacatttaaacttcatcacataaaaatatgaaatccattattttctactaggatattaacaatagagttttaaacatcttttgtaatagcacagtttcataactagtccattaactacatgataactgtcatgaactcaaataagtgtccataatgatcagtgagtgcttccacttaagtgtccatatacttaggagggtgaagcacctttcagttggtaataatacagtgactataataagttctgagcagaaaatattaatgaatctgtggctttgtcttgatttgaggtattaggatagaaaatatcatctcaaacttttcaaagttggttacatttctagacattataatttgccatgtgaaaatcatctatgcattattaatatcttacttatattttaatcttataaaggctaaatatatatctttatataaggatatatagataggatagttatcctatagatatccatataaagatacatagataggactgtttctatttacacatttcatgatattagacttccagcatgtttgtgtagcagacagtatttgggctgaaaagagcaaatttgtttccaataaatactatatctttctacttaacataggatgataagtagaattattacatgaaatatttgcttggagtatggacagaatttgtactttaaatttgcattgaaagatttttatatattcatttgtaaatttagcattaattttttttggattgtagtttaactttcgccataacttctaaaatctccattcattcattcatttattcattcattcattcattctgccttctatgtgccagatattcttctacctctgaataatatagttttttattaaaaaacagctaaagcctcctctctcatgaagcttacagtaatgaagaatgagaaataatataagtaaataaattttaatgttgctattataaatgttttcccagaaaaaatgaaatgatacagttgagtgacaatttatattattctaataatttaagcttcttaaaatttgatctagctgatacagttgaaactcggcatttgttatgtatataagctgcatcccaaaaacaagtgttacatagggaagaataaaaacaatgagatgtttccaaagtattgtcagtttattaattaaatatttttgaattggtattaatacattatagtatgaactgcttattacaatttttttatttctaaaacagaggctgattttattaaataacattgagaaaaataatgtaactccactaatagtaattatgatgcttaatacttacttttggttttgccagaatagatttaaaatattgattgatggcacttttattaaattctaccagatactgaggagttgtaactcttggactaatactttggaagcaaaagatcatttacatttcattaacatttaattatctcagaacatctctgttctaccaatgactaacagattcagaaaaaaacttaaataatcttaactcttacactattcaaaaacacggttttctttgaagtgaaaactacattgattggtttaaaaatgtgtagtacagtggttacaacatgaactttgaaattatactctcttggatataaatttgtgtgccaccacatattaacaatttaagcctcccaaagctccatttacctaatatgtaagatgaatatatttaatagtacttatagattaaagtgatatcatatgaggtaacctatgataacagtgctggacaaaaaataagcttttaataaatggcagcttttatttctgtagttgtttttagtgtttgtatcataattattattctaatataattatatatgatatgaaatttataattgtatataacctgtgtatatatagcaattataatcattttataattttaattattatttgaaaaatactaagaaaatagatattctttttcataatggaatttgtatccataaattagttttaaattatatagggagcatggaatctgctgtcacctgaaaatggtttgtggatgttaatgtcatcagaacctcagttgactgattctttgttgcttttactaacattgtgtttaagcatgtagtttcagtttcttgttggctttcttcactaaattccaagttccttcaggactatgtcttgcttatggtggaattcacaatgtttagtagacttttttcttacatatgaatgaattaatcagatattcatcagcattattttaacattaaaagaaaaccttactacttaatggtggatcaaatgtgcaaagttcttttatgaaaggtacttgtatactatgtcttaaaaaaacaattgtgcgcaaaggaaggaagaaacatgtgatgcaaatttaggcaatgtttgttaaaatagatatgtgaaacctggagcagtggcatgtcccagggactcaggaggctggggcaggatggcaggaggatggcttgagcacaggaatttgaggtcagcctggacaacggagtgagaccccatcttgtagtaaataaataatagataagtgagtaaaatgtgtgtttaaatttttataataccttgcagtgggaagaggaatatgaaacatccaagctagatgtagcataattacttgtaatccttgacactttcattttaaaaaatctaatacgcattctaggagttgattctttttttattaaattgaggttgaaaaataaacactcaatttgctttctgattctctttgctttaagcagaatataattcttgtgcttctcttaagttcccaatctatactatcaatgcctaacatatatcaaatgtatgcatatgccaataacagacttaaaaatatcctttagtgaaaaaacccttaacctaaccaattagtaaggaaaaagtaaagaaggacaaaaggaccaattgtgatgaatgtggttatgacagtgcatttgtttgtcggaaagggtaggtagagtaagcattgagatttaagaatttacagaacaaatataatacaaaagggaatttggcacaattcatgtgatgaaagaatacacatttacctgcattttcacccttgtcattgaccacccacaagctttttaccctcaagaagagaataagtcctctgaaatataactgtccactggagagcgcaatgtatgaatggctcatagcaagaaaaagaaaatggtaactataaaattaaattgtagtcatgaaaagcaaatagatggaaactgattcctctcttcaggttagagatagaaacactgcaggatttttttttttagactgagcattcttttctttctttctttttgccccagaatatcataaataaaactactgacttattttctttatgttttctcctgcaagtaggatttttcttttcacatatgagttccaggcctttctgaaacaggggacattaatataagcctaagagaatactggtcaagatagccatttgaaatagaaaccactccctgtttcttgaaattttctcctgttcagaatgccaggccaaactggtcactcctgttcagttttcttcattgatctgttttctcatttcactctgtaaatgtttgttgtttgtaacagacgtcacatttgtctactctctaaccactctgcctggattacctggttattttaatttaaatgctctctagtgaaaactccaaaatctggtctgatttctgtcattgagtttcagaactttatatctgatgtcctgcatggacaaatctaaactgattttagactcaattccataaatttctgcttcctcctgtattctcatttgtggttaataatatcatcatctaatgaatctctgaagctaaaaatttcaatgtaatataggactcttattcccacacctcagtctgtaagtcactacattttgtaggttctgttatagaatatttctcttctaatcagagctgttatgtgtcacagctttaggtcacatatttatcattttcctcccacattgttgaacaatcttctaactgagctgtctggcacttctcttaacctttaggagtccatgatctatactggtatcagttatctactgaaatctggtttggctctgttattcttctgctaagatatctccacatggctccactgaccatcgcctcaacttcaagcccaagtttttccctctttaggaaatgggttctattctacatggccagtaaactctaagacccagcataaaatcatcacttctgttaagaattcttctgtgaagactttctgtgacttcatggtctcagaagactgtgacttccatgaagactttccttacactcctttcttttatgctccattacagaacttaacaggcatattataatttctgtttataaatattccttaataagaaaatattttttgttgaaattatgacttaaattctctatgcataacatagtacctgtttcatagttggcattgattaaatatgaattgaatgattttcttctattgacttaaattaagtctcttagagtggtttttctacaacctctatgatactattggctgctcattttaatgtactctgattttaaatcccataatcatttacccccctctttacccctgctcctacctctatggtcatcctgtcattagattagggacattaaaagaatcttcaggtaggaatatattggtttgaggttaagaatggcagaatcaaatgattattgactgttattttaagccaggttcagtattaaatgcattaagaatttactcaataattcttagaacagaaataatgaatatatttgttttactaattaagaaaaggagaaattgagtaaatggttcaagtttatatggtgatgatggacatagctggaaaccagacacatatcagtccagtgcccaaaatgtcagtataatagacaactcatcaccaatttaaatttgtttctatttgtattgtgacttcacacataattgaattaactgggctcttgctttcctctctggtaccagcctttattccatttcaaggtcatcctcatataattagaactgattacttggcaaataaaggataatattttcacagcttcttttacctgtactacataagcacaaatgtacagtgtttatatgatattaatataatcacaaatagcatgggatttgagaatacagttttgttatcatttttagtagtatttagaagtaaaatagaatatcaaagttctgtgatttaagaacttgaagttccacagttggttctactcatattagccatttaaccttgagcaggtcagtttcatcatctggaaagatgattttcatgatactccaaactataaatgatagtagacctgaaaagtacgaagatttcctaaaagtttgtggaagaattgagaagaaaggcatatctgaaaaaaatcactataaaatgccagtaataataattataggcatataaccatgaaattaattctgtatatagtattaagctaaagatgtcactatttgaatagcatatcctgtgtacatgaagttgaaaacctaggtgaagagatggaacatatttccatctctttccatatatgactaacaattctaaatatcatttgtagtgttcaaagtcataagagctcaacataaccaagtgaaaaaaaacatatatttatgagactaggggaagaacattccaggctgggacaaaattggggagaaattctgagaatgagttagaactgttttaatctttttgtctgaattccttaaagatgggactgttttcttactttataaagataccttaggagcttattaaaattaggcttagttgtcgggaacaacatattcttacactgataaggaaaacttcaggccttttttgcagggagataagacttaaatatcaccacagcaagctgccattttagcattcagtggttaagccaaggggcaaacagctggagcagagctagcagaaaaacagtgggatgtagtttccaaaccacaagtaccttgtgtctaattcttgcattcttcagcatgaagattgttttttttgttgttgttgtttgtttgtttttgagatggagtctgactctgttgccaggctggagtgcagtggtgtgatcttggctcactgcaacctcagcctcccaggtacaagcgattctcctgcctcaacctcccgagtagctgggactacgggcgcgtgccactacacccagctaatttttgtatttttagtagagacagggtttcaccatgttggccaggatggtctctatctgttgacctcatgatccgtctgcctcggcctcccaaagtgctgggattacagacatgagccaccttgcctggccaaatgtttttaatattacaaaaatcagacaaatgaaattcctcatttgtcctcgcatgctcttgttgttcctaaattccttcagttgtctaattatgtcacctttttttcaatcaatcaaattataattgccagtattaagtatctagttgtagtgacagaaaggagtgaaagcagtaaaagatatatgaaacttaatctcctcatttaaaatcatgcaaatgactgaacaatcttacaataagaccatttctatcagaaaagctaggaagtttatattaaaatactgtttttaagatttagattcattcttttatatgaagctaatacaagatagaataaatcattttttttaaaaaaaaagcaaatctcatcagaggcaaaaatcaatagtttcatattcaaataaaaacagtgcttaaaatcagtccattgtaagttgtttgctgttttctaattgtttagaacaacttccttttatctttcccaggtgttttaatgaaatagtgaccaatttctgaaaatgtttttctgtaatataaacgatagccaaatgccttggagaatattttcttttataatttctgtctttataaaaagttagtctttgtaaatttagattgcttaaagtctccaaagttcttagatgagaagaattgattttaacaattctgtatactattaatagtaatgcttcaggctcattataaaaactcaaaaggaaaatagttaacaaattgtaagttgaagtattattacctaataatattattattgctcaaataataatttgattattattgtactttcttctctcaattacccttattttgaatcttcatttctaaatttgccttcctactattattttcagactttttttgttccctctgtcttttaatgattaaatcatcatcaaaggctggagtgcagtggcagcatcactgctcacagcagtccgtaactgggctgaagcaatccttctacctcagcctccccagtagttgggatcacaggcacactccactgttcccagataatatattttattttttgtagagatggggtctcactatgttgccctggctggtctcgaactacaaggcacaagtgatcctcccgcctcagccttcataacttctggattacagacatgagccactgcacctagccaatatttagttttcttgtttgtagcatctatattattacatagcaatgtgttttagttaaaatatcaacttagttaaaaaaatattttgttagtttttctcaaaatagctatagtttcctaattctttaaaattatttaatatatgcctttgatataaatatacttcccttaaaaattgagaaggtatatgtaatataatttccattaacccaaagaggctaaaatgctgctttgaaccttctcagattctctctacttgtaacttacactctgttcttactgtcctgtatgtggtttgccaaaaatattgaccacctaaaccaatttcgctgtatttcaataaaacaaaaccaagttttcgaatcataactccaaagtttgaatcatagctctctcacttaacagctcatgatttaactgccatgagcctcagttttctcaattgtagctaacatcagaaggcttttttttttcttatactttaatttctgggatacatgtgcagaacatgcaggtttgttacataggtatacacgtgccatggtggtttgctgaacccatcaacccgtcatctacattagatatttcttctattgttaacctacccctagcccaccatcccccacctgtgtctatgtgttctcattgttcaattcccacttatgagtgagaacatgcagtgtttggttttcggttcctgtgttagttcgctgagaatgatggtttccaatttcatctgtgtcccttcaaaagacatgaactcatcattttttatggctgcatagtgttccatggtgtatatgtgccacattttctttatccagtctatcactgatgggcatttgggttggttccaagtcttcactattgtgaatagggcttcaataaacatacgtgtgcatgtgtctttataggagaatgatttatagtcctttgggtatatacccagtaatgggattgctgggtcaaatggtatttctggttctagatccttgaggaatctccacactgtcttccacaatggttgaactaatttacactcccaccaacagtgtaaaagcattcctatttctccacatcttgtccagcatctattgtttcctgactttttaatgatcacaccaaaagcaatggcaacaaaagccaaaactgacaaatgggatctaattaaactaaaaagcttctgcacagcaaaagaaactatcatcagagtgagcaggcaacctacagaatgggagaaaatttttgcaatctatccatctgacaaagggctaatatccagaatctacaaggaacttaaacaaattaatgagaaaaaaacaaccccatcaaaaaatgggcaaaggatatgaacagacgcttctcaaaagaagatatttatgtggccaacaaacatgtgagaaaaagctcatgatcactggtcattaaggaaatgcaaattaaaaccacaatgagatatcatctcatgccagttagaatagcgatcaaaaggcttttttatgagagataagtgggagaaataacacaaaaatatcatcccagtgcacctctgatataataattcttattacatgttagatgatgttattaattacaatatttgccaattttaacataagttgggacaatgttttaccagcacagttttttcccctgaagaaatcaaggctcattagacttttgctataatggaatttatattagctaaaataaaattacaattagactggtgaatatagtttccagaaagtatataatttaaattgctaacataaaagactgatttttcttaaagtcagatcttatttatatatttgttacatcttatatatcctgccttttatgaattttaaattttgtagctattatattttagtaaattgatggtattgtttaagtagaaatgaagaaaatatataatagtttttaaagctttacctaaaatatacaagtcttggcaggaatacatactattccccatttatttatttatcattgtattaaatctttttgctgacagcataggggaaattatgatgatttaaagagtgagtatcagtatttgacagagaaggaaaatgatgataacatacaagcagttatttataacaaaatttaactttaaagtggcaattgcttcatatttgatttatgcatttatcctaggtggtagaacagacttcccctgtccaaggagtgacctttaaaggtggctattgcaatatgaaaatatacattttgagagtacagtgattatggaaatgcagaagaaaaaatagttgtgtggcatgttttgcagattttttttctttttgcctcactaacttaaatggtggtttgtgattttcggtattgactttttgaattatcatttaaccttttcatattcagtaattggcaccaaccagtttttctttgctgccccatcttctaccagaaacagccacactacctaaagtctaaataaaacacaaataaatatgatccagaaacacagctaatagagaattctggactttgtgttccaatgctttggtggactcagtttgatttagaactttgtctttagcaatgcagttttagaaatttgattttattcagttactcatggatactctgggttataattcatttactccaaccaaactttaaagacttcataatattacttcatttgtgaaccataagtttacctaaagaaatgctgtttagttctttgtctataaaacacacgttccattaaccagtgacatttttttctagtcactggagaaagtaaatttgattaaaattttatctgtgcatctaaatgttgttaaatgcaacttactcattcccaatgggttgtagagaagttttaaaggtaatattaggtcaccttgtctgtttttaaattttattatatgttatcatcattttcaaccagtttccattgttgattgaatcatgccttatctcactggttaatggttgagcaaggatttttagagtctttttgtgttggaattttgttgtccatataatgatttgtatactggacagctaaacatcatagacagatgtctgcttttttttttctaaaacttatgataaactattcttgctgactaaatttatatttggtaagtattttgtataagtcactctcaggcttgatgagaaaacagaaataatacctataatcctctttcttccagattttatgttgtagtacatgtatatacacgttgtgtttctagggcaatttgactttgtaatcactattttttatttattttattttttatttttttgcgagtgagtctcactctgtcactggggctggagtgcagtggggagattttggctcactgcaaactccgactctcaggatcaagtaattctcattccacaacctctcatgcctcagcctcttgagtagctgcgactacagacgcatttcactatgcctggctaatttttgtatgtttaatggagatgaagtttcaccatgttggctaagctggtcttgaactcctggcctcaagtgatctgcctgccttggcctcccaaagtactgggattacaggcgtgagccaccatgcctggcttataatcactatcttttaatgacctactactgatatttcctaaaaacaactaatggtcccctgttttatctctaataatttaatcacttaagaatggtatacagaaactagttgtttttagagatgagtatgaatatgctgctttttttggccattagctgtttatcaacatttaacgaaatgtggatgttcaatttcttaaaataataacataaattttcattacttttcagctcctctattaagagttctgctctgatgctaggcaaaatattacaaactactacatgagggcccacctttcttttagggaacgttgctctattaagtaaagggaaatggtgttatccctcaaatcacttaggagtatacaacctcatagatcctttagcagcatattaaatagaatatatatatatatattttttttttctctaatggtagagaatatctgatctgttcttatgaacatttccctgctctttaatatgcatggggatatattctatgcattaggattaaaagcacaaatgaactacattgtgtaagtaaacttcagaaaaacaaatagacattcattgaacacctactaggtgacagacaactggacaagaaactggagatgccaagatgaataggggtatggtcccttaaagtatgaagctgaaggtacagtggagaaatatagaacacaatttaatcaagtcagtaatcatagttttttctgttattctacttaaaagattaacactcttatagttttcatagattattggtgtcaatgaaactgatattggtgggcaaggggaggccagtgggacctctaccccagctggtgaacaggctcttgacacagtcacaagaaggaattcaaggacaagtcagaaaatagtaaaagtacagagattgttgcaagggaaaaagtacacactcaagaaaagggagtgtgggcgtactcaagagagagagtcacgtgcaagggactttggggctgctatctttatgggtttctttagccaagggatggaatattcatggagattcctagaaaaagctggtgatttctcagaactgtggtgccacccatttttacatcaaatatgagtgctcctggaactgtcatggcgcttgtaggtatgttattgactatgttaatgagcatataggaagatcctaggtgaaacccaggacagatacagtgctatgttgagtccaccagatcttagccagcttggtccatgccctggttttcagggtcttatctgctcctggcttctgcagctatttcggcagtttccttttgctagtcacatgaaactgctgcctggaattttctattctcttgcaaccaccttgtgctactcctgcctcaaaactgtccccataaacttgctccttatcagaagaaaaattaaaatactgtcagaagcaaatattttacttaaatcagtaaaatgattgtccttaaaaacagatttgttgagttcaccttaattagtaattggctgacaatgagtacgaatttagttcatgtttgtttataagccatgtaacatctgtgaattagttttatatgaattgcaatcttttcagaaaagaaataatgtaggctttttctggtttggccttttgttttttttttaaccccccaaggagccacagtagaaaatgaaaaacatagatctgtaaaggaaatggcattttctaaatactcttttctccctgtataaacacattgattgttagtttttaaattgctttgacttataaagaccttaaaaatctcaaaaatgagtatttacttccctggagatttcttcattgagtttaataaaatccttagtgagattcatacactgcaggtttctttttttttttttttttaacttttctgcttttgaaattacaagctgttactcaccaggtgtatttttattagtttgtgtgattctgagcctgaatatttattttacaagtccatttagcaaactatgaagctttttaaatctgtaagaagaggggcaatactttcattgcaactttgaatgtcaaatgtttaaagggtaattacatgcttgaatcatattcggagtcaggatagtcaggacacacttgctgatttggaactgagaattagttacttcaaaatagagagttattttttacccaaatgtataatattgttaaatagcatcactgaaaattctgtgaaaaactggtctgacatacatacacgcatgcatacatacacatattttgccagttgagccttttcacaagactcagctacctagttttcttattaaattttgctcaaatggcaccaaataagaaatgtcagcatgacttgtataacaacatactttcaacagtttgtatcaaatgatttgcattacactagagtcttggttagattggaaaggtgtttacaataggtaacataaagctaaattcttagaatttgattttaagagtatatatatatataatgagaataaagaaaatatgtttgtaagatttgtcttagcaaattttataattaatagtaagtaatagtgcagcaagagaaagctatatagtatctttataaatcaaaagtatgattatttatcttatatgaccacatagcctactccagctattgccccatctctttgaaatactctaaagctaaactccttgagagagtgcacactttccattttctcacaccatttgcttcccaggcaagtgatttccgtatctctaaattcagcaggcacattttagtctgccttttacatggacctagcaaaactggaaacactcacatttgccatcttaaacacttctttttctttggcttctgtgattccatattttcctctctcttctgcttgttccgatgatttttctcaatctgcttttatacccactttctacccatctagccttgtctgcccagagtttaaaagttggagctttttacggtggtgttctaagtctgagaaggcaaaccttttggtaaagggacaaatagtaattatctcaggctttgcataacatatggtgcctggtgcacgtttgctgttgtagcatgaaaggagccgtatacaataggtaaataaatagctgaggtttctagatatgttattctgcttctcagtttctttatatcaaaataattttgtatggacttctaccaaaattcttttctatttcttacatttaaaggaaattagttttacatttccctaggatatttttgtagctttatatctctagaccgtcccactatgtacaaatagatcgacttgtactttgagtagcttcctcctctacttctcccaagtatctatcttggcttttttgtattctgttcttactgtttctgttcaggtcactttagattgtactccctcccaggagttactttctagtgtgggactttggctaaaaagagagctaggttttttagttttgagattttacagggttgagggtctcctattttctgactttactatggtccctttgcatttacccacaaatttgaatatgcaaaatttctgtgggtttttttttttttttttttttttttgagacggagtctccctctgtcgcccagactggagtgcagcagcgcgatctcggctcactgcaagctccgcctcccgggttcacgccattctcctgcctcaccctccctagtagctgggactacaggcgcctgccaccacgcctggcaacttttttttttgtatttttagtagagacggggtttcaccgtgttagccaggatggtctccatctcctgacctagtaacccgcccgccttggcctcccaaagtgctgggattacaggcgtgagccactgctcctggcctctctctgttttatctgctattctcagattgtctcactgtgcttcccataattctctgatcagatggactctaagggccatcagaagcctgaatgccttctgctctctttgcataattgcagataccttccagattttgtagctatcagtgatttttattcactcactggttttttagagctcataacgatttggagtttataactgatacttgtagaagcctagagatcttttggtttggctatcctgtttttagaggaatatttgggaagactcaaaactattccatttctgcattttccaataatcctgtcatagacgttacctagtatatttattttttaaggtggagaatgtaaatgccctagtattctatatcattgtatttttatttatttatttagccattcattcactgattgattcttttattcattcaaaaatgacattcatttattgagtatctattacattacaggtacttgacaaaatgtgattcagaaacagaatgttccagatatcatgtcaggtgctttaacaaagaatatcccatttacccttcagaataatacagtttcctgaaagtaattatgttgccaaagtttacagacagcttcagtaccaggtcttcgagttgattgtacaattgaatgaaatatgttgcttaagcagttgtttgatgtttacaattggtcactaggctaggcacttggaacagaaatatgtgccagctctttttgtttgtttgtttttgagacacagtctcgctctgttgcccaggctggagagcagtggctcaatctcggctcactgcaagctctgcctccagggttcacgccattctcctgcctcagcctcccgagtagctgggactacaggcgcccgccaccacgcctggctaattttgtgtatttttagtagagacggggtttcaccatgttagccagtatggtcttgatcttctgacctcgtgatccgcccgcctcggcctcccgaagtgctgggattacaggcgtgagccaccgagcccaggctgtgccagccttttgtgtgtgtgtgtgtgtgtgtgtgtgtgtgtgtgtgtgtgtgtgtgtgatgtttacctattctctatattaaaaactttactatggacgagccccactattacttttggcaggaattaaagcagatattgaaaggctaaagcaaatattaaatatttcacatgctcacacagagatacataaaaaaataggtgagatcattgctattgaaggcttaacattaatctttacttttaaacaatttaggataggaaatcaattcaggttgcactgcaaggaagaaatattaactggtctaccagttgagcattgtattgttattactatagagtatttttggattagatgtaattgctactgaagttaatcatttattatacacacacttagatttcttctcatcagcataccatctgcatttaagggtgctctaatgccatgctactcaaaatgtggtcaatggaccagcagcatccaaatcacttgagacctagaaatggagaatcttggatctactgaatcagaatctgtatttaacaaaatcaccaggttatcttatgcatctgaaatattgaggaacattgttctaatgtgtcagtgcttagattcatcaggaataggaagaaaataaataacattaactaccaaattctttttttttacttagctacactgagaataattaactgccacattttaaatacattattaatatattttaaaaatagatatctagaacctattaatatttgaatatttgtgtgaattttttatttagcattttaaaaattatatgcaatattttccacctagctcaatgttttggcagagctttgttagtataggcattagacatcatttgggctgagcacagtggttcacgcctgtaatcccagctcttggggaggtcaaagtgggaggatcatttgagcccaggaatttaagaccagaccggacaacatagtggaaccccattaatacaaaaaacaaaaaaacaacaaagaaaaaggaatcattttgtattactttaatagtagtaaaactcatttgatttaaagagaatttttttaaagaactatattgtttacacttagcacagacagccactaaataaggttgtgcagtgctcaaggaggggactatgggcagctttgtcacatctatacctacactggctcatagctagaatgtaagcactataagtacagggatctcttttctccatatacattaatgatagaatactgccaggcaaatagtagttcaataaatatcactgaaactttttttttctttgtatgtgaagagtcacagatgacattgtaaaatgatacaggaaggcagcacacattaaaaaaataaatcaatgggaatgatactttgcataacttatatttttaaaactcagatgctttgctttgacttgagcaaatcctattaatcacattaattacagtttcacagatgaggagatggagactgtagttaaatgacttgagtatcatatgtcttgactataatatgccttgattgtaacataacatacaaactagaatgtgttgacactaatatttctttttctttctttctgtttttttttttttttttttgagacggagtcttgctttgtcgcccaggctggagtgcagtggtgagatctcagctcactgcaacctttgcctcctgggttcaagcaattctcctgcctcagcctccagagtagctgggattataggtgcccgccaccacactgggctaattttttgtatttttagtagagatggggttttgccgtgttagccaggctggtcacgaactcctgacctcaggtgatgcgcccgcctcggcctcccaaaatgttgggattacaggcgtgagccaccgtggccagcctaatattccatttttatgaatactttacatcttctccctttagtgagagttgcgataattagcctatttgcaagatagcagggaggattaagtgtatatactgtaattgagaaaaacatactcatggctcatccatgttaatggcttgcccttgtttccatcatcttctgtctgattattgtactctagaggcaaccaggtattcaagtgtgtggcaactgtggccttcgatgtgtatttggagtcagtctgtaccttgaccttgattactctaaatgaggagaaagctatgacttaatggcaagtacattggcctgaaaattaaagacctgggtctaattaccctgataattgaagatctggcttacatcccagttctgttactgatgctgcattgaatttagtcttttcacttaatctttttcaccattgtttcttttttgatggaatgaggaaaattctagctaccttacatggttattgttattaaatttgaatgaaactcatttgaggtatattcttttaggaagactgatgaaaacagaatttccaaagtccctaggtgttgaaaacgcttttctttatcattgatatgtagtgaattttctcgtttgttctcttgcttcgtatattggttttgaaaagcctgctgctaatctgattatctcatcttagtaaattatttgccacttttgccgggaggccttgatgattttatctttaactttgaaatctaattgttttaataggatatgtttcagagtaattttctgagttaattttcctcaggtgaacctttttaagtttagattgttgtcttgttctttctctgaaaggcttccttaagctttacacttgtaaacattagctttgttgcattgttttatttttcttacatcaagttaatattttataatttaaatactagttctttttgcctgtcttccatttccattactttctctctgacccttttacttttttatatctttttcgtttttaggggcttctttcttgcctttcttcaatgaggctttgtgaattttcattcgagttttttctcatttggacattttataatgtattcttcatttcagtgataattttgtttttttcttctatttctttcctgaggtcaatcagctcttttccatttgtccgttttttccacttttgtttgtaaattttgaatttctgattcgatagtttttaaaaatatcatgtgtcttatttgcgtatatttaatcctgcattgtgttttaacttaattttcttctgctttgtggttgctttgtatgaaggaattatcagttggtatgtgtggaatttagcttcctacttttctgcaacagctgtgtaaggacttttcttcacttttatctactggggttttatacaacagtgctagtttagttgttccttcttctttcaatatagcaaatctaggtactttagaggatctttgttatggtagtggggaaaggattgttaaccctccagttttatgatttgcattttatcttgcaagaccctaaattttattttcttattgtctcttctttatcatccagtagcctgtacttctctcaccattttttctcttttctgttttctaagagctcatctttaaattgcatctactgtatctctttaaatcatgtctgccttgaaaattatgtttgtctctttaaaagggatgggaccttttaaattgtgcttacttagaaatttctttcccgttgtccctgctctgatctgcacagatatcttttcattcttttcagatataaggtggattttatttttctagttattgttgtaagtcactccttcttttgttttccccattgtttgcctgtgagtagggatggggctgggggttgcagcaggagacatgatgctctgggatttcctgattttcctcttttcactcatagttatgcagttttgatattctctatataagatatgcttgaataatttacatagaatttaacttttaatttaatttacatagtatttaattttcctagttttttcttaaatgtagaatttgattttctttctcttttttcttatttgcaggggatattatgggagataaatagttatattgttgccattgccctcagctatcctgaaagtatttttaaaaagtttttacttgaaaaacttggcttctgttgttttactgcttgacaactttgatttacattttctcagatttgtttctctcataaactttagattgagtgcacagtgtattattttgtagcatgatatactgtattttataacaaccttaacggctagctcatttaagataatattctagcatgtttataaaacaaaattaatccattgatggattatttgcttgttctgtaattgaaatatttgaaatatttaccttatgaaatctctagattgtctccacgagagttaatttttcttcagaaataatgaaatgctatcttaattataatgagaaatataatggtgaggactttgtgaactgaatcattcaagtataaaatattttaaattatttttccagtttttgcattatgtgaattactttggcatctgatatttttgtaaatattaataaaataaaaaaattatcttgcataaagttgctgacaaataatttctttgtatggatgtttctgcaagtgacaaaatccatgaaagaactgaaaatgcagtataatttctatcataacttttttcaatcaacttttcatatctaaataatttcagaaaattataaaggtacgtaaacttattatatcacaattttgttttaaatattttagatactgttttgcaatatagtggctttcttttataatcctaggtattttattttatgcatgcaaacacataattctaagaatgggtccataggttttacaaaactaacaaatgagtgtaggtcatgaaaatgtttaagaaccccttccctagaatatagtcctaaggaagacagggattcactgatgcagcctaagtgcctgaaacattctctggaatataggaggctctcagtgcatatattctagattaaactcagactttcctagcaaaatctttagtgacttttttatgtgataaaataccctgttgtaagctctcataagaccaaatactgctcatttttagctcttgtggcaattacacgtttacattcattgttattataatttgattgtgagccactggaatacagactctaattgggtagggatcttaccacttttgcatgcattttctgagccccacacagagtctggcaaataaatgtttgttgaatgaactataaattatattgagacacaaaataagtaagatttactttctgtctcaaagttttgtagggactgtgagaactgtaaaatattgtagcaaaaggtagtaccccagcaaacaatcatccaaccgactggctaaatgaataaataaaacttataagaaagtacaaatacattgttatgggaattgaaggtattaagtgatcactttttgtgtagaggtcagtgtgtggtttatataagtagtagtaatttacttgaatgtagaaggagaggttggatttctaacacatttatagagacccttctattctaagaaaggggaataaaagcaaaagcatggaaatggcaagaaacagggcaatttcagacactgaccataagttatctataaggaacggagcaaattagtttgtgcagttagattttgagtaatttcagtataaacctgggtgctaaggcaaggttttggactaagcttctttggtagctaatgctaccctgtttacagtttttgaaaagtgaaatattcaatgcaaactattagggagattcaacttaacatagaaaaataatactgtgaaatagatttttctagtaaaataagtataaaacacatatttcagattaataagagttcttaaattcaataacatattttgtgtttattaaaaacaccatagataaattttgtgtggatacagagaaataaaactagataaggcctattataaaaattttacctctaagaggtaagatctgcatttttacttatgtcatgtgtggataatgggattaatactcaatttatctccagaggaaggtcagcatgcctgttcaatagcattatatatttcaaaactgtaatagacaacagcagaacctttgcttgcaaattattttatttttatgtagttaatattttgatgacatgagagaaaatgcccatggagaagagaccaaagaaagccacttccacttaattgatatatttgtattaatttctagatttaaatctaggtgtgaggttacagagtaacatggcagagagcttaggaaatcatggactttcagccagacctgggtttcaacacctactgggttgcttcccagctcttgagtcttaggcaagttgcataactaataagagctttagtttccatatatgtaaagcaaaaacaacaaaaatgggaatcacatgacatgatgcatagtgcatagcacagtggttgtttagtaagcaatcaataaaattgttttatgattaaaatattatgatcatgcatgatagaggtccaaactatgaaatactcctctctttattttctaaaatcctacatttaaaattttcactaagttcactatttgaaattccaccatttattgattcattaggtaagaaaatttctttgctactgtaaccattagacagttgtagatactggctttacttctttcatcctggcctgatgctgtggctaggcaagtaaagaagaaaatgaagagggtaaaaagaaagtaattggaagaaaaggatgtagaaattgctgagtatcaaagcaagaagacagagaacgacatgagtaaaataaagacattgaagaaagtctgagaaaaaagccaaatgtaagagagaatgaatactctctctaccattcgctactgctcattaagattataataataacagtgttgataagttaaattttttgccttcaaagtcagcttttctctgccttgctacaagatactgagaaaatgtggagagccccgatttagctgttggccttcaaatcttatcccaaactctataaagtgactgatctggagcaagttacttaacaactatgaatgtgagtttaccaatttgtaacacggtgaaagttagcaaaggaattaaatccaggaatgacacatagcaaactataccactataccacacacaggaagtcttctttatatgttagctgctatgtataaatatatgtagtgttctctcctgttctctctcactctctctcaatatatgtatatagcagctaatatctgtatgcatatatatttgatttataaatgttatgatgttatgttatttataaatgttatgatgttatgtttgaaaatagtttgaaactgttttcaaaactggcacttttattttgtggatacaaataaatgtttttctgtcatcctactgccacaaattcttttcctgaaaatggtttaaaatgtattcaacaacagcattatatatctaatgaaacttgtcacttaatttcttcaagttcttcattccatattatttatttcttaaaaatttgagaatcagatacttatcaatttactttttagtttagtatgatttcataaaattgtaacatttataaattattatataatttgcttagtaatagtcatacgactcaatatttcaatcagattttataacaatttgtttgaaactttgaattgtgataaaagaacttttcagagataaattcagattaaaaagcaaaaaaatttaaaagccttttgatggggagtaccagttacttgtccaaattgagagaaaaagaaacagtcatcaaaatgaccaagagtaatatagcctcagatttctctttgttacctgatgacactatttaagatggactgtcagatcccattaggtttgcggataatattctgcagatgagatgaaaatggagttttcgctcagcaggaggaaagtgagaagtacacttattctagtcaggctcagagatgttattctttttctgttgttgctatgggataacattgcatcaataacaggaaagcgatccaactaagcttcatgcaccgcaatcaagttgttttgatgcaaataaggttcagtcacttagggtactcagttatgacaaactgtgctaacaaactataaatcaaacctgagctgaattgcaagtgtatatgctagataaaaaagaggaaaagcttttatcttttagtagacttaagagttattttgaataactataaagacctttacaatatttactgcaaaattaaagtataaatgttgttgttgataatttttaaaagtcaatttttattgtcccagaaatcctaatggagtttttattaaaacaatattatgagacaagtaagcctatgttatatttgggatagtatgtttttctagcatacataaacaaacctctgatcatagctctttttccctttcattttgaaattgtagttggtctggagaatgaggaaaaggaatttactaaaattatttgctctttaaaaagttatgcttatgtattatacatattcacatttaattcaaaatccttattttttaaaattttattcatagaaacattggcatttagggcccatatatttacctgactgacatttgctggtaatacatgtctgtcaaactaaagtattagaaactgaatagattttgaactaggagttcacatgcaattgcccatgtttcatactgttgtatcatttgttcacatttcctttagtggttgtggaatagaaattataatagccatatatagagagaccttacatggagccgaaagaatatatatcaacctaaaaacacactgagttactataagaatcttagccatgtgtatctaaattttcatttttcactgccaggtgcaatttgagaatgaatctttcctacataagaagacattgtaaatatgcaggtgggccctaaatcctgcatttgtagagcagtcatactgtgctagcttgtagtcataaatgtttctagatcagaattagatttggaaatttagcaaccaatgaaaataagcatttcaaaaccttgtgggtgattgttttttgtttgtttttaattaagtctgaagagagtgcacagaatgtcacacagtaaatagatgctgtcatctttcattaccaggcaccccatgacagagtccattgcagcagagctgaggaccttcatatcacaaaatgagtttgcttatcaggcatagagtgaaatgtttctgtatctcacaagaatgtctgatattatgcttctttaactgcacctgtaagcctgttcactgcaatttaaagacagtatcatatgtaacttgaagtcattttcaactggccatttgctcactcttagaatgagttttctaattaataaatatttttgaagacatggtgaataattggtcagatatagttaggattagtattaaaccctcggatctgaaattgtgatgaaagggtctgagatttcaccctgcatctcagctaatgagtgagcctgtcacagttttacagatattgacagaaagatatgaggcatctgtgtcagagacaagagtttcttccagtaaaagcagcagtcgaagtaacattgtaatgctgttccctgagccccaattcccaggggactaccggatgagggccaggtgatgcctgcacgtgtgaggggtatactacagaagaaccgtgagattagaagactgttttttatagaagctattggaatcctttgtcgtggagaaaaacgttatctttattaccctgtgcaaaattaggaaacagtccagaggatcatcctcacatttgagctcagttgtaagtccaggtgtcccccaaaccaccttaagtatttataattcactgcctggatgaatagaactcactgaaagctgttatatgcgtggttatgacttattatgtcaaaagaatacagattaaaatcagccaaaggaagagatgcatgtggcagagtctaggaaagttcctagcgtgaaacttctgattctcctctcccagtggagttacggacaacactgattttctctgcaaccctgcatgataatatggatggagtattgacaaaccccagaagctcatcaaagctttggtgtccagagtttctgtggaggctctgttatgtaatcatggtctactgcccgtatggctagtcttagtctacagcccctccagtgtgtgagctgaaattgtgactgaagaactccaccccaaatgacatctggtgtgacattttctaccctaattcctattgttagagtatctggtatgatccaagtccctcaggcaagcaaaggcactcccataagtgccttttatgaaattccaaaggcttagagacctagcaaaagccaaggaaaaagacaagacatgaatttgggcgatgttaaattatttattacaattcttagaatgtaagcagatctctctggggaggggaacaagatgtgtttatttttatcatctctgtctttccagagctttctgcttatacaaatatttctgaaaaaaatagtcctggagcaaattggctgttaatgtctagatgtgtagattcatggagaaaagcctgccaacaattagctagtgctttgcatttgataaaactcatcttttgagattccctctttcaaatttctggctctttgggtggactaaagagcacttcttttcaagctgtatttattaaacctagagaaagtgatcacactacttttagtagcttttatgttggtaacagaggaagtctttcgacattgggaaggttttttacttccctcatgcatacatatatgtgacttgaccaaatttagaaggtttttgaagggaacagaaatcacagattacctgcaagcaagcaatttcatgagatggcaccactgaaatttatttcaattttttccctcctaaaaacaaggcgattttcttcaatgactataaggttaacaaaacctaaccatgatttataatttaaatatataatttcatgtgtttcttaaaatgatattccattgctgagagtgacagtctcctctctgcctcgaaaccctaatagttggaaaggagaggacaggtactctgctttctaatcctcctgccttcaatcattactcctcattcctattaatacacttatatttttagccatgactattcctcaccctgcccctcccaaattcactttccctttagatactttcatggatccaaaaggaaaagcgatgcttctttttatccatttggttcaagcatgaatatctttccttgatatctcatagtaaacttcggaacatttaaaaagatttttgtaaaagctaggataactttttcaaactattttccctaaaacatagtttcctttaaaacaagaatttcactgtcaaatacatttggaaagtgttgtaaacaatattttcctctagggaaattcaaaatacacattatgcctaaaaggctgtaacaaaatcctgcagcaaaatttagacagaggaacaacaataggtaaaataaatacagagtacagcatgcaaccaacacagtttcttataagatatagtttgtcccttatggcatcagatgtgagtttcaagggctgccttttatgtgaaagagtcatttcttagccttcacacccagaagcattggctgaaatagtttgacagcttaaggtctagacctaagaaagtgaagctcattgaaagaggttatttcctctcctgcttacctaatacttttcttctaagttttttccttttctctgtggatactggtatgactaaatctacctgggaagagtaagtcctcaggctatggcttcgctctgtgaccacaaaggactgccaaattcagtgtaagacaatgacttaataattcttagataaaatgtggtaactagagcaaacaggaagtagtggagctaacagtgttatatttcattgtgtgcagttgatatttcataggtatagcttctgcatatcccagggatcagagatatgctctgccctgaataatggctgaattaattgtttattttcctagatatgacttagtatgtttgactatgcattagtatgctaatggtgtatgtatagaacaactaaagtcaaagtgaggcaatttagtagaaaataatttcaattccttatttatgacaaaatttaagtcacattttaactcagaaaatgagtgacttttaataaaaaaaatttcctataaaagatactgattttctttttactggaaacaatatttttcaacattgtgttctttcttcgagagcttagcatcccctaaatatgagaatcatctacttaaggaacttgaaattcctgagaagacacaaaacatgtatatataaatatactacaatacatcagcaaatagtcattctttttcaggtttaccttattttttattcattatcaaatctgcttttaactttttatcagaagcagaacactagatttaaaggctttccaaagcctaatgagtaagtccagtgttctctctgtgaatattgcatacttaaggctgtcatgttttgattaagcataagctttaatagatttgctggaataattattaaaatatttgaagacctacatttcatactggaaaggtcagaaagataaaacatacattagcggataaattcatatgagataagttttagaaaaattaatttcatggtatttatgactttttggagtgatagtttgttgatgcctattgttaatgccaatacaatgtgacacaattaaataaaataaaataaaaaaaagaaaaaaaaaggtgaagaatagttgtgtattttataaagatttttttaatctttatactcttgatttactcttttgaaactgtttctattagaaatgcctgatgccacatttttaaacaaagtgtctatttcttcacaatttgtatccaggaaaacatcatttctattaatatgccagtgccagagagaaacatattaatacactttcactttcatttttatactgacattttatttttagtcttgcagtctaatttttttttctacctgaactgtcttatggactaggtaaacttaaacacgtatcattcctgagaaaggagaaaaaaatgaaaacatactctatgtcttatcctttcaaaaactttaaaagttggaattctgaattcgagaaagcattcagaaaataacattctaaggaaaatatcctagttctttctctaaaatacacctctgctaaatattatcagatatattttcactgatcttaacttcgaaaatgatttcaaattaaggatgacttgctagacataagataatttggctctaatttttttgtacctttacaaattgacttcaattcagaggaaaatgatttgtgaaaagtctactttatgccatttgatttatataacagtggcaaaatatgcctaactggtatgtgagtaaaagatatatttgctaagttattatttgctaaacaaatctccaaataaatagggccatcttttagaaaacgtataattgatgttttagctaaaattttactcaaatgaggtaatgagcaaggctaagcctcacgttggtattgagtgtgtattcttacatctctgaaagtgaggaatggacaagggcaatcattctgggatgctatttgcattatagaccagaaaaaaaaaattataatgacttttaagagggccaagtctggatttgttagaaaacaaaactctggtagtgtgtaggactcttacgcagctaaaggaaaagtaaggtggattaatttattagcagtcacttgctccactccaggttcaggcttcaacagtacatcccaatcagccctttaaagtgccccttatctgtgcaccactcatccttcagccccacattcaatctttagggcctacttgtctgttgcacatgagcatacacacacatatcccagctggcacaagtaatgttatcttcactgacaatttcaaaggacgcaaggaaaggggagcctggcacctgggtagagcctctgggactcatgactccgagggtggctagagaacagatacaccaaacatcgtgaaggtgcctagaaactctaagactctaggtccttggattgtagggcttcagcctagtatgacgtgtctcctagtgagtggtaggacctgggaaactcctattggtatttgtgtcatgctaagcagaattgacttagaaaagttagttacaataacatcttataagcaaggtttatcatttaaagatatatatatatatatatatatacacacacacacagacatatatacacacacatacacacacatactagcatattctttatcaataagtgattactctgtactattttcaaacttcagaatatcaaagttcaaaagaatcgtttgaaagagtgagggtaagaggttttaatatgtagttttctgagccttgttcttagactctgaatcaagattgagttggtttgttctggaaaccaagaatttgctagccaaacaaacatccatgctggattgaataacaacagtcttaggaacacactttacaaagcatgaccccactgtaattgtacctatcaacatttattttgcagtatataatatgtgatgcccaaccacaatagtgtgagcatttttcactaatcatccactgctgtttccttcactgcattctttctgtaatgcttcatttaacaaatgttagttggccatgatttagcaaaacatgatgtctacccattaataacctgtatcataatatgagaacatttcattcacttaatgtttgctaagtgtctataatacagaaagatttacagtgaaactcctctttcaacaaactttatcaggaaaattgtcacatctagaaacactcacaagaaaatgaagaaagtaagaagtgccataagagaagtcacgataaaagtttttcccagaaggggattgctttaagcttagggtagtcatgaaaatagagtatttcaggtgatcattcatggcactgtttaaatatgagtcaggctgtgaaactcagggcaaggagagaagcagtggcagatgaagggaaggtttagggtatgcacagggaactgtgtaccatatgcgtatatagaacacatttggatatcacataggataagtgaatagcaataaggtaaatttggagcttggtaagagaaccttttgaatgccaaataaataaataaggactataagccttactgtgtagatgaggaaatgccagtaagggttggggtaccagggcagtatatcatgaagatgttccaggtaagtttgtgatgagttgaagtgaaggaaactgttctataggagaccacagagactagataagatgtaaaaatgcctgaatttaagtacataataaaaggaaaataatgtaaggaaaatttaaacaattatattgaataagtcttggtaactactggacatgggggaaaggaaagagtcaaaaaacaatgcccagaatttgaaagctgggcaactaagattattgtggtgacaagaacaaaaaaaaattcttttattattatcaaaaccttgcattagatcctttgtaaatatttaaattaatcttcctcccatcttagaatttggaaagcagggaagggggtcccaggggaagagtagccagtggacagttgaggagagcaaggggtagttataaagagattcttgatatgtcttcctgtatcacagggcgtgctaaactttctttttcaagggcggatgtgtgtgtgtttacagcatactcaaagtaatgtttacccttgaagcacattatttattgatatatttacatttattgaacatggaaattctctaagaggaaaataaataacttaggtacttgactttcatgaaatttattttctttatttacttagtaatcctattagttcctgttttgtttgagattctatagtattgtttcatttagccaaatatttcaagacaactttttggcagaagaacttttcatttatttgcatttctttcacaattttattttctaatccatttaaactatcacaaattaatatagaaaaatatattattgaggcaaacaagtttttgtgaaataaattgaaacccaaaaggatgaagaatgtcattgacataaaagtgtaattgttcttcaatgtaaccttacaagtatagatataatatatcataattgaaaaagaaggaagagggaaaactaacatccaaaccacttgaatgaagtaagtttttacacagcaaaaatatatacgacttttatttgtcaagtatactttaataatgctgggggtgggtggaattaattagcagtaagttggggggaaaagtagattacgtggtggccattgtagtagttgagagcccttcataaatgattgttaacatcgttctagttgcaaatattatctgaatatgaaattcatgctaccgtcattctgaatacttttattcttgagtttattttattaagacattaatattgttttcatgatcatcatcataagtgtgaccatctcccctctattctacctagcactatttttcttctaggaagtgcatgtggtgtttcagcatattttacattactttggttacaattaagtgaaattttatgtcataaatttatatagtttagaagcttagtttataagatcttgctatggctttctatttctgggaatgatgtttctgacaaaaatgtgtgatagaatgcatgatagttatccatttcattccctatggctcttagtgtaaagtccaaatctcttcacatgttttataaaagccagtaagatctggtacctgctttttactcatgcatagtttttctccctcatatttcatattttgccctccagttttactaaattttagtttgttccctgaaaatgactctggttcttgcttgcaggcctcagagcgcacttttctatcagccacagtactttcttctatgcccagccttccccttcccatcttttgcttggcacctaagcatttttcatgtctcaattggtcccctgtgcatcctttaggtttcactttctctggagaggcttatgaatagcccccaaatacaatgggtggacctcaactctatatccaaagaattttgtgcttctattttcatttcccatgaaaatatacaaaatacttcattaaaaaatataattctctctctctctctctctctctctctctatatatatatatatatatatgtaattacctgtattcttgtctcttatccccactagaccctaagccttgtaaggacagtctttgtctatcttattttccctttgtcttagtctgttcatgctgctgtgacaaaatatctgaagactgggtaacttttaaagagcagacattgattttctcatagctccagaggctggaagtgcaggaccaaagtgctggcaggtttggttgtctgctgagggctattctctgttttcaaagtggcaccttgatgttgcatcctctggagggaaggaaatctgtgtccccacatggagaaaggcagaagggaaagggagctggactcagcattaaagctcttttataaagaccttagccccattcacaagggaggagagctcatggcttaattgcttcttaaaggccccacgacttaatattaatactatcacattggccattaagtttcaacacctgaattttgtaggggacacattgaaatcatagcaccattgtatcctcagcatttaagcatagtggaggtacatgttagttgatgattgttgaatgaatcaattgatgattttcttttttatggttaaactaatgtggtatatactagactcatattccaacacaaacattcataaagattaaaatataaaaatattagattgtagaaatatgatataaatttgaataacatttttagaacaaattttcaacaagaactatgctttatactgtgctacacacttagcttttttagattttatttttatcttttttacccaggctggagtgcagaggcgcaatttcagctcactgcaacctccacttcccgggctcaagcgattctcccacctcagcctcccatgtagctgggaccataagcataacactacacctggctaattttttgtatttttgatggaaatgggtttttgccgtgttgcccaggctgatcttgaactcctgagctcaaacaatccacccaattcagcttcccaaagtgctgggattataggcatgagccactgcgcacagcccacaattaagcttttcaaagctttttgcgtactagtcttgtagaaattatttaacagctctgatttattgataatatcaaggtgtattgtaaggttaattctttattcttaatattgagataatgacctatgctcttaagtttgtatttaacttaaagagtaatctctgaaccagagtgttagctcttaacaattcataaatggtcactaaattaaccattttttttttttttgagacggagtctcgctctgtcatcaggctggagtgcagtggtacaatctcggctcactgcaacctccacctcccgggttcaagagattatcctacctcaggctgccagtagctgagactacaggcacacaccaccacgcctagctaatttttttcatatttttagtagagacggggtttcaccctgttggccaggatggtctcgatctaacctcgtgatctacctgccttggccccacaaagtgctgggattacaggcgtgagccattgcacctggccaacactttttttcaaatataactttaattaaatattggtggtgtgctaatggtttttaataaagtgttaattgaattgtgcttctcatcacaaaatatttgtaaacttcaaaggttcttatgaaactcatagtaactttaagaagaaagaagtaaaagcagaaaaactgataaattacttaatattatttcctgttacatgcattttctggttcttgtttttaataattagatacatattatggctttaatgcattagaactattaatcaggtatctcaaggtgatcacgcctgtgtcttgctagtcatgcactgcccacaagtgctcaataatatttactaactttaccaggttaactacaaatgtgggaaatagttaactcattcattttaattggttataaataatcttattttactttgttatctcaatatctttacttgacgcttactctgcacatttattaattgaatactctattaaagagaaagttattgtacagtgcagagttggatttgcagacaggagttcaactacttattaattcatttaaaccttctgaaatgcattttctcatgtgtaaaatgatttcaaagtgcaatgaaaaaagactgtctcaaggagatactgtttactcaccaacttatcaaatagaataacataatttaaagcattctaaaaccaaagaactctagacgtactaggtattattaccaaaatttgtatttcttttctacatatcacaatgttcaacacagaattaggggtaaaagcagaaaattggagagaacaccatataaataataaaggaactgggtgctgtggctcacacctataatcccagcactttggtaggcagaagtgggaggattattgagcccaggagtttgagaccagcctgggcaacatagaaagactctgcctttacaaaaaaaacacgaatgaatttgctgggcatggtggtatatgcatgttgtcctagctacttggacagctgaggtgggaagatggcttgagcctaggaggtcgaagcctcagggagccatggttttaccactgcactccagtccagcctcggcaacagggcaaagccctgtctcaaaagaaaaaaagaaaaagaagaaatgttcaaataaatgatgttacacccaaaatatgtgataatatgtgattcaatttacctttaaataccgaaaatatttcatgaaattaaaaacactatcataacaattgaggagtatcaattatatatgagtacatctggatgcctacattgttcctcaggttttgtgcatgaaggacagctcatatatgagattatattgctattatattgctacataccagccagctaaatgcaatcccccaaggacaggagctaaagtataacggagaatatccaaattttaaggaagtctttaaatgcatgccagtgtgtaagggaacttatctttctgtaagtgaatgctgttttacttttcttagcccagtagctaacagatttgacttctcatcatacctcgtttttaagggagatatctgagaagtaaaatgtaatgctgtttatgctactgatctttttagcacccaggagagtaaggagggcagcaccttcaagttagtgaagatgagaagagagccaactcttaatgaaatattttcttgaatctggcagtaacacgaaggatctaaaaactgataaacacttcggttacatcaaggacttttatattcccttctttattatgccagatgtgagctgccaacttaactaattaccatgttctcagtgggaagtttgctgtaatgcattttttgctcaaaaatatgttaaacataaaattcatttttttttcatttggggtcttcattttccaaaaagggaaataatatataaagctttgaaaagaaaactacatagtagcatttacataggaacgtttcttgataaaatacagatatacgacccaggaacaagcctggcaaaaaatttttcctgagggttttcaagttagaaaacccagtagtagaataaaattatccaaagacacatgttttggcaaacggtaacttacttctcttttatattctgttagaaaatattcagttgcttttgttggtatttaatattttgagaatatctaaatataataaaaagatccgctttcttcatttgcaaatgagaatgtaaagttcattattttgaccagcagtttttgctatttgtgattaaattcctataagaacttgtttgatatgagattgtgctcttctcaaataactctttaattttaattttacacctttgcaagtgtcagaatgatttgaatatgagagaaaagataaaggacacacagaataactgtgtgtaaatgatgtgcctttattattgttaaatactaaatagtaactattgtttaaagaaaattagtagtctttgaattcacaaattggagacctatttacacttcatttgataataattgctagcataagaaagacattatgttcaatacatatcaatatacataattaagaaggaaatgatttatattcaaggtcatgaacatcatacatcttagatttcataataaagaccaccagtaacacagcattttactagacacaggaagttattttgcgttacactaaaatttaaatattcaaatttatttcctaatattttaccaattggcatccataatgtagacagttcaagttgttattaaatgcacacatgcagttaaatataaataaggtataaacaacaaaaatctccatctactatgtcaggatgttaaacctttcttatggaggaaaaaaaagtgttttgctacactttgagctactcatctggaaaatcaggcttatccattaggcccatggatcaccattgaattactcatctgaatgtagccaaaaactcatactgggaaaacagtttaagaagctaattaaactgatagaaagaaaactttaattttaaagaaatatagaaagcagatgattatttataatttcaattaaacttcctaggctcatatatgaagaataaagtattaaacaaggagaacaagaccaatgcaaatatgaattgtggacatcaggtcttaggatatatatactaaaatacctaggcttattcagtcaaaaaaatgtaacagttgacccttggacagtgtggagtggccgaacgcttgtgcagtcaaaaatccacagataacttttggctccacaaaaactttaactacttacagcctattgttgactggaagacttactgataacataaacaattgattaacatatattttgtatgttatatatattatatactgtatactgtattttcacaataaagtaagctagagaaaagaaaatattatgaaaataataaggaagagaaatatatttattcattacgtggaagtggatcatcataaaggttttcttgtggtttataggctgaggaagaggaagaagaggagggtttggtcttgctgtctcaggggtggcagagacatataagtggacttgctcaattcaaacttacactgttcaaggaacaactgtatatctatatgtgtatatatatatatatatggacatataaatgtatatacatttaagaatttcagtgaattaatcagaagagactcccttctttattagcaaacataaataaaaatagatacaggtaccaacattcaataacaacttgtttttttgatatataatttatttatatctacttattgaaaagtatgcaatatatgctctgtttattttctttcttctctcactatattaattgtatcccttcccacccccttgaaataatctagatttataacttccagtgtttcatagagatatactaaaagttttatgagattattctggagttaccatctgtaattttcaaaagtaaactaaaattgctcagcggataatacctgtattccatttggaatatcattatttgtgcatagttgcttattaatcattatcttggaatcagaataattgatcgatacagcaaagatttttgtaaatatcagcagtctttggagaatggagagttaggaaatttgaagattccaaataagtcatattaacagatgattatgttcctactaataattgtattactagtagaacaaattggcctcattcatctttatttttgttagctgtttaggagcattagactggtgggtacacttttgtctttactagtactaactagcaaaaggctgttttcaatctttttaaataaatatctattttagtgaatactgtaggtatatatatcatcagaagcaactactttgcaataaataccactactgactttgtagacattttcttaaggcattgtacctcagtttgaacaatagaatttcatttaatacaaaatgtttatcattatttcccttcttggaaggacagtctagcaaactctgaaggtgtttctcagtaaggacttctacgaatgtggcaagattgttaacatgatatcacttggcaaagtttctcatattacatgtggacattttaaacgtatttagtaccatagccttaatgtgtttttattgtataaacaagttgtattttgattcagatatacttagtttttaaaaagtagatgttgaaatacttttagtttggtaaatatttcttttcaagaataattccaattgtgatcctcttccatattacaatggtaatatagggtttatttgctgctaggtaacagataaaattgctgttaggtaacaaataaaatatgcaactaagaaggtttgtaacttctgttttatttctatcactggtatgtgcttgaattaatgaaaagcgtctgagactactgattatttcaggaaaaaatttgccagcaattcagagtagttgctactacatggtagcagtgtgtttctttctctagcatagctgggttgcaattaaaaagaaaacagacatttggaaatattctttataaaaacaattattcttgaaacttgaatttcagtgaacacattataaactaaataaaattaacatatagaaataattgtaaaaacattttatgtttcaaaatcattgtaaaaatgttttctcttttaaatatgaggtttactctttaattcttcaaaaattccagtaaatcgcctcacttttggtctcatctgcttgctacctaacctatattggttcattggtcctttcagtgatacttgtttttgtattctagactatagataagtccatagacttctgtcatctttccctctagctaatgacagcagcactatcatcataaatattataggagcttctggtaactgagtacctactgcatacctggaactgtgataggtgtttcaaagataatcagtatctttgtctgaaaggtaggtagtattacccttgtataacttaaattgcagaagaattggctaaataaaataaatgatgaaaatagctgtaagacaagaaatgtgggaatgagtatattttttagggaagggggacacctgccttttaggtacaatgattgtttttaagtgagctaagcatgaacagatttcaggttttcaagagaatctgaatctgtgaattatgatgtgaaatagccttagagttgagatggccaattgaattatctttctaactacatggtgggtgaagcaaaaacaaatgtagacaaggtctgctgtaagcaattttataggctacttggtgtcacacaggtactaagtgataaagcaggatcccagcccaggtctgccagggtccattgcactccttttcctctaatccacactgctttgtgagctacaggcctgtataaatgccactatctgatttgtatattctatttctaggcagttgaacattttgaggcaaaatcatgaaattaaattgagtgttgtccaaatttagctgccccccttttattaattgctccctactttttttataggttctaattcctgagatagtaaatggcacataggaaatttcttaggagtaatttggggatcaccatctgtggtgtagaaggggaaaaggcaggattaagcagagggagaagttgagctgcaaagcacatccaacaaaggccttcagcagaccccatggggagctctaggacaacccaaggtaaggtgggggacttggcctttatacacttgcattgagatttgatgaaatctggctgccttgaggagaggaagtcccttcggctgactctgaaaagggctgagaggcaggacatagtggctcacacctgtagtcccagcactttgggaggccaaggtgggaggattgcttgagcccaggagtttgaggccagcctgggcaatatggcaaaaccctgtttctacataaaatacaaaagaaatagccggccattgtagtcccagctactcgggagactgaggcaggagaatggcgtgaacctgggaggcggagcttgcagtgcgccgagatcgcgccactgcactccagcctgggagacagaccgagactccgtctcaaaaaaaaaaaaaaaaaaaaaaaaaatagccgggcatagtagtgcatacctgtagtcctacctacttaggaggctgaggtgggagaattactttagtccaggcagttcccccagcctgggtgaaagagcaagaacctttctcaaaaaaaaaaaggaaaaactacaacaacaacaacaaaaacaaaaggactgacagctgaagcttttctagcagcagcactctctttcacagttacgataatagcctgcaataacttatcctggcataaaaagaatttgcatatcatataattggtgattttcttgaccttcattctcaaacagaggctagttatgttttatatcttctgtgggagagaggagaggaaatcagaggggaaataataggctatcctctttcggaaaaccaagcggccaagggggtatcccttggtgcacttttagagaatatccaaatattctctaagcccaaagctctaaacatcctagatcagattaaggaaatgtagaaccaaaaatcagaaatttctggaactgtagccactcttttgaaagtgccaggcagacacaggactcagaattgtcctgtcaatactcagtctggactgtataattttaccggttggctccaaaatgcccagtccagaaagggataaaccttgatgggctgcctgcaaaatgtattaatgtttttatattgttttccaggaatttttattcatgttttactacccattataaagacaatgtggttggtcttcatcagtgtcatgttcaggggcccttaatagcactttgttgggattttaatctgttaattaaattaataattaaaaattactcatctattattcatactccttattatattaagtgcctttctcatataatgttaagttgtttaacacctttactttgagcaacattaataataatattctaaattgttggctactttttcaaaatacctgatactcttttcatggagtagttttttaaaaatagcttgtttagataaagactgaaaatgttgctaatctggtttaattctggatgtttgaaattatttccagttgtttaaaaagctttatgaaaaataaaacaaagcttccctcaaatcatctggcaggtgactttacaagtaaccaggaattggtcagttttcaatatcatttaatcataatacgttaattgagttattgctaatatattctcacagggtatttgttctaatttactaccttatcacactgctataaaaatagcagaagatgtgttccgaaagccactgccatggacgttcataagataatacacagttaatctgttatgcctcaccttcatagatctgtccagaaacagaaagcacctctcattttccattgatccttttctatctcctgcctcaacaccaccaaatatttttattccacacaactctgtggccttccaaaattattaatttaagagattctaaccaagactctgtccaagaatgaaatagcttatttatggatccattcattggtttatggatccagggtgccctggagaacaccacaaatcttcgtgacatcccaagtgttaactttaatgtttatatctttaatttagctgaaagatgtgtaaaatctcatatagtcaaatagctccctcttgactgaacatataaaattgggattaaagcatgctgttccaatagatatcaatcataacttatgctcaataatttatttttgaatctacattttaagatcgcacaatgttaaggagcaattgatttttttctcccatgcggcttatttgtggccaaatcctagttgtacagagattgccttgaatatccagacttcctctgggcttccctgttatatgcaatagtgtaaccattaaaataaggtcagtaagtaacctcttggcatcacaaatagcagcaggacagtagtaagtatatgtctgtctctacatatagtattttcctatttatccagctcattacataactatttttactttattatttcaaaattggaaaatgatataactaataataatcaccatacataggaagggatttgactgtaaagataaatttaggccgggagtggtagctcacacctgtaatcccagcactttgggaggctgaagcgggaaggatcacctgaggtcaggagtttgagaccagcctggccaacatggtgaaaccccgtctctactaaatataccaaatgttagccgggcatagtggcgagtgcctgtaataccagctactcaggaggctgagacaggagaatctcttgaacctgggaggcagaagttgcagtgagcccagattatgccattgcactccagcctgggcaacaagagtgaaactccatctcaaaaaaaaaaaaaaaaaaaagataaattcaaagtcacactgtgtttcacatgtagcatactgtgtactctccagtgtttctgcaaaagccgttcttcagcatgttagtcattagtagactctgacacattctatatttgtcactcatcaggttagtttaatatccactctttccaataaacgtctgattctgaatattccatatgtagagcagattaaaaataaaagggaaaacacatagtgaatcatgttttaatgttcttaactccattaaaaatgcattatatgcttcacctacttgcaaaaaaatgagtgaaattgaaataagacacagatacattttattttttatttatttatttatttgtgacagagtctcactctgtcacccaggctggagtgcagtggggcagtctcagctcacggcagccttgacttcccagaatcaaacgattcttctgccccagcctcccaagtagctgggactacaggtgtgtgccaccacacccagctaatttttgtatttttagtagagataaggtttcaccatgttccccacgctcgtctcaaactcttggactcaagcagtcctcctgccttggcttcccaaagtgctaggattataggcttgagccatcatgcccagcctccctttttttttttaaaaaaaaaaaaaaagacctaaagatatcttttaaagtttgaatggatattgataaatttactccaaatctgaggcaaagataatttcttataatatttaaagtatacttgtatttagcttagtattataaaactaatattgaatttcatgcccttctgaatttctgtgaaaatttaccatttctaaaaattattcataacccttggcattttataattttatttcattattttattttatttttaatttcatttaacaaatttttatttatttttttgagacgaagtcttgctctgtagccaggctggagtgcagtggcacgatatcggctcactgcaacctccgcctcccgggttgaagcaattttcctgccccagcctcccaagtagctgggattacaggtgcccgccaccatgcccagctaatttttgtatttttaatagagacagggtttcaccatgttagccaggatggtctcgatctcttgaccttgtgatttgcccgcctcaggctcccaaagtgctgggattacagttgtgcaccattgcgccctgccccaaattttatatcttttgaccaacgtcttctcccccatccctccaaccactcctgcccttgataaccaccatttccctttctacttttatgtcagcaatttttttctatcagtgagattatgtggtatttatctttctgtgcctgactcatttcatttaacttagtgtcttccaggttcatctatgctgtcctacatgacaggatttcattcttttttgagggtagttactattttattgtgtatatatattacattttctttattcattcatgtattgatggacacttagattgattccacgtctggctgttttgattactgctacagtaaacgtgtgatgcaaatatctgttcaacatattggtttcattttctttggaattatacccagtagagaaattgctggatcatgtgctagtttcatttttaattttttgaggagattccatactgttttctataatggctatactaagttacattcctaccaacagtgtgctagcgttgccttttctctacatctttaccaactccttttagcctttgccattttggtaacagccattctgacaagagtgagggatatctcattgtggttttgatttgcctttccctgatgattaatggtgttgagcattttctcacatacctattgatttgtatgtcctcttttgagaaatatctaatcatgtattttacctgtgtttttattttgtaatttattttttattaattatttatactcatttatttatttaagacaagatcttgctctgttgtccaggctggagtgcagttgtgtaatcacagcttattgtgatttcatagagatgggggtctcactatgttgctcaggctggtcttgaactctgggcctcaagtgatcctccgccttgccctcctaaagtgctagggttgcaggcatgagccaccacacccagtccattgtttaaaattgagttatttgtcttattattgagttgtttgagttttgcatatattctggatattaaccatttatcagatatatagtttacaactattttcttccattctgtatcctgtctctttgctcttttgattgtttcctttactgggcagaagttttgtcatttgattaattccatttgtctatttttgctttaattgcctgtgctttttgaggtcatatccaaagagccattgcccactctaatgtcttggagctttccctctattttttcttccagtagttttatggcttcaggtcttatatttaaatatttaattcattttgtttttttttttaatatggtgtgagataagagtctaattcattcttcttcatgtggatacccaattttcccaaaactattcattgaagacactgttctttccctcttgagtattctggctcctttgttgaaaatcagtttgctctaaatgtgtggatgtgttttggggctccctattctgttccattggactatgtgtcttttaatgccagtgccacactctttcgtaacttactatagctttttagaatgttttgaagccaggtagtataatgtctctaacctcattctttttgctcaagattgctttggtgatttggggttttctgtgctcctatacaaagttcagattttttttttttttctgtgaagattgtcattggtatattgataggtattgtgttaaatctgtaggttactttgggtagtgtggatgctttaataatattaatattaatgctttcaattcatgaacatgtgagatcttttcatttatgtcttcaattttttttcattaatattttaaattttaagtgtacagatattttacctctttggttaattttactcctgagtatttttttgtaggtattataaatgagattgttttcttattttcagatattttgctgttagtgcataaaaatagtactgatttttgtatgttgattttgtatcctgaaacttaatgaacttttttattattaatagttctaaccatattgagtaatgtctttagagttttctacatatataattatgttttctgcacacagagagaacttaacttctttctttccaatttagatgatttttatttccttctcttgcttacttgatctggctagagtttccagtactatattgaatggaagtagcgcaccaggcatcctgccttgttctaatgtcagtggaaaagtctttagctgttccctgttaattatgttagctgtgcgtttgtcatatatgatttttattatgttgaggtacattccttccgtacctaacttgttgagagtttttatggtgaaaatattttgaattttatcaaatgctttttctgcacttattgaaatgattgtgtggtttttgtctgtcattctgttaatatgatgtgtcatatttatttatttacatatgttgaactatcctttcatcactaggatgaatccctcttgattttttttttttttttgagacagtcttgctctatcacccagggtggagtgcagaagcgcaatcttggctcactgcagcctctgcctcccgggttcaagtgattctcctgcctcatccctagtagctgggactacaggcacatgccaccacggccagctaatttttgtatttttttttttttttttagtggaccatgttagtcaagttggtctcaaactcctgacctcaaatgatccacctgcctcgacctcccaaagtgctgggattacaggcatcagccaccacaccaagccacaaatgatctttttaatgtgctgttaaatttagtttgctagtattttctttaggatttttgcatctctgtccatcagagatattggtctgtagttttattaatagtgtctttgcctggctttggtattagagtgagactggctttttattataggtttggaaatattctttcctcttctgttttttggatgagtttaagaagaattggtatttaattattctttaaatgtttaatatgattaagcagttagtatcttgatctcctctgtaaattaaaaaaaaaaagtagctaagccatcagttcctgggcttttctgtgatgggatagttttcatcactgatttgatctccttactagttactgtatcttactgtatgcatcaagggctttattcatttcttccaggttattcattttgttggtgtagaattgttcacaattacctttttttttttttttttaagacggagtctcgctctgtcgcccaggctggagtgcagtggcgcaatctcggctcactgcaaggtccgcctccagggttcacgccattctcctgcctcagcctcccgaatagctgggactacagacgcccgccaccacgcccagctaattttgtgtatttttagtagagacggggtttcaccgtgttagccaggatgttctcaatctcctgacctcgtgatccgcccatctcggcctcccaaagtgctgggattacaggcatgagccacagcgcccggccaccttttattctttgtattttacttgtatcaattgtaacgtctcctttcatttatttgagtcttctgtcttttctgttagcttagctaaaggtttattggttttgcttacttaaaaaaaaaaacaaaaacaaaaacaaaaaaacctcttggtttcctttaattttttctattggctttctactttccatttcattagtttctgcttagatatttattattttcctttttctactaactttgggcttagtcttttcttgtttttctagtatcctgattttcaacattttgtgatctttctcattttttgatgtcggtgtttcttctataaacttccccttttgaactgctgttgctgtttcccataggttttgatatgttatgtttccattttcttttgtctctggattttttttttttttttgacggagcccaggctggagcgcagtggcgccatctcggctcactgcaacctccgccttccaggttcaagcgattctcctgcctcagccttccgagtagctgggtttacagacatgcaccactacgctttcctaattttgtattcttagtagagacggggtttctccatgttggtcaggctggtctcaaactcccgacctcaggtgatctgcctgcctcggcctcccaaagtgctgggatgacaggcatgagccattgcacccagccagaaattttttttttaatgattttttttttttttttgacaaggtcttactctgtcacccaggctctagggcagtggtatgatcacagctcactgcagcctcagccttcatgggcataggtgatcctcccacctcagcctcccaaagagctgggactgcaggcacacaccaccatgtgtagctaatttttgtattttatatagagacagagttttactatgctgcctaagcttgtcttgaactcctgggctcaagtgatctgcccgcttcagcctcccaaagtgctggaatcataggcatgagccattattccccccaacctgatgaaatttttaattttacttttaatttcttcattgatccattggttgttcatgagcatgttgtttaatttccatgtatttgtgaattttttgaagtttcttccgttatttctaattttataccgtgtcatcagaaaatatatttgatacaatttcaatcttattaaagttgttaaaatttgttttgtggcctaacatgatctgtcctggagaatgttccaggtgcagttgagaataatatgtattcttcagctgttaattagatttagttgatctagattatattttaagtcggatgtttccttattggttttctgtctggatgatctgtttattgctgaaagtgggctgttgaagtctattactatttctgtattgtagtccatctctcccttcaaatctgttaacattcgctttatatgtttaattgctatgctgttgggtgcatatatataattcttatattctcttgctgaattgacccctttatcatgatataatgatgttcttgtctctttttacactttttgacacattgtgtattttatctgatttaagtttggttatttctactctcttttggtttccactgcaggaatatattttttcactcattcacttaaagcccatgtgtgtctctacaagtaaagtgagtctctttaggcagcatatagatggctcttgtactttaatccattcagccactcagtcttttgattagaaaatttaatccatttacattctagataattattgataggtaagtacaaactaccaccattttgtccattttgttaggtttttttagttgtttcatagatcttttgcttttttacttcctctcttgcttttttttttttttttcctttttgagacagtctcactctgtcgcccaggctgcaatgcagtggcaccgtgccgtgtcggctcactgcaacctctgtctcctgggatcaagcaattctcctgcctcagcctccaaagtagctgggattacaggcgcccaccaccacgctcggctaatttttatatttgtagtagagacaggatttcaccatgttggtcaggctgatctccaactcctgacctcaggtgatcccaaagtgctgggattacaggcatgagccaccatgcctggcctcttgctttcttttttgtggctgattttatgtagttgtatgttttacttttttgctttttattttttgtgtatctactataggattttgctttgtagttaacatgaggcttacaaaaacatataactggttatgtaaagctgataacaatataactttatttcaaaaacaatacaaaataagaaaaaaaaaacataactctggttgctcatggataagcagaacccagaacagactggtgcaagagagaagggaacccagctccacatttgtggcctgaagctctggactgattggcaaaaattttaaagctgacaatactggaagagaacctttgatcaaaaacactagaaattgatagagacgtgatacagacaccatgatcaaaaagagaggaagctcggatgtctgctcaaagtagttgggcaacaggactggcccctggactcaaaacagacataaggaagtgatgagtgaaggaaccttgggcaccacatgcccactgtggacctctgagatcctagctacaggagttcttatgacctccatagacctttaaactggcaggaagagctgcccaaagaacagacagaggcacaatttgtacctatgtggagccagaaggttttgctgcattgcgttgtttcagcaaaacgttaccatagatgtccatctctcaaggctctccatcttgtgctgagtggctacagctcctgctgtctgctggtccaggagagagcagggccaccactgctgcaggactgaggtgcatctgatccatccacccccttgcctgttgacctcttccaagaccacctgcctggctgctcccacaggagagtgcctacagcacagattccaccgcccccatctgagtgctttgctgttggcttggaggcagtttgcccctcagaatagccagtgcaataactgaggggccagtggacaaacccacgggtatggtcccagttcctcaggactggaaagcacttctgagggatatagaactgagatctatggcctgagcatgaacaaggacgatgacctcccctctccccagctctaagaatacagaggactgtgtcatggctttgtgtgccagtatgggagctgggcatccctcccttcataagaccagcccaggaaggagatgtcatgataaatgtcttcttccttgggagtcctgtggtctagaatgtctggaatgactctgcgatctaggcttggaagaagcctagttggtcaggcctgctcccatggcagagattggagggagatccattgggttgggggactgcaagttgaactggcctcactgcattggctgggctgaaaaccctgggctgtgggcactacactagttacaaacccatggtgccactaccctgcctaaggatgctctgcccttgaacccactgcatcaccagaccacctgcagacataccatgcaatctgctttgactccggcaagcacaggggactgatggtcccctgggagttgcatgcctcctggtgacctccttcaacatggactatccctaagagagggggtgaatgcagcctactaaaatcttcctttaggacaaaggaaatgggtgcagcaccagcagttaaaggggacaacaccaaggtctaggaatggacatggaaagggagtcatcttttgcctccggtctccacactggagcactgctgcagacccactgaaatactgaaggtatgagcatggcagagtaagagcctactgagccttacccttaaatgccatctactggactgacacttgaattataccaccaaacaaaaatatattgtgtttacgcccaaggcctgtaaaacccaccacaggaacctgtctacagcaaaggaacccttacagagtcttggccctctgaaaaaaaacatacaagcagctaacaaacatatgaaaaaatgctcaacatcactaatcagagaaatgcaaatcaaaaccacaatgagataccatctcacaccagtcagaatggctattattaaaaagtaaaaaataacagaagttggccaatctgcagagaaaagggaatgcttataactgttggtggggatgtaaattagtccagtccccgtggaaaacagtttggagatttctcaaagaactaaaaatagaacaaccattcaacccagctatctcattactgggtatatacccaaaggaaaataaattgttctaccaaaaagacaccttcactcatatgtttattgcaacactattcacaatagtaaagggatggaagcaacctagatgcccatcagtggtggatttgataaagaacatgtggcacagatacaccatggaaagctgtgcagccataaaaaagaatgaaatcacgtcaatcatgttccatgtaacaacatggatgtggctggaggtcattgtcattatcctaagaagattaatgcagaaacagaaaaccaaataccacatattcttatgtataagtgggacttaaaccttaggaacacatggacataaagatgggacaatagacaacagagactccaaaatgagggagggaggaacgggggcaagtgctgaaaaactaacttttgggtcctattttcactgtcttggtgacaggatcaatagaagcctgaatcttggtttcatgtaatatacccttataacaaactggtacatgtaccacctgaatttaaaattaaaataaataacacaaaaaatgcagttttcttccactagtctcatcatattttgaattttgatgttaccatttgcatattttatattgcacatctcttaaattattgtaactattatttttaatggttttgtgttttatatcttatatttaagatataaataacttatgcagcactattagagtattagttaatctgaatttgtgtacttacttgtaccagtattttatactttctgaatattttcatattactcattggcattttctttcatcttgaataattacctttagcagtttttgtaagacaggtctcatggtgatgaagtcactcagcttttgtttgtacttcatttctgaagtacagacttgcttagtacagcattcttggtattcagggtatttttccttctaggctttgaatatgtcatctcagtatctcttggcttgtaaggtttcagctaagaagtgtgctgcttgtagtattggaactcccttatatgttgtctcttttatctttctgctttcagaatactctctttgtctttgatatttgacaatttgggcagtcttattttggctaaatctgcttggagaacatttaacttcttgtacctggatctttacatctttattcaggtttggaaattacctactactatcttgttaaagaaattttctatcctattatgtttctcttctttttctttaacacctatgacatgaaagtttgtttagatattcttctttaaatctcataagttttttcatttcttttcattttttctcctctgcatttgtttaaataacatatctttgagcgcacgttattattattattattattatcttgttggatcaattctgctcttgatgctttctactgcatttttttcatttattgtagttttcttctctgggatttctgtttggttttttaaaagtatatgttcattaaatttctcattccgttcacatgtttttcttattttactggattgtttctctggatcctcttgaagtcctctgagctttcttaaaacagtttgaattttgtcaggcagtttatacatcctcatttatttaggtttagccattgataccatattttgtctgtttggtaatgtcttgtttttctaattattcttcatccttgtgattgagcattgatgtctgctcatttgaagaagtaagacctattccagtcctcatggactggctttgtctgggaaagccctgaggtatatgtggcactagggtgcattagaaacctgggacaattgtggtcagcacagcactgccagaaccctggggactacaacagcaggtgtgactcctggggtggactgcaaactcagtgcgcctgtagtgggcatggcattgccagatgctcagggaagctgtggccaatatggcacatgcaggtgactggggcttgctacagcaggcacagtgctgggatgtgcctgaagcacagtgcagctgcatccagtgcaatgctgccagaagccgtggcctgttacagcaggcatctttctggggcagggcagaagcttggttcagttgcagctgggtcaggtctgatgactcagttcatggatactgtcctggaatatgggactatagggatatccctagtgctgggttttattgtggtaggcccagtggtagagtccacggcaaaatcttgtgcttgcttcccttcatttccacaaagtggatattatctctctctatgctgcactgtcttgtgttggggaatgggtaacatggatgatgtaaaacagtcttttctaatttcttcaatgagtgttttcttattattttcctacaaccacatactttgatctctaagttggtttctgttgctcttgtgaatgtagttttcttgggtgtatagttactcaaattggtatttctgcagagagaaagttgctggagggtcctacttcacccctccccctcatatttttaattttaaaagatattccttcatatgtattttgctattgtattttttaaagtccatattgttcatttatttacagtagccaattgacaaataaagcacctgcttctatgtgagcaccaaaaatattttagatccatcaattcatagtttataaaacactaaatttcatgtcatttttgcttgtttcccaaatttcttagaaattacctaattaaaaatctttctttataagtatcttcttttttgctgacattctgtgtacgacacagtatgttatactatggagtgaatgaaggatattgttttttttttaattaaaaaaatacattttacctgagcaaaatcttatagaatttgatggtttctctctttgcctcagcactgatatattttaaaacaaattggttagtttttcttatgaaatagtatttcttgtttttttttaaatgaaccttgcagttatttagcttgtttacattggcattataaatattatttaatgtagtgccatatagcttgtagaaacacattaattttttttttttttttttttttttttttgagacggagtctcgctctgtcgcacaggctggactgcggactgcagtggcgcaatctcggctcactgcaagctccgcttcccgggttcacgccattctcctgcctcagcctcccaagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcctggcccgaaacacattaatttttaaactaaatttgtagggtgttatcagcattgtgaggaccggaataacatctgctttcttccctactgtgtaccagaactcagcacaattctcggtgcataaaaggcactcagtaaatatcttcaaattataaataataataataatttaaataaaatagaatatcataatgacattttggtgttttttttgtgttatattaaccaaatcatttccagcaaacgacagctacataaataaaactttaatataataatttctccctccaaacatcacaaacttttaatgtctgatgaatgtttttctcccttatcatgcaggaatctacagggaggagccgaaagtatttaatagagacttgtgagaaatttgctcatttagaatttcaagttcttgttttttactattttctctcaaattgttatctactgcctttaagtttttgtctctttatacaccactccctggttcatcactttctccttattccttttgcttttgttcactcgctttttaaatttcatccacgattcaatttagtcatcagttgtcagtgatgtcctcgatgacttagttaattttatgttgctataacaaaattctgcagactgagtaatttataatgaatggaaatttatttgacttaaatttctgaaggctgtgaagtccaagagcatgtcacagggacctggtaggggctttgattctgtgtcattccatagtggaaggtggaaaggcataagagtgtgagggcgagagtaagagatagaaaggaagggaggctaaactcatgcttcatgaggatgcttctcttgagatgacaaacccagtcccttcctcaaaatggggacagaaccctcctgacctcatcacttcttaaaggtcccacttctcacactgttgcattggggattaaatttccaacacaggaacttgagagtacacatttaaaccatagcaccagtcatgctgttagcatgtggaattacatcactgtaataaatacctgaaccaaactttaaatgtaccgtcaatgttacacaagcctctatgtatcatcatttttctctcttttgctttatagaataaaacaaatatttactttcctcaaatttttttttctatttctggttttactcttaattctattcttgtgtgtttgtaaatgccttcattctactttcacatttaataaatgttttggcagaaaatatttttcttaagaattttgaaatctttgttactgtcaagaagcctgataacattctgattccctttcctttgtttatacacttctgtcttcactctcattctctggaggctctgctgtgagtatatttgctttaagcatatctggattttttttcagtgtattggacattagggtaagcccttttactctggaaatgcagttttcatatctccgaaattttgttgtattgtttctcagatatgttccctctctgttttcccttttctttgtttctagttcttggggttgtcttcgttttgcttactagattgatagtttgttttgttcatgactatatttcatttgtttgctttttttctactttctaagagatttgattgacttttcaatatttactaatggctttttaaaaacagattttattttttatattagatttaggttcacagcaaaattgaaagatggtacaaaaatttcccataagcacctctgttcccacctaccacagactctcccactaccaacatctggcaccagaatgactcattttttaactgataaacttacgttgacacatcattgtcacccaaagtacatagtttacattacagttcattcatgttcattctatgggttttgataaatgcataatacatgtatctaccattgtactaacacacagagtaatttcacttcaactatgaatcttctttgttctacttatttatccctccctccactcaccccctaacaaccactgatgctttttcttttccatagtttcgctttttccagaatatcatataattggcattctacagtttgtagccttttcagtttacctctttcgcttcataatatgtatttaagtctcctccatgtatttacattctttggtagctcatttctacttagcactgaatacaattttattgtctagatatactacagttgatttatcaattcacctacgagaattaggttgctttgttgcttccaagtttggcaattataaataacgtttctataaatacctgtgtgaaggtttttgcatgaacctaggttttcaactttggggtggtaaatactaagtagtgcaattgctagatcatatagtaagtaagagtagatttagtttagtaagaaactgacaaactatcttccaaaatggctgtaccattttgcattcccactagcaatgaatgggagttcctattgttccatatcctaaccagcatgttgtgttattaatgttctgcattttggctattttagtaagtacctagtggtatctcattttaatttgtagtttcttaatgacatatggtgttgagcatctttttatatgcttatttcttgtctgtatatctttttgttgacgtatctgtttaggtctttttcccagttttacattaggttaaaaatggggttacttttcttctcttctgctagaagtaggaggcgatttttttccaatatttactctgagaacttggtagagttcctaaggtaaaactcataaaaatgtgaagaacctcttatgagtgagtgtccctggattttttaactctcataattgtccacactgattacctaagaatttgtcagttttagttgagggattttttgttttgctttttgccacagtagtagttcctacagaggtttctgctggtggatttctccttcaataagttgttactccctaattttgtatgtctatctctccactttttagggcattggtttgccctttgacctaacttcgctgatagttctaaaaagagttgtttatttttttagtttgttcagcttttaaattgttggtaggatgaagtgatgacttctaaactttttacatgctggcctggaatccaaaagttccaatattacttattttttaaaatttttgtatcatatttttaagagttcctctgaacccccaaatgctaatagatggagatcattgtctgagttaacaatatttctgtagggaataattatttattttgacaaataatttttattttatttcatgccggtgcagcagagatttcatgatgtttatggcatataatgatctaccagttgctctatttaatgttattacttttaataactaaagatattaatatttattgccttgtgaagcttcatattttcaaaacattttaatatttaatccgattgggaagtactgtgatacagtagaaactgaactgatttagagtatgtcaaacgtgggttagactcgtgctgctatttacagatgacagtatctaagactaaataccctttcatacaacttgggaataaaataaaatgattactttgaggatttttaagaagtaaaagtatgtgtagattattatattagctttatacttcttctgtaataaattaccactgatttaatgggttaaaacaatgcaaatttattttctttttcttttataggtcagaattttaacatgggtttaaactgggccaaaatcaagaagtcagcaagaccacttttctttctgcaagctttaggggacaacttattccttacctttttgagcttgtagaggccacctatattccttgactcatggcccctttctgccatctcgaaagccagcaaaaccaggctgagtttttgtcatatcatggcactctgaccctaccttttgcctattctctaagaattttttcagagttaccacaaagaatacttttaagagttataattctcttagagaataggcaaaaaataggttcaaagtgatatatttaaggactcatgtgattacattggacctctccaatatccagaatattctcccatctcaacttcagctgattgccaacgttaattgtatctgcaatcttaattcccttttgctatgtggcagcatatttacgagttccaagtattaggacatggccatatttgggggggccattgttctgcctgtaaaagtatctaggaaaatcctgatatagactatcaataaatggatacttgctattcattcaataaaatatttattaagtaattaattttatagattgtatctacttcagaggaaccttgaggtagacatgacaggtactactctagctttccatctatttcatctattttaaagcattggtactaatgatacaagaatgcaaatcataatctacatatttttagtgcttataaagtatataaatattatgttgtctattaaaaaaagcttgactttttttaatcaataaaataaataatatcctagctacttaaaatgatttatatttttaaattataaaactaagaaaaaagggtaatacttgtttttaatatcaggtcacacagaagaatatttttttcgcatgctatattacaggtgtgtcattgttcaaatcatctttttttgtacagaatctgaaatactccaactaatattttcaagggctttgtttgattgtgtataatgcaggtctagcagctctactaggattcttgtaatcaacacagtcattttgaacaatttgaggtgacgactttactaagtgttctctaatctgactttgttttccctatgggagcaattattctacaaaatgacaaagcagcaagggcaaaaatctagctaccaatgacataaaatcactgctttatttcagagttgggattcttgatctcattaatggcctggaattgcatgacaagcttttccatttagacaattaacatattaatccacttcatgtagtatccatctgcttatatataatttttcagaaatattttccatacctccttgcactcatggactgtagctattttcaaaagcaatataatcactagatggtgtaaaacactaatataaagtacctgggggcaattactggccttcagaaatgaaaaattacagtcaaatcattttataaatctttgaaactcagatattgaggaatagtattggggtaattcattttcccactcagttaattccgtggttggccttttgtgcagtttgacaaatcaagacttcttgtggagactggagagtaatttcattcatagctgagaaggatttttttttaaagatggctaaagtcatttatagttctataaactgaattattatgtagctattctcttatcttttttggcagtctggagcaaaatccatacttaatagtaagtgaaaataaaaaaggagaaaaaagaaaaaggccacatcttagcggttcttagaaaaactaattattgttttttagcaaatgaaatcaactttgctttgccttacctagatttcctgatgaatgataaacaggagaggctgagctatattacttttcaaaatacatgcatagggatatatataaatatacacacatatataattatgccagtgaatattgtaaatgatattatctgtggaattaacaaattatttccaaagctgaaataccacaggtcaatgccaggttctcctccttactaattatgtgacttcaggaaagtcattttgcctttctataccttgatttcctcatgtataaaatgcaaagtgttggcaaccagagaaacttacctcactcttagtgttcagggtttttatggggagtcatgtacttaagtatgcagcgtctgtgtgactgacctcagctactctgctgctttgaactcccctaccctcaagagcaaaaataagcattcactgtaaatcatattgttagtgtaaactatctgatcaaaccagtattgtggcttaaggcctcagacctatagaaatactcttaccaggcagaatattccaagggctcagagctcatttcctaggagctggcccagggccagtgctgcagacagccttttcctgggaatatgcagggtctgagcaactttggtctgttgagttaacctttatgttgcaaattatatctcaaaatagtcaagaacaaaagcataaatatttgttacaaactctttacatttcttgttcttctatgataacactattgtagcctctgtcagtgaaaggagccaaagaatatttctttaatttgataaagcatttcatttaaattaagagttaagatttaaaacaggatactttgcttaacagaatccatggggaaattgagttttgattaattgtgtgttttattttaaaagggttaactagaaagacctttttacttatacttcctcattgaaaataattccaaaatattttagttattttcttacctgaaaaactgcttgaatttctaatgcaataaattgaataatatttttcatccagaaattttaattcaaatggcaacaaataagaaacaaagatgggttaataaatatatagtaggataaatattttaatctataatactaaattatagattgtaatatctcaaaattaccccattagcaattattacaatactatatgtgaatgaatcagcactaacatccaaaaacagtgattgaagaaatccctttaaacaatttagctatgagcacatgtaaaagatgaattataatatttcatgcaagaaaaaaagacttttagtagaccagtttaataatttatttttcttcaggacattcagtaggaagatagaatgatgaaatgatcactgtgagacggaaaggaaggaagacttggttaagatctgtttgattacgttctacttaatgcaagtttatacatagttaaggggtatgtgtgtgtgtttgtgtgtgtatctgtgtgaaatatatatattgcacagttcttattaattaattatttaattagcacctaaattgtcaagaattattttgggggaaatccctttaatggaaataacttaggttttgaaaacaaaaaatatgggttctatgtctgcctcctgctctccgtgtgactctgatcaaagtgtttacctccatttgacaaagtattttgtaccctcagtttactcatctgtattttgagtttttgcatggggactattttgttctttgaaagagaacttgttgtaaatgaagatggatttagacaaaaaaatagcttcatatcagtacagagccttgatttttagaggaaaggaatgactttttttttttgtgattttttcacaagagtggtagcaacgtaccatgtgtagattactttgataggaccaagcaggatagatattatcaaaggaggaccaattgatgaatttcattagctgagtgatttttttcttattgttttagtgtataggaatcccatttctgcatttcttggtgggacaagaattgataaaacatgggttacatctgaataatattactactgacctcagctgttgctttcagctctcccacccccaagagcaaaaataagcactctctgtaaatcatattgttagcgtaaactatctgatcaaacttgtattgtggctcaaggcagaatatttcgaggattcagagctcattccctagtagctggcaaagggccagttctgaagacaggcttttcctgggaatgtgcagggtttgagtaactcaggtctgttgaatgaacctttatgttgcaaattatatctcaaaatagtcaagaacaaaggcatagatattagttaggaactctttaaatttctttacctactattatattaataacactttagtgttaaaacatgggtgacatgtagtattgctactccacatgattagtacaaagcaaattaaataatgactataaaagcactttataaacccttaaatgctaaatacatgttaaaataatcattgtttatcaatcagttaacaccaatatacagtcaaacacaggttcttaagaagaacttttttatcattatgtgtgaggtgaactcctttgacagggttttctctcattctgttctcttagctatggaccacttgatcagtaagtaattcaaatgcaataatctgtaggagacatggatatttaaagtaacccttttcaggtatccctatgttgatgattaccttcacactttaaaacatcgagagtgaagtagaaaattgatccaattacctgactaattcatgcttgagaaaaaatatagttttttgtttggcctatgaaaaattgactaatattataaatacactacttttaatttgcaaaattacttgtattgatatactgatctgtaatctgaagaagaatcattactaataccatttttcagttcttaaatacattcagtttgttatgtctgtgttgaatttatttttcactggggttaatatttcttgttttcttttattttacctcaaattaaccacacctactacaccaccttctactcaatggttttgtgagtccgttaattatattacattatttcacattttaaaaatttgtggatatgttttttgttttttaagacggagtctcgctctgtcgcccaggctggagtgcaatagcactatctaggctcactgcaaactccgcctccctggttcaagctattctcatgtctcagcctcctcagtagctgggattagggtgcccgccactacgcctggctaatttttgtatttttagtagagatggggtttcaccatgttggtcaggttggcctcgaactcctgacctcaggtgatccacccgcttcagcctcccaaagtgctggggttacaggcatgagccaccgcgcctggctggatatgttttttaaattgaggtatacttctgtgaattctgtataagaattcactttagaaatacatttttatagatattaaaaaaaggaaaaatatgctttctgccaaacatgctaaaatgttaacctatatcttggtgacgaccgaaactttaatttttttgcagggaagtatccttagtattgatttgcagccaagcttgtctctatctcaaaggtcacaattttcaaacgagaatacctttttatgtggtgtttcagcacatctatttttagtttcagctaaaaacaagaggttaaaaatcaaccatggatgaaaatattcaaggaaaaaaactgatttttttttcaaatatgaaaggagagtcttgtaaatgtcaaatacaattattttagggataaaatgtaattcatgttatctttgaaatatgcagcaatttaattttaattggaatatattatttttcttattaatgtccaataatataaaaggtacaatttaaaagaaaaaagttgtatcaagattataattgtgcatattaattcaaatgtcacggtggtatgcagaactctaagctgagcaccaagatctccattccctggtgtacataccctatgtaattccctaggactgtgaaataggatggctttcactctctgcagctgggttatgttataaagctacagggattatgcatgtttaattaatgtctcaaatcattgatctcaacataaggagattatctagttttgcttgatctactcataaaagcctgtaagtctgggcctagaggtcagacaaagataaagtcagagattccaagcatgaagatttgatgtagctttgctagcttgaagaagagaaaccacacggcaaagaatgaaggtggcttctagttgctaagagccagcaaggaaaagagaacctcagttacaggaacttcaaggaagcgtaactctgacagcaacagaaaaagcttgggggtgaatttctctttagaaactccagaagagaagcccatccagattctttgatttgggccttgtgatactttgagtagagagcccaaccactgtatgccagacttctgattacaaaattgttagctaaaaatttgggtattgttttaaagcactaacttgtgataatttgttttgcagtgatagaagactaatacgcttcctataaatttagccaggaaaatatgccatgtaacacagtgcttactagcacacttttaatatagaaactaaatataatccaattaattggaagtatagctcaaataatatatcagactatgaagtacgtatttaaccatgttttagttcaatttttaaatttaaactctcaagcagattataaacagatttgacaaaatcttttttttaaaaaaagcacaatgatttaatggaattttttgatattaaaaacttttggtctttgaaagacaccattaagaaaactaaaatgaaagccacataatgaaagaagatattcacaatacatttatcttgcaatgggcttgtatcccgagagtgctcaaagaatgcttataatttaataagaaatcaaacaattcaattgagaatgaacaaaggaattgagcagacccttaaccaaaaatgatatctgattgaccaataaacacatgaaagatactttacaacatttgtcatcaaggatataaaaattaaagccacaatgaaatattactatgaagccattaaaatagttaatgttgaaaaaactggtaatagttaagtgctggtgagaatgtgaaacaggtatcctggctggcgaaaacgtaaaatggtactaacaacttggaaaactattggagttctcaaaatttatatatttttgacaaaatcctttatgtacagtaaaactcccatgattcattccacatgatagttaaatcttgattaaactataacctgcattggtgtaaaaaataataatgaaagtgacaataacaggaaaggcttttaagatctgtttgtttctttaattgcttgcatgaaaacaaatgattcaatatactctaaaatgctttcttattcttataaacctagctaattaatattatatgaagagttacctttactttgcctataactagaatttgtgaaagtatctttaaatatacattattaatatagaattttgttactaggttgaatgacttttttttcatttaatgctggctgatgaagcataaacatgttccaaaaaagtaacatacgggtgtgtgactaaaaatgttaatgacaaagtactgatttctcagccctgatatttctatactgatatccatcccagtagcatgttaattcccactgaaattctgattattgatactactgataaaaataattatcctctatgtacggtctcttatgtgtcagacactgtgctatgtgacattatcgcatttgtatctcatagtaacatcaagaaatttattttctattattatcctaacttacaactgaaaaataggtgaaattcattaataatgatgtctacttagatgtcccagaagtatctgaaatgtaattatctagaacaggggtccccaatccctgatatcagtctgtggactgttaggaaccgggctgcacagcaggaggtgagtggtgggtgagcgagcattactgcctgagctccacctcctgtcagattagcgctggcattagattcatgagagcacgaattctattgtgtgctgcacatgcgagggacctaggttgcgtgctccttgtgagactccattatacccccccaccccagtttttttccaatttgtccgtggaaaaattgtcttcacaaaactgacccctggtgccaaaagattggggactgcggatttagaagataagtgttgctaaaaaataagtttaacacagatctattataatttgctaaaatataactgtcaaagagttgaaaacatgaccctcataaatataaatgaaccaagtcagtgattttattcaactaattaattaatgcgagaatcagaagatgccaaaactggttcaaaggattattaaaagtactgagattaatatagtcagtcagagaacattaagaataatttactaatagatgcataattgcttaatatcctacagggctatgaactataacatttgagattgttgcctctagcagctagaaataaatcatatctatactggacaacatttctttagattactttaaataaaaatcattttcattgcttttataaaagaatcaattgcattattataagtgcaagttaatttcacaagttgtttatgagtaaattttatagaataaggaagttttccagaaaccttatcagcaatgctgatatgatgctgtagtaggcagaataatggcctttcaaagatgtctcttctctaactgtgaatatgttaccatccatggcaaaagagattttgcagatgcgattaatttaaagatcttcagatagggtgattatcccggattaccttcgtgggcctaccataatcacagggttccttaaaagtgaaacggggggaggcagaagaaaagttaaggccagagtgctgtaatgtgataaggactcaatcaccattatactggctttgcaaatggatcaaggtcatgagccaagaaatgtgcggagcatcgagaagttcaaaaaggcaaggaaatggataatctcaaaaagaaaaatagtcttgcaggcaccttgattttagaccagtgagacctctgtcagacttctgctctacagaactgtaagataatatatatgtgttattttaaaccactaaatttgtagaactctattatagcaaccataggaaattaataaaaatgcctggccggatgcagtgatcacgcctgtaattccagcactttgggaggccgaggtgggcagatcacgaggtcaagagatcgagtccaatcaggtcaacctggtgaaaccccatctctactaaaaatacaaaaattagccaggcatggtggcaggtgcctgtagtcccagctacttgggaggctgaagcaggagaatcgcttgaacccgggaggtggaggttgatacagtacatgattattaataatttgttgactggatgaattatttagggttcaataaatgtaactcgtttaggacatatagttaataaactggatcctagattaagcctctgtgcctgtccctacaacctgtacttttaccacttaagttgctttatttcttgtgtagtcaaaaataatatcctttaaatcatttccttagattattttgcctagattctccacattcattctgataaggaaatgatttatagttgataatgtttattatttagttttaataaactggaaaaaatcaatttcaggcatatgttaaagatattgcaggttcagttccagaccaccataatcaagtgaatatcacagtaaaataaatgtcatacaaattgtttgggtttcccagttcttataaaagttatgcttatactataccacagtctattaaatgtgcgatagcattatgtctaaaaaagtccatactttaattaaatataccttattgcttaaaaatgctaacagtcatccaaatcattatcttttggctattggagggcctgatctcgatgttgctggccactgactaatcagcgtggtggccactgaagcttgggtagctgtaccagtttcttaacacaagcatcaagtttccaccctgattcactcacaagagatttttctgtattatgttatcatttgatagcatttaaccgacacttgaacttctttcaaaattggagtcagtcctcttaaaccctgctcctgctttatcaattgtttaggtaatattctaaattctttgttgtcatttcaacaatgttcactgcatctttacatggagtagatttaatctcaagaaaacattttccttcttcatttataagaagcaacttctcaagcattcaaattttgttatgagtttgcagcaattcagttacttctttaggctccacttctaattctagccctcttaatatttctacaacacctgcagttatttgcttcccttaagtgttgaaattttcaaagcccctcaccttccttctgcagcttcctgacctctttcatccttcacagaatctcatcttgaattgtagctcccctaattcccatatgttgtgggagggacccagtgggagataatggaatcatggggtcggtttcccccatactgttctcatagtagtgaataagtctcaagagctgatggttttataagaggtttccccttttgcttggctctcatttctgtcttgcctgccgctatgtaagccatgccttttagcttccaccatgatggtgagctctcccaagccacatggaactgtgagtccattcaacctctttttctttataaattacccagtctcaggtatgtctttatcagcagcatgagaatggactcataaaactggtatgcaaataagcagactctacatcatagtattccagtgtagttgaactattattataatggagtccctatccataaaattgattacaatctaatatggatttgtgcaataaggcaaatataccagtaactaaaatacagggaaagtatgctacagatgaattaatttatacaaatatatgagtcaaagggagaaattattcaattaggtaaaggaggaaagcatttattaaaattagagagggtgtctgggtgagagccaagtctgaaggatttttttgggtaatggtttctttactctattttctatcacatgttgaaaattttaacacattgctgtcatcagaaggtgtttataatttttttgtttatagggtttataatttttttgttttttaatttatagatttatttgattaaaaaagagtttcatgtaccagagatgggttattgaaaataggcattgtttaaaatatgataaatattttatttgaaaacttggatttttatgatttacaaaaatctggagaaaaaacagggcaaaaataacagaaaatgaacatatatttaaattccccaaatattcaaatatatcattatattatgatgaagacttacatattactattttgtaatatgacaaagatctattcttacatttattatgataaaatgttgctataatatgagttcattatatgaagctctgacatgttcctctcattcttcatctaatatctaataatgactacctgcaaggagaaataatcactcaagttgtttacttttgcagaaggtgcagtctctttcagagaattctaaaaaaaaatcacattctatttaaactagaaactttctattaaaataagtgaaatgtagttaacaaaggatatttatttttatgtattttgttagttactattttccttattttgaaaaacttcagatcactggaatatctacattacaaagtggccagattgtatggtgtctgtaatctcattaccttgtggtaaaaacacttaattttaggctggacacaatggctcatgcctgtaatcccaatattttgggaggctgaggttggtggatcaccttaggtcaggagttccagacaagcctggccaacctggagaaaccctgtctctaccaaaattataaaaattagccaggcatggtggcacatgcctgtagtcccagctactggagaggctgaggcaagagagttgcttgaaaccaggagaaagaggttgcactgggccaagatcatgccactgcactccagtctgggagcctgggtgacagagtgagactctgtctcaaaaataaagaagattggccaggtacggtgtctcatgcctgtaatcccagcactttgggaggccaaggtgggcagatcacctgaggtcaggagttcaagaccagcctcaccaacatggtgaaaccccattgctactaaaagtacaaaaattagctgggtgtggtggcgtgcacctgtaatctcagctactcgggaggctgaagcaggagaatcacttgaactcaggaggcagaggttgcaaagagccgagatcgcgctattgcacaccatcctgggcaaaaagagtgaaacttggtctcaaaaaaaaaaaaagatcagatggctgtagatgtgtggtgttatttctgaggcctctgttctgttccataagcctatatgtctgttttggtaccagtaccatgctgttttggttactgtagccttgtagtatagtttgaagtcgcgtagcatgatgcctccagctttgttccttttgcttagaattgtcttggttatatgggctccattttggttccaaatgaaatttaaagtagttttttctagttctttgaataaagtcaatggtagcttgctgggaatagcattgagtctataaattactttgggcagtatggccattttcatgatattggttcttcctatccatcagcgtggaactattttccatttgtttgtgtcctctcttatttctttgaacaatagtttgtagttctccttgaagaggtccttcacgtcccttgtaagttgtattcctaggtattttattctctttgtagcaattgtgaatgggagttcactcatgatttggctctctgcttgtctaatattggtgtataggaatgcttgtgatttttgtacattgctgttgtagcctgaaactttgctgaagcttaaggagtatttgggctgagaaaatggggttttctaaatatccaatcatgtcatctgcaaacagagaaaatttgacttcctctcttcctatttgaatacaatttccttcgtttgcctgattgccttggccagaacttctaatactatgttgaataggggtggtgacagagggcatccttgttttgtgctgactttcaaggagaatatgaacagacacttctcaaaagaagacattgatgcggccagcaaacatatgaaaaaaagctcaccatcactggtcattagagaaatgcatatcaaaacaacaatgagataccatctcatgccagttagaatggcaatcattaaaagttaagaaacaacagatgctggcgaggctgtggagaaatagaagcacttttactctattgatgggagtctaaattagttcaaccattgtggaagatggtgtagcgattcctcaaggatctagaatcagaaataccatttgactccgcaatcccattactgggtatacacccaaagggttataaatcattctactataaagacacatgaacgtgtatgtttattggaacactattaacaatatcaaagacttggaaccaacccaaatccccatcagtgatagaccggataaagaaaatgtggcacatatacaccacggaatgccacgctgccataaaaaagaatgagttcatgtcctttgcatggacatggatgaagctggacaccatcatcctcagcacattaacacaggaagaggaaaccaaacaccacatgttctcactcataagtgggagttgaacaatgagaacacatgggcacagggagggaaacattacacacgggggtctgtcgcaggatgggagcaaggggacggagagtgttaggacaaatacctaatgcacgcagggcttaaaacctagatgacctgttgataggtgcaggaaaccaccatggcacatgtatggctgcataaaaaacctgcacgttctgcacatatatcccagtatttaaagtaagataaaactatatataaaaataaaaaaagaaaaagaaaacactgatttttaactgacagattatgtccccctaattgcaggcattagaataatttaccattgtgataatgcttgaaagttggattatattacagacctgtaagacggcattagactttgagtcaaaagtattcattcattttttttgtgtatttttgtgttaaattaacagctttaaaaatgtttatagggatacatagtaaaatagctatatgttcatgtgtgaggattggataagcatgtgaaatactccacagaatttgtgctcaattttgggacttcacctgccttgctatgaataaagtatgtattcttaggatacataaacttgtatattattttaatcttaatatttctaatcatctcttacgcacagcctacttctttctctataactgatggtgattaattgcctaattacttgccccatatgcttctcattattttgtgttgtattagctttcttttttttcatctattgaattagagtaggggaatttaaagttcccagacagtacgttatggttctttgtatcctctgaagtccctaatacagcactctctccatactgggctatgtgatacatttggaaaagcatgaggtttgaagttcagacttcaaattctggctgtatgtgttaactcagtacacttgagaaaatctcactcttgttaaactcttctataacatcaggctggtgtggtaagatcagtagcagtctatgagaatcaagtgagaaccatttgcacaaaataattgtataaattccagatagctataatatatactgtagaattcttcattagataaaatgatcatactaaagagtataataacttaaaaaatatagacagctattattaatgcttgcaaaaattactatttcaatggaacttactttggatttattcatttttttaatcacatcataggaaaactaaacagattctaactcatttagttgttccaatttaactttaaaaggaaatagaaaaagcaaaggagcaaacaaaaaaaatcctgtgattctaatgccaccagttaaatcatagtgttactggtggagggggtacaggttcttgacgtcttgaacaaagaattagatgaaaatgcacaaagcacggaaagaatgaagcaacaaaagcagagactaattgaaaatgaaagcacactccacagtgtgggagcaggcccgaggatagagactcaagagccctgttacagaatttttgggggtttaaatatcctctagagatttccactggtaactttgtgtatgccctatgtaaatgaagaggatatttcctgtcataactgaagtgtttccatttgatttagttctaggaagtccttaggtttccagcctccaggttctattctcctgcctcgatagaggctctttaaattcacgaaaatcattagcccttttgcactgtatatattattgttgtatattttccctgggtgttatattcatattgccttcctttacacccgaattctgcttggatgcgtctcctctgtgttcttaaaacaagacaggtaattcctattatgttgcatattataatttcttcttattgtactttccttaactttttattctacaggactaagagctctgtgagtgaagggaccatgtctaccttgcacactaatatattcaaaatgactaattatgttcagctcatagtaggatctcagtaaatattggtcaattatataactgcagatgtacagcataattaaatatatatgcaggcccattgtaaagtggttttattttagaagcaggaaaatctttacaatccaaatttaaatttaacctttggaagttatgctatggggatgtggctattggcattcactaggcaaattcacctaggattctttttttccccagaaaaggaaaaaaaaaacaagctcaaaccaacttaagaaaaagatgttttattttctcttttaactgataagtaaaggatactatgtggtttaaatgaagtaatcatggctcagactcccatctccccacgtgttctctcaggttctcaagtaggctttcttcacttagcactgtgtcttgccttaaggccaaactttgcttcttgccactcataatttagtaagaaacatggctttctcccccatgatatgtatataaatatgtagggaagaatttaactagccctgtgtgattctagtgcccatatcttgaccaattgctgtacccaacataagtatggacagggttaatatgcttagatacctttctaccactatagtaaacagtctcacagaactcaatagattggggaagcagtgattttggatggaaggcatgagaaacaggtaaaaagcatttcttcactatattatgtctctttaggttttgcctttatgtggcaaagaaatagaaaagtctccactaaacgtttcatttagaccatccttgtgaacaacatgtagagttctaccagcagaatagtaaattgtgaactctttcatttaagaaatatatcaaagaattgaggtgctttttagccccaaacattgaaaatacatgagacaagtgaccatgtcagagttaaaacttggttttagataggtactagctaacaaccacaacacctagtattagatgcttggaaagcaacaaaaactctttcctcagggaagcattgaggatttagatgaattcagtgttatttataaagtgcttattatatgttctttttattttaatatcataagtaatatatttttatactttaagtgactaattatttgatttcatcgatctattaacaagtgttttgagttacttatcagagaattcatcataaaacacatacattaaacatctattttactactataaattcttaaacttgatttcatccagtagttcttatcatgtaatttcgaatgcaatgtaatgtagtcagaaacgtgtagaatatcttcatttaaatttgtcaggcatcacatgaagttaaaactcatagtggtctataagaaaaagcaaagaaaatactgttgcctcaaacagttattttaacagctgagatttttatattgaaataaactaataagaacgtttagtgtttgaaaattatggtaggcacttgaaatatttatatgttaatagttaaatcactcaggcaaaattgaacatatttataaaaaatttattctaaacatatggaaggaattctggattaaccttcataatatatttgaaatacgatatgttggaaattaactgggcttagcttgtattcctagtttgggctctgagacacgattgaaataattaatttcaacaaagaatatagaaagtatgaacatgtgttggctttcaaaatgtgaacaacgtggtgaaattattagatccttgggtggttctggtcttaattcatagcttaaaatattatgtagtgagagacttatatgctttagttttttagtatcaataacgcccttgaaacctttctttgtactcctcaaccagacctaggtgttttctccttaaactgaaacattcattttcacaaaaaataaaataaaataataaagaatagtcaagaacttgacattattttttgattagacttgttgggcagaacatatcttttatagaatggtatgttgtaattgatttaatatggaaagagagaaaaacctcttatataaagacaggtgctttgcaaatttcagtgttcatacaaataacctggagagtttgataaagtactaactgattcttggattccacttccagaggtcctgattcagtaagtggtgcctgagtgcttgcatttctattatattctcagatgatgctgatgctaatggtctgtggagcacattttgaatatcgcttaggtagaactactttggaaacaaaactatttcctcctttaaaaattaaactacaagaattaaaagaacgcacactaaaaacatgtgttaaactaaaaacaaattgtaaaaaatttaaatgaaaatattaaaatcaagtcaaattatttatgatcatttatgttaattatataatagaaaaattctcatttattcaattaaagttatttaatgctttttcatggtctgttcatatctgattttcattatggtgaagtaaaaataaaggatataggtgttaaatatactgatttaaagtataggacatgtactaacaatgatataattttttaaatttggcatttaagcttatttctatattgactatatatagctataaaacacatccctgtcatgagtcaacttgatttttttctaggacaatttaaagtatcagttcaataaactagcttaggtacatagtttactgctttggaacttcaaagtgacagtcaggtacaatcaatatgaggaaataaaagaaggattcaattctcttgttactgataagttcaagaatatctctgtaaaagtaattgctaaaccagatatttttttaccaaaaaaaagacaaacttaaaagcccaaataataatttatatgtaatttaaatgattaaaatcagtcataagttctttccaaaggaaataacaatttcagaaaagaccatgatttttaaaaatttcaagtgtactgtaataatacaatctatgatgaatgacagactgaaatagtgaatcatggagcttggatattatcaagaaaagacaataaaaaataagtaatttcttatggacatttaaaaacttacagctaaagagttttcagtgtttttatgactttttaaaaattattctcagtcatgattagttagtgctaattcaatctattaagttacaatttcaaaaaggcattttataaaatgtaacgtatatttctacagaaatttaaattctatcttctgatggtttgcttatcaagtaagcccatggactttgtaaaattgaaatcaaggtttacatcactctgaataagctggaaaaataccgtaacctgcagtaggaaaatcaaagatgaatgaatcaaatacttattctgcttaattcatgcctctgatcattttaaacttaactaattggtattatgagttcccaactgaacatgtgttattatataactgcattcagtatgtattttgtcttattagaggttacatattgctttttatttacatagctttattaagatgtgattggcatacaataaactgcatgtttttaaaatatactatttaagttttgacatatagacccatgaaaccattaccaagattgagatagtgatcgtaacacctcccataattttctttaattttttttaaaaaatacatttgactgtgtatatttgaggtttacaacatgttatgagatacatatagatagtaaaatggttacaatagtgaatcaaattacagtatctgtcatctggtatacttatgtttttgtaacaagaacagttaaaatcttatttaacgaaaattcctaacacaaaacaatgttatcaactatagccctcatgttgtacattagatatctaggcttgttaattttatatcttttgacctaaatctcctcattttctccctgccccacctgccatggtagccactttttaattctctgtctctatagggttgaccttcacttttttagattccacatataaatgcaatattattctttctgtgtctggtttatttcacttaacgtaatgtctttccagtccatccatgttgtgtcaaatggcaggatctgattttttttttaaacgctgagtaatattttgttgtatatatatcacattttctttctccatttgtctgttgatcgacacttaggttgtttccatatcttgacaattgtgaatgacactgcaataaacatgacagtgtagctatctttagggagtggtgatttcatatcttttgagtctattcccagaggaaagattgctgaatcatacgctagttctatttttaatttacataggacctttgttctgtttttcctaatggctgcaccaatttatttttttattattatttctttattttttattttttaaatatactttaagttttagggtacatgtgcacaacgtgcaggtttgttacgtatgtatacatgtgccatgttggtgtgctgcacccattaacttgtcatttaacattaggtatatctcctcatgctgcaccaatttaaattcccaccaacagcatgctatagtttccttttctccacaccttcaacaatatttgttatctcttacctttttgataatagccatcctaacatgtgtgaggtaatgcttcacagtggttatttgtatttgcctgatgattactgatgtagagcactttattatatatttgttggccatttttatgtcttcttcagagaaatgtgtattcaggtcctttgtccattttttaattggatttttaaaatttttctgctgttgaattttaagagacactccaattcaggagattgggggtggagtggatcatagaggggtggtgtggtgggacactgggttggctcaggtgtctacctcactgggcctaggttcaagtagtcaggggacagggtagacattagaatggggagatgagcctctgaggcaccttgttcccagagtagggagctatagcttggctagggaatgttgcagtatcatgtgtgagagcatggtgcaatgatggcaaaacctccgggatgaaggaatgcagtggctactggccattagaacataatgcactctagcagtggctctgggttcagaacgtgatagtgcagtggcagcttgggtcatggggttcagggcacaatgtgggctccttctctagagtagtacagccatgtgaatcccaggcaattccctaagctgtgctcaggaactgtaaagactgcaggatcctccagtagcaaaaattgcaggtatccgtggtggttgatatggtttgactgtgtgtccccacccaaatctcatctcaggtggtgatcctacatgttgagggatagacctggtgggaggtgactggatcatggggtggtttttcccattatgttttgttgatagtgagggagttctcacgagagctgatggttttaaaagtgtttggcaatccccttttcattatttttctctctcctctcgccatgtaagacgtgccttgcttccccttcaccttctgctatgattgtaagtttcctgaggcctctccagccatgtgtaactgtgactcaataaaaactcttttctttataaattacccagtcttaggtagtatctccatagcagtgttaaaatggactaatacagtggtgatgagggccactgagggtctcttacttgcctttctctatctggagaagccccttgtgatccagacttggggatgggatggcagaggcaatgtgttttcttctcttcttatgtgaccatcctgagtttctgtgctccacagggtttacctcactcctttgctgcactctggcactcctctttagttactcaggtcaaaatgcagctgcttattcattagtttggttcctgattgttggagagtgataagtgttaggcacacctctagtcagccatcttgctgatttctgtctcagaattttcttgtgccctttgtaaatcttctttcatccctcctgctgtggctccacacagccactgcttagttttctgtcactaaacactaattagcatttcttagaactttatataaatggaaacatatgtagtttttgttgtctggcacttttcacttaacataattattttgatgttcttatgtactgcagtgtgtatcagtaggctatttattctaattgtggagtagtattctattgtatagataacacacactgtatccattgacctgctaatggatatttggattgtttacagtttgaggttactgaaaataaggcttctatgaacatgagtgtaaatagggacgtaggtatttatttctcttgagtaaatacttaggactgaaatgatatggtcaggacaggtttaaatatttaggagacttccaaactgttttcaaacaggttgtagtatttcacatttctaccaggagcatatgagatttcctacccaaaacttggtacagtcagactttttagttttagccttttagatttgtgtgtagtcatttttctttgtggttttaatttgcatttccctattgttgagcatctttttctgagcttatttgctatctgtatatcttctttaatgaagtatcttttcatatctttttcctatttgaaaaatatgtgttaattgagattttagaactctctctatattttggatacatgtcaattattagatatatgctgtgaaagattttcttccagactctggctaatcattttattctctgaatggtgtcttgaaattaagtagcactagtccttcaaatctatgattttttttcaaagacatctagctactttatgtcctttaaattttttttaaattttagaatcaattgatcaatgtctctcaaaaatcctgctaggattttgattgaaatacatgtaattatagatgaatttgagaaaaatttttatcttggcaatatttagtcttagtgtccatgaacataatatatctgtttaggtctttatataagcaatattttttagttttctttcatatttctgtcagatttctatgtattttgtatttttgattttattgttagtgatattattttatttcaaatctatttttttcattgctaatgtattgaatacaatggagttttgaatattgatcttgtacaaactcgttaaataacttattagttctagtaatttcagattttctaacacaatcatgtcatttgcaaataaatacagttttatttctttctttctgaactagattatttttatgttttattcttgccttatttcataggctagagtcttcagtacaatgttgagcagcagtggaaacagcagacatccctgtttttttctttaatcttcaggtgaagcatttagtctttcactattaagtatgctgttagctctgtgtatgtatgtgtgtgtgtgtgtgtttaatatatatttagatatcctttatcaggttgtaaatttcctttctgtttctattttgttgaaagtttttatcaggaatgaatattggaaaaaaaggcaagtacattttcttcacttttctctccctcccctccgtgcctctttcccaactaaaagtttatcaatttgattaatcctctctgagaggcaaccaaatgaagccaaaagttacatttactttctttacttgtatgctattttatttagttccattctcatctatgctatttctcacattaggtttcatttgctctttttgtttacaggttcttcagctgaaagctggatggcttttttttttttgagaccttattttttatttatctctaatatgggtgtttagtgctccaactttctccctaagtattgctttcacagcatccaacaaattgtatatgctgtatattattttaatttggtataaaatactttttatgttctacttttatttttatttgacccttgaattattttataatgttattttttcccagcagttggagattattcagggatttttctatcactaatctttattttaattttatttggtcagagaacctactttgtatgacttgaattcttttaaatgtagtaagatttgttttttggtcctgaatatgatctctcagtaaatggtctctgtgaactttagaggaatgtattgaactgtttttggatggagtggtctataaatttctggtaggtgttgttctagtcttctacattcttatagaatttatgtctacttgttcaaccagcattgtgaggtagttttggaagctctgactataatggggcattttcagtctatcagttttgcttcatgtattttgaagctctgttattagctgcaaagcacatttaagatttttctgttcctttgaactaacaaccccctttttcaatatggaataaatttctttatacctggtaatattccttgaatgtattttggctattattaatataacctcctctttttatgtagttaatgtttgtattatatatcacctttcattattttatttttaatctatgactttatatttgcatttctctataggcaatatatagttaggtctttcggcttgatcagatttgacaaatgagacattgtgccttcaagatgggctgtctcattcacccaatatccatcttagtatatttattaattttaatgtgtgcatggtattctgttatattatcaactggccaagtagtttctaagcaacaagcaactgccaggctacatttccacattttcatggatttgaccaataaagaataagcccaagtggatttagacagtttattacccatgacaaagcaaacaatatgatcttcatgttcacatttctacccctgcttaccctccgcaagtctcatggggacaatatagaagagtgcaggtgaatactatgcacataggattatttatcactgagaaggaacaagtgtaatcttataaggagactgataacaaaccttcccaacctttgctacacaggggaatttctcctttattaccccgatcaggaaacaaatctgtcctctctcctagaggtagacactacctttgttattccgaagtgcttctagggaggagagagagactttagccttagtaccatggaaagtaagcagatctgttccttgacctggagaagctttgacaaagctgtcaatgccctttcttcagaggttgtgtagaaatgtcagacttacagggaattttctcccaacatatttagaagtatcggttacttctttcagaaaaaatgaagctactcagtattttaaggaaaagtttagtagaagaaaatagaagcgtatgcagtggctggaggagtagggctagcaaatgttaggcccattatttgctatcaggttatctggacgtgcagacagagccaggtaagctgatgctgcagatctgtactgctggtggcataaaagtgtttaattatcaggaggatgcctgaaagctattgggaaaactccaggtcttcagcctgctgtctgccaatgcccttgtgcctgtcctcagccctgccagagaataatggcttttcttactcttccacatcccaaatctcattcaagtgatatttattggcacaatctagtggcattctggaatttgggtaggatacctctcaagctcttcccttgtattttaggaaagtatatagatgaaggagagtgatgttgaaattgaaaacaatctgtggaagcctttattaatgtaattctaacatcttttctcttaccacaatactttagtaaataaccttgtacatctcccttttggcacatgtgggaggatttccactggatagatgcctagaaacgtaatggctcacagtgcgtgcctatcatacattttgatagatgataccaaattactctccaaaagcagttgctttccagggagtaactgtaggagaagggaggagaaaaaccctgtttgtagatgatttagaagcacaagttagtactcaagtctccttcatggacactgactcagtgcctttgggtggtgactctgtgaggcaatgggagggaagaagaaagtgcaatgaccccacgataccttattataagacctaacatctagcatcaatctttgaaccatcgagaaagaaagaagaaatacaggattgaatgtcttgtctcaggtcttatgccagcagcttgtacatggattttccaatttaattgtcaatgtaagtctatgaaatatattattctccccatctttcctggtgaactattgaggggtagatgccaagtagcttgttagagatcatgcatttaacaaatggtagggataagattcaaaaccagctgggaaaaattacaaaatctgtattttttttctatatctcacagaaatcttcccttcttggtaaacatccttgagcctcctattattcttttatggctagtttactgtcttcaaggctgcccatgtgtaccggagagaatacagactctggagatgtaaagacttgaatttgaattaaaggttgagtcccatgttcaccatttattatctgtgttacttttgagcaattcaattcagctctttaaatttagtctcaacatctataaaactgctataatgaaacatgcttggcaagtttgttgtgagcattagagataatatatgcaatgtgcttagcatattgttacagcattaattatgtatacttatgtatacattgcaggcgagctgcccgcttccgggatccactaggcaaagccagctgggctcctgagtcaggtggggtcttggagaacttttatgtctagctaaaggtttgtaaatgcaccaatcagcacttcgtgtctagctcaaggtttgtaaatgcgccaatcagtgctgtgtgtctagctcatctagtggggacttggagaacttttatgtctagctggaggattgtaaatgcaccagtcagcactgtgtgtccagctcaaggtttgtaaacacaccaatcagcaccctgtcaaaatgggccaatcagctctctgtaaagtgggccaatcagctctctgtaaaatggaccaatcagcaggatgtggatggggtcagataagggaataaaagcaggctgccccagccagcagcggcaactgagtgagctccgcttccacgtgtgggaggtttgttctttggctgttggcagtaaatgttgctgctgctgactctttgggtttgagccgcctttatgagctgtaatgttcaccatgatggtctgcagcttctctcttgaagccagctagaccacgaaccccccagaaggaagaaactcccgatacgttggaacattagaagtaacaaactccggacatagcatctttaagaacggtaacagtcaccacgagggtctgcagcttcattcttgaagtcagccagaccaagaaaccaccaattgtggacacatcgggattggcacatgttgaatgctgtgagactagatgccaaagtatgcatgtgttgtgaattatgtttacaagatgttataaatatgggccgataaagttgatatttataattccttaaagtcacgtattaaatctgatatattttatctcttcacaagtcaaaataaacttagaaagttttgagaaacaaaaatatagactagaatattatatgcatgtaagactgtacaaatccagtctaaaatgtaattaatgtatcattgtttcctccttgggaaaattatccagtagtactccaacattatgtctttttctgtctagtcctaatgcagaggagacaggaaatcagaaacagcttaaaacccttggtgatgtactagtgacagttgaattagaataaaatatgtgtcttttgactgcttgctaaaaatgtaaatgattttttataattttttttgacttcttagtgccagtgtgtttacattgaccaaatattttggtgaaagttttgtatattttttttcaaaatgttaagacaataaaaatatttgagttcaacaatgtattcttagaaatatatttctagttttatagtgcttaagtttattagaatatgacaataacatatgccaaatcaatgcttaaattgatactttttataattttcttgatcttgagaagtcttaaaaagaggtactatatttttcattataatatataaagatacctattgattataatttcatttggcttaggaatttccctttgaaagaaagtatcattttggatgaatgtagaatgtatttaaaaattttaaacaccgaagagataagtttatacacttggactctgttattaataagttatggccattatctcttccttgccatggggagagtcctagttgttattatactgtcatgtgtcacttaaagatgcagatacagtctgaaaaatatgtcattaggctgtttcatcattgtgcaaacagagtgtacttacacaaacctagatgatatagactactacacacctacattataacgcagttgtaatacaatggtaaaatatttgtgtacctaaacatccctagacatagaaaagataatgcattgtgccaagacattaatgttagctatgacatcacgaggcagctcgtttataatcttatgggatcattgttgtatatgcggtccattattgaccaaaatgtcattacatggtacagtcccacacttgacgtgatatagagttcatatgtcactttttcattgttactgattttgatcaaccaagttttaaatatgtactgtgaaaaatttattttcacctttattttgaagtactgtgcatcatttcatagcaaatctatggcatggatatgcaggaaaaagtggataaaattatattttgacaacttcctaaattattatgtctctcagagataataatgatcagtggtatatatactgttctactctgagatagcccaggggcatcccaaactatgagggtttctgtgacactcatacagataaactaggtccataatgtataaatattaatgttggcattcacactgaggctgggcttttgcatttccacaccaaatagttatcttttaaaaacataacattacagatacattttggcctgaaggtattttcataagttccctatttatatgttgttgatgaaattaaggattccagtaaatcataataatcattgctagtggaggagaacacagtaagattaattccaattttgtggggaagaaatattttacatatggttttagttatgtatttagttatggatgactctgatgttctgaaaatgtattgcattttaaccaaaagcgtcagaatataatacattagttagtacctcagtatttgaaaggcagtgaaaaccgttggctgtttttagacatttgtgtatattttgatatatatgtcaatatttaatagaataaatcttatgtgttaaaatgttctcattcctgaacacactaaatataaaaactttaaggaaggagcatttattagtttgctaaggctgccataccaaattatcacaaactgggtggcttaaaccaatagaaatttattgtctcacagttttagaggctataagtctcatatcaagatattgacagagctggttccttctgagggctgcctctcccctagttcttgtggttttctggcaatctttggctttccttggctcatagaagcatcaccctgatttccgccttaattttcacatggtgttctccctgtgttttgtgtttatccaaattttccctttctgtaataccagttatgttcgaataggggcccatcgttctctgtgttgaccttatcttaactgattacatctgcaatgactcttttcccaaataaggtcacattctgaagttttaggagctaggacttcaaaatataaattttggggagacacaattcaacccatacagagggtaatggatacttataactaccttcttaaacatggatcttgaaattcaacttgccttttcccttcctctcaactaaattttttttcaaaacctgaatttgaaagaaagactccacttaaccgtttttaaattttaaggcagaaataacacataagcatactggagtaaaagtgtgtattctatatcctgtgtgcactccacaactatatttagtaatgttgactcctcacatttcctaagttcttttaaaactgtacaaaatatttatttttacattgctttctgaaagctgatatgttatttagggatcttaataaataagaacaaggctagattaattcaaagaaatttaaggtatttagattaaggtttacactttctgtggataaggagtttgagcagggattagttgggtcctctattagggtcccacaaggctacagtagtggtgttggccaggccacggtgttatctgaggttcgtcacccaaactcatgtgatcattgacagaattcatttcctggtatctgcagaactcatggaggcttcaatttcaagctcaaaaggaccatacctttctgatgctttaccttctcctaaagggtcctctgattggggactgggtcagaataagttatttctaaaagattattaactcaaagacaaccaattatcaagctaagcacacgatatcccattaaattcacagtttctgtccacagctcaaagggaggagaatatacaaggcatatacaccagggagtggaatcttagaggccctcttagaattctgcctcttatagtaacaaatatatacattatcattaagaggtagataactaatagatactattaataaaaatgattcatgcataatgtaaaattacacaaatattaatgtttccattaaactcctaatatgtataatattctgatctagaaaataatatattctcacttcttattttgcctttccaatttatttcttcttattttatttcatttgattcctgattgtcctgcttctgtagaaaggtttcaaatgtggccattctatgtagtctattgtttagaatttttaatctgttttataataaagaaaataccttgctttttaggcttatttctctatacataaatcttcaccttatgattttgttgattttttctctatgggattctctccccatttcagctcatttgttctgatagcatcatattaaaatgcagttcttgcatcaaatagtaccgcctccaagatagaatcctggattcctgtagttatctataataactgtattttagtatgtttactgcaattgaccataatagaagtgtgattaattttattcatatttttatatatttatacttagacgtttgtttccattgcatcccttactagataataaaaatgttgtgaatagaaatcagacatagtgtgatcatgtcattttcttcaggcttagtaagagttaaattgtttcacttttcactgtagttgatattaattggtttatatatttgttttgtgagttaacgcatataattaggccaagttaaaaggaatcatatgtcagttgtattcatatttaaatatgctgtgaaattttctagcctgtcagaaaaagattataccagtattactatatcaataatacacaaaaaagtctatatagttttccttttgatagaacaaaacttattctgaaagaataaataaaatgttcaatctaaagatattatcccaaccttcaaacttcagtgggaatacatgacacaactattttagaaggaaaactatagagcattgtatcagtatgtggtatcttatatgccttatagcacacaaatgttacccaattgagatattcattaggcattagatacctgtctctaaatctagctatcatagagatgtttcgcatggagggacactcagaaaacatttatgaataagagtagattcggctactgaatttagataaatgcaacccagttggatgtgtactttagtaatcagtggcatattagagtcattgaccttaaaatactgaactcatgttttaaattattttactccttacttgggtgacataggattcatattgattactgtaatttggattacagaagaaaaagtgctatttattcacatagaatatcaattttaaaatgtgaggccaggcgcggtggctcatgcctgtaatcccagcactttgggaggccaaggccggtggatcacgaggtcaggagatttgagaccatcctggctaacacggtgaaaccccgtctccactaaaaatacaaaaaattagccgggcgtggtggcgggcacctgtagtcccagctactcgggaggctgaggcaggagaatggtgtgaacccaggaggcggagcttgcagtgagccaagattgcgccactgcactccagactgggcgacagaacaagactccatctcaaataaataaataaataaataaataaataaataaataaataaataaataaaatgtgatttcagtaagctgtaattacaaaagatcgcaaggaatctgccattctgagtcaaaaattttactgcccttctcgagtcatgcccaatcttcttgtcttaaacatgtgagaagaatatttgtgaacaactatcagctactacttcatggtgattgcttaaacgtattcatacacgtataaatagatacatatgatataaatattttagctctttttgctttctaaggctgacatctgacagtgaggccattgatcttcagttgctagaaaagaaaaattttaggctagtctaccacttgagtgatttgcttttaaaactatgagaatacatagaagtcaaatcaataattaagcagtacaacaataaacttcatgttagtattatgatgaacatcatatttttatgtgaaaagctacacacataacaatgaaggcaaatattatcaaatttattaatatgcattgaatagcgctagagtgtacagaaggcagatcgacctttatctcattacattaatgagatgagaaaaatttgaaactcagaagattgccatcagttgatattctttttttgttgttgtttctttgagaccaagttttgctcttgttgcccaggctggagtgcaatagcgtgatcttggctcactgcaacctccccttccaggttcaagcaattctcctgcctcagcctcctgagtagctgggtttacaggcgcccgccaccatgcctggctaattttcttttcttttcttttttttttttttttttttgtagagatagagttttaccatgttgatcaggctggtctcgaactcctgacctcaggtgatccactcgcctcagcctcccaaattgctggaattacaggcgtgagccaccgcgcccagcccagttcatattcttaacaagcaaatgaaaaaagctgtcaaatgacaaaattactgaaaaaaatgaagctctgttgcctttatttaatgattgggctatttggttgcaaacactttattctactctctttcttgtgatatatgactgctaacatgtaaattcagtagatctttttagtatgtgaaccagaggttgaaggcacagtgctttagtcctttgaagccttgatatccttataagatcagttggatttattcaaatctcagttggttgctttgagagaataaaatgatcccaggggtagaagatatccatttgctaatgtctaggctacctggtatttaaaaactgaaacacatttttttttttctaaaatgtaagttcttatatgattggtatattttatttttgtgtgtattaattaataagccaaacctcttaaggatatttctataataccatttcatatgaagaaagttatttcctgttcattcactaaatacatatatggatgaacaggatataatatataattatatatattatatatttaaaataatactttaatatatgtagaaacaggctttatatatattatatatttaaaattatatatacagcttatttctgttatcctcaaaataaaaccactcacgtggcatgaaaaggagtcttaatatcttaaagggagatatacttggcctcttaaatatgattagcacatttattatagaaactttctcacagatatcagatactcaaatttttcctgactttttacactctttcttaatatatctcttttatttaccttattttcactttgattttcttttaaatgatagctgtagacatgccaataacaaatattttaattgcgtgttcaataaaatgtaatttaaaattgctgagtttatttacaaataaaataccttaagacttaaaacaacaacaaaaaaataaactatttagttccacatgaagtttttgtttatctcaaggtaaaattttagtttatagaaaagttttagagagaaactattgggaacattggtggaatactaaaaagatcattattattttttaatggtggaaagcataatctaaatttcttgttgataattcagtaggacagggtatttggagaacggggtatatttcatcacttaaaagacaagataatcacagaaagcagccatcagttttagcctttctcatgaacaaagacagaaaatgagtaaacattaatgtgttggaactaccaatgaaaagaaacttaggcagtataagataaacttattagatttatgacatatgcaactccatttttaaagcagagaaattccacattaaaacaaaattcttataattttctgttgcttccctccaagccacttcattctccctagtgtaaaaaggtcagtcttagaatagcttatgtatttttgcttccaaatgcaacagaaacttgtagacagaatatatggctccctatatagtagtatttgagaaaccaaataccataaaaaggctatcttttgcagacataatccccttaatgtttgtgtgtggagttattccttttggataatacgtactctgttaaaataaaatgttataccagtctcttatcagacaccagcatattagctggattaattacctaagaagggtcagagtggtgagggccagggcatagcattggtgtattttgacagggaagttaaaaaaagtcactggcctctgacttagaattaaatgaaatacagcaacccaataatgaattctgagtatccagggaacaataatactctaaagcaaactcagagatcacaaaggggcatgacaggaatacacccaacggtacacaggcactggaagaaccttgtactacatttatactttagtcttaggtgtgcccaaaagtataacatacagttctttgatacaagtcccagaaacctacttttgctcacttcatgaaaaaaagaaaaaaaactggttattggaaggatatgaagaggcacacagaaatgaaaagctaaacagcactcaagtcaggcaaaagatgggaatcttagagaactgagatagaagcagggctagcctcataattgaagggtccagtgcaaaatgaaaatgtagtactacttgttcagaaatcactgaaaatttcaagatggtgacagaagaatatattaccaaatgtagtatcctttcaagaggtgggcatctcacaagttcatgaatctgaccatgggtggcaggaattaatggataagctccatagtataaatcagctactatggttttctgtcttcgtcctttgttgctactaaagattcacacttctgggaaccataatctagggatttagaatggtgaattctttccagaaggttttcagtttactttgcctaaattcatcagaagaatcactatctatggcagctatagccacaggggaagagagcatgggaccctgtttagcaagactgcatgcaatcatggagaagagtaaggagtttctcgaaggaacataaaggaactgttaacaaaggacgtgatttcttcctgtgcaggaaaaaacaaacagacattcacatggaaataaaaaaataaaaatcctttcttacactcctgtgaccagcttctaagaagttggctctaagaacatgaatagtttatttaacagtgctcctgtaacatctccattggatcacagatactcaggtttaaatactggcatatctcattttattgcaccttgctttacacagtgcttcccacatactacattttttacaaattgaaggtttttggtaatcgtctgtcaagcaagtccatcggtgctagttttccaacaacctgtgctcactgtgtctctgtgccacaatttggtattcacacaagatttcaaactttttcattattatattagttatggtgatctatgatcagcaatctttgatgttactattgtaattgttttgaggtgccatggactgtgcccatatagaaatcaaactcagtggataaatgtgtgtgttctgactggctattcccctatatctctccctgtcctcaggcctccctattccctaagacacaacaatattgaaattagatcaattctacaatgccctgtagatgttcaagtgaagagtcacatttctctaaatttacgtgaaaagctgtaaatgattaagcttggtgagcaaaacatgtcaaaagctaggcatcttttgacaaacagccacgttgtggatgcaaaggaaaagttcttgaaagatattaaaagtgctacttcagtgagcacaggaattataagaaaataaaacagccttgttgctgatatggagaaagttttagtggtctggataaatcaaatcagtcattacagtcccttatgccaaagcctaatccagagaaaagccctaactctctttgattttatgaaggctgagagaggtgaaaaagctgctgaagaaaagctggaaactagcaggggttggttcatgagatttaaggagagaagctatctccataaaataaaagtgtaaggtaaagcagcaagcactaatgtagaagcacagaaagttatccagaaaatctcactgagaccattgatgaaggtggctacactggcaaacagattttcaaggtagacaaaacagacagaagatgccatctgggactttcatagctagagagaagtcaatgcctgacttcaaagcttccaaggacaggctgactctcttgatagggactaaagcagctcttgactttaagttgaagccaagttttatttcccattctgaaaattgtagggcccttaagaattatgtctgtgctcaattaatgaagcaacgaagcatagatgacaacacatctgattacaacatggaacactgaatattttaagcccactgttgaaacctactgctcagaaaaaaacaagatttctttaaaaatattactggtcattgacaatgcacctggtcaaccaagcattctgatggagaggtatgaggagattaaagttgttttcatgccgtctaacagaacatccattctgtagctcatggatcgttgaggaattttgatgctcaagtcttcatatttaagaaatacacgttgtaaggctagagttgccagagagagtggttcttctgtttgatctgggtaaaatacattaaaaatcttctggaaagaaccattctagataccattaagaacatttgtaattcatgggaggaggacaaaatatcaacatcaacacaaatttggaagaagttgattccagccctcatggatgacttcaaggggttcaagactacaaagaccagtgtaggaagtaacttcagatgtggtggaaacaccaagagaactagaattagaagtggaccctgaatatgtaactgaattgctgtaatcccataacggttgcttcttgtagatgagcacagaaagtgttgttttttttttttctttttttgagatagattctactcttagtgaatatgctgtgaatattgttgaaattacaacaaaaaatttagaatattacctaaacttagtggataaagctggggcagggtttgagaggattgatacgaagtttgaaagaagtttaactctgggtaaaatgctaccaaatggaattgcatgctacagagaaatcttttgtgaaagggagtgactagatgcagcaaacttcattgttgccctatttcaggaaattgccacagccactccacccttcagcaaccaccaccctgatcagtcagcagtcataaatatggaggtaagacctctcactagcaaaagattaggactcattgaaagctcaggtgattgttagaattttttagcaataaattatttttaaattaaggcgtgtacattgttttttagacataatgctattgcacgcttaataaaatacagtatagtatacacaaacttttatatgtgctaggaaagcaaaaaaattgtgtgacttcctttattgaaatatttgcttattgcagtggcatggaacctaacccatgatatctctgaggtatgcctgtataccaaaattattaatttcaatgattctaggaaacttttttttaataaagtagtttttggttaaaatttccagtatgttacactcttctaacaaactgtcgaagaataagagaaaaaatgttttagactgggtgtagtggctcacacctgtaatcctagcactttgaaaggccaaggtgggaggatcacttgatgtcaggggagttcaagaccagcctggccaacagagtgaaactccatctctaccaaaaatataaaaaaattagtcgggtgtggtagcacacgcctctaatcccagatacttgggaggctgagtcaggagaattgcttgaacctgggaggcggaggttgcagtgagccaagaacaggccactgaactccagcctgggccacagagtgtggctctgtctcacacacacacacacacacacacacacacacacacacacacacacacacacacacaaataaaataaaataaaagggagagagagaaaaaatgttttaggttaaatacaaataaaagagcttataggaattactctgaggtgaaactagcttatatcctctaatcagtatgtattcatggcttttagagtttggcttaagaagcttatcgaggatttcgccaagtggctgtctctgaagggagtggaaatgttaggactcacactctggagccagactctgggtttaaagttctgttttgctgtgtgtatcctgttcagtctctacacctaggaaaatgttaatataagaattgattattaaaatatctctaaaggtgacataatttaaaatacaattattacacataaaacaatttattcttttcagaacagtttattcttttcagacatatgtttcatatgtatgaaacaatacatataaaacaacgtagtacgattatttggtggaggtatgtcttaggaatggaacttgattttattggggggaattatttttttttctgttatcctttctaaatgggcagttatctctgaagaggaaagagcaaaatggagcttttattctctcacctcttctttggttgtattaagaagagggctgagtttttattctcatctctgtttcaaagacaattcaatgttgataccaatctgtgtttctgctgcttgtgtaaaagaaaaaccatcctatgccaccagcaaccactgttatctggttttaaatgtcaagtatacttcagcatagaaataaagaaactgagataacagtcaaagaaaaatatattgaagcacaaagataagagtccaaccatcttagtgtctgtgtctttgagaaaggagttaggaaaagattcatcaacagaaacctaaaacattttgcagcttctaacttatctaaccttatgatttatagccatgtatcatgtttatacatatgattgtagtatttgtctatgttggtgctatactgatgaataatggaaagtaattcagctactttaaactgaatcgtttaaattagttcagcgatgacattctgtcttcatgttatcccttctgaggtctagcctgagattttcttactaatctcaaggatttttttgtttgttccttgcaacagatgttcatactttgacagttctattgtatataattatgtataaaccatattatgtttttcattccttatttgaaagtaatctagatgatttttgtgtgtgtggctgtgagtgggtatgtcaaggcattttggaatccttgacttggtgtaatatggaaaatctgtttctagttgaaattgaatacatatatcacaagtccttttgttacttttagaatggaatgtatgaaatctgattgggaagattaatgtaggttttattaatctttctcaaattgataaagttctgtcaccctaaagatttattcaaagttgtaatctcaaagtcataagcaccaagtctttacctttgaaaagtattggaagctttagtttcctagccactatggattatgccaatacttttaggtattacctttatgccaaattacaggacaacaattttctttttagaaacattattttctagactataattttttggctaacacttatagctcttagattgccacatcttgaatattataacacaaattatcagaagcaaatatacatacagtaatatttttaataatgtttttcataaatcatatctaaattcccattttgtgcattcttcaaatggctataaaaattttgcatactagctcttaaagcaataatattaggttctaactattttatgtgataatgaaataggctcgattttattttagtagtttggtcctgtaagattaatcaaatttattacatgatatggatgtgaagtaagcaaggcactggtatttttgtggctcattattctgatattaaagggaagggaagaaggtaggtaacaagtggcatttaaaataaatgtattttcataataaatgatgattctcatcttattctgttacactgcaagtataaaactcttattgttgataagaagttcataataagtaaatcactttagacctggagtttgtgacttaaaaaaagcctttatttcaaaaagcaaaaataaaatgaataatgaattatcttatatatttcttccactaaacatatttcaaatgaaatatagtatgtaagttaaaaagccaaaaatacttaacccataactgtaagatctacattataggtaactacaaaataaaaatactcattatctataatatatttataaaatgttgttttcaaccaaatgttaaatagaatatttaatatagtaaaaattatttccctttttagaggtttttcatctttataaatgtatttgacagtaaatatagtaaaaactacaatggaactgaacttctagcaaattttgaaagctcttcagtatcatcgtgaaataattattcctcagatgagattttgttaaactcattactcttcttctgtaatttaaaatttcccaaataaaattactcttccatatagtggtgaatgagagggtgggaaaatattcctgatccccgcaagagaaaaatgtgcagtttggaaaatgtataaaataaaagtgttccaacacagcagatgatttatgttgtttatatgatgaattgcatgaagggctaaggagaaataattttagattaaaaaaaatttgtttgatacctcttagacataggaagacccgccaacctgtgatattttgtaagttacgaacaacttctataaatattagggggcagtaaataagagtttgatttatttccatctatatgaaatgtctttgatgattttgtgctctcaactttctgtcagttttagtgctctgggaaagaaacccaatgtattattacttcaataatagcatgattacaggcatacaatacctccaattaaataattaattagaaaatgagaaatatgtatgtgtgtgtaaacagatttggtgtgtatctttatgtgtatagaatttttaaacaataatttggattttttttgttcaacctgattgtactttcatctctacattcattaattctgattcttttcataagtgaaatgctccttaacctggatctcaagtcacatgtgaatatgaaagtagaaaatgggagagaaaaatactcatgacattaatggcatggagaaaaggtactgaacatacacagtcacgtcaaccttctctttttaagactaagccagaacttgcggagtttgtatgatcagttttatgctcataggatactttctctaaaattttggacaaagttaaaaataagcaccaaaataggtgtaaaaataaaattaataaaattttggacaaggaaactaattttagtgaatagtgggagtcgttactatttaatctaattccctaagactgtaacttaataatatttcactattctagcttcagtgaaaatagaatagataaatacaagtgtatttaaaaatgtaaccctattaagagatgatacaatatggtaaaagaacactggactagaagtcaggaaaccagaatttcacagtctctgtgtgacagttagaaaattaatttaggcttgagctttcctatatattaaatggagatattatacatgatggactattattctttttctatactaaatttgattagtctatttatatgagtattacatagaattgtgcaaggttttgtggatacattgatgaacaagaaacacaagtactgtccctgttacctccttgaatcatcgtagtttcaaatatagaaataaatagttacacagttaattatgatatttcacccttacttctagatttaatgtctttcttactggaatatatcctttagccattatcccagttagaatgccttccccttcaagtaaaagacaaacctaacacaaagattattaaacagtaaaaacaaaaaacccaaaaacataatcttgtctaacaagaagaggtagggaatccccaagttggttagttacaagaaacaatgacctcttttcttttctttctttcttttattttttttaaacggagtctcacacactctgttgcccaggctggagtgcagtggcgcgatctcagctcactgcaacctccacctcctgggttcaagccattctcctgcctcagcctcctgagtatctgacattatggtcgtgcatcaacactgctggctaattttgtatttttatttttagtagggagggggtttcaccatgttgtccaggctggtcttgaacgtctgacctcaagtgatctgcccacctcggcctccgaaactgtcaagagtacaggtgtgagccaccctgcccggccaccagtgttttttacagctgactctcctctcttttgtgggatacaccaatcattccaggcaatatatcaagacaaaacaacatccaaaggaaaatagctataatttttctgtgttttttttcttttttgccagggaggaaatgttttcctgaagccctcctacctcactctttgtcttatttatctgagtcataggagaaccagcctttaaacaaattaagaagttttgtttttgaaagaagcaggaaggaggtataaaatgaatagtgggtaggcagccaacaatgtctgcacataatatttttttcctttcagaaatgttatcaattggtttccaagtttctgggttttttttttttcatctttataatgtccttttctctgctgagacttgccatttgtttttttgttattaccatttttaatagaccttgaacatatttataatgctgattaaaattcttgtcagctaatttcaatatatgggtcatctcatttttagtgtctgtctgtaaattgtttttctgcttctttgcatgcctacttattggaatatttgacacacatgaatggatgacatgtttttcagagtctgtattttattgtcttcctttagagaaagtatagaattattccagcaggtagttaatttactagtaggatcaagtgaatttttgagcctttttaaagtttggaactctatgtctatcagcactacgagtctcctttgtctgtggcagatcttctcctttatctgcataggcgtaaaaattgctgcagcctctgtttttagaaacctcatgcaagttcaataccctgacactaccacagtggcaatttgtataattatttctattttgctttctttcatatggcacctggaagttcatctggcttttccttttgtactgtaatatgttttaaaataaatgtggttgtaagttatttagcatttctttgtatttggaacatgaggtggagtgtagatcagctcattcaaatgtgttcttagaggtcccctcaaattagttttttaaaatgcatctgtgataagcattaaaaatgaagtcttaccatataaaagaggtacctgtgtattttttaagagtggggtactagctgcagaggtttctctggcgacctgatgtttgtttgtttgttttagttatactttaagttctagggtacatgtgcacaacgtgcaggtttgttacatatgtatacatgtgccatgttggtgtgctgcacccattaactccttatttacattaggtatatctcctaatactatcccttcccctgccccaacccctcgacaggccccggtgcgtgatgttccctttcctgtgtccaagtgttctcattattcaattcccacctatgagtgagaacatgcggtgtttgtttttttgtccttgcgatagtttgctgaaaatgatggtttccagcttcatccatgtcactacaaaggacatgaactgtcctttgtatggctgcatagtattccatggtgtatatgtgccacattttcttaatccagtctatcgttgatggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgtccctatttctccacatcctctccagcacctgttgtttcctgactttttaatgatcaccattctaactggtgtgagatggtattttgctgatgttttataagggaagatctgaagatgggtaaaggattttttttttttttttttttttgagacggagcctccctctttcgcccaggccagagtgcagtggcgcaatctcggcttactgcaagcttcgccccccaggttcacgccattctcctgcctcagcctccagagtagctgggactacaggcacccgccaccactcccggctaattattttttttttgtatttttagtagagacagggtttcagcgtgttaacctggatggtctcgatctcctgacctcatgatcccccaacctcggcctcccaaagtgctgggattacaggcgtgagccactgtgcccggccaggatggcaggattttttttttatggagatagaacatcatatgcaaaggccctgaggcaggatggaacttggcacatttcagcgcctgaatgaaggccaatgtgtttggaactcaaagagcaaagaggcagctgttaagagatgaggttttgtgagagagacagtttctagaccatgaaacaaccttgttggctatgttaagatatttgaattctatcttgcttttccccatatcacaggtagtggtgaaataacttgtcacatgtagatttttatctaaatgtaaattttatctaaatgtactgttaagttcttataaccactacacttactatagagggaaatgctgattgcatctcttctggaaatacgatgaaacattcagttacagaataatttgagatacaagtgttttcctaaaataacactctcagacagacaatatatttggaaaggaaaaatgaaaaatataagttattcataatcaacagcctttttgtaggtaggtccttaaacagatagtttctgttaggttctgggaatgctagttcattaatatagatttatgtcattgtgctggtcttagaattattcaagctaggattaaactcaccgtaaataacctgaacctttttaaaatgaagttgaaacaacagtaagtatcctaagctaaggtttttaaaagttattattttctgcagctctacttaatgaagctttggaaggcagttgtgtgcatatgcttatttattatgccaggtaaataggggttacttacttttctgttctttggaaatttggttcagaaatcacagttacattataaagtgtaaatcattgagatgcttttggccatagacattccctataatgaaagatgtcattgcactaaataaggaaaggttcctatgacagataatgggatcaatgctatgcaactgacatgatcttgtattttgatagtcatttgggccattttattaagaagttttcaaatgatttgaagagcacttgtgggcagaggaaattctaactacccaatgatactacttagttatagctaagtgagaaaaaaaatcataaaaatattcttactttctctctcaggtaaggaaaacctttcagtttccctgtagtttgtgtcaagatatatgttttcccattaaacttgtctgccatactgacgagagaattacagcagaacttttgaactagtttgataagaaattcctttcacacaaaggatcccagggagaaaagtgcaaagccagttcaccatcgtagtttaacttaaatgtgttaagtatcagttgaaagtctcaaatcctctactcattcgaaaatccacttaatataacatttatgggatttgctattaatcttatccaaaacctgtgttattttggtacttatggacttagaaaagtctgtatgtctcaaactttaaatgttactaaatcttaaattataaaaacttggttagcactcataagcaacgaggcatgtgtaaatattactaacaatttcactgaagattcatgaagttgacacagagaggatgaactgtatataaatgtgttcagcggagattacattgtctttgttttttgtttggagtagttatggtgattaatgaaccactgtatccagcttcagtatcatactctttctttttttgccaagttaaaggactatctttggtgatataaagcacatttgttcaatttcttgaaactataataattcagagttggcagacagagttatatatccccaagtgaacgaattgtattatccagtgaaccctgctaaatgcaagaacagaagagcacctgaatctttttctcccctcaccagccttaatatgttgtctgtgctagaggaaaatatggcttcgtattagagatttttcttcattttcttgtcaaccacaaggataattttaggtgaatttacccagagacacttgggtatttttctgcccaataatggctattgatcaaaacattaatattcaatacattgaacaactgtaaaccatgggcaccaaccaatcagaaagacaatggcaatcagcataaaacaggatggctgtgccggcctttgcagctgagtggcaaccccatttaacagatctttcactaactgtttcaacctaattaagaatggttttgattaccatagccttgtagcagatctattttttcatgtagagataaaatgttttgagataaattgatttgtttctcatatgtgaaagaatattagttttttttggtatcaactactaaaaagttaataattgtggtgaacctcttaaagtcagtgacagaatcctattaatctctgcaacttcagccatcactgctctgctggacacaatgtggatgttttcaataattttggaaaaaaatgccatcatcttttccttttgggattaaaaatatattcaaattattgaagtatgaaaaaatgactaattttattttcaaaatgcatttctgtacatggctcatcttagctatttgaaaatggcaaagatattcaaatttgtgaatgttaaattataatctccagagcctcagtaaattccctgaaatacagtgttagaacttcacacgaatatgattcctgaaagttgtgtcagtcctcatgggtgtttagatccatgactgaccaaataattttaaagagccagcacgctaactaacaggaattatagaaatataatttaaattttattgtaattgtggcaggaaacttagagccatggacaggagccccgcaattcataacaattcacaatacagaaaaatttttctgtatgagttgtatgcgtcgatgattacaacaaattgtgttttatttattcacccattattgtatttatctattcaatttcaattatacaactatttactgagtcagcctaatatatgccaaatagcaggcaagttcacaacttaaaaatgatacacttcaaaaattcgattataactaaagtactactctaatttaatatatacctaccgtgacttctaatttttatacttgattttattcttattggtcttagagaaaatagccatagaaagcattaacactaaacggaaggctttaagaatgactgtatagttcgttgcaattagacataatataattaaattgaatcaatcgtatcagataaaatatacactttaaagtgaaaatgttaatgattcttagtataactgtaagtatactgttttgttcatttgcatgcttgttttccacacaaaatgcagcactgttgtggtttagagctaagtatgtattgccagcattcaaacctcagcaatgtcttttgttagctgtgtgaccatcagcaagttacttaacctctcttgactcaaatcaccccactgggaaatggatattataatagtactaaccttaaagaattgttgtgagaattaaatgatttaacacctataaggacattacatgactgcctgaggttcaataagaactatataaatattagctattattatatgcatgcacattatgtagttagtagggggcaaaatcctaggttatttcattttacatccatttctcactaactctttaactccaagaaaagttacttatctgtactttatttcatctacctcttgaagttgttcaaagtttgaatgaattaacacacatggagtggttagcacagtacttggccaatagtcaaccctcaaaaaatgttagccataattttttattccttatttcattatagatataaaatggaggtagtaattattatcttatcccttcacaggacaattgaaccactgaacatatctgtgaagataagtaaacagttgaatattattcaaaaatgtgtttactaattatctagtaatttataaattcagttattctgtttgtgaataatgagatgtgaataaaattaattaaaatatattttcttatctgtattattgcctgaccttggtggcaagcgccagagcatctgtttgttttttctctatttaggttgctaaagtatcttgtcatataattcagaaaattatatgatataaaaatatattatgtaagaaaataatataattcagaaatatatgtatagtattgaaattaagcagaagccctaaactgtttttataaatattctgaagtatgttacaatattaattatcattattggataggtcttttggttttaaaaatggaaacaatttttttaatggaaagattatatcctaaaacagtaattttcattgaatcttaccactaaatgtatatttgaaccatttcataatttctactggaatgtgtgaaaattttaaaaaactactatcatgaggatggaagcagtggtgcacgcctgtaatcccagcactttgagaggccaaggcaggcggatcacgaggtcaggagattgagaccatcctggctaacatagtgaaaccccatctctactaagaatacaagatcacgccactgcactccagcctgggggacagagtgagactccatctcaaaaaataaataaataaataaactaatatcatgaaatgaggacacaagaaatactttctaggatactagaaacattgattaacaacttgggaaatactgctctaagcatgctgcactgtaatttttgttctttttttttttcttgttaggaatctttccctgaaattaacaaaggacgttgatcaagaagccaggtgttcccacatcagccgaatgcccaacagtccatctgcggattggcctctacaaggtgtggaagaaaacggaggcatagattctctgccattcagactgatgttacaggactgcacggcagtcaagacgttattattaaagatgaagagagttcttcaagaggtaatggtttcctctaagattaatgtccttcagtgctggtagacaatgaagtctgcagacgtggttagaccctgctctgtcagtaattaactacatgacattgggcaggggtcaggtttcctcttggagcttagctattttcatatgtcaaatgagtgttttgaagttctggtttataaggtactctttagccttaaaattgtaagagtttacgaaatacttaaaaaagaataaattgatcccaagcatccccctatttgtcaggtaaggagaaatgagtatcagctatatagttatggttacatgctattataaagctattgagaaatctattaaatgtatttcacatcaatgatactgggtctttgtttatatgataccataaaagtagtttatttagtcatttttgttccaataatcagaattcagtaaaattgaattacagtaaaattcaatctgaaggtctgaatgattttgcctaaggaatgtagttgccctccccacagcttgggcctagttactgaaacagtgagctagtcaggaaaatgcataatgagattcttttacccttgtgcccagaaatcagccattctttaggactcaagtttgctttggtttgatttttataattacaacagttgttttatttgagggatttctatacaaagtatacccgtgattattattacttcatagacatgtgaagtgagagttagaaattttaaattatttttctcaagtaagtgtaatttcagggcaacagcctgaaatttgtgtctttgtattacatcctattatatttaagtagatttatctttattgattggagatattaataaagaattgagaaaaatattattatttagaattaatggtccctatgttataatgattgctaatatttgctttttgaacactttgataataatgctagcagctaccactggaggctagaattgaatcaggaagaaaaaaggcagtataaaagaaatgaatgccatagactattggggcttccagtaatgtgttctcatcagctgttataaactgtattagtctgttcttacactgctaataaagacatacctgaggctaggtaatttataaaggaaagagatttagttgactcacagttccatatggctggggaggcctgacaatcacagcagaaggcgatgaaggagcaaagtcacgtcttacacggcggcaggcaagagagcttgtgcagggaaactcttatttatgaaaccatcagatctcatgagacttattcactaccatgagaactgtatgtggggaactgcccccatgattcagttatctccacctgcctcccccacccttgacacatagggattattatgattaaagctgagatttgggtggggacacagccaaaccatatcataaacaaaagctggaagataccttctctgtgtcccatacaggttatatctctagggcagcctttgtttctggatattctggatcctataatgtgttgtgctgtagcggtatgcttatacttgattactcttagaatttcagaaattatatgagctggcagttcagcaaaggcatcaaaataaattatatgaacttaaatcaattactttcaaaaagggtaatcagtattcaaaatgtgttttctatttgttttactattatctacacttgtgagattatttacatcttttagaatcacatggtggaagtactatataattctgactgtacagatttccaacatgtagattcatttatgtcattttggtagcttgaaatcagccatgtgggagtatttatgcctcagaaattggcaaacactgcaaattagggcctcttatttttggcaagcctgttgttaaatattgactagcacattactatgtgtataactgtatgattctatactgacaacataaatatttgcctgcaaatgaatagataagtttgaatttcttccacctttggcttaacatgcaacctgatcctctttgaacaagacaaacttagtaacagctgttatattagaagatactagtctcaactattcagctttttacctctgtttggtctgaattttaataacaaatcagttaaagcaaaagataagtagaaagagctgacagaaggtgtcaagaggctttcttagagtacttaattttataattttaaaatattcagtgatattcactataaagtcaatattcagaatatatttagatggtttctatactgccacctggttttctttattaaggggtattcgaagaagctgaagagaattgattttttaaagctgatgtagagtgaacaatacttaatatatgtttgtgcagcccattcagtgagcagagggtctttattatcaacagggaaaagcaatagtattatatgattagcatagacaacagttctactaagaagatattcataatagaggcctctaaagaaaattgttttttgaaatgttccctaagccaggaagttttaaacttccattcccatttcattactaaattggagtttaatatcaatattcatttagattaacaatatattttaatataaaaaattcattcctattttgagctgatttttatgatgcacaatcgttcaatctttgttcacagattattattattattattattattattattattattattatttgagatggagtctcgctctgtcacccaggctggagtgcagtggcgcgatctcagctcactgcaagctccgcctcccgggttcacgccattctcctgcctcagcctcccgagtagctgggacaacaggcacctgccaccatgcccggctaattttatgtatttttagtagagacggggtttcactgcgttggccaggatggtcttgatctcatgacctcgtgatccgcccgcctaggcctcccaaagtgctgggactacaggcatgagccgccgcacctggccaagttcacagattattttttaatggcaggaggtacctatttgattttaaggtaaaataattacttaatttttacatgtcatattagaatatgcttttatttgagatttttggtttgttacatgagtattgcatttgtatattttttctcattgatctctttgaaacctatgacttagtggaaatgcaatgcattcatgatatttttacacttttgctaataaaggtacacctttcttgtgagcaaatcaagttatcctttgttgtttttgagggaacatcttctacaaatagcatttgaaaatatccagagatagtaatagtgagatcacagaaaatttttggcttaatctgtttaagattgctctagggttgtggttaatgactagcggctagaaggatgcctcgacagagtgttaatagatgactttcctaaagtttctagaactgtttcagggttgtggagtaataaaaataattccttggaaagttctacacagcaggctaaataaatatacaggtcgagcatccctaatctgaaaatccaaaatccaaaatgctccaaaatttaaagctttttgagcactgacgtgacaccacaagtggaaaattccacatataagtactttaaaccacttgttttatacataaaattattaaaaatattgtataaaattacctttgggctatgtctataaagtatatatgaaacataaatgactttcatgtttagagttgggtcccgttcccaagacatctcataaggtatatgcaaatattctaaagtctgaaaaaattcaaaaaacacttctggtcccaagccttttagagaaggggtactcgacctgtactctatctttcaagtactcttatctatatagtccatattacttatggcattttaatgaatataagcattaacgctgagatctacttgtaatattttaaagctacctataaaatttacttctttctaaatttttttgtgaggtatcacatgtttaatattattttgcaatttttattactggctaaacaaccttagattgctattaaaatgttaaatcccattagctcattccagatttttttaaaagttattttgtcattaactgtaattgcattacttattattctacctactttgggtttaataaaaattttcatcaagtaattcatttggcacttagtaattcttccattttgtgccatcaccataacaacataaatcatattaatctaatccaggtttggggattatatatgttatgctattttataatatataatatatactttcaataaaatataattttgaaagtgaatacacctgcaaaagtgaatctaacattgtgtttgtatctgaatcatcttgggtaggaaccagagatggagatgagtaatgggtaggcattgctctaaatattctgcttcagtaaacctgtctttggcccaagcatgtgaatggtgaggactttctcagtgtctcttccaagtatactggaaaagcactgggttaggatattgtgttttagactgttggtattaaacatcctgaaaccttcctctacttaggagattcttgctcctgaatacttttcagatctgcttatatgcatctcttcttccaactgctcctacatcaatgatggtccattttactgaagttacttcacaactggtcttacttctagtcttcccacctatcaaatcaatttactcattgctgtcaggctaaaatgattatgtgatcaagtcagtccctgtatatctttaaatgtttcctaattgcccttacaagttcttctacaggttgtataacagtctatatttcctctatcattggagcacttatgtctcctcattttaattgctaatcttccttttcccagtgatattctaagatgcaggaaaatgatcttgtgaacttgtaccttgttatatcttctcaacctggaaggtatttgctgcttaataagtgtttattaataaataaatgaaaggaaatggatttcattctgtttccaggctaccattaaaataactgttggcagaaaacaaatgataaacttgagtgcttgatggaatgaggatcaaagtaagtatgtagtaaatttctcctctttaaaagaagtgtacaatatgtttttttctcagaatatgaaataaagacacatcacaaaaattactagatttaatttaatcaagacccatttgtatgcccaagtctatcaatggtagatataatttcctgaagctttttcagatctttctatgcagtagatggctatggtattccttaactgtatttttaaaattatctgctaaatcttccagattagaagaaaggcctagaggtttagagactggttatttccatatgtactcactcttttcacacagagaaaattttgttttcactgaacatcattgcaatttcagaggaaaaggataactataaatcattataaaaccacaaatcagttaatctaataaacataaaattattggtataaagccattattacttcttatttgtttggctgagcttaccgttttcctagtgatggtctgtcgacctcctagattttaattttgaggtgagctaagaattaataatctgaatggagtatcacactccaaattctgtcatccttttttaaagatcagtttctttttattaaaatgcacattcatattcccagcaacttcaaatttcaactcctttatttttagaaaaatgaccgatgttgggcctttagaaattctattgttgtcactttattctctagtattagtgggaaaagacatgactgtagtaagggaagagaactctatcatttttttcttctttttcttaaatttttaaaaaattttatgatctataaaagaaaatgtttaatatctacagaggtgggttttgttttaatgcttccttttagtttgctctattctctttatcaaacaaatatattttgatataataagctgtatctattctaacaaaatagccagataagtaaaaatcaaggaactacttatttgaaaatttatataatttacaggcccatatagttgatgcaaatattggggctgtgaaacatttgcaaaagacccgccattgattaaagagctggaatctatttttctttttcttttctctactacctaatagttcaaacattaatttcattttacctaaaaggaataataatttaagactttcaaggataatattcaatgcaaaatttttggttttttttcagcgtaatttgcaattacattataaaatttacagtgttttctacttcatcatttgtcactgtttggtgggaatttttaaagagtttatttttactgcatttcagtaattgattcaaagggcattaataaggattttataactaaatgacattttcctatcagcacatcttgagatggaaagaaaagtctatagggtaggaacttcagcaatggataattagagaaggaaatggccacagtggagagtcataaagtaaagaaatatccaaatcaagcaattaccatggaaatatagacagcagtctaataatcagaattctctttatacttatcatttgaaaataacaaaattacaagtttttgctaccttctttatgtttatttatttatttttgctggtccagaaatatgtttaaggaaaattagaaaaacaagtttcatgaaaacatcaaatggcagaaagttagagtgactatactagtatcagagtagatctaaatatatgacatttcaccacagtcagaaagccatacttcataatggtaaaagtcagttctttaggaagacacagcaatcaaacatgtggatggcttgtttcaccaatacacaatgcaaaaactgacagaactaagtgaagaaataaacaaattaacaatcacagttgaagaatttaaaacatttctttctgtaattgataaagcaactaaatgaaaaaatcagaaaatttctagaagacttgaacaatattatcaatatttttaacccaattgacatttatagaatactacaattaataaaataattatatattattttcaaatgcgagtggaacatcgtcaagacacactatatactgggtcacacaataagtcccattaaatttaaaaggtagacatctatggggtacattttttgagaaaaatggaatgaaactaggaatcaaaaataataaaataactataaaagcatcaaatatttggaaattaaattacaaacttctatataacccacagacgaatttagaaagctgaaaggaaatttttaaatgtttccaatgagatgatgataataatatcacaaatcaaaattttctggatatagttaaaactataattacagggaaatttgtgactttaaatgtttatattcaaataaagagtgcgataattcgtaacctttaactttcttccttgaaatgttggttaatggatacaaaaaaacagttgaatagaaaaaagttctagtattaaatagtacaattgggaaattatagtttataataatttgttatatttcaaaatagctagaagatttgtaatgttcccaacacaaagaaaagatacatgtttgaggtgatgtatatagcaattaccctgatttaatcactccacattgtatacacacattcagagatcacatgcacccaaaaatatgtgcaactatgaaatatcaataaaaaaggtagctaataaaagaagggcaaattaaatccaaacgaagcatgtagaaagacataataaagaacaaaactctataaaattaaaaacaaataataagcccaaattgattctttgaaaaagttcaaaaaaaggctgataaaaaaagattatagaaaaattaagaaacataaatactagtgccagcaatgaatctagggaggaataatcactacaaatcctgcagacatcaacatgataataagacatggttacaaagaacattatggcaaaaaattaacataaatgacaaaaacaatttttttgaaaaatacagctttccaaagtgacataagaaattgcaaatctgaatagcctaacttgtactaaattaatgtattttattatttaaaaaagaaatacatatgacagatattatgtaaaaattttcaggaaatagagacacattatgcttctcatcttgttttatgtggccaacatatgcctattaaaaaaaattggcaaaaatccttataggaaaaaggaaattacagaatttttttataaatatagatgcaaaagtcacttaaaaattagtaaatacgtgtagcaatatgtaaataatgacctatttgctttcattccagtttttttagcatccaaaaaccaagcaatacaatttactatattaaaatattaaaaagagaaaagcacaagactgtattaatagatgaaaaaagtacctttgaaaaattgaaaaccaatttatggctcaaataaaaatataaacctcagtttactggtagtacaagggaacttctatagctaatattcatacttgatggtaaaacactgaaacttctcctcctaatattatcagcaaggtaagaatatccactcaccacgtttgctgtacgtgtgctagaggtcctagctaggaatgaggcaagaaaaagtgtaacaggcataaatatttgaaagaaaaggtaaaactgcatgtatgagcagatatgtttgtttatacagataacctaagaaatctacaaaaaagttaataataaaatgacagaattagcagtaaatttaatagcattgaagaatataaagttgtcataaaattatatattgctgtgtagcaaatcagctgtaaaatctagtagactaaatcaatatttgttatttcaaagtttctatggttaggagtttgagagtagttacctatgggttatggctgaaggcgtctcattagtttgcactcaggatgtcaacaatggctgtagtcatgaattcttggctaaacttgaagatctactgcctagttcactcacttgctgtggcaggaggactcagttcttcactgctggtgctcaagaggcctcagttccttaccatgtagccttttcgctggtcaacatggcagttggcttccccctgactacacaatctgagagagagaagacaaaatgcacaatgtcttttgtaacctagtctcagaagtaatataccatcacttttgtcaaatttattggtcacaaagatcaaacttgatttagcatggaagaacaatatgtaaagtatgaataccaggaggtagggaacattgtggtccattttggaggctgtctaccagtcaatggtgtattcctctcatatgcaaagtacactcagcccctcccaaggccattcaaagtatcattcaattacagcatcaattcaaagtgcagaatctcaaaatctaaagtgtgtatagccgtagatgaggtttaaacacagcaactcaagtatagttttccattttaacctgtaaactaatacacatgttagtagttttttggttaggattcaaggcctactaaaaattcttgctctttgttctgccctctatgttctttgttctaacctctgggcaattctttcttataaaggtagcacatgttttgcagcagaatagtttcttcatccttatttgtagttgtagacattggtatccaaaggcccttttcattttactctttgtcccttaaagaccaaacttggaaagtgtttctgtgaatataactctcttaaattccttttggggttgcctgtgaaccttattcgggaatcacttccttagacaaaatacgtacccacaaatcgcttcaagataagccctactctaacttgaaataggtgcgggataactcctttaagcttttgaaattttaattgtttgactgtgaagttcgatgggccataccttaaaaccttaaacaaaaggcatcttctgtgtgagtgaactaggtactctgcagcaccacattttatcttttaggacagctctacattgattaaataaattttaagataataattttttttaatctcaaatcatgtggttgttgcacaggtttccatgtttatcaaaactcatcaaattacacattttggatggcaacacatgaaatatcattacacaactgttaagtgccagtgtcagtgctcccatttgtggagtttttagttttcccttgtgagacctgtaaaacaacaatgaccatttatcatacagactaacttagtattgtcagttcttataaattattacaagttattttccctcattgttagaataacataggttaaaaaaatttacaaggtaacatagtcttcatatacacatatggatcccattgtatactccctggagaaacctctggtttagataatgacatctcttagactgatagatttttagtaacagtattctgcctacataaataaggcctggttatgctgctgtacaacttggtcttgaaaatagatgaggagaggaggaaagtataattccatgactcttgctttgtaaacaaccctaattttcaacagtcctcttggagagattagagaaggtggagaaaaagtctttcctaaccccaaccccatttcactcacaaaattccactggaggaagtatattgcagtggtaaagattacagttgttttgaatcgtagagatctaggtgtgaatctcacttctgccattgtatagctactgtaagttgattaatgttttcttaagtttctgtttcatcatatgtaatattaataactacctcataggattatttggacaattaagcaataaaatgtgtacagaacatcacagtgtgagtttggggtaggcactcatgaacatgagccactgcagtgatcttacttgtgtgataattgccaactatgtcaagccacgtgtgaaatatttgagatttcttaaacacttaaaaatataacaattaaaaaagcatatatatattctttatatatatatacacatatatatcagtaaatgcttcttaatagcataatgtgttgtattcattgaatcaatatcaatcaatattgaatcaatatcaataaaattatcaataatttttaataaaattaaaataatttaccaataatttttaataaaagccatactatctaaaactaaaactagaaggattattgccatttatgcttttctggacatactcaattatggcagcacatttgacttgacaccactccacaaaagtactacaacatgtcaattgaatttcctgtttagagtcaacatatactgtggttgttccaggtgagaactcagggtgacagaccagaatgaaagaaattgagatagaagggaagagatgtgtagtgtttttttgaagtcttgtcaatagtacctgcttgtgaactggaatagagtggtgacagatagagaaaaatcaagcattactctgaaagttgtcacttgagttacaggcagattatattgccattttatgagccttggaagactagaagaggagtaacctgtgcaagacagaaggaaacaagagttctattttgatcaggtgaaggttgaaattcttatttcaacatgcaaatgtatgtgtcaagcagaaatttgaattaatgtgtctgtacatccagcaagatcatggctagaaatgtagattgattattcatgatcatatagattctatttaaagttatggaagagagaatttgtatttaaaaccagattaggatgtgccaatatttaatgattggaaaatcaagagaaagagtgtccagggagctaggaagaacactaagagcatagtgtctttcaaaaagccaagagaaaatattgcttcaagaaggtcagcttggggaggtgctgaaaagtaagtaggataagaaaagataagcaatcgatttggcaatcctttgaagttaattccaaaagcatagtaataagctttaggaatttcaatatataaaacaacctattctaagtgttaacttggatagtcaaagcctagaatagaaataaccatttccatctagttctcagttgttaaattgtttgttaattcctttatggcattggtctatgaatgtgaaagacatgaaaattaataatagatgtcctgagttttaaaaatagcttttaaagtaagacatgtcttagttttggaaggaaactatagattttattaggttaatcaagaatgataaacaaaaattcattttatagagtattctccatgttgaggtatcatttttcttttaaaaagtattatttatattacttaatgttattacttaatactgcagaataaatctagcatagtgatcacaggatacagttatgatatgattaggctttacgtccccacccaaatctcatcttgaattgtaatctccattatccccataatccccagatgtcaagggagagaccatgtggaggtaattgaatcatggggatgatttctcccatgctgttcttgtgatagtgagtgagttctcaggagacgtgatagtttaataagggactttttcccctttcgctctgcacttctccttcctgccaccttgtgaagaaggtgccttgcttccctttcatcttccaccatgactgtaagttttctgaggcctccccagccatgctgaattatgagtcaaacatctttcttttttaaattacccagtcctgggcagttctttatagcagtatgaaaacagactaatgcaaggtactagaacaaactgctcagatttgaatttcagctctcacaattactaggtgcatatgattttgggcagggtgcctaatctctccgtggaaatctggtctcttccaaaagtgtaatggtgcatgttcaaaactactagataattttaagttttccctggtgtttttattacattactctcccaatgaggtataatatattaatctaaaatatattttatgttaattgtattcttatgcccacaaaaaatattttgagtacaaaaatcaagtcacaggtaaatcctcatacagaatatggagttaaaaatatgcaaacttaaataatatgttgttaagtaatagatatgtatatagtaagaccataagaaaaaagatttaaagagtaagaagatgctaaacaccgtattcagggtaagattatctgttagaggtagtgggggaaggcatgtgcagttacgaaggggcacacagaggtctttctaggtattattatttacaatatattttcttacattttttcaaaataattatgtatacatgttttcttatgtatgtgaaatcttatattaaaaaactcactttccaagtgtatgtaatccgagtggttccctgtacagcaacattactccccacaaccctttttcttgtgtatccctatgcctgtaaaaatggcagaaatattttgcctactcctatgctgtcaatgtatcttctgatatttatatgatgtcaaaatgcaagtggagcaggatcaaggtgaacaaatgtatacccatatgccagagatttcttttctggtatgtgtacttatattatctgctagtcatgcataatatttgattgcttataagaaaacgaactgcaacccacagttttaacaataatgccaccttcattgtacctaactggtgtggtaatctatttgtgttattatcatattcaataattaatcaaataaccactaatgtggttttattatgcatgtctaactttcagttttcttcatgaatccagcattaatgtttcacttgtaaaacaactcacatacttttgtgtgattcgatgggctaaatccgacattaagaatttcaagctgcaacataacaggtatacagcagacggcaccctgcagaatctccaaggaatacttgagtcgtcagcgcttctgatgggttttggaaaaagacagtgagcagagaatcacttaagcaaagtggaaaagccgtaattgtgttcctctgagacacatttttactgaaattatgttttgtttttgtttgaaaatcagaatcaaaggcatatttaactacagttaaaatagctgtttttaatgagtgattctatcaaatatgatgttacaactttagataacataatgcaatttcttaaaagtagtatgaatctaataatattcacatgtttacagatgagcaaaagtgtttcagaatctagtgactcgtttagctggaatgcacttattccttaactgtatcattttaaccttgataaaattgaaaacttgtggaaattgatggactttattttagtttagatttaccagtagatagacatttactatttcaaatattgtcattttaaatatgttattttctggagaggcacagtggctcatgcctgtaatcccagcacttcagatagcctaggcaggaggattgcttgagctcaggagttcgagacaagcctgggcaacatagagatctcatctttactaaaaataaaattgttaggtggatgtagaggcacacacttgtagtctcagctacgcctgtagtcccagctactctggaggctgacatgggaggatggcttgagcccaggagtttgaggctgcaataaggtgtgattgtgccattgcaccccagcctgggcaacaaagcaagaccctgtctcaaaaataaatacatacatacatacatgcattattttctgttttttttttttttaaagtaaaagtgctcaagatatatagaggactagctattgataaaatagaaatgagtcaatttatatttaagataaatacgtgtgaacataagtagacccatttgttttgttctctttgattaaatggacttttgagcagactatgaagagtggagtgtttaaaaaaaataatgatttctcatgaaatattcacttcacttctcttgaaaacatgaatattgttttgttatgcatgatctacattaggagtcagcaaactttttctgtcaaggctagttagtaaatattttaggtttttctgactgtatattttctgtatttcaactcctcaactaagttgtagtgtgaaagcagctacattaaatgaatgaatgtgtgttgctagttcccataacactttgtttaaggaaacaggcagctgtccagattcaggatttgtcctgggcctgtcatcctatactacttcagagagaggagattaaactgtcatgggaggcattgggtccgtgacattggagcattagttttaggagcaagaatatacagtctaaatcttattccattactagttaaatgttcttaggcaggttgtttaaattctttgcctcagtaggttggggataacagtcacatatcacttaggtttgtagagaatattaaatgtgttaatatacttcaaatgcatggaacagtgttggacacatagcaaatgctcaatacgtattagatattattttatgattttcacaaagtctgagggccactagtgaaacaaagaaactggatttgccattagacaagcctgaattcaaatcttagatctacaaaaatttaagaatgtaatttaattcagttttgtttaatttctttagcagtcataggtttctttgggtgtaataaggggattaaaaaaatcatataaatgttgttgtaaaggttagatttcatttgtgtctggcaatggaaggatctaaataaatgttacttctctttcccccttaaaaagttttttttaattttagtattaattctaaatttgttgcccaggttggttttgattgctggcttgatagtacatttatgattatagttttctctagaactggtccttgattttagtatcctatttctttcatgtgccagagctgaagtttgggccttgagcctcacgtttgttgcagagattcttttgctagttcacaggatttctaaacacaggtttaatatcccttatccaaaacacttaggatcagaagtgtttcagatttcagagtttttggattttggaatatttgcgtatatgtaatgagatatcttgggaatgggacacaagtctaaacacaaaattcatttgtgtttcatatacatcctaagcacacaacctaacgataattttatacaatatttttaatagttttgttcatgaagtaaacttgtgttatgtgttcatgtgtggaatttttcacttgtggcaccatgttggcactcaaaaagttgtagattttagagaatttttgatttttggattagggttgctcaatctgtattttttttatttaatttaatttaattttacattccaggatatatgtgcagaacattcaggtttgttacatagataaacgtgtgccatggtggtttactgcatctatagacccatcacctaggtattaagctccacgtgcattggctatttatcctgatgctctccctccccaacccccaacaggccccagtgcgtgttgttcccctccctctgtccatgtgttctcattattcagctcccacttataagcgagaagacgtagtgtttgattttctgtgcctgcataagtttgctgaggataatggcttccagctccatctatgtcccttcaaaggacatgatcttggccaggtgcggtggctcacacctataatcccagcactttgggaggccgaggcaggcagatcacctgtggtcaggagttcaagaccagcctgaccaatatgatgaaaccccatctccaccgagagtacaaaaattagctggatgtcgtggcacacacctgtaatcccagatactcgggaggctaagacaagagaatcacttgaacccaggaggtggaggttgcagtgagccgagatcatgccgttgcactccagcctgggcaacaagagtaaaactccgtctaaaaaaaaaaaaaaagaaaaaaagacacgatctcattcttttgcggcatagtattccattcaacctgtacttcttatccacctttctaagtctctgatcaagttacattgtttcatagcaaattttggataggatatcagtgaattataagcatgtccaaatagatacctacgtttacctaggttttaaaatctttccaaaattttgttttgtttttaagaaatattcaaaaatgttcgatgaaacagagatgtgttgtaagtgcttttcttgcaaggaattctgtgttatagtaatgatattcgtagcttctatttgaagccaaacaattttaattcatctatatcttcttctaaacaatttcctttatatctatacttatagtcttcaaggtgacattttatctagatatgtagggatttactgtttacaacttaaaacattattttaattgcgtattctcagatggaacaatcctaatttgctgttgtttaaattgtattatttatttcctattcagggctttggaaaggctcacaatcatcatatttttgtttaacttaactcttggtttatggttttgacacatggtcataaaaacatgctttgataaggtgtgatctaatttagtacctactgaaattctatgtcccaatatgcccttactgctttttaaacctaaggctgttttgaaccaaaagccaattttctaatactggaaggctcatttgctccacattattgagaaacatatctattttatttaagtactttagaaatatccttgctagggctgtgtcaaatttaaataccaccggaaagataattgaaaacgctaaataatcttgaattgtttcttctgaatatttctctttacttggttaacatccaagactatgtatcttactgacaaattgtttaatatctgtcaaagttatatttcttttttctagaaaccctcagaagaggaaacaatttttttttggtaatgaattgtggtaaaagagcagtaaatattgccatggatacatataattctctggaccacaggccaaaaaactgctggcgttgattttggggaaaaaaatcagcagataacatctaaatctctgtgcatatagcaaaaataggaattttgggggaaaaataatcatactatatagtaatttgtgtttggatttgagaatattataatagtagagaatgaaagtgataccaggatgcctgaagtgtgtgtatgtgtgtgtgcaggaacatacatgagtgcaagtacacaagtgcctatatgttcattgggtttgagtgtgtgtatttgtatacactggggtttaggaggtagagttggaagggatcttaaaaatagacctaaaaaacaaacaccttaaatgcatagatgacatctattgcttcctctctgtcaggttaaatttgacctcattgaaatttctacccaaccttgcaaaaaaataccaggatgcataaaccaggaagtatgtctgcattcaaacattgcttctgagccatttcttggtatccttattgtcaggtctatcctgcttttcttcactatgttaactgaacttactatttctgtctacttttaggctctgactttgacctttcctgtgtgtgaatttaatttctccctcttagcagtaaagcaatgcatagattacttttaatgacccaccctttcctttcatttgcattagccctatgatattctatatcttcttactttcctagggtagtagaagtcttggcttgttttgccagacagagcaaaagtgtcctgggatccacctaaatctcgtaaaatatttccttacacagaacgcaaaattgcttagtactctctacaaataccctcatccccccaccccaacacacatccttttcattttaaatgatagcccaggataaatggtgtgtttccatcagtgcttcagattgccatgttctttcagctcattatgcgcccacccaaattgaatttctgtccctagcatgataagcaagcatttaggtttaattgagaattctccttatcttattataatgagaatttttaacaccaccatttctgtaaccattatggtagtttaactgctgttttctgattatcaacttttgtgagacttttaccatgtgcagagtgagccagtttggccactgccacaagcgctgtggtattgttcctttataatttttgagagtaagacatggacagagtaaattgtgtttaaggaggggtttttgttgttgttgttgtttctcaggtagacacatatgagcacgttaaccgcttttacagggctttctagatttcaaaaagctattggtcaatttagcaaatgttagtattttcaaacttcttagaaatgttctttatactctgccatgaaaattaaaacataaaactagaaatttgaaagatcatagcttttctccccaaaagcatgctatgtatttgtaaggtaagtaaaatgagtgaaataggatgaatattcagtgattttaaaaattgtgaaaaataaaaactatttttgacaattaaaaaaatagtagtgtactctccactttatacaaaatatatactttaaaataacattgattgtagagtcgggtgtaggagaacaaaaagcaaattccaaaaatagtttattttacatttgtttatgataagtttaaatggacttaagtcatttgtcctaagagtttaggaagtgaagaaatttcaagatagtaagaaatccagatgaaaatgaaactaatcaatccataagtaataacaattggtatttggcttatacgttatgtgaaaaacagcaacaacaaaaaatattcatgcctgtgcttaacatctcagtggggagaaataggcagaggaaaacatgtttaaaataagataatttatacgatattttaattgtgcctccatttcttaagggaactttttttcattcactatctgcttgagctttatgtttaccttttaggttcaatattagagtattaggtgcaattattttataggctccttaccgtagttatagaattcagtttagacatagactcacagttttttgttcagtttatcaacaaattttcattgtatgtcagtctctgagtctacaaaaaggaaagacaaaatgagaggaataaaggaaaaaaagaagaaagaaagagagagagaaagaaaggaaagaaagaaagaaagaaagaaagaaagaaagaaagaaagaaagaaagaaagaaagagagttgccctcaagaaagaagtatacaagttcctggtattcaaaaaattaagtcatacttaaagcctgaaatttctgtggttgtagggcatactataagagagagtttctaagaaaaccagttgttatggaatgaattgtatgtccccaaaattaatatgttaaagccctaaccaccaatgtgactgtatttggagataaggcctttaactaaggttaaatgaggttataagagtagggccctaattcaatatgattgttgtctttataagaagacaaagaaacagtaaaagccaagtgaggacagagagagaatgcaccatctgcaagccaagaagagaagctgtaggagaaaccaaacttgctgacatcttgatcttggacttctagctccaggactttgaaaaaataaatttctgttcttttagccacccaatctgtggtattttgttatggcagccctagaaaagtaatataccagtcaatatcccaaatacagtagaaagaacaaagccaagattagattttatatggggaaccttaggactttgtgtgttgtactaatatagggaagacaaccaagagagtaacacggtcttataatattagtgacagagcagaagttagctgctgcttcttacacattcatctatgtgcatggcgataaggcttgacagctttgcactgataagaaaacaggggcaatgctccttgaatggtttcactattaaaatggccaagaggttaagtgaattttaagaaatttttcatacagaagcatgttgtgaaaataacaatcctgtccagaaattaatttgtgggttaatatgcaggacatattagaataaagtttattgggagaaatgaagatcaactttgattcaggtttgaaatagtaagaatatggagtgtggcagtggcaatgggaagctaagaagagagaggctgaagattatataaaaattggaaatgaagagattaattactattataaacagtatgcttgtgccctctcaatattcacatgttgaaagactaaccttcaatgtgactatgcttagagacagggcttgtgaggatgtaataaaggttaaatgaggtcacaatcgtggggccctgaatcagtagggtgggtgcacttagaggaagagacaccaaagttttctgtctctaccatgtgaggacacagtgagaaggcagctatttgcaagccaggaagagagccatcaccaagaactgaatctgccagccccttcatcttggatttcccagcctccaaaactgtgagaaatatattatctgttgtttaagccatcagtttatagtattttgttatagcagcccaaacatattaagacaaagtggttgggtactttgaaactaatattttaactaaagcactctgagctttagaaatcatatttataataactataatacatttccaaagaaagtataatttagtgaaaataaagggtcaaggggctgggtgtggtggctcacacctgtaatcccaggcctttgggaggcagaggtgggtggatcacgaggtcgggagtttgagaccagcctggccaaaatggcgaaaccccatctctgctaaacaaaaattagcctgtaatcccagcactttgggaggccaagacgggcagatcatgaggtcaggagtttaagaccagcttggccaacatagtgaaaccccgtgtctactaaaaacacaaaaaaattagccgggcatggtggcaggcacctgtaatcccagctactcgggaggctgaggcaggagagttgcttgaacctgggagggagaggttgcagtgagccgaggttgcaccactgcactccagcctgggcgactgagcaagactccgtctcaaaaacaaacaaacaaacaaacaaacagaaagaaaagaaagggtcaagaaagtgaaaacgaggaagaatctttttgagcaaaaaggaagaaggttgccatgttttctgtaaaataagaataatgaaaaaaaagaaagcttgtgggattcaattgcaaaggaagttcttaattaaggaaaggaacatgttaagatagtaacaggatagtttggacaccagacttgtaaagactttggataaaacttatgatgaaaaaaggaatgtgatgaatagaaacaagtcattctgaaacaacctgcttgtgcaataaaagaaagggagataatcagtgaatgaaagggaataccatatcaggtccaacctcttcaacagctaatatctactctttaatatgttaccccactttacactcagcatgcttataaatagtgcttcttggtatcaattttgcctttccctaaatacctacatattttttacaccatcattttactgaataccaataattaaaacccaggctctactttaacacagttttatgctaagccaatgtgtcactaagtccttttctttctgtaaaatcttttcttcctacctcaacttttcttctccatttctataaccaatgctctagtctaaaattgctttaaatatgtgaaatcttgtaatagtctcataactaagaagcagtattgcaaaatgtttaagaacataaactatgaagtcgaactaacttgggatagaatcttgtctctgacgtttgcatactaagtgcctttggggaagttatttaatgtcttcaattctgtttcttcatttgtagaataaagacttgaataatagtagatgagaaaggctaattactacagatagagagaaagagaaattttctcctttctcttcattaatccactcatatctatttcatcatgttattttctcaaaaaattttagcagatttctatttcatggaaaataaagccaaattcattctttattctactataaagatacatgcacacgtatgtttattgtggcactattcacaatagcaaagacttggaaccagcccaaatgtccatcagtgatagactagataaagaaaatgtggcacatatacactatggaatactatgcagccataaaaaagggtaagttcatgtcctttgccagggatatggatgaagctggaaaccatcattctcagcaaactaacacaggaacagaaaaccaaacaccacacgttctcactcataagtaggagttgaacaatgagaacacatggacacagggatgggaacatcacacaccggggtctgtcaggtggtgggggataggggagggatagcattaggagaaatagctaatgtaggtgacaggtcgatgggtgcaacaaaccaccatggcacgtgtatacctacgtaacaaaactgcacgttctctgcatgcatcccagaacttaaagtataattaaaaaaaaaaaagtttgtaaagcaaataacttggaagacagagatagcgttccccctctaggacagagagcaaatttgaaagctaatgtctccttccaagacaagttttggcaggtttgctagcaacacatttaaaagattgttgttcctaagcttgagattatttagctgtggcacaaacacaatgtgtgtatcccttccacctggattgcttcatatagtgtccattaaacttgggggatgagaaatagcatggacaactggagtcaatggaaaaattaagttcatgctacctgctatatcctgaataataaatttcctgtatatttaacccagaaagtctcaagtgttctgctagcatttatgaaactggggcatactaattgatttatatttattgagtaaaatatcagacccctcacagttattttcaaatttaatatgcaaaattttttcctgtagcaatttaatttataagtaaattttaaaattgtaggtgtataaacaaatttacttcctaaatatttaaatgtaataaaaacacttaggaatataatttttgtatttcaggatgattaaacatgcagtaaaataatgaagtcacatgttgctactggaatcaaaagttcctagtttttgtgatgtcttttataataatgttgtatatgattgtagaaataatactaaaatactacattatcagattttcagcacttttcttctgaaaataatgggctgttacttttgagtcagagaatcagtggtctgtttgcatgtgttggagctgagaaactgatatcccaaaatatggcattttgacatgctgaactgaagaagccttagggtgtctctgactatctttcccaaaggaaaagatctagacccaataaggagaacaatattctttttcttctcttccctgttatcttattatctattgcaaaaaagaagaccaagatgagatcatacctcagtggacctttttatgagtataataacttacaagcataatgacaaggaccatttaaattccaaagaaaactatttacaagttaatctctattccccattcaatcatttttgctagcaattatttattgcccttcaacagaattcctcttcccctttttcccataacctgtcttactagaagaatccaaggccccattgtttctctgtatcctcaaaattaagtttctgtaactcattgggaaggtttggtcttcattctgaaggcttccgtgtatgcatgttaaataaatttgtctgctgttcctcctattaattaatatgcctcatgcctgtgatttttcagaaaacttttagggggccaagcctatggctcccacaaatgcatttcaagtcgtttaactgccatctttcttaccagacaacctacttgtctttataaaatagatttatttggtaataagagttcctatttaaaaaaaaaacttgctttgaatttccagctgtcagagctgtgtaattttatgtgtgcttgtttttatttgagagattatatcctcttaaaaggaaaacaagtaacagagtaatgaagataaaataatctcatttttataaaaagtgtattttatatgtttgcatatttgtatatgagaaacactgcgcagtggtatcatgtgttacctaagaaagaatagaggagtagagggaaatagttgactttccttcatatatctgtgccaatgttattttttcttttggttttgtgctagaaatacaaattgaaaaaaaaattttaatgaaacgtaagtattgaagaaccaatgagataaattaattaaaattatgatagacaccatgatagagtcagtatttatattaataatattttaatacaacagggtgtacattcgtaagtgtgaataacattttgaaatatcttattttttaacataatttttatatttccagtaaattcagccaccaccatacctatttcctattttatataacttgaggcaccttgatgcttcatttttcacaaattgtttccttattgagtgatatgcttttatatttatttaaaactatgcacgtctacaaaaacgcattagttaatttaaatcttgaaaggttgtaggatcatgtatttgtccattttcacactgctataaagaactacctgagactgggtaatttatgaagaaaagatatttaattgactcagttccacagacttaacaggaagcatgactgggaggcctcaggaaacttacaatcatggtagaaggcaaagaggaagcaagaaccttctttacatggtggcaggagagagagagcaaagtgggaagtgctacatacttttaaaccatcagatctcatgagaattcactcattatcacaggaacagcaagggggaaatttgcccccatgatccagtcacctcccaccacgcccctccttcaattcaacatgagatttgggtggggacataaatccagaccatatcagatcccttatgttttgtttctgttatagtataaaattgaaatccgattatgtgaattcgttgggatgctttatttaacaacacttaattatttttcaagggctaatattaagattttgttatccaatggaataacatatactttataatttttcatcagctgtattacaaaaaaaggaatccttattactttaatttacttgacacttgaatttgtattttcttccttttatactttatatttcattttacatactaaattctaattcttatagttttaattttttcttatatatgcaacatatttttgaataaatgttaaacatacattttaaattaacccattttccattctaaatgtacattgctcatttctctcttctgttacatagcattgcgattttttaaaaatctgctcatatcttctctttcatagaagctagcttccatgacaaagttttcccattcatttattcattcattcaaaaccacttatttagccctttattgtacgcctaaccctctctcagtttcttgggctatattatttatatctctgtaagtgaaagaataacacacaacttaaacttctttggaggcctattgccccacagtagtataagtataagaatgagtgtgatgtttttgccagaaaagaagtatagaagagatgctggctatataataaatttttattttataggtggggttagaaaggaggaaaagaaataagattgaggttgattattgtcatcagaaattttaatttcagtaaagaaaacagtgcagttatttataatgaaatattatcaaaatattattttgcatatttaaatttagattattctagcaattgtttatattttgaaatgacttacatttcatgcatactgttctgtacctatagatggcattaatatcactatattaaaaaagtatacttgatatttggcctggtggtttttgacagtgtaattataggaattttagttatttgtttctcatgtcaaatctagcagattcaataaaaaatacaatgattctctgtttatctgagttatatataatcataataaagttttataataggatccctcatatcagctgctctctttaaattatcctcctggtttgatgaagtaaaagatagatttttattaaaaaatttctgtagcacattttgtggtgtgttttgtgagatgacagtaacagtctagtgttttcatggcttttgatagttatttattgcatggtaaaagagaactttgggaagttttaaattatcttttctttcagattgaaacaaaacactattttctaacctgttatctctcatttccacctatgaaggcaacactttctggctctcttactcactggctcttgctctctttctctctcttacatttggagtcaaaactctgagaatgagtaagatctttttgatacagatctggtctgacctagatctttccttatagttttcaatttattgttttcacatgtcctagtttgggtagtattgagaggatccctaaaattttgatggatgcaaaaatatagctttagtaaacatgtatgtgtgcatttactcagaatttaaatgaaaatggagaatagaaaggattaaatactcgggtccaaatagagatattgttaatcttatattatctgacaaacttaaacaatttttaaaatagtatgccctaaattcatgaaaatcaaaggtataggagagtaaaaatcctcagaatacgtgtggcaagatattctaagaggctttgcacagttataatattcttggctttttcttttactaacatgctgcttctccaagtagagaataatttaatttctttcattctcttctacccttacattgttttgatcacctcttcacttcatctttcagagaaagaaaaagatattcatttgtttgacaggttgacattaaaaatctctttttaaaagtttttaaaaattgttgttaacaattaatatttttgaaacccattggacagtctaaatgctctcaataaaagatctttatttccatgttttctcctttgtgtcctgcaagtttctgaggaaggtgtgttaaaaccttcgaatatgactatgaatttttctatttatctattatgactatgaatttttctatttatctcttttattctgtcaattttttaatatatcttgaaaatatattattggatgtattagcccttttataattatgattttttatttttaataaatattctggtgttaatcctacatagtctaatattagtattgcttgtgctagtttctgttggttagtatttgtgcgatatctattttccattcttttatttttgtttttctgcatttgctcatttttatatgtctctagtgacagcatatagttggcttttatggtaaaattcagatttaaaaatcctttttatcttttaattggagtctggatcatatttgtatttaatgtaactactgatatatttgaatttaaatgtatgtttttaattttgttttctatttgtccctcttgttctatgttcctttttgtatctccttgaaataattattttctaattattctatttcctcttattactttgttagttatgcaatttaaataaactattcttttagtggttatgatagagatatcaatgtatatctttgacctggagaaagcctaatttaaatgaacacatgtaattttctgtgtaatgttaggacattaaaatactttatttatctctcatttacatcttcagttatgtatttaattcaacagatatgtgatcatatgcatcatgacctcaatatttattaagatttacctaaatatatgccattttatttgaactttatacatttctacatacagtcatctatctgggattattgtcttaatttctgaagaacttccttaatatttattttagtatgggtgtgctgatgatgaattccctctctctctgtctccctttcattcttttttccttaaaaagccacctatatcagtttcatcttaaaacatattttaactaaataaaaaaatctgtttgcagttatttttattttcaatgctttcattttctggctttattcaaaagagattttgttttttggaagctgatgtgtcttttctctggcgtcttttaacctttttctttggctttttgtagtttgagctacctttacatagaattttatttgtttgctgtttatgttatttacatctgtggctagtttttaaacaatctgatccagtatcttttcaaatgttgcttctgcatagttcttctgttttttacttctgggactccaattgcatatattttgatgttacaccgtataccgtgtcattaagctttttcctgtatttttgttgttttttgtttccatgtttcaatcagagaattttatctgaccttcattatgcttcactaattttctcttcatctgtattaaatgcactgttaaagccatctaataagatttaaatttcaattatcatatgttttagtccatttgattttacatcacagttttcaattctctgctgaaatttttcatcttgtcatgtaatttcttgaacacattaattacaattatgttaagactatgttataactctatatgtggagccagtcacagtggctcacacctgtaatcccagcactttgggaggcccaggagggtggattgcttgaggccagaagttcaagaccaaccttgccaacatggcaaaccccatctctactaaaattacaaaagttagctgggcatggtggtgcatacttgtaatctcagctatgtcaggagactgaggcatgagaattgcttgaacccaggaggcggaggttgcaatgagctgaggtcataccacggcactccagcttgggtgacagagtgagactctgtctcgaaaataaaaacaacaaacaacaaaaaaactctctatgtagatctcctttggttctgtttatattttctggctttttcctttttatttatgtatttatttgattccatctccttgtacacctgataatgtttaattaaataataggagtaatttgaggctctaacattattaactttctgcagaaaggatttacttttgcaggcaattaagttctaaacattacatcttaatccaatcaggaattaaagtgattccaagatggacgtcagtcattgggaacctagtgggattaccaatggaaagaaaaccaggagtttccccaggaactcctctccctgggagacctgaattccaatgtcttcttctcaactcagttacactagtgacggccctgcttaagacctgtcattctcaaccactgctttctgctcaacttctcagattttgctgtcaatttgacaaatgaccccaaggataaaagtgacaccaaatgttacatttgcctttgtgggtttccccctgaaatcatgacgttttaggtctttgacttttcagagtaaaccatacttatgcatgtaattctctattactcccctctaggaataacttaaaaagatatagtaactcagattacagctgtgcgtgtaaagaatcaataaacatttaaatatattcacaatggatgttttctttatgaagaatgtaatttagtatgggaccattgaatttgcttttccaaagcatttcacaaactaaatatcttagaatatgtggtgacatctgtagttatatagtttaagtaacttgaaaccaaatagccatattaaagagatctcagtgtatgtactgtatacacacacatgtgatattttcttcccgttttcttgcctctctaggtagttttagaaataacaaaaagtggtgtgtgcagttcatccttgtaaatttgattttcacaacaaccaatgatatgagagggctttttttttttttttgagaactgcccttaataatgaagatctactcctaaattaatgttacaatgggactcgttgactcacatcagttttctaaattgattccaaggtaaaaatttctgggagatcattctcttgattctgctaccctctgaagaaagcaacaaataattaggcaattaacaagttgctttcatgcttgccctagtgttttgttaagagctccagttctggataggctctttgaatatgaattatacttctagcacctagcagtttggtaacccagaaaaagtgacttttccctcttagtggataagaattgtacttcataaatttagaggatttaatgagaaataaatgtaaagagcagattagtcatccccccaaaattgtattattattttttcatcatcatgatcatcattacaaccaccaccaacatcaccactgctaccatacttccaaaccatgtattgtgggctccaaaagttattattataacatttttatcattgtgactatgagtctgatttcaatagctagctatatttttaaccaacattgcataatgaatattacctagatagccttcttttcttagtaattgcatttccattatcactctatatagcatttaaacttttaaaaagctgcctgtgtttttataagttaaatatataatattaactatttagttgtgctatcctgaagagttaaaaagtatttgcttgggattctgactggtgtaagatatcccattgtggctttaatttacatttatctcatgaatgatgaacattttttcatatgctagattgccacatgtatgttttcttttgaaaaatgcttatttgtgtcatttgcacactttttagtgaggttttttgttgttgttgagttctttgagttccttagtcttcaaaagtaaaaaaaaaaaaccttaaatagatgttaatgaagattcagaaaaaggggaacacttatacactgttggtggaaatgttcagttagtacaatctctataggaaacagtatggcaatttctcaaagaaataagtatataactaccatttgatctaaccatttcacactgggtatctacccaaaggaaaagaaatcattatatcaaaaagatacctgcactcacatctttatcacagcactattcactatagtaaagatatgaaatcaacctaagtgtccatcgtcgatggacaaatgtgtaaagaaaatgatatctatgcatcatggaatactacatagccataaaaagaaggaaatcatgtattttgcagcaacatggatggaactagaagccattatccttaatgaaacaacttagtaacagaaagtcaaatactgcatcttaaaatttttgggaatattaatgaaaatgtgtcataacatttcaaattgatatatgatattcttcaagttatgtcttatctaatatttatatagccatataattcataaaagctgtgtaagccataaaatcatatatgccaattttgttggttctgttaaacaggaaaataagggcaacattattatgttttgatttaaatttgcaggatttatgataagaaaaattattgtttgttattgctaacctttttctaaaatagatattaaatacattttaaaatagagtcacaaagctttgaaccaaagtagaaatggtggaggaaccttgtactttacagatgggctgccagctaattgcaccttttgcgtaatggctatatatttgatggatttcgcaatcttagaatgcttccaatttttatttgcaaagtagcatattaataattgccttgcaattttgagatgaagagtaaataatataaatttttataagacacttggcacatagtgctcaataaaggtaaaaggtgttattgttgctatagtttcctggaataaataactgctgtacagtgtttctcatggtgcttgcaataaaggaagcaacattcgcttggttgtctggattctgaaatactgcatctctgaaattcattcatattatgcaaatagtgtgataaacatttttattcctctattcctgcctttctcaaactccaaattataacttacctacagaatcccctgtattgaggttggtttttaactgtgcttttaatttattctgtagtttttaaaactgctttagtatttacaatagttggcagtcatgaaggtagtaaattatgacctttattcgttatcataagaaccccagtttgaacagagattgcacatgactttattgtccttctgtgcttcaggagtgtgcagttgcttttctgaaactccaagggagaatttgtgagtgtatttatatatatgctactagaaaagtaattgaagaatagaatagaagaagcaatgtaaaggcttcttagaaaacattaaactagtagagattattcagcctgaagaatagaaggctgaagcgcaatatgcagcgaaatgtttaactatagtgtgagatgatttatgttaactataaaggagaacctccctgggctgaatgatagttattagaccatggtacagattagagaaagagtttatggaataactccaaaatttcctaaaatatcagagtgtcctacttaaatcgtatgctattggtcttactgaaaactataaaaatgcagagattttatacactgtttttgttctttaaaaaaacccagtgtttagtaacatgaaattaaagaaataatggaacacaattccacaagtatcagaaaatgtgctaccttgttgagtaaattgaaaaaggcaggcattacttccattctgcttaagaaaaaaaaaaaatttattttaggtctgctgtgtgatagttgacaagcagtaaggactggcttgtttgtcctataccactctttgtttctttctttcttttttttttttttttgagacttagtctcactctttcacccaggctggagtgcagcagcacagtcttggctcattgcaacctccgcctcccaggttcacgtgattctcctgcctcagcctcccaagtagctgggactacaggcgctcgccaccatgcccagctaattttttgtatttttagtacaaatgggtttcaccgtgttagccagggtggtctccatctcctgacctcgtgatccgcccacctggggctcccaaagtgctgggattacaggcctgagccaccatgcctggccgtcctatactactcttttatgggaaaaagtagctcaactgggtgtgaaaacattaatgttctgatatagggtctgctacttatactatattatatggaataatatactatattatatggaataagtcattttaattttctgcatctttttttactcactatgctaattgatctctaaaattttcaaattataatgttctgtgagtaaataaaataatgaaaagtaaatgttttttagtctcatatactaaggcacatttaatgcacctcccagtctttaacatgcattctgattggattatttattcatttggggaaatcttatacattgtacaatatcttaactaaatttgatttgcattttcatgtagctaggatatgtaatttaggaaacaatataaattataaataattaaaacctatttttgataaagagggtgttaatgtaagctagtgatcctagtaagttttttcattacgctcttgtcttttgtttctggtactctacaaatttcaagtcatacattaaagtgggatctctgtatctgattcaggtcctgctatgtcataatccaatgatgtctcttaaatcatattttctttccttggcagttttattattatcactgcttagaaatactgaggcaacaaaatcatatttctaatatcttaaaggatggaatattatttcataaagtgagattacctaattgcttgttatgtttttgttctctataatgagagaggaaattaagataatcaccttgagttgattttctgatttttatcaggaagataaaataacttccctgtgctttttcatatgcaatattttgatagtaaaataatggtttactgtttgaaacctagaggaaagagaaaagaaaataataataaattgtgttaatccacacttggaaattttctataccttgtaaacatttatttcttacaattttctattaaagtagatattaacatcttcacttttttgatgaaaaaactgagattcaatcaggtttattagtttgtctaagaacccagtcaacaagtgaaacctggatgcctgctcagttccaaagctcggagtgtttctagtacaccagatattctggctacacacaagaaacaaatgggaaccttaaaaataccaatgaattcaatgttcaagatcaattgagaaccactaaagtatatcgtttatgttcttgagacaaggtcttgcttgctttgtcacccagctagaatgcagtggcacaatcatagctcactgcaagcttaaaccctgggttcaagcaatactgtgggcctcccaaagtgctgggattacaggtgcgactaccacacccagcctatactttattattcttcacaattttttcaaatatttattttacaatattttagtgaaaaataagtcaaatctaaaacatatgtttgccagttatgttatttcccattgcaatattgtagatgaacagatggttagctattagttccatctgtatgaccaaaatagagagtaattgtgtgttattgttacttataggttcacttgtcaaggatgagtgtttccaattctacaaataaaaattgtattattttctagttgtatgaaagtgaagctaatgcttaagaatgtaagttacctgtttgctactaccatttaaaagataaaaattggtttttcagtttggagatacttttaaaaaaatctctatttagttaataagaaattctatacaaaaaaaatctctacttagtttacaagatattttatacaaataactgttttggcacattcatgtatgagaccggcttttaagagtcaaaggattaatttgaaatattgatggtatgagtatgatagaaatttcataatagaaatattacaaaatggataaaatgttttctatgtgcttcgttatttactaatacattgacttctcatttcattacacatttccagctagatggcaagcaattcaaaatgggacttaatgtaatgatataattttgtgatttgtgtgtctcctttaaactttcaatcatagattaaattttaatttgttaatgtgttctcacaggataaacaaggcacaaattcctactatatactaacggaaaagggagttttttttgtcaaaagcattaaagcaatttgttaatagaattcatcagcattgtatttttctaccttaacatactaccttgtggttcacattaatagttataataattataaaataatttcataaatttagatacttgggtaattgacaaatatctatttacaaagctggtttagaaatagaaactaattggccaggcacggtagctcacgcctgtaatcccagcactttgtgaggccaaggcgggtggatcacctgaggtcaggagttccagaccagcctgaccaacatggagaaaccccatctctactaaaaacacaaaattagcctggaatggtggcacatgcctgtaatcccagtgactcgggaggctgaggcaggagaattgcttgaagccaggaggcagagattgtggtgagccgagatcacaccattgcactccagcctgggcaataagaatgaaactctgtctcaaataattaagaaaataaataaatgaaaccaaaataaatttttggcgtaaagtagacgcttttattgaattttagttctgtggaaaagtagatgtttgcgaagattactatattaaacatttaatcctgaaaaattcaagtccttgtttagtgaacttatttttccattacttttggctttctattacattattatccagtacaattttagtgagtatctagtaagtttaaggattatattaggtggtaggatatagtatatctatagtaggggtccttgctataacagaagagcagggaagaaaaacattaaacaaatacttataagtgttgtatgtcatgtattttctgcgctttgtgacatatggctgtaatttcgaggtagggagaggttctaaggactgaaacatatgctgagatttttttttcttttttttttttgagacggagtcttgctgtcgcccaggctggagtgcagtggcgtgatctcggctcactgcaggctccgcccccagagttcacgccattctcctgcctcagcctcctgagtagctgggactacaggcacccgccacctcgcccggctaattttttgtatttttagtagagatgaggtttcactgtgttagccaggatggtctcgatctcctgacctcgtgatccacccgcctcggcctcccaaagtgctgggattacaggtataagccagcgcctccggccatatgctgagatttgaggggtaaaggaagtatatttccagctgagggaaatgctaatctgaaggcactgaggcaagagtttacaaagcagtggggtattagtttgttattgctgctgtaacaaattaccacaaacccagaaactgaaaataacacaaacttattatctcacagttaaatagatctgaagtttagatgtgggaggtttctctggtgcaaatctcaaagggcagtcttcaaggtgttggcagtttgggctcttatgtggaccttctgacagtgggaggtgtgggaaaagggactctgtttccatgctcattcaggttgttggcataattcatttccttgttgctgttggctgacttccccatttccttacaggcctggagcctctgtcatattcttaaggtcttctgcattccttgtcacatgcccccctcaatcttcaaaccggcagttgtgcatggagtctttttcacctatcatatctgcctgacatcccccctctgccacatcacttctgactctccttttcatacgttagatgcaaaaaaaactttgctcttcaaagtttatatgattatattaagtctacacaggggattctggataatctattttaaagttaactgattagtaatttgaattactaatttaaatcttgattactaagtcctttttgccatgttatgttacatagtcacaggcttgacaccatgggcataaattatggggctaaaattctgcctaccatggtggttgaattttactgcacatgaagaggtcagtgaactgagtggctaacttgctttttagcctgtatattttggcattaatcagccaaaaatggttgtggtgaagagataaactaaagtcaatgacatatctctagcaatacctaaaggttggcaattagtagacacaggatgagtagaggatgataccagcatgagcctcacagattgggggaatactgcaggctatggagtggtgataattaggaaaatgcaccagattgccctatcacgtgctgaagaaaaagctatcttcaactgacagaactcagtggaatcctggcactttggagagagccaattttcaccaagtcaaaaattgaactgagtagtcattcaaagagttcatactgttgagaagtttgttaaaaattttccaagagtaaagtagaaaattttgtgggggagaggaggaatcagggaaatgtatcaggagaaacaacacaaagaacattatgggcatgggagcgtcagacagagatggcagagagtggtgaaaggcaaagtgaattgagtatggatttacaaagaaaataataactctaataatctcttggaaatggatatatttctttcactagttatcaagaggtctgcaaagaaagtcaagttgttgaaaactgcatggtctttggaagagagtggtagagttaacaccgaatcgacttcaggttctgtgaagtctggagcatgtaaggtccaagtcagccatttgtttctgagagtcagtacaccatagtggttaggaatacagcctgtggcacaagggctcatgggttccaatcctgtccttctgactttgaacaattcatttaaactttctgtgcttcagattcctcagctgcacagtggaaataatgacattagtggccatttcattgtgtcattgtgaagattaaatgagtacatggctcattgttaagtgttagctactattattattattatactttaagttctgggatacatgtgcagaacattcaggtttgttacctaggtatacctgtgccatggcggtttgctgcacccatcaacccatcatatacattagacatttcttctaatgctatccctccccagccccccactccctgacaggccccggtgggtgatgttcccctccctgtgtccatgtgttctcattgttcaactcccacttacgagtgagagcatgaagtgtttggttttctgttcctgtgttagtttgctgagaatgatggtttccagcttcatccatgtccctgcaaagaacatgaacccatactctttcatggttgcatagtatcccatggtgtatatgtgccacgttttctttatccagtctatcattgatgggcatttaggttggttccaagtctttggtgttgtgaattattaataatattgtgttagctattattattaatggtcattgctatgattttttacctacttaccaaagatttcaatattacactctatgcaagacaaataaacagtttttagactgaaaatctatgctaaacttaataattttgtgtatgtcatttggttcaataatgctacttaagaaacacagtattaacctcatagagttaggtattattgcttgtgtgtgatggtggagctgtgtcaaaatagttgttgggaaaataggttatggtttaagtgattttggtagatctaaagatgccaatcctggtaatgtaaacttgcctgttggattactttttctttaataaaaacagccataatcttctagaagcagtgttcttgagaaatgtatctgtcgctaaaaacagaggaggtcaaatgatttttctaggtatagtagtcacagtaaatatctactgtcacatgtagggaagcagcagaaatatactgtggcttctgttattggaaaactgtctgtatcttttctagctgtctcctccaagcatccttcaatggggaattaaccttgtacaattaaatttgcagcagagtaaaaactttttaagaaaaagagccatcttttaaaatattagcctgttgccatttagttcaaattacgcgattgataattcaaaaccacttacatgctcatttttatgctatgtgaattgaatgtcataaaattcatttattatgaacaaaatattcaaaatgcatcagagtattatatgctgagctttgataagagaaaaaagaatgatttgacaaggatatgaaaaatcatataccaggtatatgaggttaaatgtattttcaaatgcttcttgattacaatagttaaatattccttgagagattttactatatgaatttatttcagatttcaagtagtcatttggaaattgttattttgggaattttttagatcaactttttctaatcacaactagaaaattaatactatcactttggcataatttgattgggactgctggttatttaaaacaattgatgtgtataagaaacttttaaaattattttaggaaatgtaaaaaagtatttgatttagtttctgcctccaggtactaatacagtaaggggatgaatcatgtacacatataattattgcacaaggtataatataataagggccataagagaaatgcaaagcaaatgaagtccaagaagagagagattaccagaagcttggcaatcaaaactctgttttcatatttcagatagacaatggaaatattaagtggaaaagtagggtatggaatatataatatagtgaactccaataatgaatattttagaaacacacagatacaaatagaaaatattggaaggaaatgactaaaggtataatgagtggtcatctccttctttctcttctgcttcttttgaatttctcaaattttctacaataattgcatttttctcttaaaataaaaacttattaaaatatatggtctcatattaatctaaaatctagagctatgagacaagagaagaaaatgaggaaatttctaagaatatgttcaagtgtaaattttaaaacctgtttataggaaagaagacaaacaccatagtaggtctataaggatggttggactgctttaatactctatagaatccctcctgtagtttatagagagtctctgtaaagaaagttatctatttgctattttaaagtaaacattatttagagaatatataccacattatgcttgataagtttggttatgttataacttggtagaggaaggtatcgtttaggggagggaataaaagcaactaacaattgagtcgaacttttgataagttttaggagtcgttgactaaaggttggtgtgaatgaatcatgtcaccttcatttgagttctctcttcaacctttttagtagaagaaaaaaatgtgaaggagaggaaatatgcttgtagatataagttatattaagtattaatactcatgcacttacatgcttttaatataagttcaatgagaaaaaagagctctaaaatatttgtcaaactttttttaaatgaggatctttgcttattgttgcagattaataatatggcttttttgaaggatatttgccaaaatgtctaaaatgcttttagattggattatcttagagcatgtaaacaaatacagtgatacagtaatagggctatgagaaaaatcattcatgaatgaacctattccacaattatgatctctagcttgcacatgataacattttcatgtcatgtcttaatttaagaagattctcattgtttatgcaaaagcagctagtagagttcttttaatgagatggaatctattaaagtctcgaattgaatactaaagatgccaagtttaagaaaatgttcacattattgcttactgttctttgtgaattttctcactcatacgttgtatctcaggttgggatccctagaagcagacgttgagacaggatttcagttgcccatatttattgacggtattttctcaagataaagggagtgagggaagtgagaaagttcaggggaattcactaaagcaagaaggtggttttcactgcagtctagattcagccatatctcatggggataagaaggagcatgacttttaccatataattgtccccaccttgaggcaaaggggctggcattttgtacctccatgtattctttatcgatgttggaaaagcaggttagcaatctgttaggggaaagaacttctggtaggcaaagggaaattctccaaagaagggggcaactatgaactatcagcagccaacactcacagcagctggatcaaataaagagagtgtggccagaacacttaaactgttcagtagatattattggttaatcaagaccatagacatatttaatttaatttcacaatgttcaatcattaaactgtcactgagtacctgttagctactgaaaagtaatagtgaactattattaatatatttaaaaaaaatacatgccctcctcctttatccaggaagaggtcaaaatctctgggggcaagagtcaagtataccaatacagtcataccttagagatactgagaatttggttccagatgccacagcaaagcaaatatcttaataaagtgagttacacacaatgtttggtttcccagtacatgtaaaaattatgtttatagtatgctgcagcctattaagtctgttataaaattatgtctaagaaaccatgtacatatcttaattaaaaatactttattgctaaagagttctaatggtcacctgagcctaaacagagtcataatctttttactgatggagagtcttgccttgatgttgatggctgctgataagggtgatggctactgaaggttgcgatggctgtgacaatttcttaaaataggataatgaagtgtgccacattaattgactcttccattcataaaagatttctctgtagcacgtgatgctgtttggtagcattttacccagagtagaactttgaaaattagagtccatcctctcaaactctgctgctgctttatcaactaagtttatgtcatattccaaaacttttcttgtcctttcaacagtgttcacagcatcttcagcagaagtagatttcctcccaaggaaacactttttctgctcatctgtaagaagcaactcctcatctattcaagttttatcatgatattacagaaattcagtcacatctaattctggttcttttgttatatttccatcacatctgctgttacttcctctcctgaagtctttgaagtcttgaacctttcaaagtcatttatgagggttggaatccaaactcctgttaatgttgatattttgacttcctcccatgaattaagaatgttcttagtggcatctaaaatgctgaatcctttccagaaggtttttaatttattttgcctagattcatcagaggaatcactatctatgagagctatggccttaggaaatgtatttttaaaataataactcttgaaaatcaaaattccttcttgatccatgggctgcagaagatatgttgtattagaagacataaaaacaacattaatctgcttgtccatctccatcagagagtcttagataactagatgcattgttcaacacgtagtaatattttgaaaggaatcttattttctaaggagtaggtctcaacagtgggcttaaagaatattcagtgagccatgtcattaaacagatatgttgttatccatgctttgttgtttcattaattgagcatgggcagagtagatttagcataattcttaaggaccctagaactttaagaagggtaaatgagcattggcttcaacttaaaatcctcagctgtgttagcctccaagagagtcagcctgtccttggaagctttgaagccagcccttgacttctcctccagaaaatctgttatttagcatagccacctttatcaattatcttagctagatcttctggataacttgctgcagcatcttcatcaacacttactgcttcacctttcacttttatgttatggcttctttccttaaacatcatgaatcaacctttgctagcttccagtttttcttctgcagtttcctcacttcttttagccttcatagaattgaagagattaagggccttgttgtggattaggccttggtttaagggaatgttatggctggtttgatcttctattgagatcacaactttttctgcaccagcaataaggctgtttcactttcttattatttatgcattcactagagtagtacttttaatttccttcaggaatgttttctttgctttcacaacttggctattttgtgcaagagacctagcttttggcttgtctcagttttagacatgacttcctcactgagctaaatcatttgtagcatttaatttagggtgagagaaattgtaactcttcctttcacttgaacacttagacgccattgtagcatgattaattggcataatttaaatattgttgtgtttcaggaaatagggagatccaacgagatggtcagagactagagaatgaccaatcagtggaggaatcagacacacacaatatttatcaattaagtttgccattttatgtggctgtggtgtgtggtacaccaaaaaaattacagtagtaaagtaacatcaaagatcactgaccacgtatcatcgtaacagatataataataattttaaaactttgaaatattatgagaattaccaaaatgtgacacagaaacacaaaagtgagcataagttattggaaaaatggccccaatagatttgctggaaacagggttgccacaaaccttcaatttgtaaaaagcacaataaagtgatgcaaataaaatgaggtacaattgtatttatgtacaatgagttatgtactaaaacaatattcaatattcaactattatggaacagagaaaggctcaactattagtgccattatttatatatatcttaaggtatgctatttgagcttgaaaattatgtttaaacttaaacttttaagtgtcccttctctgggaaattcacctgtatagaatatcttacttctatggaatgctgtataaactttgtgtactcacatacctgtgcatataaagcacatcccatttgttgggcggccacttatccccaaacttaaaataagtaaaacataatgtggatcaatagtatttgaaaacaataaaataactcctgccagtcacaatgaagggcagaaaatactgtgccagttgaggcacatggatccttctgctaggtaaatataattaaaaacaaaatactctcccaacctagaaatcctctccacaaaggtagcaggtaaagaacacatctgtattattgagtaagagttaaaccagaatgtggtgaacatcataggcaaatctcttcactaaaagattgcaaaaacagcaactttgctcttttatgtagtcaagcagatacaacccattatacatacgtttttaagatacataacatctagtcctcaaataaaaaggacttagtaccacttgtcaggcatagttcattataaatttagccagtaattggggtgaccatctatgttaactaattggtgttatccagaggagaaacaaacttcttatatccttatgacagaaggcagtttttgagttaggtcctaccttcccacagaagctgggagatatggatgctaactctcttgatgttgacatttcaaggagatgatgtgcaagcccttaagacattcctaggtcataagactgacaaaaggcctatttagctttgtaaaggatttatatatgttttaaaggaggagaaagtacttagtattacaagctttctaagaaaatggagaggagggaaatctgtttttttcaatagagagaattatgcttcatattttaaatttttctttgtccttgcactacttatgatgggattctttaggccccagaggaatcatttactcttatttctgacccagttatatagtttgaaatcccacagcagattgtaccttatctgagagcaggcatcttattggagacagagatgctgactctagcatgatgaagggacagttgtcaagtctgacactgagagaagcgacaatacttacaaaaagcagatggagaagtgtaaaagaggggaggagagagagtaggatgaaatggacagtcattcggcttttctaatgggaagaaacaatcctgccacttaggtgactcctgacggcattgttttattaccaaacaaaaattaaaattgacctttaaaaatatatatacatatatatttatgttcactaaaaaattatttaatacattcaatccacagatagtctctaggttgtttgaggtcacattcctgttatgtttaaggatcttcactgatgccctttgacaatgtctctttcaggcttctctcctttttttatagcatgtaagaaaatgtgcacattttctgcacatgagtggtactggtttttataagtattacaggaggggaacacattgttgagttcattggtgatttcacccccaagaaacaaagaccctcctgacccaggaggaaagtagagcagttgcattttataatgaaaatattattgtgtcacattattatgactatttttcagtgggtgattcagtaaatgcagcatatgcttagtaaatatggatgcacagtgtctgaaaccagactgccagggttcaaatcacagcatggccatttactatcatcattgtgaccttgaacaagttacctcatcctttctcatttcattttcgtcattgatgaatagtgattattaatagtgctttacctcataagactgtgacgaggataaaaggagttttcagagagacagaaaaagtgaaagagaagatctgtcaaaatagtcaataaatatcaactattatttataaacaattacttacagttgcaaggcttatttcaatctagaaataatatgtgctttaagagaaaatgcatgtttttttaatcacatgtagagagtgtgctttgtaaggatgcaagaaaaaaatattctatattactatatgtctagtaaatgtgtattgtacagctagttatagctgagtttattttgtggattcacaaaatattagtttgaaatcaaattggtattttttgtattttaagtatgttgaactcaattttatgatttctaatgttagtgtatatcttatgggtagaccaatttttttttgcctgtactgacatattttgatgttgatgtatttgaaaactttgttaacacacatgatctaaaatttatatagtatgtgtgtttttatcttttttttttttttttttttttttggcttgggttggtggtttttttttttttttttttatgtgtttttttttttttttttttttttttttttttattatactctaagttttagggtacatgtgcacattgtgcaggttagttacatatgtatacatgtgccatgcttgtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcaatttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgacttcttaatgattgccattctaaccggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttgtcttttgttgccattgcttttggtgttttggacatgaagtgcttgcccacgcctatgtcctgaatggtaatgcctaggttttcttctagggtttttatggttttaggtttaacatttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgtttttgtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttatttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtcgattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtgactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttgtcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatttcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtggtgcgccgtttcttaagccggtctgaaaagcgcaatattcgggtgggagtgacccgattttccaggtgcgtccgtcacccctttctttgactcgaaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctccctcgtgtttttatcttataccatgtggtaacacatgtttatttgtggactgatttaagaattgataattatacagtcttcacagaactcagaaaaatggtaaatttttacattcatattgggtgtttaccaccttgggaaatataacaaaaggaagaaatatctaatgtttttgattttctagtattgccgtaagaaaacaaaaataattctctacttgtccactatttctggtcccagactgaaagaaaaaaaaataacttttttttttatgtttctatattttgctaaactacaagtgcttgctgttgagcaagtgtgaagcaagctttctcctaccacttttgatgtcctaaattatgtctttactctgatttggcaaacatggtgtaggtaaatcatcttggagagttcttcctagaatgagtttacaaacaaatccactttatacttataaattataataattccgcttatattgattcatcatgaattgtgctcataccctattaaaaaaaaagaaaaaaaaagacactcattagacttaaaatttattagtggcttaattagatccttttcagatcatttttaaaattttgtgtaaaatgataagaaggcactttttaccagatatagtatatcatggcctggtgaatgctttccttttccccatgtcttaatattttatagatttatttctccaaaggacctgtattagttaagttcaggtggattatgtcaataacatattaacacaaaatctcagtggtttcatataacaaaagtttacttaccttttatttttttttctaaaatatcaattatggagccagggctctgttccgtaaagtcattcagggtctcataactccactaaccaaggataatgggaaaacaatctttcctgtgccttgacagaaaaaagaagtgcttcttgttgtgcactaataatatctaccaagatccatgtggctcttttgtccttgaacatatataatagtttgtgtaaattctcagaatttggtgaatacatgggtgttactgtataaactcagatttattaatcactaaatagctctaaatttgtaaataaatttaattcttaaattttaaaagaattttaattaatgtttttacattgacagaaaaagataatctttctcaggttatttttggacatgaaatggcaataaatgactgcattgcctactggcaatgggtgaaaaacatgattgaaagcctaaagaacaagtgccatttttatcctgtgaacagccatgcaaccaaactgcagcaagcaacatactgatatttctgaagagtctcctggaaatttgccaggaagaaaagatgagagattaagaagcagagtacgaagatgaaataattatttattctatttattaaatgtaaaaactttccctttaagttgcaataagaaataaaataagctacttgagaaagaagaatcttactgtattgactttagacatagagagaatcttaaagtgcttctatgaaaaaatacactcatatctaagatatgtagaaagaaattatgcccctttctcttctagtcattgtaaatatcctgtcttaaagagctcaagctattttgctactaacagcaatcatattactcttaagttaatccatcttatataccctctataaatcataatctagttaaatacatagcaaaaatggtgaattggctctccttaacctgagtcattttaagttgtacttttaaaaaatcttaccaattgctaaaaagcttaattatgaaaagaacttgcaaaagaaattaatgactttgtaaaacgaaaatggctttaaaatagacaagctctaattaaattgatttggacccaacatctttttattcaacaaacatatgtatttaaaacaattttctgctgtaatgattaattataattttatttttaaactgacaaaaagaaaatagcatacctatttaaatcaagaaaaggtagtttttctttaaaatggagatttttagttttgctaaatttaaaaaaaaagataatgtctcaagtagtaaactaatgagggattgtatgtctgacaatagtctaaaattgtcttttgagccatgtttccttgactgaaagaggaatggaacaaaataattatcttttttttcaatcttctcctctaacatatttctaagccttcagaggttaatagcaattatacaaaagatgccttcccatggcttcaagcctgtcatgttttgttttgtttgtactctagagaatgctctgaggttgattgagttgtgttttgaattaacggcctcacatcacctttcaaaatttgaaacattcttatgacattgtcaaaattagaaaagttgttatcatagttacagttttatgcaataacagattgtgtctattttgtttcactttattttgggatatactaatttgcttcaaaaaattgtatctaggaaataatgagcaatagaatcagagagaattaggtttgaaatataagttttatttaacttctttgagatgtaattatcttatttctaaaatgagattataaatatccatatcttctgaggatcaaatggcataactagtatagtgtctgccatattatatccaattaaaaaataacatgctattcattatttttgtccttactgtttaagccttgtgtttaagtttatgagtacttagaaggaatttttaaatgcctatgatttatttacactttatgctttaaattatgcttgtgaattatttatagaatttttctacaaatactgagccaggaagcatataacattttaatggaaacatagaaagcaataaaaaggttagagttattcattaatataattagttgtataagagtaataagcatatggttgttgatatggtttggctgtgtccccacctaaatctcaccttgaattcccacctgttgtgggaaggacctggtgggggataattgaatcatgggggcagatatttcccacactgttctcgtgatagtgagtaagtttcacaagatcgatggttattataagcggtggggcgggggtggactcttgcacaagctgtctctttgccaggtgccatccatgttaggcgtgacttgctcctccttgccttccgccatgattgtgaggcctttccagccacatggaactgtaagtccattaatccctttttcctgtataaattacccagtctcgggtatgtctttatcagcagtgtgaaaatggactaaatatttgaaatttggacacaattccactcactaataatctactatatagcataggatgttttgatctgcaagtcacagaaaacctcaacttctagggtagtcctgagttagaatgagcttcaggcatataacaatctgtggctagtcatatcatctagaactcaggctctttccaatattctgccttctgtttgctggtgatcacatcaacttcaggctagaacaagatggcagcagtgtttccaagcaacacttccagactcagccatatcaaagaaaaagaggaactgccactctgttttcttcttggaatcaaggaaattttcctgtgaccctggtagatttttcagaattatccaattcctacaaaatatactagaaagcaaaaattattactaatttaaggatgtaatggatattattagagtgccaatcaaagacaccatataggtcacacttttaggtacccagcatataaacacacattctttccacccataggcatttaaaaaatgtccatgctcactaaatacacattctccagaatgggaaaacacagacatatgtaagaccctcagctcaagtttagggtctctgtgttcggtgaagtcctttccatcaatttagacagtaactgtttattgtctggtgaagaagtgtttcactctctgcccaacttttggtaattggaaaacaggaaagacaacttacatgaacactcttactcaaaacattggaaaatcaaaccgcgatactgatttatagcacattttctattttgctggaaacgtgaatacttttggtttgatagtcaactaaatcccttattctgcaaatctgacagttgtatttgatgaaagctgagatggtaacaactttcttgcccatatcgaaattcagggaatggggatgtggaaaaatgcctcactttgagattgcacatttttaacaggccccttcctattgagtgggtttggtgagctggtttaattatttaattggtttaattatgggatcttactcttggtgaggcttacagttaccttgatattgtagttcccttaagaatttatttggcttctagctcactggagttcagctccacggactggtaacctaggcagagagcttatccagcaagttatttattctgggaagtctagttttagccacaggcctcagagcttcatccacccctctctctcgaccctgtcatcattatcatttaatgacctctgccatgaacggaatcaaaagaatagcctgaagtcagaagacacatatattatgtgttccttctaactgcatttttaaaacaagattgtctcctttactagatgaataatgcctaactggaggtgtttgctagaaatctggggttgtaggatttctttttactttaatcaaatattctgcccagtatccattatcccatctctgcttgctttatctatggcttgagtagaaaatttggcttttccagtcccccaaatttccaaattattgaactttaaagcaatttagattatagcccaaaacctcttcaggcagaattgtattttattctttctctgccttctgatagatcagctttagcctaagcataactctttcttgaaatacctaactgaaagctgcaagaagtagccaaaacaccaatgttctgaaaattttctgtcagtttcccaaatgggcaagcatttagccaagtgcttcagaaccacacacgaaaaagggtaattaaccactaagatttgaagaatagagcaaattgtctttatccttgctttatctcctctcctctgccaatttagtgttttaaagtctgttacttgtggcagcatatttccggtgacatattcggcatcaggatgcttctgtcaacaagtaacagaagacattaactaaaccaccttacaaaacaatggaaattataccatttaactaatgtagtgggggtccccaagtgccatgcatgaaggttcagccccactgtaattttcttacctatcgtctttctctaggactggtagcaaaataccttcagctccttaagataagatatttacaatgactagaagaaaaagagaaataatttatttccaggtatcttagaacaagtatatttttcacagaagcacttcagaattattctctcaatgtctaaagtcacttatgtaaaattctttttttcaagtagcttactttattttttattgcaactcaaagagaaagctttttacatttaatagatagaacaaataatactttatcttcttactctgcatctcatttgctcatcttttgtttctggaaaattttcaggagacccttcagaaatagcatgttgcttgctgaggtttggttgcatggctatttacaggaaaaaaaaatagacacttgttctttaggatttcaaccattttttttttcacccaatgaaaattgctgggtcatctgtgacagcctcttttggaaacctgcagttgtcctcagctggggtgagaagttcatattctcccaggcctgccttgagataaagtaaagcactacactttagaagtgcttccttttcatcctaaccaggagtttgaattaggaatagaaacattcctggagcccttcgtctctgccagagtggagagtggcccccttgggagccctccttccttccacccacaacctcagacagcattcaaaccatacaacagccaccccaaacgagctaggtagactgaaaggaaggaagagaaggaaggactaatataaaatgccttagaacatatacttcataattgatgggtcaccaacaagaagtgattacttcacactgcagggaaatacttttctggaaaacaagagacaaaaataattttcggatacctgcgcgctgactctgatctaactctgtagcctgtcctcatcccagtcacctttgttaaggtgtctttgttgagcctgagttctgtacagaaaccagaaaagctcgatattcataaacatttctttaaatgcagaaacatagaatgttaatgtgcatttttctgagatggtgttataagtccaagtatcaaaaagcagtagcaaatattagtttgtgttttcaactctggagtctacctaggccacgtgttaaggacatctgtatacttcattagggaatgagaagccaggaacaattaccttagaatttttgcatctgctgtcactgtcaatacccatttcatacccttatgcattctgtatcctttgctaaataatttctgaatcttaaagtgtgtgtgtgcacgtgcatgtgtgtgtgcatgcatgtatgcatggtgttttcctgaaaactcataaaacacaaaacactgtacactaaatttctgtaaaacaatttaataatatataccaccttatgttacaaatattcttttaaataatttttctacctaggctactctttaaatggttgtcactatattatatacttgttaccatatcaaaactcagtactctaattaatatatactgaattttaaaattgcagtaaattttatcttctcagtgtagtaaaaagacccactaatttttcaagtaaataatcttgttaattccttgctggatgatgttttatgatggtggttatgtgtctcctgtgagcctgttcccacattcaaattattttatgtatatactgagacaaataaaaaatataataaacacacttaactgatacatctgtggaatttttaaatactttaagtgaaatacctactttgtacaagaaaaggttataatattaccatttgaaaaatcaatggtgctttcagattccgaggcatctcagtataaatacatattattatttttactcaaatgcatatctgaaaatattttcatactgtcatgctagaaaagcactaaaattgcttgagaagatagctgatatacatatatctgggctaagaaagcaaacttgagtacaagtgtttgagttaaaacagtcttatgcatactaaatggactctggcaacatcacacatttacctaagcatttagagatggcagttcttcttaatttgttcttaattctgttttcagagtattgtgatattttaatctttggaatgctgatgatttatgagttcaaacttgaagacattttctctgtcagtcttttagtattcaaatcaatgcagggaacacagaattagatctggagaggggaagcaggattcatcctctctggggataactaagcaaattatttggaactctggatgctcttgggcattcagtaggtcaaagtctaagtcctcaaagtaaacagtgatgggtcaaattgctgagagctccatgtgtgtaaaaaacaattctttatagtgcccaacatatctggttagaatatattaattggtggttaaaaatagaatatttattttaaaacagctcgttgatatagataaaattgaactaagatttctaatatttaatgtaaatattattcacttatcattcatgcagcacttgctctatgccagggacaggctttggttcagtgatctcaaaaataattagtagtgttacccaaattcaagcagtggcgtagattggatactccaattagtggaccctgatcttaagatttagatgtaagtgacttattaagtaagtgctcccaggaagatgtgataagggagtggagaaaacaggaaatgaacgacaaagaaccaggccaatggagagaattcagtggaagtttcagacatagcctgattctgtgggaagctctggagggtaaattacaggtcagaggttgtcctgaccctagacaaagaagtaaggcttttatactcctgttagccaggatgggaggcagtgaggttttggatgtgtggttagtgctgtctaggcacgtccagcaactcctgcaggggagaggacatcagtatgcagggcattcctctgaagggtgagttctaaaggtgtaagcctttcaaagcaaacaagaataaacttgggccaggtatgcacagagctggccaaattgtggtagtcactgctggtgctccacacaagaatatgcaatgttaatcataggaatatgtttggggcaccagaagtgagtcctgtcagaaattcatgttctggaaggggtgctaagccttaaaaatatgagtgtgatacgtgcaataatatattgatattgaaggcacaatactcagaaagggggttggataactccctggatggtaagcatgggaggtcaaagaacacttgagtagaaaaatgaagagacattttaaatgctaatctgcttgctaccataaactaagtattaaaagtgtatgtctggtttgattatcattttttctttaagggagaattaatatttcactcaccgcttagagaaaggtttctcttactcagtgtcttgtgtttgcttttcaagtcctacattgtcccactgaaagaattaattattgtcctgtaaaacctattaaaattctgtcttaggaaaacctattgtcctgcatgtcaaatatttctacagttttataagttccttttggcttctgcttctcctagcctaatttcctcatcttttcttccaaagtgtatttctcttacccggtcaatgagaccatattctttcctcatgcataagtggtactcccataatcattccatcctcttccagcagcaaggagccaccttattgcctccttaattttttttatgtctctctttaagttagtatgtgtgatttaattccctagaatgaccatttgggattgaattcctgactacctgataaaattacatcacatagaccatgaacccagaatacaaagttgtatgcttttatctgggcctttctatgttctatttcaagacatctgactcaaacaatgaagtgagacatctaatttcatttctgctgcttactcaatgtcacttttaacaatatattaacctctccaagtcttaattccccaatttagaaaagataggtaatagttcatgtgtaagatggttgctgtgagagttataaatgctcagtgcagtgtctgagacatgataggtctttagtagatgacaacaactattaataagaacaataaaaataataatatagtggccttacctcaagtttattaataaggtagaaacacaactcttttaattttactattaaatctttacagagggtttatacatacaaacatacataaaacctctaagttttacttaaagatatacctgtctctgatagatacatatggattctagagtttaaatagtcttgattattttattcctaaagctaacacagcttagaccagtatttctcaaaccaccttaaaaaaactcatatatatgtgtgtatcccataatcccatacatatgtgtatgtataaactcatatatatgtatatcccataatcacatatatacacacatgtattatatatcacatgtatataaacgtgtgtatatattacatgtgtacatatcacacgtataatacatgtgtacatatcacatgtgtgtatatcacatgtataatgcatgtgaatatatcacatgtgtatatatcacatgtatatatgtgtatgtatatatatcacatgtatatatacacacatgcatatgtacgtgtgtatctatgtgtatatatatacacacatatatgttattttattttacattcaggagtacatatgcaggtttgttatataggtaaattgcatgtcacaggggtttggcatacggattatttcatcacccaggtaataaacatagtactcgatcagtagttttcaatcctcacccccattctaccttccaccctcacataggttcccgtgtctgttgttcccttctttgtgtccatatgtactcaatagaaacacttatattaagtgacatgttaatgtatgttctggaagaacacaccaaaaaataactaaattaaattttttaaaattttgcaattaaatattcttttacaattcaatgtgtgtatatatatatatatatatatatatatatatatatgataaataccagacacatttatagagctcttatgatcataaaatctcttatttatgaaggtatttctcattcacaaatctcattataaagttaaagataaattacttgaaatattaagcaagtatatttaacttcttttatttatagacagtttgtcccgttcaatagctggtctgtgttatgtgacttaatttataattttatatggctttgtcatgtcattaaatgcttttattaaatatgaaaagaaaaatgctgctcatttctaacttcaaataaatttttggcatctgctttaatccaagagcccgtttcacctcatggtttcctgattgtgttccattgttgcattataattagaaaaattatacatgggcaactaaatttaaacaccttggattaaaagggaaaaattaagaagagattgtgttataggcataatgacggcagtaacattaagggacacttgaccgaaaggcaataattcaagctacagtactagcattcaataagatgttggttaaatacagtaccttgttaattttgacgtatgaattctacttcatgaacgaccattttattaaccatttcaattagctaacataattagaataattcaataccatgaacacattaatcaaaataggttcttcaataaacatgtctagactttaatacgtcaaccataaattacaatattattttattttagtcctctaacaccaaagggccatattaaataaaagagtatcaaattaaacttaaaagatgtattttattttgctcatttatcattcagatataatagatgggcttttggctttcaaaattatccttcacgtttttctcattttaaatgcatgtccttttttctttataaagatgtttgtctctttatttgtggaaagagctaaagaaactattactataccagaaagacacacacagttccacaatgtcagagtcagggttaaaactcagtaaagtgtcacttgtgcggatgaggttaagggtaaggatggactcactaaatcttactctattcagagtggctgagtcttcaaattctctcttcaggtaactaaattttattgcatgcttgttaagtggcagttattgttctaatagaaggccttttacgtatatgtacttaatcttcactaaaatctcatgagatagaaactctaaaactttaaaattattatttccattaacagatgtgaaattattatttccattaacagatgtgaaaattgtttatagtaatggtttaaaacaattcttaccacaaattcacattttcttttactcttcccagctacaagttagagttggattatctacattacgaagagaggaaagtgattgtaaaactagactttatttcattcagcaaaggaaattcattggcagggtgagactagtcgagtgagtatttcattgaggtggttaagaaaagaaaaaggtgtgaacaaatgataaaaggtggaataagcttgatgaccttggaaaggtgtcctattgattgttcaggtgacaaatcaggtcatgtattatgtggtagtcacagattatataatttggttcttgtcaattctgtaaataattcattgtgtaacctatgaaaaactctccaagcctcagtttcttataaaataagatatagatatggctttaaatttttttcaattctctaatttttgttatatctgaagttaggctatcaaagataaaccacagccaatcactttcttaagtgtctaatgcatattttgcacaatgctatgaggaggaaaagaagaaagagagaaagaaagaagaaagagaaagaaagaagaaagaggaggagagagagaggggaaagaagaagtggggaggaaaaatcatattcttcagtttataatttagttgtcagaacaagagcaaacacatgtttaaaattttgtgaacaattccttcatggcaacaaaaaagacatggtgattttaaaatttatatttgttctaatagtcttaaccaggataaatgaccagaaagagagtaatggctattgcagtatgtaaagaagactagagtaggagttggaagatttggaacaaatcccaattttgttgtatcatccttatttagtgaaaatgttaataattattaagcatctgtcatgaattaggtaccttgctaactaactactttatatattttaataatccacaattgtagtgtgccagagttggagccttcaagttttagtgattaattgaaaagcacaacttatttcttcttgtgctatggactttttaatgagtcctcatattcagaaagccgtagaagtcaagtgggtagttacttaatgttggctaggcagttgatttactgagtctgcaatagatgctaactttccctggttgattgggagaaaaagtcaatggaaagtaacaaagaaagcttcattacatttctttgctattcatacaagctttcagtgctagtgaatgttttgtgcaattgctcaaagtattatattatttgggagcatggaaaatgttttcgtgtttacttgttgttttcctcaagaaaatttccagagctaggtataactcacaaaatcttttttcagtcttataaagaatgagaacacttgttaaatgtgccaacctccctttagcagaaacagctccattaagccagtatatttggcactttctcaatgcacgatgtgtgtgtggggtgtgtgtgtgtgtgtgtgtgtgtgtgtgttttagtttatgaaaccaatttaaatgctgcattcctaaaaagctggctatgatcctcaattttacagagaagaaaagacgttttgaaatcgtttaatataccaccaaatctgaatgccaatgagctacaatttaccagtaacatacattctttattaatattaccttcttttgctttcagaaggcatgtagggagaaggccataattagaatatatgtatatatatttatttatatttatatatatatgtatatatatttgccaatctagaatttctaatctccatacactttggcaactattggggaactaaaagatgtatcatggaaaaacaaattaaaatgttaaattcaaggacacagtgctttgaataaaagcctcagataatgtgaacttgataagctcatcagatataaatgaaagatctggcataaatgatagatttcgtgacttgggggactaaagaagttttaaaatgcatctaatactaagcactcttttggagaattaatgtaaaaactaaatcattgacctgtagaaattaggtaataacacttactattattgcacattatcaatttatgagatgttacattgtagtcctaaacattgaggctgaaacaaatcttaaaagccctcattattactttactctttgggtagatattattactggaagtatcatagaatgtcagacctagaaaggagtaaggaatggaactaatcctcttatttacataggaggaacatgtaaaggcaatacagttgtgattgtctgaggtcatgtgatttttgtctgtgtacatgggacttttacttgctcctttaaaggaatctcaatagcttataaatgtcaaaaggaaaaaccaatcatctctttacattagcacattttatttcatttactgatattattaagccaaatatttatattttaataccctagtaatgatatttatattttttcaaggaatttttttacattgttgcataagattttcatcatactttatgagtgcaagcacttttactattatatgtgagtcttattaatgttaattatttagaaatagagatgacacaaagagctaggtaacaaaacaataaataaattcaacagtaaaacattttgaaatgcaaatattttaaataaaaatttttaatgaataaaagtatgcatgttcttgaaataaatacttttattaaaaactcatcggttacatttccaaaatataaatctgataccaactatcaattttagtttataggcagtgaacattaaagctggattaacatcatgctgattttgtttttcattttctttttaattgaaaataaagtgtgccaccagtcaaggtgaataatgtctatagatttttcacctgtgttttgtggctgaatttatttacacccacattaactgattagctcctgccatgcagttccatattcatcaattatttatgaaaatgcctcattgtatttgtcatatatgtatcagtttgaatgacaagatggctcttctaatatgctggtattttactatagttaaaataatgagaaactggtaatttttttttaatgccatgaagataaaggtgtttaagtcctgttaagcagaattaaccaaaataagagctttcccaggtaaacacttggttttgtattttacctaattatctaaattcaactgtatgacacgtcctaattgaataacgatggtaatttctgtgatagagatgaaaagcacataaacttgttctgaagttcgcttaccatcatagcatatagacacgtaaacaaataatttcgatatagcttgataatcattaaaacctaacacttcttatttagcactttgtgtgccaactctgtttttaatagtttttcctaatttactccttccaacaacctttaagagtgggttctattactctccatttcacagaggagaaaacagcagcacagaaagcatatataacttgcctaaggtcacataattagatacctgtggagctgatatttgaaatcaaacagcctgagactcagaacaaaacagcagagtgttcagttgtagcagagggatggtgctgaattacagctgggaaaaaaatgaataagaatgtgctagttaagggctgcacagtggtggaaggaaacagggcaggcatgagaggaaggatgagaacagatacagagcattctgggatgagataagagacttagtgagggcaaagagctatgagactgtggctgcgtgtaaggaactaagcaggttcttcttacctcagccatatttctcaaagtgagtctccagactgtctgaagaaataagtgcttggatacattttgaaaatacagattcctagactgtgatagacctactgagacagaatctctgcagtgaattcccaaatgagaattttaatagagcacgtcagattatttattatacatcaaaagtttcagaagcctgcgcaagattgtaaagttcaagatgagaagtgtcagaagatgcctttgacttgtcttctttctgattatgttatttcacataacataaaaaaccaatatttcaaaatacatactaaatgtaaacaaagattaaaagcacctgagtaaaataagcaatctaacagacaaaaataaaccattctttgtccagatccttacttcatttatcctgtaaggaaattatttaaaaaaaaacaattcttacctacttttattgagacactacatttcccccgcccacaatcatttcagttcactatttttgctatccgcataaacctttagtgagtctttcaaaagatatgaccaagtccaaccctcattcatttaacataatgattctgaatcctattggcaaatagtgacctgagatactttttaataaaaggcgtatgaaaggagaacaattgatttgcaggtatttttccctgtatctactatgcaaaagtcttttcaccctatactctcaggaatacatgtataagaagtgtaatatccatagggagcttgaaatccagaaaggatataagacaggcccacacacacaaaatgtaataaagttaaaccattgtaagagcttcaaagaggtgcagataatgcataggagttcagcaaaatgcaattattacttaactgttgaaatcattagggaagttttcatggaggattgggcatttgaacttggttgtaaatgatggatggacttgtgatattaaggttaccaaacaagagcattttcaaatgcttaggtggagagatcattatgaatgaaagctagaaagctttcatagtaattgtggttaaagggattcttggaaaacagattacagttttttatcttgagagggacttaagtaggggtgataagaattaaaagagaagttgttctcactctgaggatactgaatgcaagcctacagagtaaggaatgtagtcagtgctctgtgtgtgacattgaactcctttagcaaaggaggaaaatgaataaccaagtttcagagagaactgacatctaggtgtgaaaagaactagagaggagagagactgagttacaggaactcttaagataaaatcgagcagacaaggaatatgatgtttcaaatccaatctgtagtgcaatatagagatgggaacctgggaatgatagagttggcaaagcattccccatttacaaattgatcttttccatgcatttcgtcattctttctttctctagaaagtgaattgttaactttgtcaatttctatgatataaatgatccaactatggtcaattttaaactaccaatgtaatgtattgaacctgaatttgggacatgttggcaggaagttttcctctgttaactgaggtctgacttgttagaggcttgtgaattaaccgacaatagacaggttaataggaggaaagtttattacacatgaaaaactagccagtagtgaggaactagaggttacggtttgtaaaccaactcaacaagagttgattggataatttgactcatgcctgtaattccagcactttgggaggctgaagtgggaggatggcttgagactaggagtttgagaacagcctgggcaacatagtgggactccatctctacaaataaaaaaattaaccagggtggtggtgtgcacctgtagtcccagctactcaggagactgaggtgggaggatcgcttgagctcaagaggttgagggtgcagtgagccatgatcccaccactgcactccagccggggcgaaagactgagaccctatctcaaaacaacaacaataacaacatccaagaaggaaggaaagaaagggcagcttagacttcaatgcaaaagtgtggaaggtccttgctgggtaccttggctcatgtctgtaatcctagcacttcaggaagtcgaggcaggtgagtcacttgaggccaggagttcaagaccaggctggcgaacatggcaaaatcccgtctctactaaaaatataaaacattactccagcgtggtggtacacgcctgtaatcccagctactcagaaggtcggggcatgagaatctcttgaacctgggaggtgaaggttacagtgagtcaggatcaagcaatgttaatgggcagttgaatcaattgaatttatacttccctgtgctagggttagacttcccccaaacagaaagttctctcaagacaaggtccatggcagctatattgtgggggaggttctgcttaagtttagaaaatgtctctctgtcgttgctgactattcagaagttttcagtttaaagtaatttttgtaccactttggtaggctgttaatcccttcaggaaaaaatgtacaaagtacactcaaagagcactggcaaagcagcttctgccttctgctgtatgaatctgccataatctgtatgtttgtatccgttcaaaattcatacattgaaatctaatcatcaatgtgatgatggtaggatgtgggacctttgaggggtgattcagttatgaggttggagccctaataaattagattagtgcccttataaataaaccctacagagctgcttatttccttccaccatgtgagcgcatagctagcaggcaccgtctatgagccagaaaatgggcccttaccagatattgaatctgccagtgcaatctgcttatgtctcaatcttttttttttttaattatactttaagttctagggtacatgtgtacgacatgcaggtttgttacatatgtatacatgtgccatgttggtgtgctgcacccattaactcgtcatttacattaggtatatctcctaatgctatccctccccactcccctcaccccacaacaggccccggtgtgtaatgttccccttcctgtgtccaagtgttctcattgctcaattcccacctatgagtgagaacatgtggtgtgtttggttttttgtccttgtgacatttgctgagaatgatggtttccagcttcatccgtgtccctacaaaggacatgaactcatccttttttatggctgcatagtattccatggtatatatgtgccacattttcttaattcagtctatcattgatggacatttgggttggttccaagtctttgctattgtgaatagtgccgcaataaacatacgtgtgcatgtgtctttatagcagcatgatttataatcctttgggtatatacccagtaatggaatggctgggtcaaatggtgtttctagttctcgatccttgaggaattgccacactgtcttccacaatggttgaactagtttacagtcccaccaacagtgtaaaagtgttcctatttctccacatcctctccagcacctgttgtttcctgactttttaatgattgccattctaactggtgtgagatggtatctcactgtgattttgatttgcatttctctgatgaccagtgatgatgagcatttgttcatgtgtctgttggctgcataaatgtctgcttttgagacgtgactgttcatatccttgcccaatttttgatggggttgtttttttcttttaatttgtttgagttctttgtatattctggttattagccctttgtcagatgagtagactgcaaaaattttctcccattctgtaggttgcctgttcactctgatggtagtttcttttgctgtgcagaagctctttagtttagttagatcccatttgtcaattttggcttttgttgccattgcttttggtgttttagacatgaagtccttgcccatgcctatgtcctgaatggtattgcctaggttttcttctagggtttttatggttttaggtttaacattgaagtctttaatccatcttgaattaatttttgtagaaggtataaggaaatgatccagtttcaggtttctacatatggctagccagttttcccagcaccatttattaaacagggaatcctttccccatttcttgtttttgtcaggtttgtcaaagatcagatggttgtagatgtgtggtattatttctgagggctctgttctgttccattagtctggatctctgttgtggtatcagtaccatgttgttttgcttactgtagccttatagtatagtttgatatcaggtagcgtgatgcctccagctttgttcttttggcttaggattgtcttggcaatgtgggctctttttttggttccgtatgaactttaaattagttttttccaattctgtgaggaaagtcatttgtagcttgatggggatggcattgaatctataaattaccttgggcagtatggccattttcacgatattgattcttcctacccatgagcatggaatgttcttccgtttgtttatgtcctcttttacttcattgagaagtggtttgtagttttccttcacatcctttgtaagttggattcctaggtattttattctctttgaagcaattgtgaatgggagttcactcatgatttggctctctgtttgtctgttattggtgtgtaagaacgcttatgatttttgcacattgattttgtatcctgagactttgctgaagttgcttatcagcttaaggagattttgggttgagacgatggggttttctaaatatacaatcatgtcatctgtaaacagggacaatttgacttcttcttttcctaattgaatatgctttatttctttctcctgcttgattgccctggccagaacttccaacgctacattgaataggagcggtgagagagggcacacctgccttgtgccagttttcaaagggaatgcttccagtttttgcccattcagtatgatattggctgtgggtttgtcataaatagctcttattattttgagatatgtcccatcaatatctattttattgggagtttttagcatgaagggctgttgaattttgtcaaaggtcttttctgcatccattgagataatcgtggtttttgtctttggttctgtttatatgctggattacgtttattggttttcatatgtttaaccagccttgcatcccagggatgaagcccacttgatcatggtggataagctttttgatgtgctgctggattcagtttgccagtattttattgaggattttttcatcgatgttcatcagggatattggtctaaaattctctttttttgttttgtccctgccaggctttggtatcaggatgatgctggcctcagaaaatgagttagggaggattccctccttttctattgattggaatcatttcagaaggaatggtaccagctcctccttgtaccactgctagaattcggctgtgaatctgtctggtcccgtactttttttgattggtaggttattaattattgactcaatttcagagcctgttattagtctattaacggattcaacttattcctggtttagtcttgggagggtgtatgtgtccagtaatttatccatttcttctagattttctagttcatttgtgtagaggtgtttatagtattctctgatggtagtttgtatttctgtgggatcattggcaatatcacctttatcattttttattgcgtctatttgattcttctctcttttcttctttattagtcttgctagcagtctatcaattttgttgatcttttcaaaaaaccagctcctggattcattaattttttgaagggttttttatgcctctatcgccttcagttctgctctgatcttagttatttcttgccttctgctagcttttgaatgtgtttgctcttgcttctctagttgttttaattgtgatgttagggtgtcaattttagatctttcctgctttctcttatgggcatttagtgctataaatttccctctacacacagcttttagtgtgtcccacatattctattatgctgtgtctttgttctcattggtttcaaagaacaactttatttctgccttcatttcgttatgtacccagtagttgttcaggagcagattgttcagtttccatgtagttgagaagttttgagtgactttcttaatcctgagttctagttttattgcactgtgttctgagagacagtttgttataatttctgttcttttccatttgctgaggagtgctttacttccaactatgtggtcaattttggaataagtgcagtgtgtggctgagaataatgtatattctgttgatttggggtggagagttctgtagatgtctattaggtccgcttgatgtagagctgagttcaattcctggatatccttgttaactttctgtctcgttgatctgtctaatgttgacagtggggtgttaaagtctcccattattattgtgtgggagtctaagtctctttgtaggtctctaaggacttcctttatgaatctgggtgctcctgtattgggttcatatgtatttaggatagttagctcttcttgttgaattaatccctttaccattgtgtaatgtccttctttgtctcttttgatctttgttggtttaaagtctgttttatcagagactaggattgcaacccccacttttttttgttttccatttgcttggtagatattcctccatccctttattttgagtctatgtgtgtctctgcatgtgagatgggtctcctgaatacagcacactgatgggtctttactctttatccaatttgccattctgtgtctttcaattggagcatttagcccatttccatttaaggttagtattgttatgtgtgaatttgatcctgtctttatgatgttaggtgtttattttgctcatcagttgatgcagtttcttccaagcatcgatggtctttaccatttggcatgtttttgcagtggctggtaccggttgttcctttccatatttagtgcttccttcaggagctcttttagggcaggcctggtgatgacaaaatctctcagcatttgcttgtgtgtaaaggattttatttctccttcacttatgaagcttagtttggctggatatgaaattctgggttgaaaattcttttcttttagaatgttgaatattggcccctactctcttctggcatgtagagtttctgccgagatatcagctgttagtctgttgggcttccctttgtgggtaacccgacctttctctctggctgcccttaacattttttccttcatttcaactttggtgaatctgacaattatgtggcttgaagttgctcttctcgaggagtatctttgtggcgttctctgcatttcctgaatttgaatgttggcctgccttgctaggttggggaagttctcttggataatatcctgcagagtgttttccaagttggttccattctccccatcactttcaggtataccaatcagacctagatttggtcttttcacatagtcccatatttcttggaggctttgttcatttctttttgctctttattctttgaacttctcttctcacttcatttcattcatttgatctttaatcactgataccatttcttccagttgattgaattcgctactgaagcttgtgcatttgtcacgtagttctcatggcatggttttcagctccatcaggtcatataaggacttctctacactggttattcttgttagccattcatctaatcttttttcaaggtttttagcttcttttaatgggttcgaacttccttctgtagcttggagaagtttgatcatcttaagccttcttttctcaactcgtcaaagtcattctccatccagctttgttccactgctggtgaggagctgtgttcctttggagggagagaggtgctttgatttttagaattttcagcttttttgctctgttttttccccatctttgtggttttatctagctttggtctttgatgatcatgacataaagatggggttttggtgtggatgtccttgctgtttgttagttttccttctaacagtcaggaccctcagctgcaggtctgttggagtttgctggaagtccactccagaccctgtttgcctgggtatcagcaacagaggctgcagaacagcaaatattgctgaacagcaaatgttgctgtctgattgttcctgtggaagcttcatctcagagaggtacccggccatgtgagttgtcagtctccccctactgggggttgcctcccagttaggctattcgggggtcagggacccacttgaggaggcagtctgtccattctcagatctcaaattccatgctgggagaactactactctcttcaaaggtgtcagacagggacatttatgtctgcagaggtttctgctgccttttgtttggctatgcccggcccccagaggtggagtctacagaggcaggcaggcttccttgagctgtggtggtctccacccagtttgagcttcctggctgctttgtttacctactcaagcctcagcaatggtgggcgcccctcccccagtctcactgcctcctttgcagttggatctcaggctgctgtgctagcaatgagcgaggctccatggtcgtgggaccctccgagccaggctcagaatataatctcctggtgtgctgtttgctaagaccattggaaaatcacagtattagggtgggagtgacacaattttccaggtgccgtctgtcacagcttccctttgctaggaaagggaattccctgaccccttgcacttccggggtcaggcgatgccttgccctgcttcagcttacgcttgttggactgcacccactgtcctgcacccactgtctgacaagccccagtgagatgaacctggtacctcagttggaaatgcagaaatcgcccatcttctgggtcgctcatgttgggagctgtagactggagctgttcctattcagccatcttggaaccactccctatgtctcaatcttaaacttcccagcctccacaactgtgagaaataaatttccgttgtttaaaagttacctagtttatggtatcttgttgtaacaaccctaatggactaagactgaaaaccacctaaaaattgccctttcacatggtgaattaaattatttaaaaacaaacaaagtggcctggcatggtggctcacacctgtaatcccagcacttttggaggttaaggcgggaggatctcttaagccccaaagttgaagtctgcagtgagctgtgattgtgctgctgcactccagcctaggtgacagtgagaccctgtctctaaaaagtcaattaattaattaaaattaagattaaaacaaataaaaccacaacaaaagttaaagataatcttaatagcagagatttttgcaaaataggagagaggatgccttcagtaattaggattcagctgttagggctagagagattctggtgaatactacaggttttcttgagagcttgagagaatttggacaaggaaaaattacagaaaatgaagtaaaccgttgattatccccctaaagtttagaacatatgctatacagcaaaacaaaatttgcacattgtgtgtaaagttgaagtatattctttctgtttattctgctcattcccttatgtagtttttattgtaaattgattagcttgtcctgggtatgtttgccacaggatatgctaaaccatttgtcctttttgagagggtttgtgaaagaatgagtttgatgaagtcatgacttccaagtagcataagctcaatagtggatttttaaaagccatacccatcatgttatgaagcttagagaagaggcaggtgtccatcttattcctccttataatttcctaaccactgtcttttcctgctcccctcataatttttggcaggaagcccatgccatcagactgtatcacttgctacccctcttcattgtagtcttcatcccaaccccagcacactcttgtctattctttgaagattatagtcctcactcatgttcattatttccaatgttgcttctaaaatagtccatgtttagacacatagcttatctttgtctcaccttggattttagctccttgaactgttttttttttcaataatcttgttctcaatcctatctccgccagtgtagtcattcacagtgcacctctactgtgatgtccatttggaatttcaaacttaacttgaacaagctgaattactggactttacacttcaaatgtgtacatgtgtaccttttgccatcttccctatcccattaaattcctacagaatctgtttacccagacaacaccttggaaatcattctgccttctcttttctctcatagcccatatccaaactatgaggaaattctgtcatttctaccttaaaaaaaaaatatatatatatatatataatattcaaacagtttttactacttccactgctaaaaactttgtccaaacatccattatctctcaaactgttataatcactttggagtggtctttcagcttccacactcacccttctacagtgtctttgtaatggtgcatttgccatattttattcatcacaagtgcactgtgaaatccagcccacactcaaggatgacatgagagtgcaaatacaaggaggtagggatcatttgtgaacatgctagaagccacctacctcaggcagcacagctagttgtaacgagtaggcctcactctcagaatttaaagctggaagcatcctagcactctgtagcagatgcagaacacagctttcggtttacaagctgccaatattatcctacctactgaacttaaaaagccccagaatggaaagatactctttcctttcatttcagtgctctatcagccaaatctgtcaatgaaaaatggatctgtgtagttcaaggtcaaccagcagcagtttgcacctcctgaggctctgtgttttagctaaagctacctgtggtctttgtcttttctgatgttgttggacccagaggctttgctgagacacattcatctcacaagccatcatttcagtctcacaagactatataaaaatagcgtcatgcctgagggaaaagcctccataagcttcagacaaccttccaggttaaaccttcttatgatctgaggcttaatgttctcgctcagaccttagcagtaaaaagccaactgtacaactgctgagcagaacacacgttctctgcatgtgatcctgctagcaaaagaggaataagcagaaccaaaaacactgagttcattcaccccaaatttattagcaagaaaagtaatatttctttgctagggagaaaggctgggagtgtaacactagtagagcttctggtaccgggaatgaggaatgaggaataagtgttcctacccatcctcagaacttccaaatattttctttgttttataattttatgatgttttctttaatatgtaaaaaaatcaacatagtcacttaggtcagtctttgtctttattatttatttatgtttatgttcagagaagccctccttgttctattgtaactgaaaggtaatttttacttacattttcttcaagtggttcttgtgggctgatttatatttagtattttaatccagttatagtttactataatgcaatttaaggatctgattttttcccctaaaagttaacgaattggtaaatcacaacctattaaatatcctgatcaatttctctttgccagttgaagatatgatacatttagaaccctcaaactcctcaagtggtagtaaaaattaaggcattagctttggagggaaattgataatatatgtgaagctattcaattgtgtgcatagcctttaactgagactttataactctacaagtgcatttaaagaaatattcacatatctgtcttaagaatgtcatcacaacattatacagaaaaaatggaaatacaaaatatctaatgacaggattaatgaagttatttttatatgatggaaatttattcattccatataatgtaaacttaagaaaaatatttgatgtaagaaaaatcctgagaatatagctaggtgcaaagtttagatagaaattattatatacattaatgatgcattaatgattatattatgttttaaaatttttatctatttctcttcaacttttactttgagttcaggggtacatgtgcagggtgtgcaggtttgttataggtaaatgtgtgccatggtggtttgttgcacagagcatcccatcacctaggtattaagcccaggatccattagctattcttcctgatactctcttcccgctcaaaccccctccaacaggtcccagtgtgtgttgttttcccctatatgtccatgtgttctcatcatttaggtcccacttaaaagtgagaatatacagtatttggttttctgttccttcactagtttgctgaggataatggctttcaactccatccatgtccatgtaaagggcatgatcccgttcttttttatggctgcatagtatattatggtgtatatgtatcacattttctttattcagtctatcattgatgggcatttaggttgattccatgtctttgctattgtgaatagtgctgcagtgaacatatgcatgcatgtatctttataatagaatgatttatatttctttgggtatatacccagtaatgggattgctggttcaaattatatttctgcctctaggtctttgaggaattaccacattgtcttccacaatggtagaactaatttacacttccaccaacagtgtaaaaacattcctttttctctgcaaccttgccagcatctgttttttttttttttttgactttttaataaccattctgactggtgtgagatggtatctcatagtggttttgatttgcatttctctagtgatcagtgatgttgagcttttttgtttgtttgttggctgcatgtatgtcttcttttgagaagtgtctatgcaagtcctttgcctgctttttaatgggattgtttgttttcttcttgtaaatttgtttaagttccttctagactctggatattagacctttgtccctttgtcagatggatagattgcaaaaagtttctcccattctctaggttgtcacttcattctagtgatagttttttgttgttgttgttgttttttgttttgttttgttttttgctgtgcagcagttctttagtttaattacatctcattggtcaatttttgcttttgctgaaattgcttttggtatttttatcatgaaatctttgctcatgcctatgtcctgaatggtattgaccagattttcttctagagcttttatagttttgggttttatatgtaagtctttaattcctctggagttaatttttgtatatggtgtaaggaagaggtacagtttcaattttctgcatatggctagccagttctcccagcaccatttattaagtagggagtcctttccccattacttgtttttgtcagctttgttgaagatcagatagttgtacatgtgtgatcttatttttgagttctctcttctgcttcattggtctatgtgtctgttcttgtatcagtaccatgctgatttgattacttaagccttgtagtatgatttaaagtcaggtagcatgatgccttcagctttgttctttttgcttaggattgtcttggctatttatgctcttttttggttccattggaattataaactgtttttttcttgttctgcaaggaatgtcaacatggtttaatgggaatagcattgaatgtataaactacttttgggaagtatggtcattcagatgatactgattcttcttatccgtgagcatgaaaggtttatctatttctttgtgtcctctctgatttctttgagcagtgatttgtagttctccttgaagatatccttcacttcccttgttagctgtattcctaggaattttattctttttgtagcaattgtaaatgtgaattcattcatgatttggctccctgcttgcctgttgttagtatataggaatgctagtgatttttacacattgattttgtatcctgagactttgctgaaattgtgtattagcttaagaagctttagtgctgatatggttgggttttctagatatagtgtcatgttatctgtaagcaaagataatttgacttcctataatcctacttgaatatgctttatatctttctcttgcctgattgtcctggccagaacttccaatactgtgttgaataggagctgtgagagagggtatctttgtcttgtgccagttttcaagaggaatgcttccagcttttgcccatttagtatgatattggctgtggatttgtcatatgtggcttttattattttgaggtatgttcattcaatacttagtttattaagagtttttaaacatgaagagatgttgaattttattgaaggccttttctgcacctattgagataatcatgcggctttcacttttgttctgtttatgtgtcaaatgagaattactgatttgcttattttgaaccaaccatgcatcccagggatgcagccacttgatcatggtggataaacgttttgatgtcctgctggatttttttttttttgtcagtattttattgaggatctttgcattgatgtccatcaaggatactggcctgaagtttttttgttgttgtatctctgccaggtttggggatgatgctggcctcatagaatgaactagggagaagtagtcccttctttttaatttcttggtatagtttcaatagaaatggtaaaagcttttctttgtacctctggtagaattcagctgtgaatctgtctggtcatgggctttttttgtatttctgttgggtcagtggtaatatccccattgtttctgactgtggatatttgaatcttacttcttttctttattagtctagctagtggtctatctatgctattaatttttttcaaaaaagtagctcttggatttgttgatttttttgaagtgtttgtcacagtctgcttcagtgcagctctgattttggttatttcttgtcttccgctagttttgatatttatttgctcttggttctctagttcttttacttgtgatattaggtttttaacttgagatatttataactttttgatgtggacatttagggttacaaatttccttcttaacactgccttagctatgtcccagagattctggtatgttgtatccttgttctcattcatttcaaaggacttcttgatttcttccttaattttattatttacccgaaagtcattcaggagcaagtttctgaattttgatgtaattgtatagttttgagtgaatttcttagttttgatttctagtttgggctgtggttcaatagtttttttatgatttaaaatcttttgcatttgctgaggcgtgttttacttctaattttgtgatcaattttagagtatgtgtcatgtgacaatgagaagaatgtatacactgttgttttggggtggagagttctgtagatatccgtcaggtccacttaatccagagctgagttcaggtcctgaatatttttgttaattttctatctcggtgatctgcctaatattgttattggggcattaaagtctcccattattattgtgtgagagttgaagtctttttgtaggtctctaggaacttgctttatgaatctgggtgctcctgtattgagtgtatatatatttaggatagttagcacttcttgtcgaattgaactctttaccattatataatgtccttcgtctcttttttttttttttaatcattgttggtttaaattctgttttgtcagatagtaggattgcaacccctgcttttttcttttttccatttccttggtaaattttcctccatcccttaattttgagcctatgtttgtctttgcacatgagatggatcttttcaagaagcacaccgatgggtcttttttctttatctagcttgccattctgtgtcttttaattggggcatttagcccattgacattcaaggttaataccgttatgtgtgaatttgatcccgtcataatgatgctagctggttattttgcagacttgtttaggtggtagcttcttagtgtcactggtgtgtgtacttcagtgtgtttttgtagtggctggtaacagtttttcccttccctatcacgtgcttccttcaggagctcttgcaaggcaggcctggtagtgatgaattccctaagcatttgtttgtttgaaaatgatcttatttctctttcacttatgaaccttagtttggccagatataaaattctatgttggaaatttttttccttaaggatgctgaatattggcccccactctcttctggcttgtaggctttccactgagaggtccacttttagtctgatgggcttccctttctaggtgaactggcctttctctctggctgcccttaacctatttttttttatttcaatcttagagagtctgatggctatgtgtcttggggttaaacttcttgtgaagtatcttactggggttctctgcattttctgaatttgaatgttggcctgtcttgcttggttggggaagttcttctggatgatatcctggagtatgttttccagcttcattccattctccccatctttttcaggtgccccaatcagtcgtaggttcagtctctacataatcccatatttcttggaggttttgttcatttattttcattcttttttctttattcttgtcttcctgtcttatttcaaaaagatagtgttcaagctctgaaattctttcctatgcttgatctattctgctacctgtgattgaattgtgaagttcttgtgttgtgtttttcagctccatcagacatttctctctaagtccttctaagtctctttcagtcccagtatgagaacctggaaatttcagttgaaaacgttgaattcattcgccccttttcattcctctctgtgagtgccatggaccgcagctgcttctattcggccatcttggatcttttcctttcaaatctttaaatatctacttttaaatatctaaaaatatatattttatttgtgattgtctttgaatagttggaattttgttcctttttctatctatttattcgtttattcctttttctagtttgtacttttaatacttgcttgtctcccctaatgaacttaaggtaattggaggcaaagattttttcttattaagcacacattatagtatcttgttcattataggttctcaagactgtcagttaaatgtcgttaataaaactagaaaacaattctgactggttggacactgctgaacataccaagaatatttaataagataaatgaactgagggatatgaagattcaagtcatagaccaaaacataaagaggccttgccacaattggttcagatccccctacatagataaggggtcagagacagaatttctttccctgggaaaaattgtgggttaaaatagggactcagcctccaagtatctatatagcaccttgggggaatgctacaaggacttaaaggttcaaataaatatatgaactcctagaattttgacataaagttagaaactgcagttttctaaaatcgaagcaaacaagagcaagataaaaccaataagcttagttattgttgcagtaaccaataccactatcaataaaaataagctggttttaaaaatattactaataaaattaggtatttatcttctcaattacactgcagtgtatctggcatgaaatagttgtattttctatagtagatttttttgtaaataaatgagctagtatgaatggtagtcattgtggtgatgctctaacactgttcaaatgagaaagtgccctgattctgaatgatttatatttatttatatatttaccataacttgatgttagcatcttttgagaggatccagttattgcttcctacctttatatgaaacaaagaacctttaggtctgtagtgtggtttctgagtgattctgttcaccaaaagcaaagaactttataaatagattaccaataattcttatgctaagtttagtttccattattagttaatatgttggccagtatctgacaaagtacagttcattattcagttaattttgaatcatccccacaaaacctactcgtccctatgtgaattgatgtagtttaatttctgaaccttccaaactaaggaccaatttctgatttcttctgtgagattcactctgaagggatgagctgggttattgccttgccatagcctagtaatttgggttattctagggtttggtcacagctttgatttagctttcagttagtgactaaacactaaagcaagagattagtaattggaattgtatcacaagatcagagtagagctaagagcaaagctaagtcaacactgagacaatcatctcttgggatattatatctcccagctgtcttagattattgataccaggaggaaagaggatttaaaaagctgctttctgtcctctctgtgatttcaggagggtgaaccagagcttttgtttaccttcggatctgtactaaaagccttttcaagtagagaatatatggtgaggcagtgggaaaatactcactcttaagccttatgtggatgtgtatactggtagaatctctatgcaggacaattttgtaatattattcaaaattacatttgaatgtatctttcagcccagtaatttcacatctcaaaatatatcttataggtaaatttgcagaaaatataagattattcacttcagctctgtttgtaatgcaaaagagaatataacactagttaactacattataatatacccataaaatgtaatactatatagtattgatatacagtcataacaaatagtaggggaacccattatacataaatatatggtaaaacagcaagtttaataataatatatatattaccctatatgtataaaaataaataactgtatataaatatttgtgtatatttttctatttttaaccatataacatctgtagaaggttatataatacattgctaaaattggtggcctctggatggctggtcactagtggtaaaagaaagacattatttctggaaaaatatgttgtactttttgaattttggactatgtgaatatgttatccaaattaaaaatatgtacaaaaatttttaaaaagtagtaaatacttttatatccaggcatttttgtgataaagtcttatgatgttcccaattcaaaaatatataacctaagctccaaaaatgtagaaagtaataaactaacttgctattatataaatattgttaactttccagcctagaataaagtggtatcatggctgtctacttttgttagccaattctaaattttagattttataacttgaaacttctcaatcatagtgcttattcccatacagttatgtgctgtataattataatactgtatttttactataacttttctatgtttagatatggttggatacacaaataccattgtgtttcagttgcctacaatattcagtacagtaacatgctgtacagacttgtagcctgagagcaatacgctaaaccatattgcctagatgtgtagtagactaagctatctaggtttgtatacgtacactctgtaatgtttgcacagtgacaaaagcacctaacgatgcatttcttagaatttctcttcatcattaagcaacacatgtctatatgagacataatgcttacatattagacacactgttttgtgaaaattatttgtccatgtagagctggattatcaatataccaaagattcccttggaacttagtgtatttcttgccatttcctagattgactcagtgttggatttgctcctaaggatgttccatctacttggtgacttcagtcaattcagacagaaacacgttcttatgacctctggtgtgttagctgaatgagagcatctacttttcaaaattccaccacaattcccagatttgagctttgtttaaataatgcggcttctgtgccattttgtgactggcaggaaatgttgattaggccttgattatatgctcacatctattttaagggttttggaccagcagtattcaaagcaaatggattgaaagtttaggagaactcactccccaatggaaaaccagaatgttaacaagtgaaatgaactggatgctaggaaggcaaaaacagcagctataaactctaagaatatattataaagaaaaaagcttgcattttcacttggaggaaacaagaccagtaaaagatgtgaccggaatggaaaaggttgttgaaccagactaaagtacaaggggtagtccagatttagagattaaactcaatttcctatcgctcttgttttggtttactgctaaaacaacaaacactgaggcatggaatatgcaccacttagagaatgaagtagtggaatcagccttgttcctctgagaggagtgcctgtaattcagaagtcagcaccctggattggaggagtccaggcctcttggcttcttgccttttgcaggtataactagtgaaggacacacattagacactgaaaatctacccactaatatgtatgtgtgtttatatatatatatacacatatatatatatacacacatatatagtgtatatatatgtgtgtatatatatatatgtgtatatatatgagagatgtttttctgtgtcacaattaggtattctgtattccctttcttactaagttcttgggccaacagcaagcttaaccaggtcttaccaatgggaacaatcatggcaaaacttaaagtctaagagcagggaagtttaatgtgtactcaatactttttgaatggctgaataaatgactgaattttcacagaaagttgacacgtctaaaaaaagaaatatatttttaagaaaaataacccatttatactatagaaatcaaaattatcttatgtgctttatcagtgataacaccattattaaagcagcagtatactaaaccatgtgtatatattttctgtgtaattttacaactatgagaatacatcctaaaattagttaacacatttaaaagggggaaatttaattttattaggtctagaggatcattatagaatttaccctaatggcttaaaaaagttaaaatatttcacctacacttaaatctttttgtgtactcagaagatttcagcccaattgatcatgtttcacttcaagaaatccttataaataaactttaatcccataggacagatccattaattatgctttcaggggaggcataattaatggatctgtactatggaattatagcattcagtaaatattaataatgaaaactcattctaccaagcaccttaatagtacccaaacaaatagatcattttatatggctgaagctttccttcagcattcccatatggaacatgaaagtatgcaaaacaatttaacatcagcttttctgggagaacttaatagattaaagattctctgatggagagattttgcatctcaataaaatgatctgtcaaaatttactttgatgaaagttttaaaagctctgataaaaactcagaggctatgagtaaataactattatgtattataacaataaatagcctggttatattgctaatgaagaatttttaaaataaacttttaattggggaatagttttatatttacagaaaatatgcagagacagtacagacgagtcccataaactcctgagtttctcctactgttatcatccaacctcagcagagtacatttctcacaacttaaaaaaccatcattggtgcattactattaactcaactggtcaatgtatttggattttaacagttttccttaatgtcctttttgttattcccgagtcacattcaggatactttattacagggctcctcaacttcctggccacggaccactggtccgtggcctgttggaactgagccacactgcaggaggtgagcggagggcgagtgagctaagcttcagctgtgcttacagctgctccgcatcattgccattaccaactgagctccacctgcctttcagatcagctgcggcattagagacccttaggagcgctaaccctagtgtgaactgcgcatgcgaggtttgaatgctccttatgagattctaatgcctgatgctgtgtcacattctcccatccctcccaagatgggacatctagttgcaggaaaacaggatcagggctcctactgattccacattatggtgagttgtataattatttgattatatgttacaatgtagtaataatagaaataacgtgcacaataaatgtacttgaatcatccctaaatcatccccctcccactttgtggaaaaattgttttccatgaaaacggtccctcatgccaaaaaggttgaagaccattgctttattattgttgttcgccatgctttctcagtgaaagtttctcacacttttcttgttaagcactgattaggtttttgcagaacattcctcagtttagatttgtctgatatttttctcatgattagactgtggccattggtttgagggtagaagaccatagatgtgaaggatccctctcttcacattatacaacgttcatgctgtctacataatgctacccttgatcacttggttgaggtagtgtgtgctgggtttctccactgtaaagttacattttccttttttcatacattacactttggaagaaagtcattcagtgtagcctgagggtgggaatagggtgttaagtttcatctcttgaagagaactagctaaatgaattatttggaattcttctgaaaaaggatttgtctcgtctatttatttgttgatttggaatttttctgaaaaaaatgggtctcttctcccgatttatttgctcattcttttaatactttgagttatactctgtagtatgttttttatgttgttgttcgaattgttccagctttggcatttgggagttctttcgtgttgagttctttgttctttgtctctttggcatacccctgttcttttgttttttgagtacttccttgctttatggtaccacaggatgctccagaatcatcttgtgcctcttgtaaatttcttgtcccattctggacttggaattagccatttctcctaggagccctggtttgttttttagaaaaaaaaaattaaaaaaaaacacaagacctaggcactgggtgttagtaaggatattttatttaataaaattaccacattttccacagaatcagaagaaaaacataagacttatacaataaaatatttataatacttgtaaaagattctttcattttcatggattaaaaattaactccctaacttatgaatcagttaactgtatttcaaaaataaatttaaattttaaattttatattttgtttgtttgtttttgcatttgcaagatttaatagagtgaaaacggagctcccatacaaagggaggggatccaaagagggtaacctaaattttatattgttagatacacacggctgacttggaaattgtatatacagaacattgacagtactaagtgacaaatagtttgtgaatcaattgagagttcttcctttcttcatatcaaaatgaagaagataatactatgtttcccaatgctattaaaatgagtacatgtttgtatttatcaataataaatataatagtagcagttatgagaagatgtaacactcaaaatatcaactttattttctgattattaatagtgcctcttattcttcaatttctctgcttttttagtgacagaatattgagtgaggaatgaaatcgcttgtcaattaaggaaattgtcttctaaaaacaacagcaataaagaaatgaaagagttttttaataattaggcaagtagaaaggattctagagagcaatattcataaaaagaaggtgatattaaccagaatatttataatatgctcagtaaattcttgtctagattttattattgaacctaaggatgacacttaggagaaaaatgaaagagaacatagtctacattaaatagaaatagaaagggagaggtgaccaatttgtgcaaaataacattttaatggtaggtaaaatgttaggttcatattatttatctgtgctagtgtttgaaagaagcagtttgtctgttggacttacaaccaaaaaccaggttaagaacacttgttagaataggcttcttatgacaggaatgtctattgtgtctccaatggattaaaaaaaaattcatgagaattaaggagatttattctgttgagatatttgctgcttttagaaaatagctcttctatgttcccataggattcactttcacattattatgaaccaatcacttgtaaaatctctgaaatatatcaaaagcagatgaagccataattctgacagaacattttatgaagaaagttgtggattaacaaaaaccattagcttttaaaaacatcaaatgtaacttaagtattttatttagatattaaattgtatcagtattgctattgttgaatgaaagagtaaatggattaaaatatgaaatatggataagacttatcttcaaaaggtttacgatactatttgatctaaaagaataagcaaattggaatgatacctaaattacagatcactgaaaagcaaatgggaaaacaataggataaacatgaaaatatgtatttctcaacttgataactaagtacagtttatcagctgttgtcatacgagattgatttgtttttttaaaatatttatctcaatatttcctcagaacagtaaaattaaggtgtcacactttaagattgatttgaaaattatagctagaacacaattttctcttagaatgacattcaaagaatcagtgttacataatgtaaaatttggagtctgctttttactaccctttgatttatatgttaatttctggaaagttgtgggagacctcaatctttaaagtttaccatgaaccttgactttgcactcctcatgttcttataaaaattaaaccttcattggaaagactgtgatccaggcttttcaatttttacaaatgaatgtcatctatgtctcctaaatatatagtttttgagggtatgatactttaataagctatgcaggctgtccatactacaggtaaatatcgaataattcaactatgaacgaactgtgttctgtcacttgcttaaattcttgtgagaaatccaactttaagagatttagctcaagagtctttttttctgtgtttttcagcataaagcttcattcatgtcttacgttaacatcctgaggtaaattagttagcaataccagccttgtttctctattatgtcatataatcagagagcgagagtcagcaattcataatatttcctggattgatcaaataaatggcatagaactccggataaattttgaaattaaagtcaataactaactcacttcaattatctggtgcatgtattttcctacttcctttagtagattattgttcaatttttacctaatttccttctttagatatttttactcaatgcactgccttatatcaatttccaaaataggtgtggtatgtgttaaattaacattatgctgaatatcttggttcctgtgtttatagttcttatccttggtttctggactagggagtcataagtagtcccaacttaatggatatttaaaatatgtccagtttattgtacatttgaatacagtgaattgaaaataatccttgaatagaaagtctctaagaataagtagcggttgtagcacctatgctttgaatgcgttcttttgttgaaacttaagtgagtcaaacttgcctacttatatccttatctcacttgaggtgaattcattctttggttttaatcttcactgcaaaatttctgtgtgtttgcacatatatttagaaaccaagctgaaaatgtaggtatatattcttttcaatgttttcttttgttttatttgcatatgggagaatccctctgagagactgtgttaagaatataataaaatgacttctgttgctacctactattagtatatttttcttgcttttagaaaagtaaattaatgatgaacttctaactgatatatctttcttaggctaatctctcattaaagacgttttaattgattttatttttaaaagactagataaacagccattagcaacattccaggcattctcttacatttgtgtaaatcttttatccttaaatttttgtttagcagaataaaagaaaggtaaaatgtcaggggctatgaatttaggaatttaaaaaatttaatattttttcagtttgtaattgtatattatggcagattggtttacataatgaaaaaaatggttgcaatgatttaaatctttatagaagaaaaactgtaatacacgtttgaaaatcagtctgaaatacattgaaatagcaacataatgaattattacagatacagtttaatttaaaaaaggtaaaatataaattaagcaatgatgataataaataccaccctaacacaaaaaatggccattatatttgataaaatgcacttaaaatatacatggagagtgataatttgactaatttcccagataatcatttctgtataaggaatgatttattatataattatgattaaatctacgttaaatctgattttttacattcatattttacttattatttgtttattttaatgatttatttatttttctaaattatgaatagtcaaaatgactacaaaacaatcctaattaaattcaatttcactgtccttgcagagtgcagacatgagtccagcaagcagtaccacgtcacttcctgttagtcctcttactgaagagccagtgcctttcaaggtaaaaaacaaacaagaaagcattatttataaaaatattaggatagttaataaatagtttaaaatagtttatgtgtagatggtgaagtgaactgctttaatcttcaagggtctgatttcaaatcttaaaatcgtttttttgtgtgttccattgtcattctattgctaactaaaggtaaaggtttgaatgataattaatactttatgggacaattgtttgtcttacatgtaaatggtggagttttattgtaataggttgattcacatgaattagaggttttaaatattttgtttatagtaattatattaatataagtcataggggaaaaaggaaacattcagccctcatctagtggttaaattttcattagcaatgctaggttaccaataattaatgatgtaatccttttaaaataagagtcaaaatcaagagttgaaatatggaatcattccaccaaacatattgtatttaataaatattggagtaaatatgcaaataagtatgtggtatgactggtggcatttttttcactttgggaagctatatacataacaaatacgaagtcttgttttgccacttaagattagatgtttctatttaagccaaagcttgtagatcaactattttatgtttgtactggggtatttagatattattaggattattataaataaaaacaattcttaagagcctgaggaaaaaaacttaaaacgttgggatgatgtacttaagtgcactgatttcagtatagtttggtttaaagacgtgcacattttaagattatcacttttatgactgcaatattttaacatacaattattatgagagttttttatttttcatataaggaatgtatcttattcaattttatattgcttatacctagtacagttgctggcatggattttcatatattcaatattgctgtcttgttgaaatgataattatagaaggctatgaattcaaatgagagtatttagttttctaattatggacacttttttgcttaatgagagtcaaatatttgttagaaggccctttctatacctgctaattgttaaatactgaatgatattctgattacattatttattgaaacattttctttattattatacagataaatgagaaaataatactaatgctacaaagtttgatgttaccgttttatggtatatggaacaaatttactgaagaagcatatctttaacaagattttaattgaattctcaaaacttcgccagaaaccattttttctttttaatattttgacaatgattacagtctttgaaaattaatgtattttttaacagaggttaaaaaaggttagacatatttcagaatctgctgacataaagctaatataaatataattagtttctctaactggttctgagagatcaatagttttggggtaaatgtaaatggttctataagaaattaaaactttcaagtgcttataatatttagtattgtcttttgatggccaacatagttatagtgacttttaatttactccttttgtgaaaggaatattgcctatatcttttcaaaatatttaatcacctataaaattatcccactagtgtttataagtatctaaacttaaaaatcaaaattatgaaataaaactttatctgcttctttcatttttagcttataaattgtcattgtgtaaatgagtaatataatacttaatgttacataaacacaaaatatacagaactattttgaacagaatcttaacagtataaagcattgtaattccaaggatatgttgagaattatataacaaatagaagacatttaagttttcttataaccacattctgaaaaagtctaatattataattcagatgtataaaactttgattaaaattatgatatctgaatagctaggtaactagaaaataaaaggttgtctttttcacctattccccatgaatgtgacatgatatttcatgttagtattagattaatcctcttaacctcttagcttacttttctaagatacagtgatttcagcactcaaccccatcacaatccaccctaacattagaagagcaaagcttcttctaatattggtgggtgattgagggatttgattttcctttttcttctgggaagtaattagattactagaagaaatgtatttactccactttcttagtcagttttggaagcactcagaacagttggaggaagataccttgttttggctggtatgtttatcaaggtgcatacttttttttaagcattacctttagaatgacattcagattaagttgaattcaaccacatcatttgaaataaagacaaatggtaaattatttttataaaaaataaatacaaatactttcccactaatacccatgcctttattcttgaatgttagataagaaattggctattgttaggaatgtaccatagtaagatatattaaattaagtatggaaaaaaagatggcatcctagggactatcccaaggtaggttaaactttagagatacatgaatttaaaatggcagttcagtcttgtttgggatcaaatgtttattttttccaatatggcagcatttttcaactttgttagtattggagcccattctttcaattaattaaaaacgatctgccctgaaagatagtctaagccccacatacatactcacttctctattcccccacactatggttcagttcctgctaatctcaaatttactgtttaaaaaccattgctagagtggtttgattggtgtagctagcctttcaaaactgaggacatttcacacaaaaattcatccaactttgtcttaaacaattgaaaaatctggaaactttgtggatctcgttgtaagtagaactacttgataagagatgagaaggctttctccatctagacagggtacataaactccaggtcaccacagtcatcaccattcctactatattcatgccaggtgatgaatgcatttgactgtattctttcatagaagatagtgtataattcacaatcttccacatatactacacataataaactccagatttcctgggcagcctcttgatactgaggagtttctaggatgcttggttcaaaaagtttcttttataagaactgtcagattcttttacctttataaactattgttatgggcatctatttggaaacaaaaggcaaatgtataacctctagtttttgttgttttttaatagaatattcagcattatatcaactgtacacacatatggtctgacacatgccactgcatcattatagaagagccaaaggataaccaattttgcataggtaggaacaaaatgttatcaaacatcaacaacagaatcataaaagttcaagatcattaaagtgaaacattgctctgataaaagacagtggattgcttagccattaagttttttatagttttctgaggactaaacctgaacaaaattgatgttgttaattttaatgtgctcattctatccttttctatcttttccctctggcattctccctgatttcttgcaaacatctaatcacttcctatctcatctgcctgacatctccctttgttagccttggtaaaatgctccacactgaagatggcttcaagccactacatttcactgttctttagtaggatgaccctttcaatgttttgtacatatgcagttattagcagcctcagtccattcctggaactaacactcttgaagctaaagctggctcgttgctcctgaccctccataaaagtacaatttatcatgagccatgttctttttgctagtaatgttcatcagttttaaaatttatttgtacttcaatgaagcatgatggctacattttagtctcttttcctacttaagtaatattttttgattagatatgttaggaaatcatattatcctactgtactgtattatatttatcctgtgataaattcagcaggaaaaaaaaacttctattctattgttctttgaacttctgaagacttttgtagcttcaaaagtacacaaaggcattgaggaataccctccattcaccaatccttgatcaaaatttaaaacaaacctaattcattgcatttcttggcccattgactactgcttccctgggatgtttgcattcctggaatgcctagagggattgtcacagtacctggaatgcacaatggcaccaccctctccaaggtatggccacattcccaaggaactgacagtgtggcatttggttctttcctaggtctcttcttcttatgaaatccaaggttctctgacttcttttcctcatccctagttatttctctttagtctaaagaaactccaagcttctctcagagatgtttcttctctccttaaatcagccagggcactgataaaacaatatcaagaataagaacaagaaaaaactctttgatgtactttttaggaatagaattgtgtctgaagattcttctgccgtgacatgaacttaactttaatatgcacagagccactttgcttaagcaggggatagaagggaggaagtagataaataaattgtttcaaaaaatttttttgtaggctgggtgtagtggctcacccctctaattccagcactttgggaagctgaggcaggaggttcgcttgagctcaggaatttgagcccaaccttagcaatatagggagaccccctccctattatttaaaaacatatattctaccatgaaatactggtatgttaagcaataaaaatgatgcttaactttacgtgaccatagagcctggattcaggaattagtaatgtgtagtaacacacagtttgctccctattgtataaaatgaagtgtgtagaaaaaaagatgcagtaaatatagaattatcaatcttcaactctggggatggatcacactattttaagaaaaattttctgtagtttctataatgaccacttatttctatttttaaaacaatgtttatttttaataaagcagaaaagagaattgggggcattagaagcaatgcagtctaattaggaggctgtctgggaggatcaaaccccagttttgccactctctagctatgtgagaccttgagccagttattttgtgtccaaatatcttatttataaaatgacaacagcaactacttcttcattaggttcttataaggttaaacaagttaataaatgaaaagtgtctacaatagcacatagtaacccatatgtaactgttgattattatttttatagatgcaagatctccaagttcaatgcaagaaagtcttataaatactgtagggcagaaattttgccactgaactcctactactttattttcaaatatgaaagaaatatattttaaacataaattatttactttgatgaagattcaagtttaacatttattcctacaagtcatgctatttattttatacgcttgagtattcagttgagctcatatatcagattcctcttatgaaaaatgattaatggaaatgtttattaattttgagaaggagtaaatataatgaatttgtcttgagggaaaactggtaaatataatgaaacactacttggaaaaaatacataatagtttctgtaacaataagaacatatatatattggccgggcgcagtggctcacgcctgtaatcccagcactttgggaggctgaggcggttggatcacaaggtcaggggatcgagaccattctggctaacagggtgaaatcccgtctctactaaaaatacaaaaaaattagcctggcgtggttgtgggctcctgtagtcccagctactggggaggctgaggcaggagaatggcgtgaacccaggaggtggagcttgcagtgagcggagatagcaccactgcactccagcctgggctacagaccgagactccatctcaaaaaataaataaaaataaaataaaataaaataacaaaagaacatatagtatctttttatcaggcatacaccatagcaactttttcttttgttatccaaaccaccacagtaacgtaacctggtaacctcctaaaagcataccttccagtgaaggaatattatttaaccactttagaatactggggaaacacccattgtgaacaaagtgctgctgctgttttacttgtttatatattataacatcaacatagtgagtagtttcgatttatttcatctaaatatatcattatgtaaaagaatacatttggaaactctgaaagacagaagccaaattgtggcatgaccttcacaacatcatctgttgtgtatcctgcatagactcatttttgtgtgtgtatgagagagtttttattgttccttttcatttattgaatgtaatggtctctcttagtattagaaatcgcttttttaatgtatccctggaagagcccattatggtatatttctgcatttctggtcattttttactaagccatctatgcattcaaggatttgttgatgaatcaatttgtcaagtacctaccatgttcttagtaatattctaaggcattggtatgtcgatgtcaacaacacgaactaaatccctgcattaatggtgtttgggttcttgggagaagaaatagacaaccagcaaataaatatataaaatgtcaggtagggtgataaatgttatgatgaaaagtaaagcgcaatatgaaggatagaaagtggcactggagtgtgttggtgtttcaaaaaggatggctaaggaagaccactttgattatggaacattttagtagagaccataatgaagaaagggagaaagccactcatgtttttatgggaagaaacctgagaataacaactgcaaaagcaagagaatactcggtcttatcaggaatggcaaaacattgtgtttggagtagaatgaatgatgagacaagtaatacaagtttaggtcacagagaaatcttatcataaaaggtctagtatgtcatgataaagacttaagatcttatttcacatatgatgaaaagccattagagtgtttgttgaaaaaaagaatgacataatcagactattgttaaactattgctttggtttctgtgtagatataggcattactgagtcaaggctcctatagttgaaagattatgatggcttaaactggagtggtaaaagttgaggggataacaattgattgaatattgagtacattttgaatgtggggtcagcaggatttgttaatatattgtatgtagaatatcctaaaagaacaaaatcaaagatagtttctgatactaattttttaatgttttcctatttttaccctttaggtaactttctgatgttacaaatagatagcatgatacggagattagtaaaatcttatttgtttggttggcttaattgtgttagtagtgaggcagtaattgtgaaatggcagacgatgttggttttgcaggggataatattcaatcctacaagtaatactaatttctggtaatatattttatctgccagataactgaaagcacataggtaaaactaaacataatttgtggtggatgctgataaatcaataattatggtttagaaatatgattcattaatacataggtgaagaaataagcaggtaaaaataaaattctttgagggatagctgatgaattttgaatataaaccatacaataggtatatatttgaggaaccaatgtattttataaaaatcattttaaataaacatggcatcattgtggttctctaatgggaataaattttaagagggttctattatttatactatgtatatttaaagcaattatttttgattgatgtaatacaaaatgatagtttcactcatataattccaagtaataaaccatctcaaaacctgtcagtctaaaataataatttattattgatgtttatgattctgtaggtcgactagactcatctgggcagttcttgtgtgaggttttaaagtgggtacagtcagactgaggttgagaatggggtcatctgaaggctcaggtgaggtagactcccaggataattcctttattcacaagtctggtgttgcactgaaaacactgtacctattgggatttctctctctctctctctctctctctctctctctcactgctctattctacttctgcctccctctttctctcctcagcctctccatggactagcttgagctttctcacaacatgctggttttggataattagacttgttatatgatagttggcttcccctagggtgaatgttccacaggaaaagaaagggaaacatgtcagtctaattaggactagaccagaaatacacagcttcacctccacattgttctattgatttagcagttccagagtgtgtcgacagtccctaagactacccctacattcagagatttgtaagaagacacagaattcaacagagatcacactcgcctctaccagcaatgtgaacagaggacatgtatgtgatatttctgcccagtaaaggccagtagcaactcagcaccaaaggattttactgggggcttatcatgtaggaaccctgtacctagtgtatatccatattctaaactcccagaagaaatcaggtatttaacataaacattattgtacaaatattgtttgtacaaactacttagggacagtgagccaatcttatcatttatggaaatctttatatgtatgtaggactctggttaccagtcagtcaagttcttagataccaaccagtggctaatcttgcaagtgggcctttctaagcactatatattaatttgttctctatctccatcagtttaattattgtaatatttagctcccataaataagaacatgtgtaattttcttactttccttggcatatttcacttaccataatgacttccagctccatccctgttgttacaaatgatagcatctaattcttttttatggctgaatagtgttcattgtgtatatgtatcacattttcttaatccattcatctgttgatagtcacttggattatttgcaaatcttgactgctacgaatagtgctacagtaaacatgggagtgcagatatctcttcaatacactaatttcccttcttttgggaatatatctagcagtgggattgctggatcaaatggtacatctatttttagtttcgtgaggaacctccaagttgtactgcatagtaattgtacaaatttacattcccaccaacattgtatgaaggttcccttctcttcacatcctccaaagcatttgttattttgcctgccttttggataaacatcattttaacaaggatgagatgatatctctttgtagttttgatttgcatttctctgatgattagtgatgttgagcaccttttgatatatgtgtttcccatttgtatatattctttagataaatgtctattcagatgttttggccatttttaaattgcattgttaattttttgtcctatagagttgtttgagctccttatatattcttatgttaatcccttgttcagtgggtggttttcaaacattttctcccgttctgtgagtttctcttcactttattgtttcctttgttgtgcaaaagctttttaacttgatatgatcccatctatccaattttgctttggttgactgtggtttagggatattaagaaatccttgtctactccatggtcctggagagtttccctagtgttttcttttagtaatttgatagttacgtcttatatttaagtctctaatccattttgacttgatattttgtatatgatcagagataggggtctagtttcattcttctgcatatggatatctaggttttctggcatcatttattaaagagattttcctttccccgatgcatgtctaggcacttttgtcaaaaatgagttttctgtatatgtatagatttgtttctgggttctctattctgtcccattggtctgtgtgtctgtttttatgctagtaccctgctgtcttgtgtactatagctctgtaatatgatttcaagtcaggtaatgtgattcctccaattttgttctttttgctcaggatagctttggctattctgggtcttttgtgattccaaatttataaattttaggattgtttttaatatttttgtgaaaaacgtcaatttaatctatagattgctatttttatttttatttttattaatttaatttaattaattaatttatttattttgagatggaatctcgctttgtcgcccaggctggagtgaagtggtgcaatctccggtcactgcaagctctgcctcctgggttcttgccattctcctgcctctgcctctcaagtagctgggactacaggctcccaccaccacgcccggctaattttttgtatttttagtagagacggggtttcactgcgttagccaggatggtctcgatctcctgacctcgtgatctgcccgccttggcctccctaatctgtagatttctttggatagtatggacattttaacaatattgattcttccaatttatgaatctagaatatcttttcatttttgtatcctcttcaatttattttatcagtgttttatggttttcattgtagagagctttcatttatttggttaactcctaggtatttatttttgtttatagctattgtaaattggattactttcttgatattgcaattttcacaattttcaaatagattccgttgggatatagaaatgttaatgatttttgtatgttgatattgtatcctgcaactttactgaatttgtttttcaattctaataatttttttggtggagtctttaggtttttccacatataaggtcatatgacctgcaaacaagtataatgtggtttcttcctttccagtttggatggcttttatttctttcccttttctgattgctctagctaggacttccagcactatattgaataacagtggtgaaagggcatccttgttttgttccaaatcttagacgaaagactttcagattttccccatttagcataagctgtgggtctgtcatatatggcttatatggcttttattgttttgaggtatgtttcttctatactcagttttttagggtttttatcatgaaagagtgtggaattttatcaaatgctttttcagcatctattaaaataattatatgtttattgcccttcattctgttgacatggcatgtcatattaattgatttttgtatgttaaaccaggcttgtatctgtagaatgaattctacctggtcatgacgaatgatctttttaatgggttgttgaatgcagtttgctagtgtgttgttgagtatatttgcatcaatgttcatgagggatattgtcctgtagttttctgttttggatgggtctttgtttagttttggtatcaaggtaatattggcctcatagaatgactttggaagtattttctcctcttccacttttcagaatagcttgaggaggattgatactagttcttcaaatgtttgctaaaattcagcagtgaagccactgggtcctgggcttttctttgcttggagatgttttattacagcttcaacttcattacttattattggtctgttcagattttacatttcttcatggttcagtcttgatagattttatgtgtctcaaaatttatccatttcttctacattttctaatttattggcacatagttgctcatggtaactttaaatttatgtagtatcagttataatgtctcctttttcatctctgattttattggtatgggctttctctctgttttcttagtctggctaaaggtttattgatctgtattatttattttactaattttggttttgattgttcttttctagttctttaaaatgcattgttaggttgtttatttgaagtgtttctacttttttgaaataggtgcttataactataaatttccctcttagaaatgctttcactatagctcataggtttgggtatgttgtgttttcatgttcattggtttcaagcaatttttaaatttttttcttattttaatcattgagccactgatcactcagaagcatattgtttaattccatgaatttgtacagtttccaaaattcattgtgttgttgatttttcattttattctattgtggtcaaagaagataattgatataatctcatttaaacaaaattgtaagacttgttctgtggcctaacatatggtctatccttgagagttattcatgtgctgaggagaataatgtgtattctgaagcctttggatgaaaaatgttctgtaaatatctgttaggtccatttggcctgttgtccagattaagtccaatgtttctttgttgattttctgtctggatgatctgtccaatgctgaatgtggggtgttgaagtccccaagtattattgtattggagtcaatctctctctttagctctaataatatttactttataaatctgggtgctcttgtgttgggtgtgtatatatttacaatattgtatcctcttgctgaattgacctctttatcattatataatgaccttctttgtgtctttctatattttttgtcttgaaatctaccttttctgatataagtatagctagtcctgctcttgtttccatttgcaaggaatatctttttccatccctttattttcagtctatatttgtttttacaggtgaaatgtgtttcttgtaggaaacagattattaggtcattttttttatccattcagccactctatgactttcaattggagagtttatttcatttacattcaatgatattattaataagtaaggacttactcctacttactcctattttgttttctggttgttttttccttctttcctcccttgctattttcttttgtgtgaaggtaattttctctggtggtatgttctgatttcttgctttttatttttctttatctgctgtgggttttttgatatgaggttatcatgagatttgcaagtaacaacttataacccatttttttaaaaaataggtttaaaatgcaatgacaacatggattgcatgaacaaacaaacaagtacagagaaaactattaaaaaccctacactttaacttcatcctccaactttttaactttttactgtttgcatttatatcttatactaactatgtcttgaaaagttgttctagctattatttttgttacattcatcttttagtttttctacccaagttatgagtttatgtaccatagttacggtgttataatattctgtggttttctgtgtacttactattgccagtgagttttgtaacttcaagtgatttcttattgctcattaacatccttttctttcagattgaagaattctctttctttagcatttcttgtaggacaggtttggtgttaacaaaatccctcgtcttttgtttgactgagaacatctttatttctcctttatatatgaggatatctttgctggataaactattctaggatataggttttattccttcagcactctaaatatgtaatgccattatttcctggcctgtaaggtttccactgaaaaggctgctgccatatgaataggagctccattgtatgttgttcctttcttcttgctgctttttaggatcctttctttatccttgtccttttttagtttaattattaaatgtcttgagatagtcttctttgggttaaacctgcttggtgttctataaattttaggtacttaaatatttatatctttgtctaggtttgggaagtactatgttattgtccataccttaatttgtctctctacttcttctttaaggccaataatgcttagatttgccccatttagactattttctagattttgtaggtgtgcttcattctttttactttttatctcccctgactatgtattttcaaatagcctgtcttcaggcttattacttttttattctccttgatcagttcttctgagactctgatctgttcttcagtatttcaattgtatttttcagctctagaatttctgcttgattctttttaattatttccatctatttgttaaatttatgtgataggttctgattcctttccctttgttatcttgaatttcattgagtttccacaaaataactattttgaattctctgtttgaaagatcacatatctctgtttctcttcagcattggccactggagccatatttagtttctttggtgaggtcatgttttcctagatggtcttgatgcttgtggatattcatcagggtctggtgtctgggtattgaagagttaggtatttattgtagtctttgcagtctgggcttgtttttgaacccatccttcttaggaaggctttccaggtattcaaagggactttggtgctgtgatctaagtctttggtcactgcagccatatctgcattagaggacaccccaagctgagtaatgctgtcatcttgcagactcataggggtactgccttggttcttggctagggtcaggcgaatttttttttgctttaccatacagagattcttgttgttttctcttactttcccccaaacatagtctctcccactattttgggttgtcaagagctggggaagtgtgatacaagcacccctgttgccacctcactgggaccaagttgcattcaacccaaagccaacacagcactgtgtcttcccaaggcccactgtgacctcccaaggcccactatgaccaatgcctggctatcacctgtgttcactcaagaccaaaggctctacaatcagcatttggtgaatccagccaggcttgttttcttcccttcacggcactgagtttctctctccctgtagccaacactaccccaggcctagggtgagcaatgcctggctgctgtcgatgttcactcaaggccctgtgctctttcatcagcttatggtgaatgctcttgtcctgagtctctcctttcagagaagtgggctcctgtctggcccagggcaggtccagaaatgccatccaggagccagtgcctggaattcaggaccccaggagcttgtttgttgctcttccccactatggtggaactggtacaagcttcagtaaaaagtcccattttttccttcctctcttcttctaagcaggagactctacccatagccaccacagctgtgaatgtgctgggtcacacctgaagccagcatagctctgagtctcactcaaggcaagtggcaagtactgcctgcctgctactgctcattatttagagcccaagggctgtttagtcagcaggttatgcatcctgccaggactgggtccttccctttagggcagtgggttccctttggcccatggtatatctggagttgtcatccaggagctaggacctgaaaggggggcctcaggtctctgcctgttgccctattctattgtggctgttccaatacccaagttggaagacaaactcctctttactttccccctcctctccttaagcagagagaagtctctcccagagctgcaagctgtgctacctggagttgggggaggggtgatgcagaaactcccttggctgccccagcttgtgtctcattgggtcatgtgcatcttagcttcatgggctccaagtttagcaccaggacttgcccaggaattgcagtccttgtgggctagactgcatttcaagtttatttagtacccccaagctctttagcctgtggtagtggggcttactggaattcaggttccaattgctgggatgagtaattcacctctggctagggctaatctgaatgttccctccatgtcaccaactgagctctgccctgagtcactttccactgtgaccaggcagcactgtgttccaatgctaagttccacaattagtgcactgtacctccttgaagcacacagattctctctccacggcaggtggctgactactgctaggaataggggaagggtggtgtaggtaattcaaaactgtctttcttatcctcttcagtgcctctttactcgatatgatgttaaaaccaggtactgtaattacttacatgagttttggttcctatgaaggtgcttttttgtgtggacagttgttcaatttgttgttcctggttggggggaatgatttctggaggcttctattcagccatattgctccgccttcgtcactatatccctcaatgctattttaatttccgttaagtttggaaatttccattaaatgtcaccatatttaaattaacttcaaagaattatgttttttaaaagtattttacaaaataatggataaaaacactaaaagtaaattctaaattgagatatcaactaccaaacaagactttatatatatgtttatatattattatttggtgtcaatatttttttctcttggttcagtcaagataaatttagaataaatagtatacctattatttgactattgcagacagcattactgatggatgatgaatgctcacatagtaagaaaaatgagaattatatcctggtaagacaaataaaattatttttacataaattaaagtcaaaatgaattttgcttaatttgtgttaaaagatatgcaatatctcttagacatagtagacctctgggaaaaatatttcaagaggaaaacattagcaaatactttcatgttgtctattagcatcatattgctgttcaaattattctcacacactgtccaaatcatttcagaaaggttggtacaagataaagaacttgtcaacattaatacatactaaaaataatggcatacctcttcttccttctacagttcacacattcattttctgtcttaaatttaaatttcaattagtttttcattttttccaggttggtgtcttggatttctcctgttttggggttctttaagtagtactgatagaaaattttctttgtaaaatggcttattttaccatgccttcagatattgggtcatagtctgttttgcttactttaatcaaaggattcatttaagaaattttgtggacaccattttctgagcatctattaaaatattatcttggactattgaatttaaggtttcactttgtgtatcactgagttaaacagggccctggaaatctgaaggatatatacatttggattgctttccttaattggccaaagtgaggattctgtaggataagcttgaatactgcggtagagttcaggtacagaacatgggaagagttctgaattaatttgtatgtaaaggataggtgttgaactactgctagcaaaattttatagccaataaagggcttaattataaggaaggaaaaaaatatttatatgtttcttcaaacaaaaagaattttaagaaactgagtcattataacctcaatcttggtttgagaatccacttcagagtagattggcatcactgaaacattttttctgtcaaaagatgccagggcagttttatttgaaaacagttgaaaccaacatgtattcagttggatggtgttctgttcctgaacacctgttgctctcaataatttgaaaaaccttggtgtgagataatagcagaggtaacaatcacaccatcattcttgtgcacaccaatattaaggttttaaaatacgtgatatatacatcagatactgaatctggctgggaattcacactgttatatttttgatataatatcattatcaatgataatttaagcaactgatctcatgtatagcacttcagtgtttatttcttacttagtattatcatttcatataaactccattatactcatttttattgttttttacataatttcaaatattacttcacagtttacctataagtgtgaacacgttttttaaaataagaagttagtaacccaggtgaaattcaaagactatgatttactactaatgtgctcatttgagatagaccgtgaatatgagaagctatcatatatggattcagcatgagttcagtttatctggcaatagttccatctgttgtattttgaaattgcctactgtattagttcattctcacactgctttaaagaactacctgagactgagtaatttataaaggaaataggtttaattgactcatagttccatagaccatacaggaggcatgcctagataggcctcaggaaacttaaaatcatggcataagggtgaaggggaagcaagtatgtcttcaaatggcagaaggagagggagacagagagagagagagagagaaaagggggaagtgctacacacttccgagcaaccagattttgagagaactctgtcacgagaacagcagatggaagtctgtccccatgattgaatcactctcccaccaggctccttctccagcactggcaattacaattcaacatgagatttgggtggggaaacagagccaaaccatatcatctacttaaataaccattgaattttagaggttgaatcatatcaatatgcatgctatagactgaagatttatgttctctgaaaattcaccttgagatttttacctccaatgtgacaatattaggaagtcgagcctattactatgattaggtcctcagtataaagcccttatgaatgttattagtgcccttataaaacaggtctcagaaaatgctctcatcccttccaacatgtgagcactcagagggaagattgctgtctgtgaaccagaaagccctcactagcccctgaatctgctgacaccttgattttggacttcccagcctctagaattgaaaaaaataactttcaattgtttagaagccacccagttaatggtaccatgttgtatcaaataaaatgtaataaggaattaaatgcaattaattttgccatgcatgaaattctttggaaatgactgttttccttggtgactctatagtgctaaaataatattagacttaagtgttttataatgatattgggcttatgttgttattttttgtttcgtaaaatgtgtaattcaactactgtttttattgtaccatgtggatgcattaagtagccatgctgacagatgcaataaaatgagtaaaataaacaaatattttgatttttttaagatataaatttagcctttttttcactgcagttttcataccacacataagtaatttggcagatattctattatttattgttatttccttaggaaaaattggcatgttgatggcacaaattaaaatttggataataattaggagtaaataagataattcaatttggtcttgcctacaataaagatattctcaatagcttaggaatataatgaataccactttaaaatgcattccaaaagaaagaaggaaaggtacaatgtgttttagcagaaacttacttgtgtccctttggttagtggctgatacatagcacagaaattagaaggtaaacaattgccagatgaaaggattaaattataactaatagcaaaaattttgaagatagatataatttgaatattctgagaaactgttgatgtcagattctcagctaaggaaattatctgctttgaagctcttcagttatattattagcagtcggtttatgtctttgtacatgaacacgtcttctttttctcacatagtttattttactttagtaaatctgatgggaagccttatgtcagaatatgtaacaaacattgattcttgtaggctaaacttattttattaaaattatgttgcatatgcttcttattaagaataaaggtttatttagactagttaggacctgcttaacaagaaagacttcggcagccacctttaagcctgaagctttaaaaatgctgagcaaaattgtcaaagcataattaagggtaggggaattaagttcacttttctcccctaagtgtctttgccagagacagaaacttcaacaatagagctaagtggaaaaatggagccatgtcagttaccacaccatgctaaagactgattagtcataatttttggtaataatgcccacaggaataaacctgacaatggtgtactctcttgttagcattagcccttttttgtccccatttttcttgctctttcccatgggcctggtcacttagtgatattagttttaaaagtttcatttctcaccatttctgctactttcttgaatgtggtgagtcatgcagaacaattaacaagcattaattgaggttctcttatgcataagattttatgtaaaggtactgggggctgggaatattttcttatgactatggaaagctatgggaatagtgacactggttgtatttgcacacggcctggaaaagtgcaaagtattgggagttgaggagagacaaatgtcctgaaatctcagctgaaagagcagaggccttgtgctagaccctgagggtacagaaactatacgtattcggttatgtgttgcctgtatgatgaggaaaaacttagactccattttacaggaagtaaggtaccggaagtggtcaaaaattgagcaagtaataaaatgcaaaatgaagaatattttctacttcttgagtttgaattccacagaatgagttttggactttatttgaaatttgtcaattgctagaatatcaagaggcactgatcaaataaaaattattttaaaaatgaatacttcttatataatacactattgttggatacctatatctgcatatgctctaactaggatgaaaattacctatattcatattaaaataatagactttacagatgatctagaccaggggtccacaaccatcaggccacagaccaataggaaccagtcacaaagcaggagatgaccgatgggcaagcaggcattaccacctgagctctgcctccagtcagatcagtggagacattagattctcatatgagtgcaaaccctattgtgaactgcacgtacaagggatctaggttgtgtgatcctatgagaatctaacctaatgcctagtgatctgaggtggaatagtttcatcctgaaacaagtcccctatccatggaaaaattgtcttccatgaaaccaattgttggtgccaaaaaggttggactagtgatctagactatcgtaaatatgtactaaaaattcatacattttatatatattatatatatatatgtactgctatatcttaaaaagttatagtttattagtttcatattgctgctgtaacaaatgaccacaaactcggtggcttaaaacagcacacatttagtatcttaacaactctggaagtcagaagtcagcaatgggtctcatggaaagaaaatcaatatgatggcctggtcgagttctttctgaaggctataagggacagtttgtttacttaccttttgaacttctagaagctgcctgcattactgggctttgtagaccccgtctatcttcaaaaccagcaatggcctatctcaagtcttcctcatgctgcatctctctgattctgagtcatcttctgtctcccatttttgacatttaaggaactttgtgattcactgggtccacccagatagtccaggaaaattctattacaaggttggctgattagtcaccttaatttcatctgattctttcattcccctttgccatggatatctgtcgaatggggcgggaagcgttattctgcctgtcacagtcagtaatatcacacaagtaagatcaggattttatttcttaccaagtaacttttgttctgtccataaatattgagctgcttgtgtaagtatttgcaatgcacattacttttccccctcagtggttgattgttatattaatacagagaaaggaatttccattgtgctgaattacacaagctatttcttttatctttttttttttttttttttttttttttttgagacggagtcttgctctgccacccaggctggagtgcggtggcgtgatctcggctcactgcaagctccgcctcctgggctcacgccattctcctgcctcaggctcccgagtagctgggactacaggcgcccgccaccacacccagctaaattttttttaattttttttttctttagtagagacggggtttcaccgtgttagccaggatggccttgatctcctgacctcgtgatctgcccgcctcggcctcccaaagtgctggggttacaggcgtgagccaccacgcccggcctcttttatctttggtatatgtttccaactcctatgcctagaaaacttgtactttccatttagtgcccaattcaatgccatctcctctacaagaattcctccctgaagcctcaaagtagtttaatcaaacttctaatatggaaccataaaattatattgtaattatgtttatttacaatttcttccaatagatgcaaatgttcttaaaggcagatatattttatattctttatattccctatttcagttcctagtatagaaccagtacatagtatactgttaatagatgaatgagtaaattgttaaatgaattaatgatgaaaaaaattcacttaagacctctcatttcctctcaaatattttatcctatcttacagtagtgatttaataaaatatccatttaataaaattagccattgggaacttaaataatacaacaaatcctatcaagctatacacataatatcagcctaccaagttttctataacttatcctcttttttctctaccagtgtcagcatagctcagcctatcctaggtccgaattcattttgagactctaacttggtgtagggaattcagtgtcagattgtctttttctttgtcaggatcttgtcctccattctaaaaacctggctgctgccttagctggtatttatctgataatcagtgtctgagataactgcatttctgttaactgcctatttgggtttataaatattatctttttcaagatcttccataaccaagcactgaaagttttaggtactgaaaactgtctgtttgcttagattattcattcttaatacaccagactattgtcttactttacagataaggaatttgaagcttagaatagttaagtatcctgactgcaggttgcaatgctggtaaatgaccaaaatggcatttcaactcaggtcctaaaaattctgaagacttgttttaactactgtactctactgttttaactactgtactattttattttaagcattattctgactatccatttgcttgatataactgaggagtggtaaagatcaaagtagaggaagaggcagaggtagagagaagagaaaaggagggtaagggaggagatgggagacagaaaataaaaaaagaaaagaaaagagagaaaaactatgagaaaacatcccactattaggttgggcatgtattgagatcataatcctaacaaggttatgcatttcttttattaacaaacttaataatttcgagccatctttgcagttctagaatgaaagttacctgaaataatggtcagttttcctagatgcaggcaaaataatttgacttagtttaaacagaaaggattttattatagaatatttgatagcttacaaaatttcttggaggtcagcaaatcaaaatttcttggaaagtcagcaaactatagcaacaaaataccagacaagatttctgcctggaggggataaactgcggagctaggctgagagcagagaaaaaaaaagagaggtggaggggaagggatggggttatggaattttcagtgtttagtatgcagagtttaatttaatctacctgttttcagtaggatattctctttctcggttttgcctgatgtttcttcaatttggagcttatctaattttcttttttttttctttttttaaattttattattatactttaagttttagggtacatatgcacgatgtgcaggttagttacatatgtatacatgtgacatgctggtgcgctgcacccagtaactcatcatctagcattaggtatatctcccagtgctatccctcccccctccccccactccacaacagtccccagagtgtgatgttccccttcctgtgtccatgtgttctcattgttcaattcccacctatgagtgagaatatgccatgtttggttttttgttcttgcagtagtttactgagaatgatgatttccaatttcatccatgtacctacaaagacatgaactcatcatttttttatggctgcatagtattccatggtgtatatgtgccacattttcttcttttttttttattatactttaagttttagggtacatgtgcacattgtgcaggttagttacatatgtatacatgtgccatgctggtgcgctgcacccactaactcgtcatctagcattaggtatatctcccgatgctatccctcccccctccccccaccccacaatagtccccagagtgtgatattccccttcctgtgtccatgtgatctcattgttcaattcccacctatgagtgagaatatgcggtgttgggttttttgttcttgcaatagtttactgagaatgatgatttccagtttcatccatgtccctacaaaggacatgaactcatcattttttatggctgcatagtattccatggcgtatatgtgccacattttcttaatccagtctatcattgttggacatttgggttggttccaagtctttgctattgtgaataatgccacaataaacatacgtgtgcatgtgtctttatagcagcacgatttatagtcctttgggtatatacccagtaatgggatggctgagtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatgtgcatttctctgatggccagtgatgatgagcattttttcatgtgttttttggctgcataaatgtcttcttttgagaagtgtctgttcatgtcctttgcccacttttttatggggttgtttgtttttttcttgtaaatttgtttaagttaattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccgttgcttttggtgttttagacatgaagtccttgcgcatgcctatgtcctgaatggtaatgcctaggttttcttctagggtttttatggttttaggtctaacgtttaagtctttaatccatcttgaattgatttttgtataaggtgtaaggaagggatccagtttcagctttctacatgtggctagccagttttcccagcaccatttattaaataggaaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtctgaagtcaggtagcgtgatgcctctagctttgttcttttggcttaggattgacttggctatgcgggctcttttttggttccatatgaactttaaagtagttttttccaattctgtgaacaaagtcattggtagcttgatggggatgacattgaatctgtaaattaccttgggcagtatggccattttcacgatattgattcttcctaccccacattttgttaatccagtctatcattgttggacatttgggttggttccaagtctttgctattgtgaatagtgccacagtaaacatacgtgtgcatgtgtctttatagcagcatgatttacagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctcgacatcctctccagcacctgttgtttcctgactttttaatgattgccattctaactggtgtgagatgatatctcattgtggtgttgatttgtatttctctgatggccagtgatggtgagcattttttcatgtgttttttggctgcataaatgtcttcttttgagaagtgtctgttcatgtccttcgcccactttttgatggggttgtttgtttttttcttgtaaatttggttgagttcgttgtagattctggatattagccctttgtcagatgagtaggttgcgaaaattttctcccattttgtgggttgcctgttcgctctgatggtagtttcttttgctgtgcagaagctctttagtttaattagatcccatttgtctttctgtagagaataaactcctagtctgctagggacggaaggagaagttgcttgggtgcatggagtacttttagctaaccctctagttgccagccccatctttactcccactttgttaggtgcacagcttttctaaggtcccagagtaaatgtggggttgtttgagggcaaggaggtacactgctggctcaggtttcagatttcttgagactatttgctttccagtgtatgcgtttattttttcttcagctgctgccagctctcaaagtgctcaaattttacagtgaacttatcttaaaatgctcctctctttatactttctgccgatatagagatatttagtattaatgttcatttttaaagaattttgaagaacaattctatgccaaaaccaagctgaatactgtacacatgatcataaaacatagtaaacagtatacattcaattttatatgaatattggtaaatggtgtctgtatctttgtagaaaggaccaaattgcagttagcattatgaattttcatttaactttttaattttcttgttacatagacactagtcattaagtgtttaagaagagatctgattaaataaattggaattatcttttctttgaaatatatcttaattaaaccctgtctattatgaaaatatcagacctttattagtaatcatttctatattatgctgaaaataactttttttaactctgcttaatttatttcatgaaaagatttaacgaaaggttcagtgaagttttgcaaaaattggtgcataaactcagatatgtaaagattcacatattctaaaattttctccttcagccaaatataaactacacatataaaaaagtaagacattgccataagccccatggtttaataacattgctccacagtcttatgagtttgttttaaagctttagtcaaaaaatacaggatgagatttgttaatatacacaaaatttagcttttcaatgtgttcatgttgagtaattaggttatgtgctacataaattaatacatttttatgtggtaaaaacagcgtaagtggtaacagctgcctctaaagtatctttgttcttattcagatttaaattacctgttgatttgagtaagtaattataattttgtcctaacactgtgtaacatatggtgtttacattcttctcaagagctccttgagggaaaaaaagtacacagaaacatcaatataaatagtgatttaagaaaccaatgaaaaatatttacaaagattaattgtagttaataggatgttaaatagttgttaaagcatttgaatttgtcttattggattattgacttatgatattattttctattgtttgcttggtgttgacgttgttacataacatattcattttgagaaatctgttttccaaatggaagtttattcttttattatcatagaattcattttaagctatgtgttcctttttcttaacaacaaagcattattttacatctgtgtttatattttagacttagcatataagatattgataacctagcagactttttaaaaattaaaaagtataggatataagatttgttttaaaaccttttaagttataagtctattaaaatttctaatatatttaggtataattttagaatggaccatgttccaaatatttgctcaaaaaattatttgtttagaatgttgtccctgctaagccacaaagtgcccttgaacatgtggtttatctaaaaggtagctatattacaagctttaatttattgagcacttccaatgcgctagacacattttaatttgttttacatatgcttttctgaggaaaactttacagcgactccatgagttaagctaggcattttcaacctcatttcctatgaggagaaacagactcaaatactttaatacctctgatatgcctccaataaatggcagaaccaaaatgatttcaaaactcatgcctgtaagtactatgctatgctacttctctaatagaatatatatagttcttttacaattgcagggaacctttctgtttgtgtggaataattcattacatattttgccttggcatataagaaacactgtattttgaattcacaggaggggagtctttctaggttacttccaagggcttaggtaatttgggcctgagtcatgtaataacctacatttgaatcagctatgtaggtaatatttacaattttattattacaaattttggtgctctaattttcagtttgtcattttccaaatagtgggggcagttttcttcctgggaggtgaaagcgttcgagtttgatctggagtgatgtgaaccaatgtgtaaatttgtatttcccttcatctcacatcttccccctacagcctcttctccagatatactcatttcctgggtgatttcatgccatctattgacagatgcctttcaattatttatctccatctcaggtttctctaagtttcagattcatatattcaattgcctactcagtatttccacatggatggctaccaggaatctccaaattgataaaaaccattcaaaacatttgattctcatcccataatacctactttgctattttaagtttatttctatccaagtctccaaatcccttttccaatctcaataaatattttcatttaccatttcatcatataaaaatgaaaaataattttttcctcaattataagttcttagttggaccaaaaggcagattaacaagagaaacatagtgtattaacatgtgcactgcacatgatgtgagagaaacctcaacaaagcagtggcttagaacttctggcttatatagcatcttcaacaaagaacagtaaatttatagagaaattacagaacagaggaaagaggttttagttttaggagaaaactaatggtgtaaggatcctttgtagattcccctgttgcctctctaagctgataagcatcagaattgtctctggtgaaggagaatgcatatcctgcctttaggcagaaacaaacagaaggtatggagagctttcccctcatttgcttctcctttaatgtccttcaggtaaaaataaattttatgtcaaagaggcaattttggggtgacattttggtttccttcagttgctcaagccaaaaataagagagagagaggaaaaagaatagaaattcatacttgatttttcatactctttctcacacccattctgtgagcaattctgtgagctctgtgttgagaatatataaatatattccaaatctgtctgtttcttccacgtacactattatcagtatcatttctcacctagactactgcagtggtttctttgttcccactcttgtctcccctgtaattccatttcccacatgggagccagagtgatcttttaaaaaaataaattggattgtgtcattcccttgcttaaaacactccagtgccttcatatcaaacgcaagattaaagtgaaactgctttctaaggccttacatgttctaccccatggcagcttttccaatctcatctctgatttatcttgcaagtcttttctagatctggcaatgctggccttcatgttgttcctcaaacatagtaagttctctccttcatcaggatagtcatactaatgttttcttccgtctgtatcatcctgtcttcacattaccatatagctcattctatcactgtatttaagaatttgaaatcatatcagctaatcaaaggagacttccctaactgcccttctaaaatagctgccatattcaggttcattttctgttttgtttttcttcatggcacttattatttttcatagcacaaaccccttgtgacctgacattacattgtatgcatgtgtttaaaatcagttttgctcagtaaaatggaagcttagcatgggcagggacttattcatcaatgtatctttagctcatgcagcaatgactggcacagaaaacctgtttaataaatatttttgctaaaaaaattatttcatgttgtattttattttaacatatacgtttatgtatatataatctactaatttacctgagtgtgtatgtgtgagcatatatatctatgcagagaggtggggatttattaggagtatattaataaaaatgaaaatatgctattctgtgatgatactcagttatctggtcaaaacatcctttggttggtaatggatttattctgatctagtccctgtcttcatccagtttacacaggttgcatataattagccagacaattttgtgtcattcaagatacaacctggttcagaaaaaagaatcttgaattgtaccttaatgcaacccattacagtgaggttacagtgtcactcacctcggaaacagtgtcctcttgtatatacccatttcttcccttaactacatcaaatcttttttctgacttgaacattttgctagcatttttagtactttgttttagtagaaatagcattcagctgcaaaaataagacaaagaaaacaaaaacagaaaataacagtatcttaaaccctattgaatttaatcttacacataaaacttggtctgaaggtaggcagtctggagagcatagggctgctcctggaagttgtctgggaccctgagtcctattaacattctgctcccctttcctcatctccagcttctgaattaaagaccccattataatctaatacagctattggagttcctgccatcacatcagtgttccagatagtagttgggaggaaatggggaaggagaaaaaaaccatacttgctagctgagttagcttcatataaggagctactctggaaaccccacataacacgtttgcttatgtcacactggccaaacttcactgcaaataagcctagaaaatatagtgtgttaattggatactttgctactccaaataacatcaggatggtataactgaggaacaagagggggtgcatattgataaacaagtaagagtcagtgccagatatatgtgttttttgtggaacttattctactgttgctatagttattggcataagtttattttcccatatttccattacagctcccactctcatacatcacattattctcatctctctgtacctgccatcccatctagcagtgtcttttaaccaatagttagtcagtaaatacttgctaaatttggatttaaatgactcaaacccattagcttgtttcattagcactttattctggcagatgataaaatgctgaagaagccttgtctcttgtgtcctctgcacttctacagatattttaaaaacaagaaaaatgaacgtattctgcttaatactgtatttttagataacaaatggacaaattgcatacttaactttgaatgaaaacccaattgagttatcagtggatttgaaagagaagtattatcaatgcaaaacactgtatactgtgatttgtattaaataaacaaaaacttgaaacttctgaaggaatttgtgaatgaaaggacattagttaccttatgaagttaagcacagggaaatatctaatgatccttgctccttcagctaaattatatgcaataaggaatttacacttctaaagtatatttcctgttttactcaaaacatgttttcattttacctaaaaacctagcttttaaaatgcataagaaggccagccacagtcgctcaggcctgtaatcccagcactttgggaggccaagagggggtggatcagttgaagtcagaagtttgagaccagcctggtgaacatggtgaaaccttttctgtactaaaaatataaaacgctagccaggcgtggtggcaggcacctgtaatcccagcttctcaggaggctgaagcaggagaattgcttgaatccgggagacagagattgcagtgagctgagatcgttctactgcactccagcctgggtgacagagcgagactctgtctcaaaaaaacaaattaataagtaaaataaagcatgtaagaaaacatttaatagaaaattgtttactctctttccaaattctaaatatcatctctatggtttgtataactttgtagtaagtttcataaacataactttcctctccatattcaactcttaatgcaaaaataatacaaacaacttttcaacatttttaggaatgtttcttgaggaatcattcctaaaaatcaaaatagcctatttaagtttttaaattgaagttagccagtaagaaagtctttcttcggtgtcttagtttctaagctcactatagatttgtgttttatgacaatatataatatgtctgattattactgacagccttgtgtcatatgccaaatagcctctaattttaattttgatatatttgtgacacacacctatcaattctcttacaattttttagaagacttggcaagatataaaaattatattcctagttcttgttatgacaaattgtgaattaccaggagacaagaaccgtatacatatactttactgcatcttctaaaatatctagctaagtgccttgcatattttagatttttattaagtacttattgaacaaagtatttcttaagtttcatgaagtacttcttgaaagtatagcagaatgttaggttaaaataatgagataaggaacacagaggaggcttatgtgtactttattccactgatatgaatatattaaactaaaaataaatttatgaaaacttagatttaacctagattagaactttaattaatttggaagtaacttttctttgctccctcatcataaaaaattattttcctttatataagaacatttatcatggtttctttttatttgtctcacttttgaaatggaattggataagagattcgcaaatgacaaagttagaacaaattcagtttagagatcttcattggcttttgtttatgattctggaatgaggcaaaaccccattctataaaatagagtaggtgttccaattagctgagaaaaggagtttggttgtatagacagcaaagggaaagcagaaacagaaaccaaaaagcagattggctgtttcaaagttactgtccttttaaaggttaaagcagatggaactcccgtatcattcaggttaaaactggcttgcttgggatttggctattatatctctcaatcttctgatttataaggtcagataaacaacttaatttcaggttggtgtcatggaactttagcatgagtgacttcattttggtttggtctattgggccttgtacaggagcttagtccaaagcaatggcctcctataaagtttatttaacaaggtaatgagaccctggttctacgtagtgctccagaatcatgggcacttaatccattcaaccaaggaagcagacaagtgccagaaatggctgaagagtccacatcaagttcctaatcagggagctagctgcaaggtagaatccaggaacaaacaagagactagctgctggtgcttcaaactcagttttaacagtagggaagtaagccaaggagcacatcaaagagactgtggagtttttttcttttaaatctcaatatttacttttacatttaaatgtgatttaatggatgatgtaaaaatgtaaagtaggcaaagctcaaagtggggactgaagacaaccagctgtacaatagtccttgtttccttttctttttttttttttttttcttttgagatggagtttcactcttgttgcccaggctggagtgcaatggtgcaatctttgctcaactcaacctccacctcccaagttcaagcgattctcctgcctcagcctcccgagtagctgggattttaggcatgcgccaccacacctggctaactttgtatttttagtagagactgggtttctccacgttggccaggctgggctcgaaccctgaccccaggtgatccgcctgcgtcggcctcccaaagtgctgggattacaggtgtgtagtccttgtttcttacatcaagaaccagaccctatgctcctattaagaagaaaataactgaattatatttttgtattaaaaataatagagatgtgaaattaatgtgtgtcttttatctttgatattgctaatgggggaaataacagtaatttaaaacagtttttttgaataaaaaacttaagacatatatttggggaaaaataaaatgtttatgattcaatatatataaatatccaaatacataaatacatgataggtgatcatttctttgggaaaaaaagacaagcagattaaatttcttaaatataattcagatagcagttttgaaatttactgttcatctcatacttaattttattatttctgaaataagaaattagtgttactatgatgccaaatcaggtgttatttttaagtgttttttccaacatgcactcaatgatgttatataattatgttcagatcaacagatatatacccagtccctctaaccataggctattgtgtgtgattctgcaaagaatgataaaatgagaaagatatagctactgttcttgaggatattaaaatatagtatgttgaatagaaaaataacacaaaaatagtgtagtaggatggttaaaatagcaaactgacagaagtttgtatatctcatggtgatggctaaaggggataatctgtctaaggggagaagggatttaataatatttcatgctattgtatttgaatttttcccattctgttatgttcttttagtaacaccctatacactccttccagtctgttttctctaaacctcccttttgtcttcttactggaacatcttgcacctccttctaagccatccatatgacctttagtcatcctaaattcgaagatccattattaaattctcttagccgtatttctagacaccaacgcttcctcccaagtagtagatatctttcttttatgttaatcctctgtaaccctccaaataagctcaattatgacacagcattggaatgatttcttatgtgtttctctaatagactgtaattaatctgaaggcaagaatgacgttttatttatctctgaatctgatttttcaataaatctcaccaaatggagaggataactagaaaattgagttctttaaagatattgggaataggacaaaatgctacctcagtaaaagtgacttaattttataaataaaacgggattaagaaggagatgaaatagtctcagaagcaaaatagtcagaaccagaattgtgctggtaaacatttaatagtaaatctttgcaaaggaaacaaacaaacaaaatgatttgtagactttgtaaatttctatgttgttattgttgcaccatggccaatttcaagctaccaagtcgtgtctctgaacttggagttgggaaaagatgagcccaatcagctcttgtaagctagtgcaaggcaactccagtgaagaactcacgaagaactagaaaattgtttgtcccttgtagtatcccactgtggttttcacgatctgatactgaaatatgtatacacaaaattgatttaattctttctgataatttctttcgtcttcaccacatatataccacagagatgtactttttaaaaatgaccaaatcaagagcaaaattattaatttcaaaaaatttacaaaatgttagaatttgacttacagaaaattgtatacatatagttaaaacagctgtataaaactacttaatatgaatattttctttaaaattattacattttaatattgtaaaatattataaatgaagtataaatatttcactaagaagctttatggatttctttaggaattttttagtttcactatgaagaaaatataccaagttaaaacagtcttgtaagcaataattattgcctatttaaaataagaaatgaaggatatataatgaatatattagtaaataaagtaatatgtgccatttcgggttgaaaagtaactgtgaattcaaccagtaaattatttttaaaatactgtcaagttctgttcatgtattatatgaatgctgactgtacataattttattcttttttaatgtttgaattaatgacactattaatatcttacagttaacatctagcagaagcagatatgagctaatttgtattttcctgtcatataaaatctgaagtcttcttcagtaatgttaattttatcttgtcattttagatcttttacagcacttaatatcataattgtaaaaatattgttccttattaatatttgaacaaataacaaaaagtaaatccaataatactatttataatttattaggacatagaacaatcattttgaataagctgttattaattagtttatgataataatactagtaaaaaatttcagactttcaatgtatgaaaaatactcagtttaaacaaatagaaatgttctatatcattaaggaaccaaatagtctagtgattaaaaatacaggttttagaaatagatctaagttgaatctatgctctgtttcttgttatgggactacaggtaagttttttaatttatgtaatctctcacttatgagttagtttgatgctgaggttacaaaaacaaatacggccaacaaagtctctgtatgcatgaagctttctgttttttggcatatacagggagcaaacaaatactcatagtgtggtaatagagaagtaatagagaactgcaggaataaagagtaagttatacttaatctattctcagaatcagaaagccctcctgagaaaagtggtatttaagctgagacttgaaggaaaaataaaaattagctggataaatgtgaatatttgaaatgacaataccaaataaatttacagggctctctaaaattaaattaaaatgccacatataaatcccttaacagtcactgatagatgctgaataaacggtagatgatgctgtcgttactaactatggtttgattctctattagactccctaccctcacacttgtatggtactttttggatttatttatgatagaaatagtctaattgtgctcacactgactgcaaaagtactaaaaacacaatgagaccaacaatattatcttatttatctttgtgtcttcatctgatcacactgcttggaatttaaacaggtgttctttaagtcttccttagcaaataaatacatgaatgaatagggaaaatacagcttttaaccattaatacagaagtaaagttttgtgactagatgaagtattgttcagtaaataaaatacaggtttgctcccacttgtcctagtcatttggcctccgagttataggatggatatgtataaattcgattatttattcaactatccatatgccagtgtcggcaatatattaatttcaaatggtaacacagcaatgcactgatttagtctgttggatctgagtaagtgtaatttttaggagttcatatctataaacattaccccaaattgggattgaattggaaaataatctgacacaaagcttccctaaaggcagtgctttgggttaggcgttcattaaataactgaatttaaatggtgaatggactctttttccttctggatcgttgtaagaatagcagatttgagatgaagtgaatttcaaagtgttgcaaatggccaaagtgagaagagatggctcacaccaagagcatcagctgatttctgtagccatttcttaaggaggctgacaaattaacttgagaataatcaagaaaggtcaaattatgatcatctgattattttaaaaggttaaggaaatataaaaacatataaagaaagtaatttcagaaactaccaacatatgaaaagctttaacattttagaagactgatatgatttggctgtgtccctacccaaatgttgtcttgaattgtagttcccataatccacacatgtcgtgggaaggacccgacaggaggtaattgaatcataggggtggttacctccatgctgttcttgtgatagtaagtgagttctcatgagactgatggttttataaggggcttttctcccttctatttgacacttctccttgctgctgccatgtgaagaagtacgtgtttgcttcccctttcaccatgatcataagttttctgaggcttcccagccctgctgaattgtgagtcaattaaacctgtttataaattactcagtcttgggtatgtctttatcagcagcatgaggacaaactaatacagagacaaacttaagttatatgtgttacttgttggttctccttagttgaatcactatttttgcacatccaggactgccttctctctgtcttcttagtatcatctcttgcactaccaaccaaaacagttctctacagcgtagccatagttatcacttacaaataaaactttgattatgcatcacctctgtaaactgtttatggcttctaataatagcacttagataaaagccccaaatcctttttgttatttcacacaaaaataaccataccaatttttgtttgatatgaaaaaatacatgtagtgggctgaaaatggttctcccaaattatcatgccttaatccgggagcctgtgtatgttaccttacttgaaaaagggattctttgcagatgtgaccaaattaaatatcttgagatggggagattatcccagtgtatgtgggtgggtcctaaatgcaaccacaagtaagagagagacagagagagatttgacagaggcagcagaagaggagacagtgtgacaatggaagcagagattgagtgatgcagtgaggagccaaggaatatgagcagtgatcagaacctcaaggaggcaagaaacagactgctgtaaatggtcaaagtgagaagagatggcttacaccaagagaagacattaaagcagcagctgatttctgtcatcatttcttgtactaccaaccaaaacaactctctatagtgagaattgtcataattttccttgtgaatttgcatattttcataatacaagctagggaacccactaccagagaaaggggcttagttccacctattgagtaccttaaatcatggaggactcatgggtggagagaggtcaagcagtagactactaatcttacacagcctggaagatttgggaggagagccatttgtccctggtgcttcctgcagattccactatttttaggagccagtgaagcaaacagatgcactgaaaaacaatattaaaattgtttcaatgttctttcaattgaattttaactccaagtactcatcctttagtgatggtaggaagtataacttcagttatttgtgagttatctcaaccacagagttttgtcagtgtcttgatattttacaaacaatgtatccattggaaagtcccatcgagatgttggtaatcagttcacagagcacatcaaccatttaagtcccatggctctgcccgtttatgtcccacagttctgcccatttcatgccgtgctagagatgtaagcactttgggaagaactagaaactcctctgcctaggatctagctcattaagtcaagagtgaacaaggtagctcttcctcactgagtctttgccctctccccagatgatgccaggaacaagcactaggtctccttcattcattgaaccaatacacttcttctcctatctactttaggaatttttcctcatttcctggtcatccatttctcaaatgttttcttataactttccggtgtcctctgcattagcttttaaaatgtttatgattttataaagagcttctaatttcacattgattatttcaattaaacctaattccttgcttaaaatgagaggaaagaaggaaaacatatcaggaaaaacagatatttcaacagttcactaagttatattgactcaccaggttgtgttctcctgtaatgtgtttctcctaccacttcatcctctttttctgaacacccaatatacttctagaacttgtgccaagtcttcccttcgaggtagattgtaaaaatcaatgagagcaagcttgcacttaacacatgattatttaataaaaaaaagagaagtacttcaggagatgataccaccaaacagaatgtgttttatttgtttgtttttaacagaattagttttgactgatagagtataagtagaactataatccatgaagccattcatctgctatacagaaaaatcaatgcttggtctttaaatataaacatcgtcttcaataataagactgaatttatggaatgcacaaataatactgattaatttttcttaggtgttttatacctacagagacatcaattgtcacccaataatggtggtttttggagtataggctgcatggatcataatggcaaaccttatttaaacagaaagaagagcagaatatcagtcataatgttttctctgtaagaactgaaaaattgaagtaaatatatgaatcttaaaatatcaattgtaatattggcttttgcaactcaggcaattataagatataggacattttaaagactaatgaagaaaattgtatttaatttattctaagttttaaaaactttatttttctcaactagagaattagttgaaagctcccaacccatgatttcctaaaaaagtcacatctaacttagatattggtagcagttcatgctctttttaccgctggcttgtgtcccttccaaacactttaatggtattttactgttaaacaatatatatttctcaccacttgaaaaactaattcaaaataatatttctttattctatgaggtctctcactattgtcattctccttttgtggcctatgctcatttcttttccccaatgaaaagtagagaaaaaaaatcatgacaaccttgtgtgtctgcaagtctctgtaaaatgcctccatccaagtttccttccaatcaggaacataattcttagcaaataggtcgctaactcacttaattaactctctgctatgtccttagaggagtttctattatcaaacttgaattggaataacatttaacaagctgtacaaggcctttgggaaacctgtttttcacaaaaatggcttcttaaatgggctttgatctccttaaaggattctgaattactgcataaaatcctaatgcacttattaacgatgcatatatatgcagattttaaacagagtgaaagataaatttcttttctgcctccttggggagcatcctaatatggattttctttaaacatttcttgacctattgaacatttgataaacaggtattttacccaaagctccctccagatctttgacaattaagaaataacataaaaacctatttaggattgcatcgtactcttctctgttagtatttgggatagagatttgaaggagagtgatcctgttttccatttttcgtctcatataattttttttaatgcttactctttgtcagtcactccactatagacagggttgcaaagtcaattaagctatggtttctttgtttcaggaaactgcagactagtgaaaagtggagcagaagagaaaaaaataaacaaagaaaatatacaatgataggccagactgatacattgataaggcttataatagatttttacctagatacaagagtcagacatctaatttagaccaagagaggataatattgtgagttgaattttgcagaatgagtcatatgttactgaataggagaaggctatcctgagcagaaagatggatatatggaggtaagcatgacctgtttgagaatttttaagaaatttatgactgtcagctgtatgggttcctctgagggttggtggttgacaccaaagaggttagcaggaacattaaaggcattgtaggaaaaaaaagggaaaatgtgtgtgtgtgtatgtgtctgtgtgtgtgtctgtaattaagtaacctagagaggaaattttagagcataaatttttagaaatttggggacttgtcatatgccaaaatctagacaaagcaatcagtgcctatcaaccagcctacttatatttgaacatagcagatgagtcttcctagtgcagatgaaaatattttctatgtgtgaaaataacttcctgaaagttgtgtccacataatttcccaagttcatatataacgttctttatgcagaaattttatttacaactgaattcttgaggatcacgcctactaagtaacaccaggtgcaactaaataaagagaagtaaaatatctgaatgctcacccagaaagcgatcaatctatttcattttaatatattatttatatttagtgaatatacaaagaatatgtcacaaatcattggccaggcctggtgaatgtggacctatagtctcaactactcaggaggctgaggcaggagaattgccagagcccagaagttccaggctgcagtgagctatgatcatgccactgctgggtgacaaagcaagaacctgtttctaaaaaataaaaaaatatatatataagcaaaattaccttgtcattatgtgatgccatctggtattgaaattgaattttattcacacacataatttaatacagttttttaaaaatttctggattccttctctatattcacacattttggcaataactcatacatattttctctccattgatacagaagtagggacactgtaaagatataaaacatatatgacatctaagaacccttaatatttgttcactagagctcatacgagatgtgatctatactctgtagtttggagagctaaagcaattcataactactttagcactcagttcaatttaagatgaattgcctgtcttatgtgaatgtactactgagcaagctgaatgtcacttatctgatgaaagaacagtgcccagctatctcacatacaccctgtgtatcattcaaacttggaaacatttatatcatagtcattatcttaaaatcacagtgtttgccaacaaagccttccggcttgattccatagaaggacatttaaaaaaagatatggcataacagattcattgtcctgcttgtatgtgtttctaagtttgttcttttttttaggtaaaataaagaatttagcagtagtgcaaccattcacagttctaaaagaagcaagtgcaaatgtagagcaattttttttttcatgaaaggcagcataatgtgactgcacttacactttggatttgcaatttcactgatgatctaaataatgccattggtttaaacagttagttgctctactttgaaaattacctttgacctttttctcactagatatcaattgaattccaggttgcacatactgaactaaacgaggtaattgctctggccttgtgaacttaaaaggcaacttctttgtgaatgtatttgttggtatcattaactggatctaagaaaatataatttttataaagttagatcattcatatctaagttgccttttattcatgtggcttagtaaaagttaattgtactttcaaagtaccaaggcaaataaacagggtaatttttttttaaagggtctcgttctcgctctgtcacccaggctggagtgcagtggtgctatctcagtttgctccatctccagggctcaagaaattctcccacgtcagcctcctgagtagctggaactacaggtgtgtgccaccatgcctggcttatttttgtatttttttgccatgttgcccaggctggtgtcgaacttctgggctcaagagatccacacacctgggcctcccaaagtgttgggagtataggcatgggccaccatgcctgaccaaacaaggaagttctaataggtgtctgtggtaggctctaagattgccccagtgattctcccttctcagtgttcatgatcttgtataattcctcccctgttgacttgctccacatgaatagaatatggaagaaataagttgtcactttcatgattagtttacaaacaactgtggcatttgtcttgggtgctctaactcaccctcccttggttcactcactttgggagaagccagtactgtgtcataaggtcaccctgtggagaggtccaaatgactacttggaaacaggttttctgaagcctgccaacgaccttgtgagtaagtagatgcaatctttgagtcaagctttgggatgattatacacctagccaggagttagaatccaacatcatgagatactgagctggaggcaccaacataagctaggcctaatttctgacccacagaaactgtgaaataattgaaacttattccatgctgctgagttttgtgataatttgttaaataacaacagatacctatatagatttttattctgagtgtaggatgctgctgtaataagtctaaaatatgaaggtaactttggatctggtcagcagatttcaaggagaatgttagtgaaagtggaaagtgccttgacggagctattgttacatgtctcatagttttcaataaggctgtaggttaggactttcagaagatttaaataaatggtattggaaactggaggaaagataatccttgttatatagtatcagaaagtttaacaacaacattgattaaagtaaggcagaaaatagaaaatgtgcctaaaagactggacgatttgcctaaggagatgtcttagcaaagagttgaaggtgctgtctcgttttctctagcagtacatctatagagtggggagataaattaaaggaaggattgttaaccaaagaggagccagtacttgtgatggctttgaaaattctcagcctctctagaaatcaaataatgctaaatttaagaaatggcttcaatcaaagatcaaattcagagtacttccaggaaaatgtagtccaaaaatgaaagtgagggtatacataaaatcttttgtcaagacctcagaaagattaaagctggtgactcagaaagcccttaaagagattaagagcataccctctgtgtcctctgaaacattattatagcttctagaaagtttaaagacattattgctcatccatagaagtaggagctcaagatagagaagggcttatctcaagagatttttgaatgtggcttttgtcaaatgatataaaccccaagaaacttcacaggagacccatgaagttcttaagttatagatgcagaaacattttcagcttgaacaaagtggggaacagagacagtttagaattagaagaaaccgtttgggctctcagaattatgctgatagggagtagactgagagagctgctcaactgaatgatgactcagagggcagaaccagaccccagcagttaaagccaagagccatggagaattatacaaagtcttttgaccttattaagtaacttccagtaattgcataattggacttcagaattgttataggccagtggcttttttgtacctgccattcccccctttctgaacagaaatgtttaaagcagttaccctctatctgtatcattattatctgttgtgtatttgggaaaccagtatctaccagttttcagacgaagagggattatattcaaggatatgtatttatggaactagacctgaagtgtctacaccatggctgaacctgattcagatgacaagattatttaatttgagtaggtactacagtagtatcaaacttttgacgttggtggaagtgggtgagtatattttacatgtaaaaggaatgttaactggatgttaattagaggccaatacgcagagtatagtgatcctcaattatccctaccacctggtattcaggccctcatataatccccattttttgagtgaaggctatgtttattagcttctaacaaatatgatacaacggaactgatggaaagctactgctgagactaggttttgaagaggctgtggggcccatttgtgaggctctggctcactctcccttggatcccttgtcctgggaatgcttccatgtcatgaggaacccaacagtgagaccttcatgagtgaatttagaaaatgatccatcagttccagtggatctgtagctgagaagaccatagccctggcctacagcatgattacaaccagaagagacctttagttacaagacccagctaagccatacccaaattcctgactcacagaaactgtgtgagatgataaatacttgttccatttaatgttctatgcagccatagataactaatacagcactcaataaatgtttgctaccaaatattatgcgaatggaaggttaaactgtaaataaagtgagaaaaattagggcatataaatattaacattttgagactgggacatgggtcatccaagtcaatatttcaataataacatatagaaaataatgagttattgaacaagattttaagtatcttaatattgtgttcaaatgttaggggaaaatcccagagcaagtaacatctcttatgttaactattatttccttgctatcctttagtgtattcagtggttaccatgtattatgccatcattgtattcctttttctttctgtcattctatttccctctactgactttttttatgccaaatctctttcactagcactctctctcactacaatgcttcattatttctttgtctttcatgagattttgttttctgtctcacacatgtacacacaaaagcacaaccacatgcaaataactaaaatcattgagttacttatatagtaaaaattataggagccaaataaaatttcttgctcaatagtttactaagtctgaatagaacaaatcattttaacaataatgcaaaggaaatctatcacctaagttggaagaaaaaacagttgtgatttttaatttgtttcacaagaaaaaaattactagaggtgagtagttttttaatcattcaggaactcatgattatcctccaagtacagaatatctgtttgcatgggattgcttttgctatcataaatatagctatggaatttaatgcattgttggctattcacccttttatatagctatgattttaaagtgcctacactctgcgaatatttacataaattatcataattaaccttctgtggcttttatctttataatgaaatatcccttcattcgaaataaaatatgaaatattatttttcatttctaatgatactttgcttataaaatatattattctaagattgttagtttgatttattggatttattcgataattatctttttttagacaatattattgagggaccactttttaaaattcagaaatagatgttcttaaaatgtattgacccatttatatcaccttatagatttatacttgaattggtagatataaatatctactatttgtacatcccactatttcttttcttttagctagaaaggtataacgttaaaacccttttaccaaataaaatgattttatttagaaaatgccgggcactaaaaaaaaaaaaaaaaagaaaagaaaaaaatgcatatttttgtagaaagtgagatactatttttattacaaacaactttaaaatattttatattgagccataatgcatgaggtggcttaatttgtaaattttcaattttgaagctatttcatagatcttgatattggcatgggaaattggctttctttttgaacctcagtggatactacttgtttttcttcttaaacacagctttgtgtggtgtatcctctggtttcctgttactatttctccaatattttgacttaaatttgtttcatgcagtaattcttaggtgtcattaccactggcacttggtaggagctaaaacatatagccagtataaattttgtctatatggatactcgagttttgatctttgtttaaatcccaggtgctgccagactaaaacaagaaattatgcaattctcctcatataaccagctttagttctatagtgacttttcaccctgagaaaatttgatctaaggcaagaaagccactaacatttgtgttattcaataaaaaaggaaataatttttcagaaagcatgtaagatatacataagatatcaaattataaacacactcccttatttcttagagaagttcctatcatattgttattcaaagataatgttttactgagatagggaataatatgattagagttttgtgtttgaatcaatatattatgacaatcatgtcataaatgtctgagagaaaatatatgacaaacttcaggttaattactatatattataaaaattgagaccagtttttgagaggtgatgagtgagagacataataaatttatactcattatttattgattactgttctatatattctaacagataaaatttctcacagaaaatgtcaggtataacttacagtcactactggaacaaaatgcaaatatttcagtgtcattcgaaaaactaacaaggaattataagtttcttataatatatcagtcaatcaccagactcctttcatacttggaaatgtttccatgcatgggcttaagttaatgtagaattcaaacatttgagttctgttgtagcagataaaatgaagcctcaaatcattctctaatctgaagtacatcctggcagaactactgtgacttgtctgttaaaattgatttcctcttaaagaaaaataggcttttcttattgtgtcaaaaaatgatattatctattatgtgtcttttcttgtgacaatccttaccttttatgtcccagaaggaaaaaatattgtttttcctcctaagtttttatatcctattttactctaatgaataatctgtgttgcacacgaaatgaaatatattccaaaaagagtaaagagcaatgtttaaaaatgagtgtagaggccaggcatgttggcttatgcctgtaatcctagcactttgggatgccaaggcgggcggatcacctgaggtcgggagttcgagaccagcctgaccaacgtggagaaaccccatgtctactaaaaatacaaaattagccaggcatggtggtgcatgcccttaatcctagctactcagggggctgaggaaggagaattgcttgaacccaggagatggaggttgcggttagccgagttcacgcctttgcacttcagcctgggaaacaagagcgaaactctgtctcaaaaatgaatatagaatgggcagacatttgtaatactactgattgcccttaccttaattcacatcatctctattgtttgactttataatgctttttgattggcagccttgaaagatgaatcgacacatcagaattttacaatgtaactttgaagactgctagggaaccttaggcaagcaacttcctttaggacactaaaaatgcttgatggggtttggaactgaggtgctttgtgttagctattattgttagtgatgatggttaggtttgtgattattttgtttaataagactactcaggaataaaaagctaccttcaaataccttcccacctcctctccagtattttttaagattagactttatccaccctaaattacatctatattgaatggaaaaccaggtgttggtattttctgcactagtggcttaatgatagtttattgaactgtaatgctttgtaattagaatatttctagtaaaaacaaaatgggagagcccagaaattgtagttcccatccaaaattacaataacattatttctgtaatagcagaagagaaattagaatgtcttgaggtaatagctcacatatttagaagaagaaatttaaatattgaaagaacatactcaaaaaaggagacgttagatcgggtattcagaaacttcagcatgctgtcaatagatataaaaatgcaatgacattcattttttgatcaatgaaatgagaattgtgctggctaaacactacataagatacgataaaataaaagttggtaagttataaatactgtaagtgccttgggagtgagatataagggcacatcatttttatttaatttctagttagtctatgagattgaactctcagtacttatttaaggccagaaatttaattacaaaataactataaggttacattttgatctcaggttaaaagaataatattagaagcattaaaaatatttttgtgttaatcagcgtttaggaaaacagcatggtaaattcctgtgaaattgatttatactttcttcatttacctctaatatgaaatatattttatgtttagatttgcttccttaggattgtgacttgatttttctctttgctcaaaattatctgtgggtgtattattctttggggatagtgatggttaagaaatgctatttgaagcctcacactattagaagagttagttactaacattttcatgataatataatgagtcatagaaaatttgcattgagatttattgaataaacttgacatatttaaactgtttgccataattatgagcctagtacctgtatgccacaacagtattttaaagtactgtactttgcaccttcttcactaagaattgatctgataaatccctttttgctagattgtgtcatgtccatctttttaataccttccttgttcattattaagtgctgttagccatactgtctaatgaaaggtacataatatcaactctgattactgctgtaatgttttccaggcatgcttggtgatgagcctggcatatgaaacaatttcctacagtaataaaactaattaaagtaggcagtcatccacacaacacttcctaatgaattataataagctcattaatctcatctgttcttattccaaaaagaccactaataggacctgtaggtaagagtacaatcctcagccttaaaaatggacagctatcatgaagtcagacttaaggatttaagttaaaaaattacaaattgctaatcaatgttgtaaatgaaatgtgtaacgtctaaactctgctcagattatttattgacaagatccttttctatttgagttctcctataattgatttaacaaaggaaaaaaatgattcattgtaacataatgactcttcaccacctcaaagattacaattgaattaaccctctcacatatcctcctatatagaccatataagaatcatgaattgagtacttgagatcaagtgataaaaatatagcctgttttctctccacagagggctggagtatcttcttaaaatgtcaaagtataataataattattcttttgttaactcttctacagctttgtgaggtgcctgatcaaacaatgtaactaattattattccattcaggtacagatagtttggtaacatagatgtattgttctagaaacagttttacagtaaaagagataaggttgtaaaatataaaacatggagagacgatttttgaactacaaatgtgaatagtaagaaaagatcactttaaggggaattttgttttatcttcattgtaagttgatgttttttaaatgcagcagtttctgttctaaagctgattactactgtgccacatgtatggacttctttccttagaagtgacttataaatatgtagatttcacaattaatgcagaataatgataatgggttaatcgtaaataggaaggtacatttttcacttatggaatgatcatgttcaaaattgttatccacatttataaatttttagctaatatttcatattctttgtggagtaagagattggatatttggcacagaggattttcttttgtaaaacagatatttaaaaatacgaccactttggtaggtagaggttttccttagcctatcactgaggaaaatgtctcccaatctagaatcaactatctagttgccatgtgtgtgaaggagagttggttctgtgctatgaacaattaggaggcctgactttggcaaagacttctccatcatctagttgtacggccttgagacagcagcttacacagcatgcaatgcatctgtctttataaaatgagggggttaggctagagcagtgtatccccaaatatggaaagtaccagatagtaaattttatgttttcaataattcttggatacaacagtaaaacaattgtactgtatgaggtaatgcaattcctcttttaaattccaattcaattctcctgaaatcaaggaggtaagttttgtgctgtaagtctgtaatacactggcaaatcttactttttgttttgacaaagcaggtagatcacctcatagttactaaaagacaagggagatgtgttgctgaacagaataattttgaatttaagtcttttggttaaaagaagaaaatttcttgaaagttatctcaaagataatagaagattacacaaaagtcttaagaaaatgttcacagctcaaactgaccttgttttgaacacaaatccttatttgagaaagtcttgctccaattagtagacttaattaatgtcacctattaaggtaagctagctatctattgaataaactttggtaatagactttaatgttaataggaaacatgacttatcatcataatatccaacatttgtttaatgcttaacaactaatgtttgttaaatgcttggaagtcaggtactcctaaattatttacatgtattaacacgttagtgttcaccatataggttaatgtttacaacaaccttattaaataagcactaatattttccccattttacaaatgaggaaactgaagtgccaagagatttgagcaatttgagaaaggtcaaacagctggtaaatgacaaagttttaaaaattctgtaagtacccaatactctatgcatttctctctcttattgtttcctatctcaccatccccagtaatccttagttaacttcatcctctccattctcaaccataagcttatatctttcaacattatattcgcagtatctggcacaagataggcactcagaaggtatttgttgaaattcgtatgaatgattaactaatcaatgaatctgtgctataaaacagacaaattaaaaatgcctctaagtgccgggagcggtggctcatgcctgtaatcccagcactttgggaggttgaggcgggtggatcacctgagggtcaagagttcgagaccagcccagccaacatggtgaaaccccatctctactaaaaatacaaaaatcagccaggcgtggtggtgggcgcctgtaatcccagctacttggggggctgaggcaggagaatcgcttgaacctgggagacagaggttgctgtaagctgaggtagtgccattgtactccagcctgggctacagagtgactccatctcaaaaaaaaaaaaaaaaaaaaaagcctgtaagcgtaacttattggactttaagacctcacacttagtacttcctattttcctccttgacttagttttcttctgatcatcaattattaatcatggataatttgaaaactgtgctttcatgaatactagaaaactgtgctttcatgtcagaatgtacaggttcaaatgaatatgccatcacttatctccatctatatacttaactgtgtgactttgaaaaatgtatttaactttctcagtttcagttttattatctgtacaatatagatattaatatctattgtatatagccagcaggattgttgtattaactactttaaacacattaaagtgtgtttaaaaccaccaagaattttcagcgtattgtacatgtgttatgaggcaatataacatcatattgaaatagctagaaattaaagccaaacagtccaactattgctgaagagttctgggagattaggtaaaatgtttacacatctaaagcattaatgtctcaatgcttaatcacaaaatacaagttcctaactcagggcaattttaagggctagatttgataatatgttcagagtgcctggcatacagttaaaaccaaataaatatttgttgatcttgtttgtcatagtgttccttttcaaaaaaaaaatgttttcttattcatttggtttaatatctggggaaataaaagactcaatactgaatacatttcctagactattttcctggagttctctcaaaaacataaccactatttttgcctgtaaccaaataactcagattatattatcttgaacactgtgctgcttaaagctatgattgcaagtagtagaaaatttaggactaacaaagctaatttgttgagtctgtattttacacatcagtggcaattggaagactatgataggaagaaaatttaaactctatccttgtattcacaactccctaaatagaaagaaatggaattcaagcattcaaaaaatttactggagaagattaatttgaaaatagaatgtgcatgagtgcatggatagatgtatctcttcttggatgactgcaagtaagccttgctatgaaaatatctaagaagcaaaatttattgtaaataagttttccattaaatggcagtatcttattgggaatgcatttcttaaaaaaaaaaaaacacaaaaagaaacccatacactaacatattttttaaaaaaatctatcattctgcaaaccaacacttcagagattacacatttttttctacatcttgccatgtgcttgtggagcaaacatttttttgcagtgaagcaaatgaactacatgtgggataccatgtttaaactagaaggcaccctgcatccctcaagattcccaattccttagagataagggatagagattgttggttgacttaaaaaaaaaactctttattaactctaacattaaaccatattgaattaatttactatgatttatttcaaaaccagatgtgttgataacttggtaaaaattgcttcagacagtatctgagcattttcccagagtactaaggagcaaatctataattcagggccactactatcatcctagttaaatatactttatctccttcttctaatcctagttggtattctcacttcctctcttccaaccttaactactcgtcttatttccctcaatggatcttcctttcagatttatgcaaatattatgtcatatccctgttaaaaaccctttactgcttcattcattctctgtattcttaagataaagtctaagaagcacaaatgatatgacttattttccagtatttcaagtgccattcaatccaattgtgctttgatatttcatctatactaaatatcttttatttctttgaaatttctgtgttctcttttacatattcaggtgttttcttcctctttttctgtggtaaaatcttactcatgcttcttatttcaaggtatacattacttcttcaaaaaagactgggctaggttttcctggaatctaataattatcttacataacgctcatcatactttaaaaaaaaaaaatctgcgtcttgtgcaatttgaatctgtccctagcaccattttatgtgctgctgcattctcagctctttcttttcccaatggttagcatttaacattcacttattcctaaatgctttactgaatgaaagttaaagtaatgtgtgttatgagttcaagctcacaccagacgttcctcatgggttatgcatgtatccttacaatttcagattctgtagcagtcaccttggtgatcccctccccacacagacattcttccttgacactgagcccacgagctgaaaaatacctgatatttttttgaagctacggcttagacatgtgacccaatcctggccaatggaccagaggaaaaaactggatgaaaagtatacttgtgaggagaaaatgtctttccccctattaaatacagttgactgagaacatgctttttggatctgtatttgccttccaacaactctgaagaatcaaatctgaaaaccaacgccaatcctgtgcagatgggtgaaaataaaatatatgatatgtgggcctttgatgatttaaattattctttaaataattcttgtgctgctgaattaaccgagcctggaaccacttacctctagtcaccttgttatataagataatacatataggttctatttcagccacttataagtaggtatctttttatttactgtcaaaagaaccctcactgatatagatgccctcaggacttgaccctccctgagttcctgttaggcagttaaggtaatcatctgttggattagggaagcctagcttatttacttctcagtgtggacaagtttggtctttaacttgtatgctcttgttttccaaaaaggagatagaccagaatcctaaaaaagtaagtctaaacattggtgtccttttacgcttcccatctaaattatctttaagaacatttaagtttcattgatgatccccaaaataattcaagcaaaatgctgagttggtagaatataaggactgttatttatttttattgtttttacagaccacataccctagggaattctgaaaacctgactaacatcaattgaagattggggttcaggaggcctagatgatccaccatgacttattcaaaagttgaagatgaaaggaaagaataaagactctttccatccagttctctagtctgaaaggaaaagaaataggcaaaggacagtaggcttttctatatcattatattcattcaaatgattctcttaaaataataatgaactaaggaggctctgtaagcaagacaaacggtcaggaggcctccttgctccaagaatactccctttttactttattaaaatggtttgtaaaggtaaactaaattgactaaagtatcaatatttccatatatgcgtgatcttttagagaccataaactgtcagtgtattaggctgttcttgcatggctataaagaaatacctgagactaggtgatttataagaaaaggggtataattggcccacagttctgcagactgtacaggaagcatagtagcatgtgcttctggggaggcctcaggaagcttccaatcgtggcggaaggcaaagggaagcaggcacattgcatggtgagaacagaaacaagaacaaggaagggtggctgggaggcgccacataattttaaattaccagatctcacaagaactcactatccggaagacagcacccagccatgagggatccaccctcatgattcaaacacctcccaccaagccccacctccagcactggggatcacaactcgacatgagatttgagcagagacaaatttccaaactatatcactcagaatctggaatagaaagagtatgcaccataacacttttattctctacagaaacagacactgtgctgagctcaaaaaatagtgattcatcaaatatgaatgtgcaaacctcttttgtactgtatctgtggaatcctggttactggggctttgagcccctgtcccataaaatctctgtaatactaacctaactcatggcatttctttaaaatcaaatttaatgaaatgatggacataaagcccatggaactgagtgtgtaatcttctcttatttgattagatgttaaacttgaaacacttttttttgataaaatatgaaatacataaatgagttaaattgttgtgactttccttataagattgaaaacaataaggtgtttttaatactttttttctgtgttctcttgaaagtagctttacatgtattaagcaatcctggctttagatattagggacaataaaaatatctgcaattttcccagttttatatagccattgtttgcaagtatgaaaacctgtcttttgttactgaaatattatcttttattttggcttttttgataacttttatgtttgccttgagcaagtcacttatcttttctatttgtgttttctatttcagtttatttatgaaagacagtaataatgattgtgatgtaccttacaaaaaaagataaaatcgtattgaagagactgttgaatatgaacgcagtgtattaaatgcccgatataggaacaaaaataaaatgaagaacatttctattataa

SEQ ID NO: 977 - DNA, 1102759 bp, Homo sapiens
tacaatattaagcaaaaccaatatttattttaatgtgtaatttgagccctgaggcctctctttataaagaggaatattttttcttttttttctttcttttttttttggaaaagaaagtaacattttaatgaacagctttaatgtgaactaatgttaagatcaaacattgtttctagaatttgggacttacatattgaacttgatattttcatatttatttcaattttctgaaaggataggataaacaaatacgttttagcatacagtttaaaaaagaaaaagaaaaccttttgaattagaagaaggtggagatcagaaagtgttcttcttttgttctcaaaaggaatgaggagagtcagagtgtcgctattgcttcttgacataaagacggtgtctttgttttatgtctttatctctgaatcccgcaataccatcacagcagagtgtactgtacaccactttaaatgataagagtttcaataggcactttagtggaattaagaaaaatctaacactcttccaccgtgatgccacatagctatcttcgttctaggttgtcatgtcagtaaattgtattgaataggcctgagcttgtctcagtgtgattgtgaaaaaacaaaacaacaaaacaaagcaagtacacattataggatgtatctcttgttggcagaataaaccaaaactgacaatatgattaatttagtaacttactagaaaccaggtaatcaaaggaatcttgtcccagagtgtgtgtgtgtgtgtgtgtgtttgtgtgtgtgtgtgtgtgtgagagagatttctattaatatttgtgtttctttttcttttttaaaaatctcccctctcggttgtattttagcctccacgactcccttaagtgactttatcagggttataactctcttcttcgccaaacatgtctgccaagactttaaagcggggtccccagtctgtcagatagtcatagtcctggtcggcttctgtggtgagagagtctatagagctgagggactctgccacggacccactcccttcgtaggcatatgtggccagtgaatcgtatggtggggcagttggatccacatcattttcctgtagcctttgatgaatgaaatcccttatgtctgtgttatcttccatgggtggtctctgacgaggtaaacagagagagtctggttttatatccctgcgaattttgttctcctcaatcacttttgggtttctcagagccccgatgtcgaaagcctgggtatcttcctccccacctccttcatcatcgtaatggatgacgttgtctctgatgtcttctttagaggtcatcagggtgtcttttttcttctgccttcgcagtgctacatacagtacaactatggctggaacaagacaaaaattgcaatttgagaatagaaagcagataggtcatttcatctctccataaaaattaaaaatgattaggggtggctgagtttcgtgaatgacctcctgttactttcatagtaaacataccataatcaataggatcatacatatgtttaaattttgaaattgttaactaacaagaaaccatagcaaagttattcacaaaatgaaacaagtatgtctttatattaaagtattttagggtctggtaaaagtgtgtgttgcaacaaaagaaaaaaggaaatagtagttcttccactcatacagaaaattgtaagaatataagaaaacttgaatattatcatccataaataagactaccattcattgctaacttcccaattggaacattcctaattttaaattagaaatttatgtttcttatgcgataagcccaaatcttcactgtgaccattatttttaaaggcaataaataagaaagagagaagtagaggaagtagaggaaggaaggaagaaaggaaagaaggaaggaagtagaggaagaaaggaagtagaggaaggaaggaagtagaggaaggaggaaggaaggaaggaagatgttaaggaccttagttttataaatcttacaaactaaagcattaatttcaattctgtgtcctgccatattgagaaagtttttaaaacaagtgcctagaattcaggttaccttcataaaacaatattttaaaattgttaatttatgtacttttattatcaaaatctctctttattcccagttgatttaaagctctccactaaatcaatggtgtttatttctactatgcatgaataggcacagatacaaatgacgacgtcagtgctcagcttttcttgtcataataacccctctcctccatagtggtgtcaacaggtgaaagctaatgtgtgtttgatttaccagagcagagtctggaagacacctgtcatagaattataaagtagagaagaatgcatgatgataaaatttcatttattctctcttcctccaaaattagagatggaccagttggaaggagagaggagatctaggtagagtttctgtacagtgggccttgggagacgtttagcaccctgcactcctcccaagagtttatggaatctcagaacaaaggacatgattgtttgttcctctaccaagtatgtgagagactgcagacctcatggagcagccccatacataaaatgagttcagaatcaccatggctgagaaagaaactagctggatgtgcctgaggtccatttaaaagggacccaagcaccatacctttctgttctttctctcaccccacaaaggacatgagaatggctgagaacaagctaggggacctaaaggagtgtgagattgctcaaggaggtcaaagattagatggattttaagcagaccctatgacaggacaaagagtgtcaatatacactgctgtataccaaaaattcaccatgcctagaatagtgctggtgctctgtggacgctctggaagtatttggataaatgagtggcagatggtagtacatgataaagatgacctgagcagattacttgctacagtgtatgacggccagaacataccaagccatgttaggttgatactgtcaactcaaataacaaacagaaagagtttctctgaaataaaatatatttatttggaaatagagtatagcaatgggaatgtgagtgccatagtaaactatgtgtgtgttcaagagataaaggaagacaaaggttttcaaagaaaaaaacgaggaggatacataattgttttaaataattatccttgactacaaagattaataacaagggtgatgccagtccaacattggacaggcagttgctgggcagatgttccggcagaaatgattttgtataaggttgtgatggcctttgtgcggggttgtgatttttacagtctttttcattacaggcatataagggtgaaaaccctctctccatggtcttccctagctctatttgtcagggttttcttgacattagtgactccattttgactcttacaactttcaaaatataggaatactccaggactcagctacaagagaagagaggcatatgagagagaaatacttcatttgatgttaaacacctaaatgatcttgttaaatttcagatgtgaaaatattacttggaatgtgtccttaaggtttatattaacacaaaagatgccagggataatttattatgaattataaggatataaagaatactttgctctgcacaccaaagtttctcacgtggaattaatatctacaccatgccaattggactagaatttcaccttctacgtcagcatgaacttctgactcagggagtgctctccacaagctaccatataacgcgttactccgtgcctttcatctcactaattatttttttttctttcctagagataaagtcaggtgtccatatttgtcagattatttttggttaaacagtaaatatgcatacataatttgattccacaatacccagttgtatatctgttgtcatttgattttaaaggaatgaggcataatagaaaatctctctctacttttgtcaatctggcagtgaattaataaatggagaagctgaacagagttcatggaagagggaacttcctaataggtttatattcactctcacagagatattatagaatacatttactccaatcattttgctttggagtgtttccagatattttagtctgttctgttctagtgggaatggttagaattttgatgtaaggagatgcaagaaagtggaagaattacttatggatggcagtttaaacagaaaagacaaatttgaggattactttacattctgtttctttctgttcgctcttttatcttcctttctttattgaactggaatttgagaaccactgttcatcaagtatattttttaaaagatgacataatctcttattagacagcagcaattactaggaagtaaaacaaattgagaagttgttgtaaatggatatttattaaagaggatttcattgtgacaagggtcacaaactattattactagaaaatctcttaggtcttgaacatatttttggtgtttattttatgatgttatttatttatccccaataatatatatccaagaagtatgaaatagaaaaatagcattaataacaatttaattcaatacacatagattatcttctagctaggtatgacatgtcaatgaataaaaacttgtttacatgataaattgaggagagagatggaggagagagaggggaaaaaaaggaagagagagcgagaaaaaattaacaatgattaatattgaaaccaacctaagagtataacaatgcatagtagaattgcaatcaacgccccagtgctaagtcctacaggtagaaaaattgcttccacattacaagacaggatggtgccatcagagtcacatctacagactcgaatagtcattgtgtttgtgctgctctggacagggtagctgctgtcttctattacaacagggaggaaatacaactcttgctgcctgcggctgtatccatttcttcgggtttcaatccccgctgtgttgtctacaaaacatgacatttatggtaacatggttactataagcttcacttcaaatcttcaagttggtatctgctcaatagtaagaagctcttcttgaatcaggaaaatggattcttattttttttatttctgttcacattatgaaaactgccaaaatataatcaaaataatccttagaggaaaaacaaacattaatcttgtctgatagaagaattaaattttctattcagaaagattatggaatgctttacaagacagaaagtgtgttaaattgatcaatttttttatgacattgcaatctcattaaaaaatagttttgtaaatagtttcatgcataatagaaaatattacaaactatgaatctgtaaattatctcaaataagaacctattctttaaactatattaaaaccaattgactattttaaattaaggatttttctatctacatgttgtatatgtatatatgtttataaatatatgttatatatgtttgtatgtatgggaatactttcacctctgcatatcagctggaataagaaacatggaaaggaaaataagatttgttaaaaacattaaaaattgtaaacaccttgaactataacaatgactactttaatatgatttaaaaagtaactcattgtaattctggttaattcaaaaacaataatgtttacttgcaataatgtgagacaataaaaattactatttttatataaatgcaattaatacttctattgaaagtgctcttttgcatgcatttgctcttttatttctacacaaataagcagaaattttgttttatgaataacaatatttcatttgtgtgtcacagtaacccctagaaacgctttgttatttttagaaatgtgacaatatgtagtttattatagctatgcataacacttgagaataaggtgagataatttttaaaagtgtataatatattacagttgtgcaggtctgtcacaaatatgttactatttcaatcagattccatttttctattggcagactttaaattcaaccactgaaattgaggcaggttcttcagcaataggaagcaccaagacgagaaaactttatgggatatgattagggatgaacaaatggatattaattgaatcaacatttaaatcttcagcaattgatggttgaacacttgagtccgcggaaaaggaacaggctaggaataaagttcataatctgagtgaaaatgactaatagaaatagaatgtctggtgtgtctgcacttgggagaaggtagggatttggtattcttgaactcaatgtatgtgtcaaatggcagcctaaccctttttaaaatgtttattttcaatttatttatttattttgagatggagtttcactctgtcgcccaggctggagtacagtggatcaatctcggctcactgcaacctccgcctcctgggttcaagcgattctcctgcctcaccctcctaagtagctgggactacaggtgcctgccaccacgcccagcgaatttttgtatttttaggagagatggggtttcaccatgttggccaggctggtctcgaacttctgacctcaggtgatctgtccaccttggcctcccaaagtgagccaccgcacccagcccaatttattatttattgaaaattgaccataacaaatttattgtgatgtccatagtgagaagaaaaagacatactatattttatttcctctctaaatgctttcttttcactaaaaataccttacaaatctaattcattataaaacaaggaacatggtaaatggcacctgaaattttgtgacaagtacatgtctagtccatgagaaagcactctgctataagtcagtatcatgtggttcccattaacatgattaatctgaaatagctctttcagcaaagatacgttgtggaaaatagtcaacacttgggtttggtgaatgatgtgactatctacctagttgctgaagcctaagacctggaaatctattttgtcttattacatgatatacacatattgaatctagggcatctatcatgaagtcttatcaattctatttccatccatttgtctccatcttcacagtcagtaccctaatctaaggctctcacccatttactgcaatgacatctgaactagttttatctccctatgatatattttccatgctacatccaagcagatttccctataatgtaaatatgaatatgttatattcttgcttaaacctttcaaagactactaacattattggtttaagttatctcctgaaatggcttctggatagggtcctcatatggtccagtttgtcttagacagacctattttatgtgtgctgctgtgacataacattataaatatttcccccttttttataagtgtttcagtctttatgataaaatatgtggtcactctcattataaataacttcaagattggactgctgtttgtcttatggccatttctcacattgcatattttattcaaactctactcaacttgcttcagtgataaaatgtggagactctgattttgtggagactctgactttctttgcctaatcattgtagcaaactaatctcttcaaaatatcctctgattctatcatcatcatcaccatctcaatacaatttgttcacttgttctatatgcatagaatttataaaaatttatctttttattatcaggttataaaatcaggtgttttgatgattattttagagaatatggaaacttagaggacataaaatacccaaggttacagacctaataaagtcagagatactgattgatactcaaccttaatatttctaatccagtgtcctttatatttttgtaatggttgtaattgtagcaaatgtagtagcgttagcagtagtagcagcagtaggattgatggcaatagcagtggtagtagaagaataagtgtacaccatgcaatagttcacagccataaaaaagaatgaaatcatgttctgtgcagcaacatggatgcatctggaagacattatcctaagcaaattgatacagaagcagaaaacgaaacaccatatactcttacttataaaagggagctaaactttgggaacacagaacacaaagatggcaacaactaacactgggcatgccaaaaacggggagaaagggaggagacaaagggttaaaaaaactgcttatcaggtactaggttcactacttcagcaatgggatcatagaagcccaaacctcagcatcatgaaatatacccatgtaacaaagtgctaggattcagtgctgcacctgaatctaaaattttaaaaagtaaaattaaattaaaaaaagttgtattccatatcatgttaaataatagatatagtccacatttaaagtataatgtttctattctttgcaggtagaattttttatctgtaattgttaagtggctttttttttaatgattagagtttcatttacagtaatgtgtaaagacaaattttacacaaatttatttttaaagagtttcattctttccttcctcttcattagtctttaagtagcaaattctcattataaactatgcaaaccatgtctctccctccctctaaataaataaataaataaaagtataagtgtaaaccatgatggcattggtggtggctaaaatgatcttgatggtaacatgttttaggcattttgttaaggctttgcaaatatgattttatttaataaaaaatattatgaggttgacttgatttagtaaaattgtatacattaagaatctgtcattttggtagtatggaacaaaaatgcaaacctatgtcatgtcaaatataatacctgcattctttaaatttatttattatttatttattttttaacgtttattttagatttgagggtaacgtgaaggtgtgttacataggtaaacacgtgtcatgggggtttgttgtatgtattatttcatcacccaggtcttaagcccaatacccaatagttatcttttctgctcctttccctcctcccatcctcacccctcaagtagactccaaggcttgttgtttccttgtttgagttcctaagttcttatcattgagctcccacttataagtgagaacatgcagtatttgatcttctgttcctgtgttagtttgctaaagataatagcctccagctccatccatgttcctacaaaagacatgatctcattctttcttacggctgcatagcattccatggtgtatatatatgtaccacattttcttcatccagtctgtcactgatgggcatttaggtcgattctgtctttgctattgtgaatagtgctgcaatgaacatttgtgtgcacgtgtctttataatacctgcattcttaacctgtgctgtacggtgtgttattctaataaaacagttactaaagagctccctgttagttagtataagtaatgtatatttgggacaaatgatatgtttaaaacagggaaagcattcaatttctcagagagtcttttatttgcttgactcattgagagactgtccacatttacaatgcaagcaacctgccttactagacagtctgtatagattaaatatttaatttactactaggtacagaatattgcctttctcatgtaaggatctcatattttatgaaattaagtgcttcaaagaaaagtattgattcctccctttgtgcctttttacaaagatacatgataagaggtaaatttttctgtagttacacttacttctgaagtcacgaactgtaaaatttggtttgatagcagcctcaggtgataatctaaaggagaattgttgcccagcaggtgaaagatctcggtctgcagcactgactatctgaattatctgcaacagagttgagattaaagtcggtcatcagtttcaaagaggactttacacagcaggctactaaatgtatttaatgaagcatgcaagtagacagaaatggcactttttgaatcaataccagtaggtcaattatttacacataatgtttataaacaaatttctaacatttacagggaataacgacaggtacaattatagaacatgggctaatttcaaattgatacctgcgtaactaaaaaggtaaccagcattaaaaattcacactaataagcaaagtaaaattaaaatgtacttgcttgcattttaaattagatgaaataaatgctttctagcctgaatgtgaaaatgcttactgaaaacaaaatctctgattatctaaaagcccttgtgatagcaaaatttagtatgagttatgttttgtaacaatggctctattttcataaataaataaaatgataaatagagatacaaaagctgtatatctgcttttgttatgtttttcttcattcggtaggaatacaaattgtgttttcaaagagtttttaataagcactatcattcctgttacaaaatttttcctaaattgcttccatacgttgtgtatcttacagttaaaagcctggtacttcaataaaatgcccttaaatacttggagaataaaaataacttctgagaatcaacctgtgaaatttacaatccattaaatagataagcaagtaagaatggctttgaggcatttatttattaacatatccaatggctgtgcatcagacagaatttcaggaagtgttatgtgagagatgacaagggcagagtgttggccagataatcatgctctcagactacatttgaatctgcaagaggaaggctctagatttcacacacggatatcctggtcccagtgtgtaaagcatgcatcatgtgatcttacactgatgctattaaacgtgagattcagttaaaacccaatctatgactatgatctatgttcctgtttatctgcacacacagagacacagatagatgttagatatgtaggtaggtagatggatggatggatagatatagatagatagatagatagatagatagatagatagatagatgatagatatcactgggaccttggatatccagtgcagcattagtaatttctaatttaacaaattaattggtcctctcgtatgaattttgatttcttgtcttagtgtgaattagtcacacagactctatttaagctttaaaattgtcctggagagaatttcattattcagcaccaaagcctaaatcatggaatgtggcaacttagtcaatgaatcaacatacagaccctatgaaaccaactttccttcacttagaccaatgtctgcagatcactcaatttcattgagaaaatctctgtatcttatccggggactaatacctggctgttaaattttgctttgttatccttctgttataaactagcaacattactaaattaaatgtataacatcaaaatctatcaagaacataactagaataaagaaaagtcctttagaatagcatatagatataaagactttgttatagactggcacttatctggaagtgttgcttggaagtccctgccctgaggaaaacaactaccatctaaatttgtactgatttacatagcataatctttcctccttttcttatttttttcagaataaatagatgaaatgtagatgatagataggtagataatagatagtagcataatccaggagagacagttcgtatgcatagttcttagactaggggcagaatggcagggctcaaaaacagaacatatatacatttctcatatattacaatatattacaattaatttctcatatattacatccctgaaaactcaatggacatttcagggttatgctttgtagaaaagtgtggctcaattggacacaaaaaccccataaatatattttagaataagagcctctaagaatccaagatattcctcaaaagtttattcagatatgaaaaaataacattgatttcaactaatttccttttctcaactcatcaaatcctttaatttattggacaaacataaaacattaaatggagctctattcccaaaggcttccatttggagcattacaaatgaaattctaattgatctgaaatcactaatatccttaaccacctaaaagctaaagaactggctttttttttttttttttgtctttgtttagtgaggcatcctgaaagtggaaaatagctaacttgaggaattttggtaaacctcttcaaactcccaaaacaaccaaatcaggttatttattcaggcccaaatatttttgtagcacctaggatttcagaaactaaagaaagctgcaggctcatcccatataaatcgtggatgcacttaaggtgataaattttaagtgcattctgtgccgatccaaaattaacgatgcagatttcttgagaaaatatcacaaaataagttgtgatgtcagaagattaatgagtccccacattatcaaatggaagagtagagcagcacagtccactagaaatgtccatggttatgaaaatactctatgtctgcagtcaccaaaattatatctgctcaccacaaattgagcacttgaaatgtgattagtatgaatgagaatatagtttttagtttcacgtaattttaattttattttaatagctatacaactagtagacatcacaggtttagaactatgggacaaaggttctactaagtgatgtaaagcatggaaattgaaaaagatactaaagattaaataacgacttttttcaacaaaaatactgttttaaatatcaagacttatttcaagtaagaaataaaacttcgaatttacttaagtgaatagttacgctatttaaaggtgatcaaaaactagagcaaaccaaagcataccaatgcattttgtatttggaatgcagatccacaatattagattaaacatatttttgtttcatgacataatcttttcatatatccatgcctgattccttttatattattcctaaattcattcataagactttaggaggaaaaaaataagaaaaaatggcaacctaccaccacctaacataaaacctttcacaatcagtttcattaactttgtggtcttctttcctcataacatcttcccacaactacatcttcacagaataatattaacttcataagaaaaatgaaagtcagacatttaaaataacccagatgttctcctcaaggccaccagagagggaagctttgcattttcaagttagattaaaagatttgttgtgcaactaatacaagcaaatgagcaaaataagaaatatactgggaaaatgcactctaaagtggcttgcttactgggtttacagtcacaggttctttagaaatttgtgtgtgggggctgggtgcggtggctcatgcctgtaatcccagcactttgggaggccgaggcaggcggatcacgaggtcaggagattgagaccatcctggctaacatggtgaaaccccgtctctaccaaaaatacaaaaaattagctgggcgtggttgcgcgcgcctatagtcccagctactcgggaggctgaggcacaaaaatcgcttgaatccgggaagcggaggttgcagtgagcagagatcaggccactgcactccagcctgggtgacagagcgagactctgtctcaaaataaataaataaatacaaattaaaaaaaagaaagaaatttgcaggtgtgtcacttgaggtcaggagttcgagtccagcctggctaacatggagacaccccatctctattaaaaatacaaaaaattagctgggcatggtggcgcatgcctataatcccagctacttgggaggctgagacaggataatcacttgaacacaggaggcagaggttgcagtgagccaagaatgtgccattacactccagcctgggtgacagagcaagacttcatatcaagaaaaaaaaaaaaaaaaagaaaagaaaaggaaagaaattcaacagtaggagaatagaaaaacatagcagaaaccacaagtgtagacctttaattatacaaagaactttcactaagcaatcagtacttcatctgtgcggtatcacctccacatacattcatctatatcattaattcacaagagtttaattaatcttttatggtttcttttatgaaagctctgattcagaaaaacaaatatatgtgtgcatattcatgtctggacttataacttaaaacatgcatatggtgggtctttatacactcaaggaacaatatttataagatacctgtcctggcttggcattttcacacacggctgtctcatatggcacagatatttctggaggaaattcatttacatctaagacattaatcagtatattgactttgctggtcaataaagggttacctgttaaaaacatataaagataaaagatgattacaaaatccggtcagttattgcttctacaataaatagtatttacatttttaaaaatcagcctttatatagaatgaaaaaaaatccttcttataggaaatcctgggggttccaactacaagatgataaaggatcctttttatctttagaattcaataccaaagtaaggccaactatttaattgatattttagcataagtgtagccctttctaaaagaatgacttagccatcataccagggttagttcacagaaccaatccttaccaacagtgatatttttccccagatgaaaaattgtctatgttgtacccacataatgaaaacgttattggttggatgatctacatatttaaatgactcactcaaaatgattcctcctaggagattcctcctgaaaagaagaactataacaaaaaaaaaaaaaaaggggaaagaaggctctttataaatgaaaagtattaaaataaacttaaggaagtagaactaagagatggattatggaaagctagtatacttccttaaattacttgctggtgataaaaaaggaagtaataaacttctatgcaataacttacttcttcctacttcctagtatcagaaagactgtcagtttgacaagatgcttctgccaaaattccatcacaggttttggtcccacctatggattattatctggatctctgtcatttacggaataaaactagaaaataattaaatcaataaagcataaaataatgcacctgtttgaacttgtgcaatatataattttaccttatgaagtgttgcagatggatgaactgttttgctgaaaagacctcttgctcagaggcagaaagctaaatgaatggggagtttagatccaaacccaggattataaaaatctaaagaccatgtttattccatcataccttctccattgattggtttatgagttaaattcttctgcaaagccaccaaagacttataatattcttttagacatctatctagaatacttcaaagaatgcatacaaaatcattccacacgactgattttgaaaggtatacaatatcttgcttagttaaaattcatttaaaaaatacataacaagcgtttgacacaatagctttaacagcattctgatattcacatatgacagtgaaatccattatttgtaccaatacctacacagataacataaattgcgtataaatagtatgttcttataataccaggcgtgcttataaaaggtagattaataatcttggagaattattcagaaagtacatattatttaaaaattgatattggtcacaagccactatcttatttaatagaaactgtttggcccggttttcacaagttgtttcatctttcttcaactcagtttccttgtatgaaatacatggttttcataggccctgcttcatagtgctgttgcattaaatgagatggtattttacaaggtgtttgataaattttggtaaatatcattactcattaccatttatactttgtggaggtgatcaagatctgtttctgttattgctatccattatttacacagtataaaatataaataaaagttaacaagttggttaaactaactttacttttctaaagaaattggaaattacaaacaacagcaatgcctaatgcctaatactttagaatgcttgcaatgtacaaatattcaaagccacattacaaacatgaactaatttagactttacagcaactatgatataggcattatttttatctcctttgtgtaggtgaaactctgaagagacagggatgtaatttctcaaatgtcataagtcaaaagtggtaaggctaggttttgattccagctgttctgattccacagctcatgctcttaaaatctattatatattgagctttagatgaaaaaataaaccactttgacaattatataggtacttacaaaaagacaactaattcattttataaagtttagtaaatgaatgtgaataacttaaactactcaacatctgggtaatgtaaaactcagtttctattttttattttacatagtatataatgtatgagtcctgcagctacatgaaaatgagaatgtcttttttactttatttcagtattacagttttgttttattaagttggtgtgacaatggtatatcttccacaggggacaggagttttcctagagatttattttataatataagaaaaagttattaaaatgaatttaggcctggtttatctatcagaaattaattctcttctgctagttgtaaattattttctaacctacaaaatagattctaatatctgttatgagtaaattgtcccaaacttattcttaatattgtaatttttttattaacagtgtttccccaaaagtactattggcattttagctatgacaatgttttgttgtgtgaaacttccctgatcactagatatcctacagatatttagaaatatctaatttagaaatatctaaatttcctgaagattaaatgtcacaaggcatcattgtggcaatacaaaataagtgttcaaatagagagaaaataacaaaaaagatgtttacattgttgaaaatgagtaacaagtttatctgtttaataatattactctctcttctatcatgtattttcaaaactttccataattaaacattaagaacgtcacctaatatttttaagtggccatttaagaagcaacaacatctcagtttgagaactattgtactcaaatatgaattgaaattttcacaagaatgaataatgcataggagtaatacagcatactttaatttatatagagatatattgtactaaattattttgaaaagtaatgacctattttcttactgactcatctaatgaatatttggggcagcaacgatgaaattcatttaaccttgattcagcatgagtattattatacaattatttgaaaataacaccatatggaaattagttactgttgaatacttatgaaggaaatttaattatgaacctagtaaacattaaataatcaaagtcttacacaattaagtgttaagttcccaatagtgaaaccatttaaattccaattattactgttccacattgcctatatttaatagctagttactaatttgaggctcatatcagataacaaataaataattctatgtttgtcccttataccttcacaatgctttgttagatcttcctctctctatctttcaataatatcggagtcagatcctatagcattttgagtctatttgatttagaacctatttcattaatattttaatgtacagctaaactaagagaaaaaaaggaaaataataaattacctaaatctgaaatgaattaactacttctcattataaatgaaatagaaaatgataaaggaatcttttaaattgctttatgcaagaacatagttaacaggtgaaattgacaaattccaacaaaatgcaaattaccaaaactgactcaagaataaacagaaaatcttaacatagttaaaacagttaagaaatgaacttgtaatgaaaaatctcctcatcaagtaaagcccacacccaggtggcttcatgaggaattctatcaaatatttaaggaacaaataatatcattttcttacagtctctttcagaaatagaggaggaagcacttaccgctgaatcctatgtgccttgatacgaaaaccaattaaaaaatcacaaaagccaaaatcactgactattgtttcttataaacataaatacaaacactccttaacaaaatattaacgaattaattccagcagcaagttatacagataatatattatgatgaatgggtgtttatcctggggacacgaggttgatttaacatccaagaacaatctccatattaatacaaggaagaacaaaatgttacaaggctatctcaataggcttggaatttgcatttgacaaaaccctagtccattcgtgataaaaactctcaagaaacaataaataaaaggcagcttcctcaacctgataaagtatgtctgtgagaaactaatatcacggtaaaagacttttttattctaacactgtgcacagaataagaatatgtgctcttgaaatatatatatatcttcaacattgtccttgagaattttatgcattgaaatcagacccaaatataaatttttaaatggtatccagatggaaagaaagaaataaaatgattattgcttaaagatgacatgaacctgtagatggaaaatgctaaggaatctgcaaataaacttagagatataataaaggaatacatcaagttcatgggataggagataaatgtaaaatgacaattgtacacttaatatactagcaacgtctaaatttgttagtatattaattacccttctatactcaaaggaaaggaggatagatctcacttcttgaccaaagaaatgtcagcttaattgtcagaagaacatgtcatataggatagatttttaggtgtgacataattagaatctgtaatcagaaatctcttttagaaatgggttcactgggaactaccattgcaacttttgataaaccctggaaaacctgaattttaaatataaaagagaatttaggcattatataaacttatagttctcatgctattcttcgtagtgctacgtggtttcgttaggactaaagataagctgttggcatcaaccaccattttcttgatgtaatctattgagattccacataagattttatttgacaaagtgtcctgatcatctacaaagtttgaaaactatagatgcatagacatctatttatagatggaaaacattgatataatctttcctatgatttctattggagtcaagacaggaatccagatcttctcacagtttctcaacgctctatgatagctattaactaactcagagagcaagaagatggaatgcctgaaatctaccaacatatgtgatgatcaagtatcctcactgagtcacattcagaactcatctagccaccaggctatgaggaagcccactttacattcaaaggacaaggcagagcttcttaaaattgtacctcgtagatgtgtttccaagaaccaaatgagaagtgtaattgaacatgttttgaaaatggtaaagtactaatgaacacaaggttcttgttagattaaaatacactggagttattttgtttctttattgaaaaataacatctctttggaataactataagagttaaaattcggccaggcatggtggctcacgcctgtaatctcagcaatttgggaggccaaggcaagtggatcacctgaggtcaggagtttgagaccagtctggccaacatggtgaaaccccatctctactagaaatacaaaaagtagctgggcatggtggtgggcgcctgtaatccccactactcgggaggcaggagaatctcttgaacccgagaggtggaggtaacagtgagctgagattgtgccattgcactccagcttgggtgacaagagcaaaagtccatctcaaaaaaaaaaaaaaaagttaaaattcggtattgtgatttctcaaagaacttacaacagaattactcttcgacccagcaatcccgttattgggtgcatagccaatagaatataaattgttgtaccataaggacacatgcacatgtatgttcattgcagcactattcacaatagcaaagacacagaataaacccaaatgtccatcaatggtagactggatttttaaaatgtggcacatatacataatggaatactatggggccataagaaagaataagatcatgacctttgcggaaacctgggtggagctggaggccattatcctaagcaaactaacctaagaacagacaacccaatgccacatgttctcaattgtaagtgggaactaaactttgagtacatatgaacacaaagaagggataatagacatcagggcctacttgaggacagagagtgggaggagggtgaagatcaaaaaactattacctagtgacaaaataatctgtatgtcaaactcccatgatatgcaacttacatacataacaaatctgcacatgtacccttgaacctaaaatgaaagttttttttttttaaagttaaaattcaattgtgtgactgtgttctaaattacaactacaataacttctagaatggaatcttagccttttatgccatgaaactgaattatactagtgcaaactcagtaagatataataaatgaatgatataggttgacacaggctttctttgacttttctctttagttcagttatgtttaaatggcacattaaattatatcatgtctaatataatctgtagctagtctggggaatccataaagataatttcttcaccaatatacttctgtgattccataaaggtggattcaaagattttctgatgggcaattggttgagagtgttaagttattatttaaggacctggaatcaataaaaaggagtgtctgggttaagattaggggttgtggagaccaaggctcttattatatagatgaagcctctaggtagaaggcttcagagagaatagatgctaaatgtctcttatcagacccaaaaaggtactagattcttagttacatctctccaggatcaggaaaagacctgaaaaagaaagaaaacgatgtacagaatgtaaattttcccccatgagaaatagcattgcaggcccatttcaaaatatgtcaaataaatatattttggagtaaattactttgattccttttagggcctagctatctgtcgtgtcatgtgatgtcactagagtcaggatgaaatttggtatcttattgctacaaagagtctgttttgtcattcgtaagatctttgtttcaatgttattgctgatcagttgtgcctgatttccaaaaggaacagagtattgtgagacatgttcgactccccttcccatcatcatagcctgagctaagtttttcagatttactttggaatcctcttggttgagaggagaggtccattcagtgagttgttgggcttagaattttatttttggtttacactgtaaccaacataaattttcaaaagtaccggtaagatcaagttctgtctttgattatatctcctcaatgtgtacctctttgcttcaggataaaaatcaaaatatcagaacatgctgagaaaaaaaatcatatttgtcatctggattttcttcattattgggaggcaaaggggatagtgagagacagaggcacagagaccacagagagagttttaccttgtacttatccttggtttcttttctctttcctattctgaaatcctgcatatttttcggaatattttatgctttattccatttctagagcttgatgtatgctatttctgccaacgaaaatatctttttaccttcttactattgatccaccgaccttggccttccaaagtgctgggattataggtgtgagccaccgtgcctggcccaaatagaatctttgatactaagaagtttatactaagaagtatgaacttgtaagtatcatcatatactatatcatattgaatctattcctatagtaattgattcaatatgatatagtatatgatgtcaacaagataacaattccatgtaaaaacattttctaattgtgaattctctcttgcatgtgatattaaaaagaattttatctacatgtctaaatataatttttatccaaatttcaacctttaggtgaaaagttcatcatgtagttttaatttcctgtgataatcagatactaattaagaaaaatataagcctggcattatagttgtacatgtgattttgatggagcaattagattgatttaaagtattcttaagcagtttgattacagtaatgtacgcaaaagcagttgaaaatttaagataaaatacagtctatcacaatacaaatttggatttcattacatttacatagcatataataatgagaaaaatggtattatttctaaattacactgatgattatggtgatgttaatgattattatttccgatgtatatgatacattacagtgctttacgaaatgatgtgaaaacctcattagtgattctttcttcgaagtactactcttcaaagttgtgatggttaatttgagtgtcaacttgattggattgaaggattcaaaatattgttcctggatgtgtctatgagggtgttgccaaaggagattaacatttgagtcagtgaactgaaagaggcagacccaccctcaattcaggtgggcctccatctaatcaactgccagtggggttaggataaaagaaggcagaagaacgcggaaggactggacaagctgaatcttctggcctccatctttcacctgtgctggatccttcctgccctcgaacatcagactccaagttcttcagcttataaactcttggacttacaccagcgatttccctggggctcttgggccttcagccacagactgaacgctgcaactattgccttccctatttttgaggtgttgagacttgcactggcttcctggctcctcatcttgcagatggcctgttgtgggacttcaccttgtgatcctgtgaatcaattatcttaataaactccccttcagatattcatctactaaggaattcatctactaaggaatattcacccttattttgttaagaacatgtttgtacatgtatacagttgtactaagaaaatatctttatttcctttttttctttatcatgtgacataagatttattgacttcatatcagcatttaaatgttgttaactttatataatagcatttaggttaatgattagtgtgcttctggttgtaagaaggataactgtactatgttaggcataattatgaccttattattgtcttcatttggtgattatgtatgatttcaggagatgtgtgtgggttcaagttgacaaagggtagacttgtgatggttaatactgagtgtcaacttgattggactgaaggatgcaaatcattgttcctgggtgtgtccgtgagggtgttgccaaagcagattaacatttgagtcagtagaatgggagaggcagactcaccctcagtctgggtgggcaccatctaatcagctgccagcgtggctaggacaaaagcaggcagaggaacgtggaaggaataagctcactgagtcttcctgccttcatcattcccttgtgctggatggatatttccttccctcaaacatcagaccccaagttcttcaggttttggactcttggacttagaccagtgatttaccagggactctcggtccttctgccacaggctgaaggttgcactattggcttccctacttttgaggttttgggactccgactggcttcctggctcctcaccttgcagatggtctattgtgggacctcatcttgtgatcatgtgagtcatttcccctaataaactccttttcatacattcatctatcttattagttctgtccctttaaagaaccctaatatacaagtactaataaaatattggcaattctagtataagccacacttatctttctttgagaatacaaaatagttttatatagttacttgggaaaaagaaaggaaattagaacacagtaaataaactacctacactcatgtaaaacaaggcatttacgaaaaataagaggaaagcaataatttgggcaattgaaagaagaaaggattgacatcaatttggaattgaaaccaatggttatgtttagtcctgaaaagtcaactacagtctttgagtaagtacatatattcatggtaactgattccactcttttgtttactaaaatttgagaatgacacagtgggtcccaaatcagtgttccttggagttactcagggagcttgtttgaaatggagatttcttggcagtactcccagaaagtctgattcaccatgacttgaaagaggtagaagaatcttccctttaggaaatgttccaggtgtctctgatgcaggtggctgtgattcacattgaggaaggccagtagagaagataaaggccaaaccaaggatgcctattctcaaagcgaatagaactattaataccttttttgaaaacaagtctggccaaattaaggagaatatttctgcccaaacaccacaaagaatccacacctctttgtcactttgtttctcgtaaggttaactatatagtcacccaggtgaatacactgtaagccaatcagtgcttgttcacagaaatgcaggcctaggaacagataggaaaagttggagaagtgaaatgcttctttggatccatagtaagctgggggcacacaggtagaggagatagaatgagaaggagggcagactcttagtcgcacctgaaaaactgcagattctcacaagtcttttaaggctctgttgaatgaagcctcagcctcctctctgaatgtctactccttgacagcaactataccacactgcttgcaatatctgacctcaacatgacttttcatagctatgcctttgcttaaaatgtttcttcaacctagaatggcatccttccttccatgatgattttcttttttttaatattttaaatccttaactcatatggagcttcctatgtgacactatgtttaggtcttcaaagtaattttttttaaaaaaataattacttattatattctttctgggagcactctgaattttgattttatatttaatgtatttagccagattgttgcatttctcttgacattttcagtgcctagaggccaacaaatatggtttctaattttttctcttttttcaattgacttgtctgattgccaagagcccatatggtaggcaagcttctataatggctcccaacgatccccacctcctgatattcacaccctcatgtaactcttttcctttaagtatggtctgaagctagtggcttgcttccaataaagagaatgtgggaaaagaggagatgtcatttctgacattaagttataaaaagctgactttcatcttgctggcactttctctttctcttgctcattttgatcatgccagctgccatgttacaaactgctctatggagatgctcctgtggctggaaactgagggcagcttcggatcaaacagcagtgtggaatagttgctcgtccaacagcctacaagcacactgaatcttgctatcaaccactgagtcaacttaattgcagtcttacaagagaaaccttagagaacaaagattcaccataaatggattcctaactctcctaactgtaaaataatacatgttgtttaaactaccaaatttgtaacatagcataagtaactaatacctcatacataaagagtaggtttttcttctaagttcctgcactcttcctccccaagaattgaagacctgttcgtgaatagcagtgtagtacctgagaacatctttcaaagaaatgttgctgtctttctacccttaaaatctaaatatgatccacttccgattaccagtattatgctccacctatttttaggatatttgtgacttcatcttctatttatgtgccatcctccaccccatttataattaagattgccttattcaagggcaccatattgagagtgccatatgctgcctgcatcattgaacatatttgccagaaagtcttattccttcccacaccctgccctgattttgaaggtctacattagttaatacgtcttgtgtgtcttaactaattctcatcactgagtcaccccaagacaggacctgtgatggcaccattgagcacaaggtgaaaaacacatagtttgcatatcataactaccaagtatgtttttgttcatcagttcccaactgaggtattgagaaattattgataatgaggctgtattttttcaatatttcaaaaagtctggtatattagatattacatatcatttcattataaggttaatggacacatcattttgtaattatatcaactaagtgtgctattatgttgatcaaattgtcactctgattaattaaacataaagttatttaataaatattgcttaaataagagtatgatgtcaggtagacaaactctttcaatgtacaagggaaattatcaaaaaagatccttcacaattaagttattaggaactcttactgtagcttgagatcctggtaattcacatttattgagcatagatagaaatctacctaactataccactgttatgtacataatatcacacacatatttttctattctgagtctctgttttttctttctaaaatgcaaatttctattgaattttgatatgtaagccctctaataagcttaaatatagatagataataaatacgtatttcacttcaactatatgtacattgcaaataaaaatatttagtcttttttactatgttattatttatctatgcaatggaaattactttgataattgttaccactaacattttttttttttttgagacagagtctcactctgtcacccaggctggagtgcagtggcatgacctcggctcactgcaacctccgcctcccgagtagctgggattataggcgcccgccacaatattcagctaatttttgtgtttttagtagagacaagatttcaccatgttggccaggctggtcttgacctcctgacctcaagtgatcctcttgccttggcctcccaaagtgctgggattgcaggcatgagccaccatgcccagcctaccactaacatttttaagttaacattctaactgacagatacaactgtatgtatttaccatgtacaatacactgttttgaagtatatatacattgtagaatgagtaaatctagctaattaacatatgcactacctcacatagttataatttttgtagaaacattttatatccactgtcagaatttttcaggaatacaatatattaactatagtcaccatgttgtacaatagatctcttgaattaattcctcctatctaactcaaatgttttcattacttgagcaacatctcccaatcacaacccctaaagtatttaaaataaataaatgaaacatggtgaatatgttccctgtgaaattgttgtcagtctcatcctcagaatgtgttctggaatgagagactccagggtgttggtccgagcctggtcatcattagctgtgtgacactgagctacagacaaaatatctctgaaagtccattcctcatgcccacaatgtgaacaagaacactcactctgcaggttcattgaaaggatcagatgagttaatgcatagaaagctattaatatagtttattactttattatattgttaatgttattctagaaaaattaggtactcacttctcatatgttgtgataatatcattccagagctgacaatttggcatataagccaaaaaaaaaaaaaaaaaaaaaaaaacttcagacgattctgccggaaaaatctctatttttttttttttttgtttaaattcttcatgaccatattgtcatcagtcctaaatttttgcaaccaccctctgaagtttatatgacagttcacttaaatctaatttccctggaattcagcataatttgcacagttattacttaccaaaatttacaaatctggtcaacttataactactactaaattgtaatgcccttaagaatagatatcattcctaatcagttttctcctaacccacaacaaataatgttttgctcatagatagtactctatacaggtgataccaaaaaatgcatgaatttatgttgaatctgaattataggtaccaatcttgaaatttgattttctgtacatataaggataatattacttcatgtgaaattttaaaaagttacaacataaaatagctatatagaagataaccttaaaaattaattatctaacaactttatcacaactcataatgatacaattatatgtaaacttttttcaatatagcatttagtaagggaattcactgtttttttttaacttattccacaataaatgggaccaatgcactgccatcttgataactaataggaccaagaaaagcattgtctctggtatcacctttttattttataatcatataaaatatattctaaggatttagtgaagttatgtttagttatatttatttatttattcactttctttttccttttgttaattttgtttttcttttttgagacaggtctcagtatgttgctcagactggtcttgaactcctggcctcaagtgatcctcccacctcagcctcttgagtagctgggactacagttgcaagccatcctgtctggctagttatctttaattaatgacatttgttaaagtaacacaaaaatcctagaaacatttgcctgttgaaactttctgataatttgaatgaagtaaagtttggagtctctgtctcattgaaaatactcaaggttaatataataaaaacagcaaagcagtaatgcataaaagaattattagaagtctaataaaattatttggacctccaactatagcaacactgattaatgactgctttttaattaattgaaagttgttcaatcatcgtgccatttcatttcacctgagagtttttataaaagggtcagagccaaaacatatgctagttcaatttgcaataaggtatacttaagcaatttcattcttcttggcagggcaagtgtgggctattcatttctcatttattcacggtgatgatattccctgttcagctggctagtgtgatcaaggaagacagtcttaggcattagaatatgaataaagtttacttttaagctgtgcattcaaacaaaataaaaacctatgattacctactcttcttatagaatctttaattaccacttgatagtgtttagcctctttatttttcatacagatatacagtctttgtcatacccgatttcctttatggttctaatatctttacattggccactgagtagatagtggaattaaccagaagtccattttaggaatattagtttggtatcactcttagattgtgcatatattttgttaatttgtctaagtcccagttctgcctatgacccagtgaggagcaacataacttattagcctccataccctgtggattcctgattttcatttaggtaaaaactgtagccagcagctggtagtgtgacagagcccgcatatgcaccaatcatattaataactaacaaattaggattctaagatctaaactttcagggactaataacacttgcttccactataaaggttcatacttccttccattttctaaattgttgaagctcaaggctctgaaaggagacactagaccttatcgttatgagtgtcttcaatcccataattgctttgataacccaaggagccattggaaagaaagagacctgccacagctacagcagaagcaatcaataaactgtctgagacatccatctagagttaaggcacacaagcctattatgcctacatcaaggaaacatgcacctgtttcatgtgtgtatgaataggaaggtttaggttagattagatagttttctactgaataatcttttattatggacaacatgtttatgataagtagaagttattgaagagactacctctggtcagttgtcatttattgtatccccaccactggagtgaaagtaacatggttcacagaggtcttctattctgtaacttagacaactcattttcaccatattatttctcaaagatcttataaaacgaaagtggatttttaaaattatgatatattttagctgtccccaaattctgcataaatgaaataaatgaaagcatgaaatgaatgaggaaaacatatgtaactataatagaatgtggtatgggaggggagatagatgccaggtgtgaaaggagacttggggaaaacaaagagaatgaggatgggagcccttcaagaaggggagactgtcattctcttctccctataatatgactgcttggtagctaactcactgatcatcccaagcctaactgcccaaagagggcagatatgaaagaagacggcaaggcagaggaaacctgcaatatagtggcaacctataacgcacctgttttaacatcataaagatgagtgaatttcccatggtcagctggacacaggagaaaggagctaaaattgagaaaccgtgctgtcaatttacccaaaaagcctgcctgctaagcaaggggcctctagaattaagaagttataaggtctaccactgggtgcccatgtcagattcctatgcggaggggacacccagagcccccaacagcaaataattcacaaaattacataagaattagcatttgaacaactgtctttactgccattccattttagccctaaaaacagcggcaaccagaccaggcacggtggttcactcctgtaatcccagcactttgggaggccgaggcaggtggatcacctaaagtcaggagttcgagatcagcacggccaagatggtgaaaccctgtctctactgaaaatacaaaaattagccaggtgcgatgatacatgcctgtgataccagctactcggtgggttgaggcaggagaatcgcttgaacccagaaggcggaggttgcggtgagccgagattgcaccactgcactccagtctaggtgacagagtgagactattatctcaaaaaaaaaaaaagtggcaaccaatggagcactatattggcactatattcatagagatttatgcattttaaaaattttcctttcctttctattgcaagaaactgggaatcagtagccccaccccgaaggaatgaaagttctgattatgtctttgagttcttcagatatctgttcccatgtatcagcagacatcaaaatgtagttacttttaataaatgtgaaatattgtaaaattgtgacaaataatttttcatatttattacaattttgtgggtaagaatttgggcaggatttgactgggctaatattccatttcacatggcattgatgaactttacactgtggtatcccactagtacagtggactggactagaagctcaaagacagcatcactcacatttccagaacactgggaggtatggttggaaggcagagctgagctggaattgtcaacctgagcaccgcaacgtggcctctctagtatggcagcctctgggtagtcagacttcttacatgacactttggaactctaagtgttccaacgagcaaggcagaagctgcgtgatcttttatgttagacttacttttaataatcaaaataaactaaaagtaatgggatcagctaaagatatcacgaagatgtgggaatgggtatctgactattcatgtttgttcggagttgttgaagacaaacaaaactgtttgatgtttacattcccactgagttggactgatcaaaacccttcagcagaaatgctcacagctattccctgcatggaaagtgggaattagctgctaaagtgttataaatttgcaccagatgcacaaaataaaagaagaaggaagcaaatggaagagattcagttgagatttttccaaacgtttcaagagaccataagtaaaaggaatggggagctgcacttttattaagaacaattatctcaagagccaaacgtcaccactttcaccctgatccattacttgagaaagttgtgataataaccttgatcgttctgccaaacaaataaaacctataatcactcagtctagaggattcttttctgaaccaagcagaaaccaactcaacaaataattcctaataataataaacattttgagccactccttgaagaactgcaattgaaactcctgtatattccatagtgatagtcatcaaaaataaatttgaataaagggagagaaaaggaagatgtatgagtttttaaatactctctttgatgtcagaaaatatttcagaatgggtgattttacatgataattatttcccctcacctggccctgtgaaatacccaatgatatgtaaaaggaaactgtgtggaagagaaattaaaactcgggtgaatttttgagggtaaagcatagaacaggatgaggtcacacaatgaaatgcactactagatattcatgcaatactgcaaacaggactcattggcagctgtcacaatttctctggacttatgctctgaggaaaaggaataggtttctgagtttccccgcgagaccactcagctgtcagtccaaaaatgaaaaacatctcagcagggactcatttaagagtcttaaatccaaagaactgcagtataacattgattctgtccatgccatacttactaactttactcgcaattatggagaaattatactgcgcagtgctttctctgtctagtaattcattagtggcgatggttccttcatttccatctattgtaaagtagctgtccccatcactcttccaatctatgaagtacctgtatatgaaaagagtagatgcaaatgtgcaatgattacacattaatcataatggcacttaggctaacttgacacagttccttatttttctccctgtagctattacccaccttgcaataaagaagactgtaaatgacagcttctttattgcaaagtcagtatgctcaaggggaaactggaaataataaaagatttagtactcctgctgttcatattattttagggccttgacaccttgaaagctcagcagagactaaaattctaaagctgaccatgagtttccttaacctgctgaatattaaaactttttcaagcagtaaaaaattccttaacagtggctatgactgtgtaaatggggttgagagaagcactggaaacaactacaaagaacccaggtcaaaacagaggtagaatctttgtttccagagatagaaaaaataacatcatggaaacaaacggtaaatttttttaactgacaatttggtaattatacaaaaatatttcctcaaacacatataaaacggtcatggttgttttattttgttatgtattttgttgtttcattgatgttttattacatatcaggtcaacattagaaaaacagtgactttggataatgatgtctctttatcttgtttattatgtgacatatttgataataatggatgttgccctacgtgaagcaactggactaaaaattccaagaaaatgaatagcaaaatagaaaatgcatgtatttaaatctttaagtaacagtagatatatggatcggcattatgtgaaatttttttccaacatgtgttttcaatcataacaatcattaacatttttaaatatgacaatttgatagacgttattctcaatgcttacacattgagaataaaaaatgtctgcagaatagtattattaatatgtcttacatatgagaaaagagaaagcatagagacatgaaggaatttgtccaaattaacatagttagaaaattttagattgatgtttgaaccaggtcatcaatgtttcccatataattattattacacagtcttaccaattttaaatataacattttatgggaaatgattttgctaatcaaaaggcacaatacacaaattatttgtcatcattttattctagcctggaaccaaagagagatcatttcaaacaatggctgaaagcagatggcatcattgttagtcagcccttggaatcaccactccaaagaaagtgttcattgtgaaaagtcagtaaagcgatgtgtatctcaacataaaaaactatttattttgacaagctgattatttgaaactgtagcagtttgtatgttatttcagttctaggtcacctgcatttacaaatgaaatacatctgaaatatatcattccacactagtctgtatctgttagtacaggtataccttatttcatggctcttcactgtatcgtacttcactcctattgccgtttttacaaactgaaagtttgttgcaaccctgtgtcaagcaagttcatcggcatcatttttccaacagtaagtgctcacttcatatttgtgtcacattttggtaattattatatttcaaactttttaattaatattataacagggtgatctatgaacagtgatcagtgatacttgatgttactattgaaattattttgaataagagtgaattattttgaggcaaatgaactgcacccatataaaattgtaaacttaatcaatcaacgttgtgtgtcctgactgcttcactaaccagctattcccccatctgtctcctgctccttgggccttctctagtccctgagacacaacaatatcgaaaataagtcgagtagtaattctacagtggcctctaactgttcaaatgaaagagtcacacatatttcacttttaattaaaagctggaaatgattaagctcagtgaagaaggcatgcctaaagccaagatagtccaaaagctaggcctctcatgccaaacagccaagttgtgaatgcaaaggaagagtccttgaaggaaattgaaagtgctactccagtgaagacaggaatgattaaaaagcaaatgagttttattgtggttatagagaaactttagcggtctggatagaagataaagccagtcacaacattcctttaagccaaagtctaacccagaatatagccctagctgtcttctgttctatgaaggtggagagaagtaaggaaactgcagaagaaaagtgtgagctagcagagttggttcatgaggtttaaggaaagaagtcatctccataacattaaagtgcaaggtaaagcaggaagtacttatgtagaatctgcagcaagttatcaaaaagatctagataagatcattgatgaaggtggctacactaaacaacagattttaaatgtatacagaacagccttctattgcaagaagatgccatcaaggacactcaaagctagagagaagtcaatgcctggcttcaaagcttcaaaaaacagcctgactctcttagtagaggctgatacaactggtgatttgaagttgaagccaatgttcattaaccattataaaaatcctagagcccctatgaattttgctaaatctactctgcctgttgtcttacaaatggaacaacaaagcctggatgacagcacatctgctcacagcatggtttattaatttcttttttaaagacagactcttgctctgtcacccaggctggagtgcaatggtatgatctcagctcaccgcaacctctgcctcccaggttcaagcgattctcctgcctcagcctcctcagtagctgggattacaggtgcatgccactacgcctggctaatttttgtatttttagtagagatggggtttcaccatgttggtcaggctagtctcaaactcaagacctcgtgagtagcccacctgtacctcccaaagtgctgagattacaggcgtgagccaccacacccagctggtttactaaatattttaagtctactgttgagacccacagctcaggaaaaaaaaaaatcctttccaaatattactgcttattgacaattcacctagtcacccaagagctcagacggagatgtataaggaaatgaatgttgttttcatgactgccaacagaacatccattctaaagtccatagacaaaaaatgtaattttgactttcaagtcttattatttaagaaatacagtttgtaaggctatagctaccaaagatagtgacttctatgatgattcttgacaaagtaaattgaaaaccttatggaaaggatttatcattttagatgccattaagaacattggtgattcatgagaggaggtcaaaatataaacattaacaggattttggaagaagttattccaagcctcatggatgactttgaggggccaagatttcaatggaggaagtaactgcagaggggtggaaataacaagagaactgaaattagaagtaaagccctaagatgggcctgaattgctgcaatttcatgataaaacttgaacaaaaggggacttgcttcttacagatgagcaaacaaggtagtttcttgagatgaaatctacttttggtgaagatgctatgaatattgttgaaatcataacaaaataattaaaatattatataaacagttaataaacagtggcaggttttaggaggattgactccaattttgaaaggagttccattgtaggtaaatgctacaaaacagcatcacatgctgcagagaaatactttgtgaatggaagaattgactgatacagcaaacctcatttttttcttaagaaattgccctagctaccccaaccttcaacaaccaccaccccaattagtcagtagccatccagttcaaggcaagaccctctaccagcaaacaagattacaacttgctgaaggctcaggtgatcttcaatgttttgtttttgttttttgttttgcaataaaatatttttaactaaggcatgtacttttttgggcataattccatttcacactgactcgactatggtatagtgtaaagatgatgtttatatgtactggcaaacgaaaaaactgtttgacttgctttattgcaatatttgctttatcgtggtagtctggaaccaaacctgcaatatatccagggtatatctgtaattgatttctgaaccagaagatgcttaatatttattagaataaagtatgagccacgctgttaatctaattttgacatttcttctgtttattggaggaatgagaaagcactgatgtcttccaatttcagtgtggtaccttagctcacatgaatgctctcaaaaattaaaaacgaagttaaggcacaccaaaaggtcagaaaacatagagatataatgagcttaattctccgtaccgcatattcttttctgaacaagaaagcatttctcaaaatacttctttatagcacctcatttaacttgccatatgcctaatttaataagaaaattgccactgaaactccttattaactgtagtatttctgaaagaattgctgatgtaggctcactgtgttcaatttttcaatttattaagtatttgctgagtgtccactatacactagacattgttctagagatgagacatataaaaataagtaaagtatgatgcccatcagtgaagactttagttgggaagacatgtataaacagactgtttcaatgcctgaaagagagatagtagagaaggctttgcaggagtgccaagaaaacacattgaatgtaaaacctagtgcttcaggcaatccttcctgcacatgatatttggctgacattagaaggctatatggaaatcatccaagaggaggttgaagcagaaaaagtgaggggaggaatagacggtgttttagaaaactgcaacagcagtagcaaaacgacacaggtggtgtagggagctatcagttgttcagaattactatagaaaactatctgagaagcataatgacatggaaaaaaatgagtgatttaggtcaaggaagatcttatacattatagttaaaaaactattaatttctctataagtagtccctggtgcatgatttgtattagaaactctcaaatacaactgagaggaatcactggtttttaatatatttttaatatttttaaaatatttcagatgtataataaagttgcaagaattgcacaataaagttccaaacatctttcacttacacttattatgttagtattttcccacgtttgctttatcactttctctcttctcatgagcacatgagtttttgtagaatcaaggtttcaagttgtctgactttggtaccattaagccacagacatgcacttcatacagtcatcagtttttattctttgataatcttttccttttgattaggttgtttaatccattcccattcaacagctaatattgatataatggtatttgcatttgccattttatttttaggttttctatatttctcatgtcttttttgtgtatttcttctctactcctttcttttacaataagtggatattttctagtgtgaaattatttctttaatgatttttattatataatttattttcttaatatctgctttaagttttgccatatatgacttaactcatcagattcacattcatactaaattagagtaaaatatagaaatgtttcttctatgtagttatgtgtgataattgtatgtattatatatgttacatacatatatgtcacaagtgcaataaaacattgtaacaatttttaatttttatagttttatgtaatgtttgcatcctgcccctcctggtaagatattatatcccttgactggttgcgaaggaaagagaaaccatgtctttttaccacacctgccaggtgggcatttgtatcaagccgagctgggacataggagtgggagcggggagcaggttctgggttaagtgtcactgtcttttgctattcttaccaagttttagtagcttttcttgaataaattgttctttatgtgctgcatgctcttagaaaattttccagagactgtaaatgagcgtcttttattttttaaagaaacaaatgtcatttatttttgtttcactggggagtgtgtctatagatcgcatcctgctgccattcattaagtggaaactccattcatttttgaaaatcccatactcttttcttgtgaattccagttaacttgcatgatatttttcaaagcttttctttacttccatctttgaaaatctctgcaatgaacagatcattctttaatgctaataatattcaattattatgtagatgttggaaaatatagcacagcttgtatacattttgtgtatgtgacgtgattatcctacttacccaaagtttgttaaatttcctgagagcagagactagctttgttcatctctgtgttgccaaggacctgggatgttgtttgtacatagcacctgccacttaaatattgtattgaattctttgcacagatcctattcttcctgcctgtataatagttacatatttctacatcaagggaacatatttagagctttaagactgtcttatttgggacaatcaattatttctgatttgatgaggactttctcagtttttacagtgagtgtctttaggcccagaaaactcctcaagagttttcccagataagattgggaaaattgatcaccttgtttatagttaatatttgtagcatatgttataatttaacaaattgattcaaacagaagtctaacttcatacagtgaatcaccacatatacaggttatgtttaaatgtaattttaggtatttttgataacgagtttaaaattcaaagacttacataatatatacatcaaataatacgtttatctcttagttatgtgtttctgtatatcaatccactaggatccaatatcttgcaagctcagtaaacatatttaattttttagttcattcagcctaatgctgaagtagaatttgcaatacatagattaaccaccactgagatgcaatgaaatgtagcatgaagcacagtaatttttttgtatagagagaattagggtgatatacattttattcacttaccttgtgcaattagtttagggatctttcattccaatatctattctccttatgttctataaaatttggaaaataatacctccctaatagtgtaaccatgagtgttgttataaaaatgaaataagataaagtatatgttgcatagggatagagtcatgtgtatcagcgtgtgagtgtatgtgtatgtccttttccccctttctccctctcctttcatactattttgtattacttcccagataaaaactcttccttacccacacattttcttatctggcatcaagtcgtggcacacataaccttcaactttctagtacttgaactatgaagctcccacacaaactcgtacagtacaaaccataaacacaaatatccaggctctatttcacacaatggtgcttctgtttgactgtcattcgctactttctggtatctattttttatctctgtcaccttgtgagacttagcaagctcctttctctgcatgataccctccaacaaagctttatatcttctggaatatagctgacacccatttgaacagttcctactcagctaagcatcttcaacatcttctcatagttagccaggtctcagactacaggcctaatactagctcctggcatcttcccagtgctctgtctatatgtgactgactaaaacctgtgcctgactaaagcacaaatattttctattgtgatattttatccagtatagcaactgagagacatttataagaaaagaccatcaatgaacttgcaatgaaaccattcctacattttctggacaattttggaaaagatatggcccagttcttaaaggcatagaaattttgaggagttacagcctcacagagtgaaacatcgtgtttctgctgttgggttgcaacagtctacttacaatctaaggataaaatattattggaattgcaactaatcacaacagtataacatgaactgtgtaatttggcctaacagatgagtttcaatgagcaaaatatttaaacagaaagtatgtttgactcatctcatacttatttggtgagtagatgggatttaagtgaaaaaacgattatatgattataatctgtatataataaaataaacctaatttcatacaattatgtacagtgattgttgctaaaaaaaaaaaaggttttaacatttgaatagaaatcagaaattaaaacattaacctagtctgcgcaggccatttgagagagtatggttttattcctatactgtaaattagttttcagaaacgcctttaaaatttttattctatttattaggtaagcatttcccttaaaattgtacttttcaatttgcttaataattttctcaccatcaatggaaacgctaactttgaccctgccccagttctcaactacatgtgtaaaaggaacttgatggtaccaaattcctctgaaagtactacacctcattgtttaaacaataaaaatctgctaataatgacacaggtcaaagtagaaaatgttattttgttaagataatgatagtagatcaaactgtctttactcttatctcttcttagttgccaatgtttttgttttgccttttggaagacaattaaagaaagtaaattcagttcaattcattttaacaaacactttactgagtacctaagccacctgcaacaatatgtcaattgtaatttctccatcagcaatcacaaataaatcccgctatgttcctctcaaactttttaaaccaccagttcctactttcctatcaatttctcttttttcttatcttcctcctcatttttactttccccttactagacttaaaagttgtatcttaaatggtttagatggtttctattgcttgttttaaatgtttgatgagaaactatttacaaaagtatatcatttaataaaagtaagtcttctgtctttaaatttcccatttgtacacatgcaatatgattaaaatagatctctaaagaagaagaaatataccataatctacataatgttgaaattataattgttgtatttgtattttcctccaagttgcttaagctttcctctgcccttttttttttttttttttttcttggaacagtcatacacggtttcttacggaactggaagttaacttcaaaactctcttctcctctgccattctgttggttatctgaccactgtattttgtctttaactcagagcaaaaataactttatctttgacaagaacttcttctgcccccaaagctttacacctgtcctttagtttactctgcggacaccttgaagcagcttgctctaatagaaagaaaatgaggtttagacaaataatgattaagtccaggctctgtacttaacagctttaaacatcctgagtctcagttttatcagatattaaaaaatgcagactgtaatacctgactaaataagtaaagaatgtgtgcagtaaacgttgatatctgatatcttctgcttagaagtatctttgactctagggacttcagaagtcccttattttggacttggttgtcagatcatttcaattttttttcctcccattcatgtcacagaactttcctaatttcctcagaaatcaaaggcacctttttgctttgctcatgttctccccattaagacttgctgaatccctctagacagcatctatttcttccttcttacaaaactgtaccattttttaaactttacttactacctatttgaattggtgttaacagtttctctcaaatgagaatagcaaacaaactattttgttttgttcattatacagggagtttttttcaagtatgaagagttccttactgaatatattgctctattcataatacagtgcacttatatgtgtaaattgaattattttatctgacttttcttattgataatgtcctggtcatatttcaaacatggaataccttaatttacatttttgaatattcaaacgtatttattctgaagtccttttgagagagcttcattataactattttgttgaactaagtccagtgcctgttattccaagtcaccactggatttatttactcttattaggtcatggccaaatggctctgaagaatggtgccattttatgtagagctgcttaccatttgaaacctaaatatagacatcatatttgaaagaaaggttttattttcctccttttccttctacctaagcttgcatttcctgcttgtgattagtctactgtttagctaatttgcgctctgaaagttactcatattcccttaactgaatgctctggaacagcttatgaaatgattcatttctcttgtgtccttttgatcactgattattacagtatttttcaagaagagcattttctatttattgtttatatatttaaaataactattttaatatataaatattattattatatagttgggactatactgaataaggtttcatatactttgtgcaaaattaatttaaaaatttttcttgatgtagaagatatattctagtgtataatgcaatgtactaataaaatatagcatgtatatgtatgtggatatgtgcatgtgagttttttcaaatcgaatataggtagatctatatctagatgtgtaaatataatgtctttttttcttaagggctcatacacctgggtgttctggcatgaactttatggggattaacctctgttggcaaattgtagtccagttgatctctattttcttagcaaattttttcttcttctctttcttgtttgcttttttttgtttttcatttagtaaaatgatttttcagtttctttgcttctataaatggagttaatacaagctaaataccatcagcacatttgcaaagagacttcatgcaaaaaccaacttcagagaaataattctcttgcgggtcctaaacacgcagtataccacagttgtgaaaaagatgagtagggcaaaatccccagagattaacacattcagctactcctgcagtttctaaattctacatctccttttattggtttgtttgtttctgagtttctttgaggtattccatatcaaaccttctgtttttcttttatgtccatcaatttgtacaaaatatctatttttttcatttaatatgttttgcattgtttctgtatatttgtttcctgtatacagtcaaatgatctaagaatttataatatattttttagaggtactttgagtcctagctattgttaaaagctagcagttgccttcacttagaattagtaaagtaattcatgaagaatagttttgttatagaaactaacacactattttttcttaatgtgaactttaaaatgtttttttttatgtagagcccaatttctcattttgtataactctaatcagcttttctcattttacattttattattcagttggtagaaaattacttttatttttcatggcatgctttctgagaaagtactaaatattcatataggtattggaagaagaatattatccatatatattatagaacattcattaagataaaagagttcatcttttttgagacctccatatcatatctatttcctttagtattcacaatgtgaatcttaatataatgtatatattctcaaaatcatcaaagaagcatctgacaacaagttcatgattatttgcaaagctacaggatcataatccatacaaaaataaatgtgattttttttaagatagcatttcctatcagttaattattagagacaattgtgatccaacattttggaacaaatctgagggttgaaatactgaaattatcatagtttctcagatatttttctagatttataaaggaagtaactgtgttgatttttcttcatgcagaaaacacaaatgagtactatgccattttaatacttagctgaaattagtattatataggtcaagtcattcattgaacaaatatttattaactatccacttgcgctaggcaatattttaggtgtgtgggatctatcaataaaaatgtagaaaaatctctgctgctgtgcagtttatatactaatgggaagcagaagaaaataaatcacatatgtagcactaaatatgccagatattgctctagaaacatttataccaatacttcatttaattctcacaaaaatcttgtgaggtagatgagaaagagagcatgggcattttttcaaacatttaatagaagttatacatactgctatagaatgtcacatgatagctgggcctctctttcttctctctcccaaagtgtgctgtgtctgaacttacgtttttgcacacatgctaagatttctgtcatattgaaaaggaccttcaaatgcaaaccagctactttgatactttcttaatcgagagtttcttaaaaatcaattccaattgattacagcaatttttacaaaagtgtggtaaaaagactagatttggaatataagatcatttttgtggaaacaggcatttttattttaacaactaattagtataatttaacattgtattctacttttggtagttgaaaatgttttctgattattatttaaattacctacttgattttaagtgacgggtttttgttagaaagatcattaaacaaaagcatagataagatgacaaatacagatgccccttgacttaccatgaggttacatctcaacaaacccatcataagttgaaaataccttgagttgaaaatgcatctaagacacttaagctcctgaacattctagcttagcctagtctaccttaaacctgtttgagcaacttacgttagcctacatttggacaaaatcatctagcgcaaagcctgtcttataataaagagttgaatatcttatgtaatttattgaatgctgaactgaaggggaaaaaggaatgaatgtatcggtactcaaaatatggtttctactgaatgcatatcgttttcacaccattgcaaagtgaaaacattgtaagatgaatctttatgagtcggggaacaatctgtacacttttaaattgcactattaaccactgtaattttgagtttatatatgcaagtctatatacataaaatagattttctttacatcatcattctgttattatttaattcttttgacatggattaaaattaaataatctatttttttaatttaataaaaatatgattaagttctatttttaaatttattccaaggataacagacttttatacgtttggaacaaaagaaaagtggtacatattgagcaaaattacccactgaaatctttctgtaacccaaatcactaatactcaaagtaaataatatctttcagtgtaactggataatcaacagttttaactttctaaactcaagaacttgctgttatgaaaagcccctacttcactaatgttggatatacttaatccagtctcgtttgactcactagaaattgtttctgtgaactatataatagcagtgttcacctcaaacaaatatacagcattagaaacaagaaatctagtgcatcaaaaggcgaaggctagaaaagtgaagaataactagaaattaagctggggccaaagggtgagagtaaggaaccagacagggtgtgtttgctagtcatgaaacctgagagaacctttcttcaaaacgggctcagtccttggttgtggcattgatgtggctctttgctgtgcttagtgatgatgatgatgatgatgatgatgatgaagatgatgaagatgatgatgataaaatacccaaggtcctaaattaatatcttgcacaataactctgtgaaaagacagttaagcaaaggaaaacaaaacaaacagcatatctaaccatgtcgagtaattttacactttaattcttagttttcacaaggtgttttcactctcattcttaagcgggtaaacacattttcagaacaaggaaagatgatgcctcataccccatgtttccttagctgacactattccagtttgttgttcactccaaggacatggaacaaagacaggtttcatgttgattcaaaaacagctctgtcttttgacaaccccttgtggagatcaattagatccatctgtgtcaagtgggccgactgcgactcattagaactaagacttggtatactactttatttcatataaagtagcacttgtcagatactagctactgtgacataaaatgtacaaaataaaaaacacacttacagcaggagaatttctttcatgttaacctttctctgttcctcacaccagggtcttgactgtaacaattttcttgaatttggaacgtgtatctttacctaataatgttttttacttaggaaatttttgatttttctagttcttaagtattgccttaaaatcatgtttttcttaatattttggcctcatcattcttttatgtcttcaaaatacaacaaacagtaaattaaacaacatagcatgttctctactctagatacatagtttctctatgtaaattcttatttattgacctgcagagagttttaattaatcttcatttaccttttaattatttttgttgcaaccttcaattttttttcaataactgttcacatttaaaaaagacctgtaaatctattcaccaggcatcttctacttttctaattatcaacagaacatcctagggcttcagaaataaaagactgataaataatgttaggttaatacataataattaccaaggcagcagattttggagaatacctaacaaatatttgaatgtatatgtggatgtgtgtgtgtgtgtgtgtgtgtgtgtgtgtgtctgcatatagccctataaaccatatatggttttctggaacttaactggaagtgaatcatgttgtaatatggaaatgtaaaataatagtttgaattcagtgagtaaattggttagcattcagcctgaaatgtacgggtgctcagtaattgttatacttatttctttttaaaagacagatgagcttttttagagttctctcctgattactgattctcttcaagaataaaagcatttgttatggactggatgtttatgtttccccaaaattcatatgttgaaatcctaatgtccaatgtatgatatatggataggctttgtgggggtaaggaggtcatgagggtggagtcctcataaataggattagtgcccttctaaccaagacccagacagctctctttctctttctgctgtgtggatacaaagacatgactttctgctgaatagaaaccaggcctttattagacaatggatctcttggcacattgaacataacctttccagctttcagaaacaagagacatatatgttttttgctgaagccactccatcaacggtaatttgttatagcagccttaagtgactaagacagacattggtaccaaacggtgggggtgcagctataaaaaatacctaaaaatgtagaagtggctctgaaactgagtaaggggtacaggctggaagagttttgaagtgctaaaattatgaatgttcaaggatattctgttaaaggttcagaaagaaaagagaactgtagagaaagattctgtcctcccaaataacaactcaacagtcataaacagaatgttggtagatatatggacagtaaaagccattctgatatgttaacagagagaaataaagacatgttattagaaactagaggaaaggtcagtaagtggcaaagaagttaggtggatggtgttcatggtctagtattttgtggaaagaaggacttttgagtgatgaaattattagatatttagctgaggagatttttaagcaaagtgttaaaggagtagcttggttcctcacaactgcttgcagtaaaatgtgaaataaaagaaatgaaataaagatgaattttttaagtaaaaagaaaccaaagcttaaggacttggaaatatctcagccccgtccgtgttccaaaataatgagaaagtgtgtttagaagagaacattaagggttgatagattgattacttaataagaagatttgtataggtgtgaaccagaacttcatctgctatttcaaaaaaagccaggaaaacagatgagattataatagcagaaacactgccagctggtactaaagaaaacagaaatgtggtaaaatgaaagaagatcatcaaacttcttcagctctgttaaatagcatcacatagctcttcagctatgagcattcataattctccaaatcgagggaagaattccaaatcaccccaacagtgatttgatgtcaccaggcttgtggaatggctgcttccataatgattttaaacattgggatcaatgcctagaagacacactggggtagggtcgctcagtggagccctgagagtgtgaccactgcacatgagtgaggacactgcagagaaccacagcatgggtggtgtccctccgagtggtggaggttatattgccaccctagtgagtccaaaagtgggacatccattctagtgggcctgagaggtgaagaatagagctagagaaggattatgtttgagactaaggtttaatggagtttcccctgttaggttttggacttacattggacctctcacccctctcttctttcctctttctacatcttggaataggaatatcttcaccattgtattttggaaacacataatttatttggtttcacagctggagattcacagctggagaggaatttggcctcgggatgaattgtaccttttgtctcacatttgtttggcttagatgatatttagatgacactttggattttaattaatattagaagaagttgagactttgggggcccttaggatgtctgcattttgcatgtaagaaagacataaatttggggtgggcagaattggaatcttatgagatgatatgtatccccccaaaattcacatcttgcaatcctaaacctcaatgtgatagtattaaaagatggggcatttgggaggtaattagttgatccggatggagccctcatgaagttatttttaccattacaaaagggactctagagagagctctctttctctttctccagtgtctggaaacaaggagaagatgaccacctgctgaaaagaaagccggtcttcaccagacgctggatctgctggtcgcttgatcttggactgtctagcctccagaactgtgtttgttacttaagtcatccagtgatatggtttggctctgggttccaatcaaaatctcatttagaattgtaatccctacatgttgaaggagggtccttgtgggaggtgattggctcatgggagtgggggtggttcccccatgctttgctcatgatagtgagtgagttcttacaaaatctgattgtttcataagttgtttgactgttcctccttcacacgttgtgtcttgcctgctgccatgtaagatgcgcctgcttctccttccgccatgattgtaagtttcctgaggcctccccaggcatgtggaactgtgaatcgattaaacctctttactttatagattacccagtctcagggtggttctttatagtagtgtgaaaacgaactaatacatccagtatgtgttaatggatggtagcagctagaactgactgaggtagtattcatgtaattataggtgatggattcagataaatccaaagagcaagttacgtatgctgtcaagccatttcctgagatgtcactatatgcaattactgtgttaaggatactactgaacacttgatccattgttttaatctttacttgtcacatagtgtaaaatcttacaagatatctgtctgttgtatgtcaatagaataaagtgtttttgctttaaaaacctacttaatattttcttattttggttcttgcatagtaagcttctttcgggacagaagattcaggaacaaatctcatacttgtcttttaattggtttctcaacagctgtaggcacgcggcagaaaattcaagcatacaatagaacgaatgggaaataaagtctcaaaacatactgctgggtcaatgcataaatgaggaaaagggaaattgtattatgtcttgatagtactagtggactttatgtgttgagagagagtgacagtgggagagagatgagcaggaagcagcttcttgcaaagcatttgctttgagcaattccataaattcattttactctaggactgactctaactgtgtctctactcatttcacctcaacaacagtagacaagtttgttacactggaaaaaatgacatgcaaattgcaataactttttcaaacactaactttgggtaaggggtcagaaattttagagtaattataaaatgtattaatgtctattatactctaggcactttcaaagtatcttaatattactaattatgagaatcattctctaaaaggttatgttattaaatcccgtttatacatgaagagttgagatttgttaccttgagtgacatgagaatcagacctctattggttataacaccactagtaaacactgctgcaatagttgataatatgttttccccccaatcctataacatttcctctattcttatgtaaagtcattatgttttcaagcatcatattctataattaaatcatcatgcagttttggacagagaattggttctctggtttttgttcttgttttgttttgttttcctgaaacatagaaaaaaaatgtttctttttctcacctaacagcactgctgcctacatccaggtcttgagcagtgacagcgccaatgatggtccctaccggagtgtcttcataaacctccatggtgtagagcggcttgctgaaaaccggtggctcatctacgtccagcacgctgatcttcaccgtagctgtgtctttgaaagggcccgccgagtgaaaccggtggtcaaggtgaaggttggaagcctcaactttgaaagtgtatgccttctttgtttcaaaatctaaaggctgtagtgaggacaaattaagaataaggagtaaatttatatagaatgtggcagaaatggtgaacattacttcagagcaatttgcaagttattatcaattatactggtttaaaattttcatttttcttaataactagtgggtaagggcagcacaaggcaaaccatttttttttcttttttttttttttttgagacagagtctctccctctctcccaggctggagctcagtggtgtgatctcggctcactgcaacctccacctctggggttcaagcggttctcctgcctcagcttccggaggatctgggactacaggcgcccgccaccatgcctggctaatttttgtattttaagtagagacggggtttcaacatgttggccaggctggtctcggattcctgacctcaggtgatccacccacctcggcctcccaaaggactgggattacagaagcaaggtaaacattttaagaaaagaatcacgtccatgtagaagtttctgggtaacttgtaaagatcatcagttgcctatgtttgaaaaactcatcatttacgtgcagacatacatgctaggtagggcttaatcattttatatgagcaaagttaaaacagcaacagaacagatgttcagggaagcatttctctgctcttatccaatactgacatctagtggaacaaagcaatgataaacaaaaaaatgaataaaaatgaaataggatcattgaagatactctagattctagctgtaaatttggtattgaaaaagtggtcccatgaaaactccatattttgttgtcttattttatggcatcttatattaaatacttttggatgtctagatctttttttattttttttactagtaaatgtctgtatcagtatttaaaagcatacatagtactaatttaaaaagaatttttgtgtgtgtgtgttctcagaactgtatatataaattatgggcgcggtaacacatcatcaatacacattaccaagaattgtggctttatatattaatatatatgactaaattagagaaggctgtgaaacataatatagaaagtcattttctatggagtcacggatgctcagttttagcttatcgctgcttacttgcaccctcactctaaatattaattttatgtccacaataactgaaaatacactattcctgaaatatggtgctgctgtggtgctttgtttaagtgataattttaaggtcaatggctctggcctctgatcatctaagaaaatctgagacaacacgaatttaacattaacatggtgattttctgggacctttaaaaatttatgttttctaaaggaattccttcaagtctgaccccagtaagttgctaattgctgtgtcagtacctgttcctttactgtagtacacctggggaaaataaaggaaggatggatatttttctccttctaagatatgattgccattttatgcatttcctctgaggaacaaaaacaaaaacaaaaaaacacttttaaatcttcgaaaactcacaatttcatggaatttattataacaaaacagcaatttcacttgaatatgacatcagtctctttcaccatacttttttatgcagcaggaactatatttattaattccctataggtattccttttatcatatttttatttatgtgtttatctgctttgtaatcaatgttttctttttacttttctatattttaatttgctaacctcatacctgttaacttataatattgatttcctttcattttcatatttctcctgttagaaattttgatttctcttaatacctatataagcaaagaatagtatgcataatatgcgatggttgataatgtggcctttgatgacatgaatagaagtgtagtatctgaaaaaaagagagaggatcacccagtgatgttcctttgatcagcctaaagcttgaatactgtgttttgttgaagaaatcagactcaagaaaagacaacttattgcaagactagaatgataaaatattaccaaagccaaaaatgagaaaccactacaattactgccaaggcaaggaaagacacacattttcaaatacttgaagggccattatgttgacattacttaggattattctttatgcctctgagtggtgaattaatagtaatttgagttattaacgagagtaaatttagattagaaaaaagagaaaacctctaataaataaaatcattctatagtgaattaaaacacacacacacacacacacacacacacacacacacacacacacacacacatagatgttttacgtggtggcaaggcttgacatgcatcctgtaaggatggaaagatgaaaagacaagacttgcctctcaattcattcaacaaattacagaatattgccatcttgcttaatgagtgagtttgaagaagtaccaagttctctataattacatgtgtttaagagatattcaatatgttagaagatatcggagagagaatgatgtgtaagatagaagcgtgcactagctaattcaaattaaggaacatataaaaatatgttttctgtttttccaaactctaaatgctctataaatgttaaacaatataagtggtctatgttaggtatccttaacttgtagtataagactactttgatttttatcaccttagggttccttttgcctagaaagcaaattgagctgacctggctcatacttactccctttcttaggcaaaaattaacttctatcttagaatgtaaacgtttgtaccaatcattccccatttccctctctactttctcatatgttgaagtacttctaattatctatatgatttggcaaattctttctagataagatcttaattttttttccctacttgattacacactactgttatctagataatcttgactctctacaggtaactccttttcaagccagacatgaaaggagaattttgaaacctttaaaagagatgagatgtattccatgccttttaaggacccctgacctataacagcaggcaaatatctggttgttagggagacagagtaagataaaagaatcctgtacatacagattttttgcaactgaaaacttatagcctgtagtgatcaaagaactaaagaaaattgtaagagaaatgccaccatagtctcctaggtggacttacttcttcgtgaccctgacttttaggcaatcccacttgacaaaatggtatatagctcagaaagggcaaagagaaccagcagtgatctgtctttaattgaatttacctacacatctgactgactaccctccatttttggggggaatgaactttagtttcacaatcaataaaaatcccagcatttgaaataaatatagaataaataggattagtttcagtgctagaaaataaatcatattctatgatagacatacattattgtgaggttgaactaatttatctcttgcacaataaatagagaactttgtggcatggcttggagcccatttaatggttatgaacctctcaaaggggaagaaatgattgactaaagagaatttagttgagcagcttctttctctttaggttgtttctataagggaagactagtggcaccagaatgttcaggaaacaattcatctaattgagttgtgcagtaagaaccacaactatagagaaatgaaatatgatatactcaattgttctacagagactcaagggaggaattggggaaggggggaattttgcttctttgttttttgccactgaaggaaataaaaaatattttaccccccaagatatttctctgatgtattttgaaatgtctgccacagggccagaaaatataagtggccttgcaaagctatcttttgtgggagaaaaattgcatctgtaaggaattcccattaacgtgggcaggtcttttctatgcctttcccagacctaggagccaatgagagcctgacaattttaaaagtctgaaaataaataactatcatctattttctctgagggaggtttcatttacataacaagtggctttggtagccaagccacttcctttctccctctcataacctttcttgccactaaacgtgatttaccaagacaacctggttttgtccatgctctgggccaccattctttctgtaaccttgagatggtgattagattctgtaacttattgggaaattgggtcttcattctgaaggcacctgtatatacacgttaaataatttgtttgccttttctcctattaatcaatctccctcatgtcagtaatttttcagcaaaccttttgtggcccaagagcctatatctcccacactgaaaacacctttgcaaagattatgacagtgagggaagtctagcatggcggactccatcttgcttctagcctcacaggctggcagtcttggctcattccccagcatagcccaagctaactatggaatttagtttatactttaactttgaaccaaggatgatagtagtccctccctataactgatgccctccttggtcctgggccaaaaccatgtttgcaaaactaaagaaagtccacaagattaggattatgatagtggcctgaattctgctaaaacataggtagtttctatagtctcttactgctcacaaatcatgtgaacagaggtcacaagatttgtaacttccctaattgctcctacagataacatcaccattgcagaatctaagattggtcttttgagatgtttttcactctaaccccacccagatttgtggcatatgtctcaaccagtcctatggctccctgcccagagatggactcagcatgggggggactgtattttacacccttatgatgacatccccaacgaatcagcagcacccatttgctagtcccttgcccaccaaactatccttggaaaaccttaacctctgggccttcagggagactgacctgagtaacaactctgtcttccacatggctagcctggtgtcagataagctctttactgcagtaccatggtctcagagaattggttttgtctgtgcaatgggcaggaagagcccattgggctattacagcactactttctctgttcttacattgctgaagtccaggtcacaaaaaactaaatgaaatgttaagtgccaaaagattttctcatttcaaagggaaataagcaattttttggcataaattataagagaatagctacctgggctcttccagggctcctcatgcttccagataatgttgagtggaaatggatagctatggttatagatattttgaggaatttgaaaaaatgatagcttcagcaggcagaattctaagatgctcccaatattcctgcccccaatgacctatactctgtgtgcaatgactctgccattcattgtgtgagaggcctgtaaattaaatgacatctcactcacataaacttattaagtttaatggaaaaataagttgtgcatatataattagggtccctaatcacttgacattgagttaattaaggagattttacttgagaggtgtgatctaaccaggagaccccttaaaagaaaggagtgatgcagatgcttttcgtcctgccttataagaagtaaatttgtcattataggagattatgtggcaagtggcaagtgctcaaggggtgcctgtgggaactgaaacctgatatttggcgagagctaacaacattgtcataggagccacaaggaagtagtaactaccacaaaaacaaaacaaacacacaacaacaatacaaaacaaacagccacgaggaactggctctgctaggaaccagtaaggttacaaaagactccaaggcttagattggatcatagccccaatcacgccttgatttcctcccaaaaggccctgagcaaaggaaccagttatgccatattatgactcactgtagccgtggttttgtccctttttactttttactcttctgtattacttcaatttttatagtaagcctatattatttttaccaacacagtaaagccatcacttttaggaaaatatatccttgagtgataaggctctacactctcaattatctagtaggtcttaataggcaatgggaaggaataccgtcaatgaacgcaaatgatccgaggatgtaggcttatctgaaacagactagattctttctaagacaagcagttagaaaacagatttataccaggctgaaccaggatgcacagacactaggagcaagctcttataaataggtttattacactaggctgaacaataaagataagatgttcagaacaagcatcattttaatgaaaaagcaggtttcctaaaactcagttttatgatcaatatagtagtcaattcttgtctgggaagagacgtgggagagtttatgcatatctcatcatcattgacaaaaggttgcaactcaatattttatataaaaaagctgtatttgatgaacaaaagttgccactatatcaggtgagaatgtccctgtaacaaagggaaaaacaatgaaatgtagttaagttttaaaacgtagattttagtttggacaaaatttcaacaccatttgttagaaaattaataatatataagcttataagaaacatataattactaggcaaaaagtgtttgtaaacaaaaatatttaaatgaagaaacatccattttatataacttaccttaaaaatatttgtaacaaaactatttattagaaatgcacttaatttttctgtggacaagttattactatactttagtgttttgcaactctgcaaaattttcgtagttttaacaaattatcttaagaatcatggtcattatagtaatgcctgtattttagcggtaatttttggaataaatttagtaaccaagataaacaaaaaacaagcaaacaaaacaaaacaaaaaagaattgcaagaaactctagtgcttctagacataggtttttagtgatatttcccctaaaaaattacagagggtttcgtcacatactataaatgctgaaataaaatatatgtgtcatgtccacatacagtataaatcatgactattggggaggccaattatcttttctaacatgcattgttgtacacaacaattggaagtatactctttctaaacatatactatgatttacagcaagctgtgtgactttgaaaaattatcttccttctttgagcttcagctttcctatttgtagaatcagtaaaacatatttttctaaattatttgcaaaacgttccaaactttacatgctatgtgagtaaaaagaaaaataatgcagcagaagtgaaaacagtaaaccaacagaagatatttgtccttttagtcgacaacaattttaaacatcttatatatttcaggcatttcctttactgatggggaaataaacacagatatggaaaagtgcctccaggggcttaaaatatagtaggaggaatgagttgtattttcaatatgagaaccttgtaagtatcatagatgctttgacagaaatgttgacatttggggacaaaataaaggagtgatcaactttgcctgagggactctaggaggcctttgttgagaagcaagggagaaaaaaatgttaaagaacatgtaagaattcatgaagatacttatatgggacagggagttctatgcagaaggaggagaaccacaataccattggtagacatcgcaatgattttgctgtacttggaatgtagcttgtgcatatgaacatgcctgtaaatgtgtgtgtgtgcagaagttagtaatagaaaatgcactctttgatctttatctttctatcagtaggaccagaaactgatttaagtaagatgaacatgtttctatctaaacgtctaaatagatttctttcattcccccatgaataaaaagattagttggaggaaaataacgtgtgaggctgggaaaatagcctttgcagtggcaaaaaggagtcaggaagagggctgtatggcaaattcataggtggagaaaggaaaattttaacctgagttctggaaaaatcagcaaccagcctttgtgccctatttggcaaggggatgtcaataggaatggaagcggtgttagaaaaatcacagatttttgctttaagaaactggaaaggagaaaacatgagtaggcagacttttgttgggagcaaagaaagaactcagctttagacagtgaatttgaaaagtctatggcatgtgcagttagaattgtctacaagactagaaaaatctgcagtggttacgttgatttagggctaagttacagttgatgagactttagggaaactaggtaaggtattacaaaagaaggtgaagacaaatatttagaaaaacagaaacataatatagaaacaacagcattcatgtgttttttctttaattaggtacattagcgtggctaaaaatagcattattttaaacttaaactgaggcatgtatgattggctatgtaaaatattccaaattttattatcattttgttcttaagagttattcaaaaattaaccacatgatggtgctatgctaccaaatcatgtgaactcatttgtcaagcgtgaaaaaagaaaaagagttttactgatttacgggtaagtataaaatatatatatgctcagtgggaccaactggcaccttagccgatttgttaaaaggctctttgtgaagagtaatatcatttatctcatacgtttttaaggaaaaagaaaaattctgctttggatttaatgtgatcacacagttatgttaatttgaaataaactaatattgccaagtaacatcaaaatggtaagcactgtctctaattccaaaaaaggtttacttttaaaaaaactaaataggaaataacttcaccactcttcattttaaacagtttctaagagaaagttttgtagaaatggtagagaactgtttgaaaaattatacaggatattaaattattattttggataacaagtattcacttaattattttaattatttaaattttgcaatcactttggagaaaattcaagtgcttctataaccatatttagattttgagtccttgaaaacttttaattcgtgtaactcactatccatgtttacatataagaagtatatattttattcccatttattcagtagcaaaaaaaacactagtgactaaacacaaatttcatttaggttttcactaagaatgaagccattgaattttaaaactcttattctgtcattgtaaatgtagctcacctcttaatttctagacaatttgaatttttaaaaaactttattctgattttattagtgttttattgctataacacccaacaccatataggacaagcttttttttttttttacagttttctcagagtggtaggatgtgagggtggaataaaagcagtttttattttgttttgttttgttttgttttaccaatatcttatgccttggagcaatttataaagcttcataatgttcctctgaattcgaagtgtcacagtgaaatggcattctgtcacagtgaaatggcattctgtcacagggctcataaagtgaatcaaagttaaggttaataaaataaataaaaatgcctttcttcagtcttctcagttaatctaaacctgaccatcatttttgttttctcaagccctccctctatacaggaaatagacagaggagaaaatagtgaaagaaaagcaaataaaagattttgaagataaaacagtaataacaatatgtacttcagatcattagtattttaatgtattcttaagtgcgttaaaaaaagaaaaactctgaaaacaaagcatgtcatgcctcattcctctattgcagctcaaaatctgttagctaaaaaattaaaataactggtgtttaaaaaaggactacatattcaaatgtagaatatatatttgggactttctaaatgcatttagtatacttaaaatgtaatttctgtatgaatctgattttatatcagaattcttgtattgcaatattgaagggaaaaccttaacaaataatttaagatcattctggatctgcaacactactgttgatgtttacatacacagttattgagatacacctaattctttaaggattcctaatgataattgcaagatgaagttttctgagaacttattgaatatatgcttgagtatagtactattttacagtctttacccaaaagcattctgtacttaaaaaattgttgtagtgtttcaattgattttgaatttttatgggctttattcaatgagatattttctcacatttttattaagtcatactatcatgtttaattgagtaatgcatctatgtacatgtgtgcatataaacacaatacacgatacaatatatacaatagataggtggacagtttttaagtttcattacaaaaatgtcctcctgagttattttttaaagattcaatagatgtagggtgcaggctacaatgttctttctaatagaacactaggttagcataggggattgcctctagtggatccatatttagagatgaaagcaaattacaacactgaaagaaaatccatgtgttttattaggctctgaagtctcaaatgcttggtgtaatttaccagatgatgataatatttatacaaatatgttttggctgttcctttacaatttatttagaatctcacaatctctcaccatctctgttgctgtaccatcacgttccacatttctatctgtttcccggtttacttctatggtctcttaactgagctattgctttcattatttcctagttactgttctcttaagacaaccagagtcacttgggtctacaagggtaaggcgaggccaggtgtggtggctcatgcctgtaatcccagcactttgggaggccaaggcaggtggatcacctgaggtcaggagttcaagaccagcctgacaaacatggtgaaaccccttctctactaaaaatacaaaaaattagccaggcatgttggcaggcacctgtaatcccaactacttgggaggctgaggcaggagaatcgcttgaacctgggagacagaggttgcagtgagccgagatccctccattgcactccagcctgggcaacaagagcaaaactccatatcaaaataaataaataaataaaaataaataaaagagtaaaagtgatctagatctacactcacatgggctctctatatcacgatctgttaataattcaacatctttgcctggtctacaaggctctgcctggcgagcccgtcatctctggccaaggccctcttccttcacttcattccagccccactggccttcttgcctagtacactcccaattcagagattttgaaattgctgctcaaacttttaggaactcacatcacccaaataccacatggtcaggtttttgctcatattcccttctaatacagaagtctttttttatttttcacctcactgtaagataccctccaccctccacatgccttttaccccttcatcctactttaagtctttctagcttgaattcatcactgctgaaagtgatttctaatttgtttgtttatctcctgacgtcctcagttgaatggaagctgagtatgagtgcaggcagtgtgtttgttgagttcactgccctatctccatagtggagtctggaaaacagtggctgcttccaaaatacctgttgaatgaagtagtgaaagttatggacattgagctttacttagataatgaatttcaggccagtaaaatggacaacaatgattcatccaccacaggagaaatgagtgtgtgtgtgtgtgtgtgtgtgtgtgtgtgtgtgtgtgtgtgttttatttgcagatatactttcaagattatctaccctatctaaatctattttaataaaagtattatataattttgcatatctcaattttaatccagttaagaagaataaaaattctaaataaacacaataaatacaaaaaataaataacatgactcattctctgtagatgtttcataatgaaaaaggcagatatgttcttattgctttcatgatagttgaacttacataactgaatgattactttcaaagattaatatgttttgatataataagataaaggactattattaaaccacgcctttttcaactgttttaaaaataaataagaatgacatacatttttctagattgacacctagacattgattacttattggtataggtggtaaatatgtgtaaataaaaatgaaaacataaacataaaactatgtgtgtgaatataaagtaagttacaataattaaatataaataagtatataaacataaatatatataaagtatatctagaattgaatctttcgtaccttaattttactttggaagtatacttaattttatatttaaatattatgacttcttaatttaaaatattttttatattattaatgatttttatttgttccatttgaatagatgattgtaacccatttaaatgtgatttctttgttggagaccttcttagggaaaaaattaagtgagaagactttacattgatttgggactaaaagaaaaagagaaaaacaaactaaataacaatgaaggagtaaagttgataagaatttgacatatttttctaactgtactttgcaaatttaacataaatgcttaatttaatagagtgggatcatgtgggttaaattaatttctagactaagcgtaatttttgcacaatagtagaaataaaaatatgataatctatttgaaaaatgtgtttctttttaagagtattttcattaccatatatattgcttccttgttaaaattcagaattcctgagcaaatatgggaggggcagactgattaatggaactaaatgcaaagtatttattctggttaaaataattacaatgagtaaatgagtattgtatactgcagtttggagtatattcttcaaaattcttcaaaatggagtgtgttttgtagaaggggaggaaatggctgaactaaatgagcttcacttttctgcctttactttgctattggaaattcctataatttgcctcactattatggaaaaaatgtgcacaccttaaatgccattataatttttctttctcacattaacagactccttcatgtcaccacccaacaaaagacaaaactacagacactgtaaataataatttcttcctaatatttcaactaactttgccctcagcaatcctctttggctctaatccatatgtcattactaaacagcttcccagcgcagtctgtctttctctctctctcggtttcttggtaattctttttcactttcttccttaaagctctctcacgtccattactggcctttcacatttcttctagttctcaggtgtttagagcttacacgcatcagtatgcttccactgtgatatcaaccaacattgtggtgaattagatatttatatcttcagaagaaccataaaaaggctcaatatcaagactgatggggttagagttacttctcaatcttgtttttaaattaatcttttgtctatatttatagcaataaaaaattaggttacaattaaactctgtaagaatcttttttaaatgatgtcatcaaattatcaggcctaattgttcaacataaaatatataatagttgaatcacagaataatagcacctatagaagtaaatactcagcatcactaggtcttttttgttttcaatttaaaatacagttgactcctgagcaacatgggtttggactgtgcagggccacttatatgtggattttcctctgcctctgccatccctgacacagcaataccagcccctcctcttcctccttctcctcagcctactcaatgtgaagatgatgaggatgaagacctttatgatgatccactagtgcttaacaaatagtaaatacatttccttttgcttatgattttcttaataacattttctcctctctagcttactttattgtaagaatacagtatatacggctgggtgtggtggcttacgcctataaccccagcactttgggaggccgaggcaggtggatcacgaggtcaggagtttgagaccagcctgaccaacatggtgaaatcccttctctactaaaaatacaaaaactagccgggcgtggtggtgcacatctgtaatcccagctactcaggagtttgaggcaggagaatcccttgaaactgggatgcagagtttgcagtgagctgacatctcaccactgcactccagcctgggtaacagagtgcaactccatctcaaaaaaaaaaaaaaaaaaaaaaaaaaaaagaatagagtatatactatatataagatacaaactatgtgtcaaatgtttatgtgattggtaaagcttctggtcaagagtaagctattagtacggaaattttgtaagatccaaaagatacatgcagatttttgacggcacggagtatcagtaccccaactctcacatggttcaagggtcaactctattgctaattgaaggaaaattaaaattacttgtcattttcaatatttattttttatcttctttaattattatttagtagtcaactgtcccaacatttgtctatatacctttttcaatttgatgactccctcttgtgtatcctcatctgtgacgatgtcaaacaaatttcccccatctcctggaacaatattgtattcaatttctgcattttgtccaaaatcaggatccacagctcttattcttccaatagctgaaccaataggggaagactcaggaactttcaagtggaagatgcctgataagacatataaaatttgaattgacagtggggttagtaagagatatagtaagattacaaggcttgaaaaatagagtccactgaaagtaaatcacatttagaacattatagtgcaaattgaaaaggcaatttgctgtcaagttaaggattatgattaggagtaataacttcacttttctcttcaatatgtgctgctctagaattttaactgggcattataaatagtagagaatgctaaagtaaaattattagcaggacttgttttacacacttatatggcataaaagtgtaccacatatcaaatgggagggtgggactattcatgaaattaattggtactaataatacaggttgcaagacatagataaaaagttatagatacatagatagatgatagatagatgatagatagatagataggtgatagatatatagatatagaaagttgaggttatatttcctaaaactaatgacttcaataagtatacatcattaaactaaaaataacctgtaaaataatttgtataatcaaaattctagtcgatgatagattgaaatatagtatattatagactaagattcagcttatatttagtgaattttaacttgtcacctttctatatacttttactgatattttaaatcataaagttctgtctcccgaagttttttaatagcattaagaaagaaaaaaaagtaaaatgcttatttttaccaccaggtggagcgtttatattactatgaaatttatactgaatcagcaaaacttagataaaacatttcagaatcatggaaaattgtaatactctacaaaaaaataaaaacatagacattattttaaggttttgtagaatttttcaaagtttgacacacaagaaagatatagtgcatgctcttttactgacatttcattaaagcaaatattaatgagtttaacaacagtctgttcaaattcaaatgaggaaaggaaatgagagaaaataaaaattaagaaacaaaactaaacaccaaaatctaaagtttccattttgatactggagttccactttcagtttctcttaccggatttagaatggctctttcccatgggtaaatcaaccatggtgattcattcgttttagaattttagttacacatttgtggaaaataaattaagaagttactataaatgtctgttgcatagggaagttcattaaaaaatcatgttacaatattacagttattttctccaagaaggtgtgagaaaaaaatcaatcacatcttgtagagattctgccagatattttctttttgatttcccattattttttgaggtcctgtagttctttcacaatcagtttcaaaacttggtaatttcattagcatgggaagcagttaaatctcccttcttccctccttcccccagaaaatggtatctaccatttatcttgaatatgcagatcagccgtatttaaatccaacatattatctccatggaacatatatgtgatttggtctcaagagagctaaatactcaactaaagtttgtttattttacatataagacaaaatgatactttacagtggtccacaagagttatatttaaataattagcttagttaattcatactttcaaagagggtatgaggaatctttctcaaaaatgcacttaaaagtttaaataaataaaaaaataaacattatagacctaacaacaacaacaaaaaactccttccaagtcacaatgctaaaatgttacatagatattatgaaggaatctcagttaaggaaagtcacattaattgatcaaagtagtaatttctcatagggtaggattattgttttatttttatttcctaagcacttaacatagtagctgtcatttagggatgcttaatgtttgctgaacttaaagcagtgattgaatttgaggcaatcaaatcaaagaagaaaaacaaaagaatgggttacattgcattcctattttctaccagaaggataaagccagatattcaggaggaatctatctgatttcaaatagccttaattacataagcagaatctatcatggcttttggaactactttctttagatcataaatatttcttaatagataaattaaaccatgatcctagtgaggcactcctgagatattaggaaatataagggtccctgaacttctgtttaatgaggcaagaaagcatgtgacaaagttattacagttgtactaaacttaaggacaaattccaaagaaaaaggacaaggcacagaacgtgtaatttttcattttcctttttttcttctaaaatgcccgttaaatggaaatacgatttatcagaaactgtgtttgtatcttttgcctcttgttgtgtgactgtgatgaagtatctgaggaacatcaaaagctttgaattcacggtacgattggtcatagtccaaactcgtggctcataaatgagtgttagaaaaagtctaaattttttttctaataaaagagagaaatggaagtcgatgttgaatagtgtactagaaatccttcttgattaggacatttagtaggaaacttaggggtaaacattatcaaggaaataactgaacaagtgttcagagagacagagagccgtcaagtatagtggatttcaaacttcaaatgtggccagcagtgggagtggtaagggtgaaacagtgagagtcataaggagcggagtagtatgagaaatttaggaacacatgtgcatctcacttaaagagctggggacatttctgtttattccatccaatccattcaatgagagccagttgaagttacatattaggtttatgagttagctttacatttacatttggatggttaaaagcaaaagtaaaggaaattacacatcgatgaaaatgatagagcctggagtcctctctaatggattatggttagtgaaggtgaagagtttagccagagttgagatcctccaatatgggggaaaaaaaattaaagcattgaaaggtaatccaaagggcatcagataattcaaactgcagatgaaagagccccctttccaagacaataatatgctgagatacgaactttatgttctataaaagaacattttatggggctagtcacaataaatgtaaagaaagctattctttgtagtattctatcaatttaagttaaatagggtgttttgttttaagttgtcagcatagagagtgccaacaaattccatttttatctaatggcattgaaaaattgtgataaattgaaataatagcattgtccaataatgattgatttactagcattccactaacatgcaccccttcaaaattaagataaaagtaaagcaatgattactttttgtgtgtgttaagttttagtgcatgtgaaatgcaaatatacagagcaatagattttctactctttacacagcagacatacattttagtaaggtggaagacacgttcattaagataagtgtttcttaataaaatattacagctggtaataaagtctgcagaatatggaacaagtcagagaaactatgcatttgtcatgtcagattgtttaggttctgtcggtttatttccaatgacttgacattttatcatgtctggaatctcaacagcaataaagctgaggtcattcagattaattcaaaactgtgaagtaatcttcagctatgccaaagttggattgttcatgatgtactgtgtaattacaccgccaccgtcttccaggcgtcctacttttgatgcatatgaaacatcttaatggcactacctgtaccacacaaattgagaaataaaacaggtgacaagagattgtccacagtcaataaaaatatatatttacaattcatcaaatatacctattgtgcttagccaaaatcttcattttcccatagaaaaggaggaaattgcatgcagtgaactaattataatgatcatattcttaaatataatattccctgttagttccaagagtagaaaaaaatcaggtagttataagctaagtatcctctcagtaactatgtcatttgaaaagatactgattaggacttaaactgtgtgtcgggcggggagagtggggacaggtaggggacatgcattgctactttaaaaaaaaaggatgtaaaatatatttaccttcctttttttgtttattgcaggaaatttccagatactgatgaaaacaccaaaataaatatatttacttgacaaaatataaatgaagatctttacttaaaaataaagattataggacctgaacaaatatattaagtgaatgaatgactttaaaaataccacaacattcaatgacaccaatagcaagttaaaaagaagataaaataatccattacaaactcacttttgaaatacattttattttatctttatgtaacaataattctaaagttacttaaaaaaaaggaagtcaatgtttaactgcaaataagttacctaaatacaagtaactaatgtgaatataattcatatttaataatacaagaacactagaaatattggagggcttaagaacaaattatttcaaattgatgaaaatgttaaacatttttaaaaactcaaaaacatacacttgattccaactaaatagactatgatttgaaatattacatttcaatttaaacttcaaaaaataaatatagcactgaactattgattcagtaattgaattcaaacattagattgttcaaatgatcctgcatactttttgtgtgtgtgagtgatttaccttctaatggcttagaaataaaattttgttgtatcaatattttatttttttaaatttcttaaatatgtatcacacaaaattatttcaccttacttaaacaacacgaaaaggaaatacaagtaaacaacatattgtgtgagtaaaaagaaactttatagaaattgtgtacctgtagctctgtgaccctgggcaaaatattttaaacatccctcttttcctgatcgtttaaaatatctctcttttcctgatctgtaaaattagtataacaatatctactttatagatttgtttttgaaagtcacttatacaaaagtgcatgaaactcattcagtattatttattactagttaacttttataatatttgtatattataatatttgtatataatatttgtatagtctatatgtattataatttttcctatcagaatggcaatagccaataggaaactgtctatagaggtgtggagatgaaagaaagacagatcttaaaagagttctaaaaagtcgttttaattttaattaaaatattttcccatatctttaaaattggaggattcaggaagaaaaaaaatgttttggtggtggaagaacattttatgccctctatttccttaaaagcctgaggctgtattttcaatatgcccaaattaaagtaatagaaatgttgtccataagaaagaactatcctgataacaaagctgggttcaagctggattttagtcaagcatactaaacatacagtgaatggaatctctcagtaataacagaaacatccactgctgctcattcccaggatgaggctaggatgggcatagtttttaagtgtcaagtatttggcactagagcttcactttattggttaaattacttcgcttttgagatgttatatttgcccattctcgattttaactaaccatatacatgaataagaattgccatgcacacaatatccgtcatattaatgaattaagatttataaattttctgtaacaatagcaatatttcttgtctctgaacaatgagaaatttattcctgtaaacttttttctagttctgagcagctaaacgcaatagaaaaatttaaggctcgatattaaattgtctttcaaaaattatctttgcatagtagattaattgcttaattttccggtatctcagattattgatatttgattcaactacagtttttagtggtctccttcatggaatgacaaggaaaaacacataaacaaaaagacaagtgtttttcttgatggcatttatggtctagtgggagagaagtcaattaaacaatcacacaaaaaagtaaaatagcagaaaaaaacaccagcgctctaaaggaaagttacacaattctattcaatgtttaaactgagaatccgagctgagacaataccattgggttctgtgaggtcagctaatagaaaacattccaaacagaagtaaccatatgacaaaggtgatatgatcatagtttcctgtcttaccagtttgtttgttcaataactcccactgggacctatcatctctaatgtcagaagcacctctagtatattaacctatagcctatatagcttggccatgtacttttgttgctgcaatttggcaaaccctaactcttgatgatgataattatcttccttctaaaggaggagggatggtttactgaggaaaaccatagagaagcaactagatattactataaattatgatcattaactttgaatgccccttcaaaattgcttaaaaagcacacagatttgcaaaggtaactgactaccattctctgtgacttctattttgaactgatctactgtccttaaatatctgcttaagtactccctttactacttcctttctcagttggtgaccttgccttgtagttcacagaaaaagaaaaaaaaatgatgttgcacaggagattgctcagcttccccaaccttcaaaggatcctacatcagtgtgactcacagtttgaataatcataacatgtaagatatgatacaaacttttttttttatttgtctctcactcttcctttagactttcttctgtcggggtatgctttgtcttttcttggatgaagacaatggtgagtaaatgatgtttcttctcactattaaataataatcctatgttcactttaattctaaaaacatagatttggaagttagacatttccaataaatcatattaactagcacatcaatccatatgcaaaattaagacttctccccttggccaccccacccacgtccaagccaattagagccagcagcagatgggacattgagttgggatctggatggattagcagcctttctctgtccaaatttttaatttttttttcatcatctcctttcctggggtgttttcacctcaccattggaggcagcaaagttaggaggctggactgttcttacttgatgatgtggtttttgcttctctggagctgcacagtgcacttgggggcagctcttggaagtttctcttgcagcagcctccacaccaatggcattgcctctgctttgatggactatgacctcagcctccagatttcaggcgacccactccacaggcagattctcgcttcaaggagaatctctttggcaggacttaacataatgttgggttggttttcccttctgcttactcatttcttgccattccttttgttgtcatacaattagtttcccaaacacagccttgttctcttttcctttctctgctgttttcaggagattttaactttcctcagcatgagacgcatatcattccatgaatttcccccattttctgggaaaatatattagagtttattgtttgtcttagctaaatggaaggccccattcaccaaacttgagaggagtaggaaggacaatcctaccactcacttttagtagacagggactacacatggctttctccaaagaaatcctctgcacataattttccctctacttcacactctacaaaacatgctttaaaagactaacaaaatattgcccaggcacagtggctcaagtctgtaatcccagcactttgggaagccaagaggggccgatcacctgagctcaggagttcgagaccggcctggccaacatggtgaaactccatctctaccaaaaataaaaaaattagccgggtgtggtagtgtgtgcccgtaatcccagttacttgggagctgaggcaggataatcacttgagccagggaggcagatgttgcagtgagctgagatcatgccactgcacaccagcctgggggacagagtgagactctatctcaaaaaaaaaaaaaaaagaaaaaaaactaacaaaatatcttcctatgactgaaagctacaagagccttaaaagcatcctgatatttccattgtaaattctgatctgagaccatactctgctatgtagtatctattgtatgttagctttatagtgcatacttcagtattaacctcttgttatagctgtaagcattctttcaattgaagtgtccttcatctccactttttcttcttaaactccaacaatttgtacacattttgctatttttaaagaatctgttttctctgcactcaatactttcttctcaatagagttattcttgatgagacacaaactgctcatatttgagcatcttaacaaaaattctcccttgtcccaaatctgattctagttacccccatcattttcttttccctttccaacagaacttttccaagagaaacactgttacccatgcctacttaacaaccactccacaagcagccttaccctgctgactgaacccatcattgtgtagtaaagtttcccctgagatatagtgacttccttgccactaaaatccagtggcaatgtcttagcagtgttcaacactcttggctattccctgttttctgaagcacatctcttctgagactctacaattacggttttctggcactctactatcatagtttcctcccaccttgcagctctctccttgccagattcctttgtggaaattcttagaaaagatctggataagtgattctcaaacttggttgcattttggtatcatctggaaagttaaacagttttttaaatgctttagcccagggaccatccaaagagattctgtttagttgttctgagtttagagctgcatttattaaattccctcctgttctactttacaaacgtggtcaagaaccatttttgcaggctatgtttattcagtctttccttttcctaggtaacttcatctctcccttttgcttcatttactatcattatgctaaacattctttttattttaactccagcctatattcagcttttgagttttcctactatacttggcaaaatatcatcttattccaaaacattacttggatatctccaaggtgtctcagttttgacatattcaaacatgagatcatagacttgccatgcctagatgaagattctcctactagtcactctctcagcaagtagtatttccacctctccagttccatgaactagaatctgcttcttagtagcaaatccactgctattattgattattttacctcctaaaatcactcaaatctgttgacacgctaccatttttcacaatggccctggtcaccaccatcacagactcatacttcttttctgttactgcagatgcctgctaactggtcttctgacattattctctacccctggcctgaggtgtctttccattctgcacagcaaggatagagaggtcatttccatcactcctaggtaaaaactcattgtcttctttcatgtagcggggaaattacccttttagaaaatccatgtgtgtcaacatgaaggaaacgaataaatttttaaatagaaattattctttaagaggaatagacacttagtaacagcaaccacttatatagtgctttctattttccaggcacttttctaagcacgtttccattattaactaattttatcttcacatcaagactatgagatacctgctattactgtaacttccagtcagttatatcctggtaaatattttagaactatattgggatagggagaaaaaacaggtatgagccctaatgttcagggtctgttcattgctgtggtgtaagagctcccaccatgacctatatcaagctactatcgtgatgtcttgaacacacagttgagaagaaaaaggcacaattggttctgctgatctggtagaacctactatcagtctacaaatgagcaagctgggggctaatggccatgaggtgagtcaagcaagtagtatctctgattgaaaacatagttcctcattttgtctgcccacttctgttgacttggttgtgctgcctgaaagtcaaccaaatagatacaatatttggttgatccataagatcttttaaaattcagaaaattcaaaattcttaattttagctagactgagtgatgcaaatttcaatttactaagtattgagtggattgggcacacttgaggaaagtttcccttttcagtgattggagagaaaactccatgaaaacctttaaaaaaaaggtcattaggagatgtgacaaggttctagaagaggatagggcactaaacataaaataattctgctactgcacccaagaaagaaaagaaaacttattacatctctttctgtttttccaattcttcctttcttcttacaaagctcacaacattaaagtacgaattattacgtttaatactatagttctactacttattatgtttaataaatgcctatctgcaaaactaattgtccattgtaacattattttttaaagcaaatgcatcagaaattccaaccaacccaattccaaataggctatggtacaaaaccaacttatattacttaatgattttcagaaaaattggggtttctgattctccaaagtatgtatttttaacataagtgatttatataatcactattcttgttacacaataataaacatgacggcaattttggcaagagttcacaacatttcaagtgcatcaataatttttcattgttatatatttcatgaagtacatttaatattctcttaaaacctccattgaatatttaaacctttgtttatgttgtctttatctaggtaatttctgatccatttaacaatatatggtaaatggaaaattctcagtgatactgcctaataactttacaaaaatatgccacaagcaacactaaaagttttttcataaattataaataaatttaacaccttacaaaataagctttgaaaaacaatgaatttttttttttttttgagatggagtctcactctgttgcccaggctggagtgcagtgacaggatctcatctcactgcaccgtccaccttccgggttcaagcaattctcctgtctcagcctcccaagtagccggggctacagttgcatgccaccatggccagctaattttgtatttttagtaaagacggggtttcaccatattggtcaggctagtcttgaactcctgacctcaagtgatccacctgcctcggcctcccaaagtgctgggattacaggcgtgagccactgagcctggccaaaaacactgaaaattttaagttagctggggatatgtatttactcacaagtttgacttctcactggttttcttctgagacacaggagagtagtctaaaaaagatgaaatttggtaatggtctcttcccatgtatattttgctttcttttagacaaaactaattctttcataacaacccattcaccaatttgcaaatttgatttgtaaatattcatcatatattcgtgtatcacatatggacacaatggtttacattttctgtcttttcccgcattttatttttttaatattttctgtgtcatccctgttttgttgcttttacctaaaatgttttacttgtcttctactttacatatttctatgtataaaatctattattctttcagggacaacctaaagccacattttgatgatttttttttccttttgtctttgcaattttatttgtttcacatttgtatgcttacaaccctttaaatcctatgtcttttttttttttttttttttttttgcaatggtctaaatatttaggtatatattgtttttactccaagtagtgtaaatgtgcattaacttgaaaatctccctacctctctgggcgcagtggctcatgcctgtaatcccagcattttgggaggccgaggcaggcagtcagctgaggtcaggagtctgaggccagcctggccaacatggcaaagccctgtctctactaaaaatacaaaaattaatcaggtgtggtagtgcgtacctgtaatctcaatgactcaggaggctgaggcaggagaatagcttgaacccaggaggcggaggctgcagcgagccaaatcgtgccactgcactccacactctagcctgggtgagagagagagattccatttcaaaataaaaaacaaaaaccaaaaaccaaaagcaaaaaccactccctatttttacactagcttttaaagaggagaaattaaaattgtatcttctttatgcagtgcaaaatgaaaatgataattttttcatcctctatacttgcaatgaacgaaacattattcatcaaatgatatattcccttgtgtctgttatttgttaacaaaatatatttcttatgtaccaagtctttcattttcatggtttttagtattgcttagattcttgttaactttcataaaaactactttagaagtctcatttccttgtctatataatttctaagaccaataacaaggcaaatatgaaatagagaaatgtaaaccatgtgaaataaatggtgactttaggatgctttcacatctgtgactaaagattgccgctgctgtcagaaatctatgtattaaaggattgaggagggtgtgtctaaagttctcctcataacttcattctcctacctgggttttcttatacccaagacttaaataaagttatgtgttttttaatctggctaagtatatccattctccaaacctcattgatcacttctatgtttttgtctgttagaaatgtttctttgggcctggtgtggtggctcacacgtgtaatcccagcactttgggaggccgaggcaggtggatcacccgaggtcaggaatttaagaccagcttggccaacatggtgaaaccccatctctactaaaaatacaaaaattatctgggtatgttggcgggtgcctgtaatcccagctacttgggaggctgaggcaagagaatcacttaaacccaggaggtggaggttgcagtgagtcaagatcccaccattacactccagactgggtgacaacagtgaaactccttctcaaaaaaaaaaaaaaaaaaaaaaaaaaaaaaagaaatgcttctttgactctcacttctctgcttctcttttgaggatcctccattttcaaccaccacttgttcatctccactcaagcacgttgaaaagagaaagagaggaaaatataagagggacaaggagaaggaaaaaattaaaaataaacatctttactgtcagatattttagttgtattgatttacctaattctcccagaagcacagtatattattatgaatatggctatataatttataagccaaacagagccacttttgagagtaaaacaaatcagtatgagtaattaatttggggccataggtataaaatggaattatctctggcacatgagtatagctgatcactctatttattatctctgtttgattatgtaaaagctttgcatcagtgagagtttattcagtttagtcaggccccagtgagtaaatagcagagctgtgtttcccatctgtacctttccaaaaccctaggccctctgtgctttacgaatcactttataagcttaaaaatactcacagaggccaggtatggtggctcaagcctctattcccagcactttggaagcctgaggcgggtggatcacaaggtcaggagttcaagaccagcctggccaagatggttaaaccctgtctctactaaaaatacaaaaaaaattagccgggcatgatggcgggtgcctgtaatcccagctactcgggaggctgaggcagagaattgcttgaacctgggaggtggaggttgcagtgagtcgagatggcaccactgcactccaagccggggcgacagagaaagactctgtctcaaaaaaagaaaacaaaaacaaaaacaaacaaaaaaaaaccaagcaaacaaacaaaaaacaacatacagtgagactttaaaacaatgtcgttttagctttgattagtggagcagtggattgaaagccccatagtcacatatagggctcctactcctagctactgggacaattctgatgttgggagcagtaatctatattttcataaacatcaataccatagctctaatgtgctatccacttacgttctgctgtatcatacatgtaactacaaagtttctggccccatctctcactatctctttttctttcagtttcctcttctaaaaatgtacaaatagacggaacctactcatacggattaaggaagttaatatacaattttaatggtgtctttacatagcacaggtgcaatatatgtgagctgcttttctctctataatgatcgccctattctctaaagagaagtggcaagtgtaccacctgtggaaatcagggaactggctaatgcagttccagcagccaaattcagaaaagcaggctaaggacttgtgaacttgaggacttagtaaataaaggagaggtatggggagatcacagccagaggcctagatgttttgttattactaagttggctaagttctgtttctgtatccatgtacttgccctgattctcgggggattgtcaaaagagacaattttctcgtatttttgcaggaaggccaaaaggtggggatagaagagctttccaattcaggttttatgttttaatttgtttgcctgtttaggaacttacaggttttattctgtcataagtaaagtctcatatttgagttgtatggtagactacataacactacattattcatgccactctgccaatattttaatttctaaaaaagtcacttaaagtgagctggaaagtagacagattaacattaacaaatattacaagtattaaatggacccatggcctttaacattattttttataacgttggtaagattaggggcaatatctttaatatcacttcaattttaagcattatttaatatctttcagaaaaataatttaaaactaaaggtcagatttctaagggacctgtcaatatttttgctcatatgctaggttcttctgagactctgctaatggcaccatgaaacagccatgttgcaatctttgtcctttaggacatggtgaacagaactaagtaagtcaacaaaaattttcagcaccacttaaaaatgattcatgctctcgttagcaaatgacaatgtgatattagtaataatagccatgacaaattatgttttaaatttgctaattttctttttatatgcctacatcagcctatatagagcctagtaaaactcatgatctccttataggagaatctggagcacagtgtttttcactgagcttgcattcaaattgtattcatttccaatgttagcctcaaagcacatgtatgtgacattgttaagctatttggaagacgtctaaacaagatataccactatatatgagtgtctgtttgtttagttagtttaaaatgaatagattttaatatttagtctttacccaaatatacctgtaggaatacaattttgcatgaatacaaaatattctcatgagatacacaattaacttattaacttattcattctatttaatgagtaatggaaatgcttattatatatgagacacatgatacatatcatatatatgatatatattatattaatatatatcatataatatatatattatcatataatatatgatatatattataataatataaatcatatgatatatgatatatatcatatgatatatgatataatattaatatatatcatataatatatgatataatattaatatatatcatatattatatataatatcatattatgtaatatgatatatgatataatatatataatatcatatattaatatattatatataatatatgatataatatataatatataatatataatatatattatatgttatataacatataatatatattatattataaatatatattatatattatataacatataatatatattatattataaatatatattatataacatataatatatattatattataaatatatattatataacatataatatatatattataatatatattatatgttatataacatataatatatattatatattatataacatataatatatattatatgttatataacatataatatatattatatgttatatgttatataatatatattatatattatataacatataatatatattatatattatatagtataattatatataattaatatctattaatatattatgtaatatacattattatatattattaattacatatattattaatatatgatatatattattatatatcatatattatatatcatatgtaatatataatatatggcatatgtgatatgtcatatattatatgtaatatattatataatctatggcatatattatatgtaatatataccaaacattaatatatgatatatgatatagaatatatgtatatcatgtatctcatatatatgcatacaaatgattcaaggaatcagcacttgctggctcaccacagtaaaccagtgatcttcaggtttgctctgtagactacctgtatcagaatctaccacaaaacttatctaaaatttagatttcttaggtccaagctatgtcagttgaaacagaacttccctcactggggatatgggatcccaagggattcttcaggcaaatataatttgagagccactgtaagatctactggagaatagggtctatgttctcattgccatgctttaccttcagcatgtattcatttttacttttattgaagcagacaaaggagctttttggtaattaaattagatgtgtttattctacttagaaaaaagctggttttataatgtatctttgcttatttttcaaaaacagggacagtgtcatcaaatgtgatgactctatttctattactcatgcctaaaattgttatgagactcagctagtacctgaatacaaggtcatagctttttgtttaacatttttaaatgcttagatttgcagttttattttttatgccctttaaatgtttccaccgaagtgagaggatacgcatgcacataacacacaattcatataacatatatatctcatatatatgaatacacataaacacacacaacatcaaagttctatttgtctatttctgtcttactcatatctttgggaagtattgaccaaaagggtaatatattcatgtacagtatctaaataatctagattaaaaatattagtaatgtcccaaatactacttttgaaagttacattctcttcctacatgggagatatttagaagaaaagcatggccctaaaaacagcagattaggtaaatttgttatcaaagaatgctagcaaagtgttaactgttggaaattacttaaacattagtagaaatagaattgtgagaactaaactgtatactaaaattgatgctgaacaagcaccagtactacactttagaaacgaacgtatatttgtataattgaaacattaacatatcatgaactttgtgtattactatttaaaacctccacctgctttcgattaaggaaaaccttaccatgcattttgtagtcaaaacttctttattaaattatatgttagataattatacattaaccttgctgatcaaattggcccacaccatcccttcaacctcaattatttgaataagctgaagtagttatcctcatttaatagttgtagatttcacataagagccattattttagccatacttccttggtatttgctttcacagtacttgctaccatctttttattttccatctatttacttaagagagcatactggagatagtgataagagtggcaattcacctttgtttcaccctctggggaatcatttatgtgtatgctgggggtgttatcagttgtttgcacttgttgtgcaggcaggcaatagactcttaaccagactttccaggaaatgtgggaggtgagagaggcatataatttactcacaacaataacaaagtcagcagtacattgtgggtagcagattgccttctctggactcaaataacaggaaatattttatcctagaatatgatttcatgactttgagactatatgaatatacctatatatatacacacacacatacacttagctttataacaatttataaagaattatgaatgctcagactgtatatatatgttacgtatgtgtgtgtatatatatatatatgtatacacatatatatacacaaatgaatttacatcacagaacacttgtttttagcaggcaatctcagatattaagacagtcaaacattaagtacctgacaaagtgtaaaggtgtgtttttatatggtaaaatgtaactgtcaaaattcaattagcttttcactatttatgcaaaatgacttattatatggttttatcaagaaaacttaagcctagtagcttaccattttccaagtttaagaatgccaaatagtaaacaaagaaatacactttgtggccacatcaagatgtagctgaattcatgtttattctaagaaaatatttataagttacatattttaaaaaacatttctttaaaaaaaagacctatggtagatttcaagatcataaaacaaccaatctaagcctggctgccaaaaacattaatgacaggatgaaaagagaaaatacattttacttaaacatatcaatagttttaactgaataaatgtatagttattggcatattatctttaataattcaataattaacttggacatcttgtagtccttctatgtcataaatctacaggagaagaaaaaacatatagcatatagacatatatatgtgtacatatatacacgtacatacatatatatgttgtttttaatctgacagctgacgtaaacaaagacaaaatattgttcactgttctgtaaacattctggctgatgcttttactacttcaattttattttgattttttatgttaatttcagaataataagaatttttatatcttcaggtgttaacaagttaaaaaactatgatataatacaactatgttttattctgcaattattgtgtaaatgatgttttactgacttgtaacagaatcaaaaataatatagctcttaatagaaaccgtcaatataaacacgtttgtagatatttaatcaaaacagagaattgctttaaaatgttgttgtatttatgagtaagaaattttcttagaacgattattgacgtactattttctatgttcaaatctgtttaccatacaattatcttatctattattatattgaaatagaaaggaaaacacacacacacacacacacacacacacacacacactccttcacattttctataatggaaaactctcttttcatcaaatattgtatacagagtactttattttacttaatttgttttcctatttcttacaaaattattatacagaaaaagcgaccaactgggaaaactatgaatattttgccaaatgttaattaacggcatcacttaattgatttaatcttataatgtataatttagatcagcttgttagatggttttgtcctttaaaattcatatattggaatccatcagcacttttctgtagcttattttaacagatggaaatcctctacagatatccttgattgtagtagatggaagctatttaattctacggaaaacattttgtaaagaaactattttgtctttatataacttcagttaccgctcttttaatatggcatgtatcatttctatttctgaaacaatattactacctttatttgaagaccgttttctgggttatctgtaggatcttttgggggaaaacacaggcattgaaagcaaattaccattaaagagggagagtgctaagaagttagggttcttggacaagttatctattcaaccattcttaataatatagccttgctcctttattttcaaaagtgagaaaatgctatactgccataatgagagttaaatgggaatatatatgcaactcactttctgtagtgcatgacacacagtgatttattagtctagatcctcatcacatcatcatatcaaattggcagtgatatctggtatgtgatatctcagaaactatatattttacaacaacaataaaatagcaaactatacatgcatgatacaaatgcctatgccatttacatttttttccatctcaaattaagaggtcacatacacaaagccaaaatgctttacaattagtaaattttaagaacttaatttgtgtagcttaagcaatgagaagagtatctcataaagttcatctggagaaaggttttttttttttttttagcataagtgcttaagagtcacgaacaaatatagttagttgtgggaaattctttcttatgtatgtatggaatagattttgttgacttccacattgaaaaggatactatttcagtttgtaattctatatcacacttgacggttaattgtgccacatgagaaatattcctgcaaaaagagcattggcttttaaagaattggcttttctctttataaatgttttgttctgttttttcctctaaaggatgtaattcaaaatgacagtgtagtaaaaaggtcttaatacaaaaacatgtaaaatttcagggagatgaattttttattcattcaaaatgtgaaaacctcttctttctcctggttcaaaaatatcccccacccgttatagtttcagacaatagtccaagtgttcatgtaatacaagcagaaaataatttgatcacagtgatctccttgatagatttcttctgtcctctcattttcctgtttatgagtggtgacaacatacgccgtgatttttttgcagatgtgctctaagattgtagagtgacagataaaggaaactaataacttttattttaatatgacgttaaactggaaggaatttgaacttcagattttttgttaagtcagttaattttgttgatcttcagcaagttattattctttataggcctcagtttcttaacagtaatatgtggaaaatagtgatcttagagtattgatgtgaaaaggaaatcaagatagtaatgataaagttcttgacacatatgtaaatgctttaaaagttccagtgctggccaggcatggtggcccatgcctgtaatcccagcactttgggaggccaaggcaggtggatcacctgaggtcaggagtttgagaccagcctgaccaacgtggtgaaaccccgtctctaataaaaattaaaaaattagctgggtgtagtggcagacgcctgtaatcccagctacttgggaggctgagacaggagaattgctggaacctgggaggcggaggtggcagtgagccgagatcatgccattgcactccagcctgggccacagagtgagattccatctcaaaaaaacaaaaacaaaacaaaaaaaagttccaatgcccttatcctctacattttttgcaagtacatctcagagactttcccttagacctgtagattcaaccttgaataaatgccaagcaggactactactttattcagatactcttttcatttgttaagatccgaaaatgaccatcttgtttcagtgggagtaaagcacgccatcttggtttcctaagcatactctagcttctttgccattgagccattgtcatcatgcccctttgcccaggctatttgtcagggtctcaagtccaacttctacaaaccagccttcatccatacccacatggattgcattcttccacttgctgtaactttgtatccctgatataggaatcctcactatcacccatgtgaatgaggatattgacattacctaataatacactggctatttcctacactctagattgaacatatttcatatgcacaaaacccaaaacagcgcccaatttcacaatgccactttttatgtacaagcagtctcccaatctgtcctcctcaactagctattacagcttgccacacttaagtggttaaaaaaataaaaattcagtgtttttagtgtcgagatcatattagtcacaccatatattagagaaacaaatgcattatttctttctccttttatatctcttttttcctgttttccttaataacaaaataaggaaaagtattgctttaagactctctgtgttattaatcatagcatattatatagtagccatttgtcagatacatttatatgcaaaagtagaattactttttctttaattaattattttaattgacaaacagaaattgttcacctttaatatatacaacatgtttttaaatgtgtatacttattgggagtgggatggctcagtcaagccaattaacatatccattaaagtgtaattatttctaattgccactcaaagcatttggcctttagacatttggtcactaaactaaaacatttccatcagtaaaatataggtttatgattttaagaaaaaaaatgacaaagtagtaaaatatggaaaaacttacatatagccaaaggaataaataaaatgttcatttagctaaatatcttcaatattatatattttagtagatgaactcgtaaactctcctggagtggaaagagaaaaaactgtgtttttttgactgtttatgcaaatgactgcctagtgacttaattaagatccttatacaaccagtgacagaaacatgcagcttctgtattctaagtcctggggacactgaaatgatccttgaaaatgcaccaggaataaaacaggtagtgattggtgttagatgtaatactgcaacagaaaactaaatgtaacacaagtgagaactcattttcaacaagaaacacagagttatagagaagacataggtgtgaattactctattatcatagaaactatagcaattttcatctattacaaaactaaaatgaaataactagtcagaactaaagtaatgtaaatagcatcaatatcatctgatacatgaaaatatttggaaatgattcaacacatataatcaccaaaaagaaggcacagaattctaatgttaattatatgacatagcatctaatatggtgggaaatgtgtcaaaactatgaggctccatattacattagatttgggacatttatattactttctcagttaataaaatattagggtaagatcccaacttattttgaatatgttactttaataaaaattgatagcataagaccaatacttcaactattggctcactattttttactaaagtaaccctaggcatgaatctcatcaaaatgttcaaccctgaagatttgtaatttttttttttttagattcaataccatccccatcaagctaccaatgactttcttcacagaattggaaaaaactactttaaagttcatatggaaccaaaaaagagcccgcatcgccaagccaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaattggggaaaggattccctatttaataaatggtgctgggaaaactggctagccatatataaaaagctgaaactggatcccttccttacaccttacacaaaaaccaattcaagatggattaaagacttaaacgttagacctaaaaccataaaaaccctagaagaaaacctaggcattaccattcaggacataggcatgggtaaggacttcatgtctaaaacaccaaaagcaatggcaacaaaagccaaaattgacaaatgggatctaattaaactaaagagcttctgcacagcaaaagaaactaccatcagagtgaacaggcaacccacaaaatgggagaaaattttcgcaagctactcatctgacaaagggctaatatccagaatctacgatgaactcaaacaaatttacaagaaaaaaacaaacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagatatcgtctcacaccagttagaatggcaatcattaaaaagtcaggaaacaacaggtgctggagaggatgtggagaaataggaacacttttacactgttggtgggactgtaaactagttcgaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatacacaccatggaatactatgcagccataaaaaatgatgagttcatgtcctttgtcgggacatggatgaaactggaaatcatcattctcagtaaactatcgcaagaacaaaaaaccaaacaccacatattctcactcataggtgggaattgaacaatgagaacatatggacacaggaaggggaacatcacactctggggactgttgtggggtggggggaggggggagggatagcattgggagatatacctaatgctggatgacgagttagtgggtgcagcgcaccagcatggcacatgtatacatatgtaactaacctgcacattctgcacatgtaccctaaaacttaaagtataaaaaaaaaaaaagatttgtaatttttaatccattagcttctgcttcctaaagactaagtgtctggaaaatgattgtcattcccatagcattcaatgacaccattaaatttttttaaaccgcaataatttaggcttaacaggaaaggtgacatacttttggggaatcgaggtggattgtcattgacatcggtgagagtgatgttgactattgttgttccggctaatcctccaagctgtcctcccatatccttggcttggatgagtacttgatattgttctttgacttctctgtccatgtttggcaaagctgttctaataacaccttaagggataaaagcaataatgtaaaataaatatcacaaatgctctgttttctgaaataaaataaaatgcaacaacaacatgattctacctagaatcactaacagagacataatagctaaaattgtatcttttaaaaagtgagacattcaaaatgtccaatggttaggacataatttaaaatattatagtagctacacaacaaaatgccatgccacaatgagaaatatggttaaagaacaatgtatcacctctaagaggtagtcatcattcataagtaagccaagttagacatgatttatatgcacgatcctatctttaaaaagaagaaatcattaaaaattagaggtaaaatataaatacaaaaaatgcgaagtggttgaaatgagtatgcaatttccaattattactactttcttctttgtttttctgtttattttctagagtaaaaatactaatttcttttctaaaaatgcattcaatatcttcattacatattttattttgtctttcagaattcccgttagttattttagcaacagatatttcactaagtttctccagcagccaggacagtgccatttacaaggaacacaatgagtgtatgcaaaccaattaaccgaatgagtgactggctgagtgaataaatctctaaataattaaatttataagtgtgaactttacagtacatgtacatatttacatattgtcctcatttcctgccctggtgtccaagtgtaaaaatagtttatattcctatttattcatagtaaaagaaccaaaacctcctggattattctcaaatgaaatcatgaatacatttcataccaaattccaatctttagtcaatggctttagggagagattggacagcatttgttttaaacacagctggctttaatagtgttgtttcttcctttaagaaacatgctactttctttaagtagcatatataaataacaaatataatatcaacaaaaataaatcaaccatcaacaaacatatagaatccaaatcataaacccaacatacatccttgttttatctgtactttctactctctacttaacaaacactgatttaaatttgacaatctgagatttcttctgactcttggcaggaaattgttgcaaaaaaaagacagccttcatttatgctgctgctactttatttatcaatttgtactgacactttttttttttttgaggcagagtttctctcttgttgcccaggctggagtgcaatggtgcaatctgggctcactgcaatctccgcctcccgggttcaagtgattctcctgcatcagcctccggagtagctgggattacaggcatgcgccaccatgcctggcttattttgtattttagtagagatggggtgacacctttttaatccaatgtgtttgtcctttcttcagctcaggctcctgaagcttcatttccaagtctctttactaagattcttcatctctaccgatgagtgttctggttctacataccttaagttatgtgacttctgcctgacatacaatgcttatgttttctagatagatgcctgggtttgattcatatgcattatgtcttgtcctgttgttgaccgagtctatcttaattcattttcaataagaaaattatgtataactttcttaattcatttccagcataaaaatttccaacatgaaaattatttctatcactatccaacagtctatttctatatctatatatctatctggactgagagacagaattgtggagttgttcctttctggttatttgctgacctaaataaaaagctataaactgggatccagttagattaaaacattaagatgcaaagatcgtcttttcccaagatgatgcaatcattttttgcttaattgttgagaaattcataaaaatggggtactatgaaaagaataacttcttgaaaaagttcttctcccaccttaaaataaattgcaatgtttaaagattctcatgttaaatttggagtttggcttagtacccagatttcaactccaaaaaaaaaacatacacataactacattatttttcctctggaacagcggtacttaaatggaagtggtgctggggcaggggaagcacaccctggtcatcactagaaattgactttcaaactacatatacaatcctttcctctgtctaagttctacatactatccagttggtagcattacactaacagcagggctagaagcagcagagacatcactcatcagaaacagggtagagcaggagggcagggctgtgagtgtgatggaaaaggtcttgacaatttttatgaatcactggaaaaaatacacatctactcttaactctgataatacctattttgtctctgttcaattgcatcttaatgttttaatctaactggatcccagtggatagctttttatataggttggcaaataaccagaaaaaaacaattccacaactctctctgtccagataaatagacagatagctatagaaatagatagatggatagtgatatagtgatagaccttctgctagcatctatttggtgacagtcacaaatgcaactacaatttcgaagactatcttcaataattccaaactcttttcaaatgtcctgctgtatcttaatagaagttaattcttattattacctgagactactgaggtaggtagatagatagatagatagatagatagatagatagattagattagatgagattgatatgctttttacattcattttcaggagcatagcagcaactgtatgaataacggaaagcttgacttatctaaggtataggtgacagaaggaatgtcaggattgataacttgaatcctagtctaggatccatcataccatttcacatgaataaatatatgtaaagatagtgtttattcaaagaaatgacaagttggtaggggatcatttgaataatgcaattcacagaattgttatgttacctagcccctataaatagagtaagaattgtgagactccaacaagaaatgccttcattccagtcatccactcctaatggtcaaagcttgtgagaagaagccatgtgaagtgcacacatttgagtgcttaggctccagctattccaaccattccatgtccactgagtccctaaccttctccaaacttcttgtcctcattctctcagttcccccatgaatgcctgcccagttagtggacatctttctggtttcttccactttagtctttttttttttttttttcatgaagccttttctgacccacagcatggcttcaggaagaaatgactataccctccctaggattcagtcatagcatgtagaatgttttgttgcatgttttgatttgttgcctgtttacctttctttagcagacagaaagccactttaggacagagagaagttcttttattttcttttctaattctggcatctagttaatgtctggctcagagtgataaaggagatagaaagaaattacttaggcagatagtaagagtaaaagagtccttggtaaaatttcccttttaataaaaagcagcgccaaattatttcttttccagcaaagagcagactgaaaaattgagctgcagacatagataagcaagctggaagcttgctcgggggaatgccagcagctgtgcggagagaaaagggctacctaggagccaggcatgttcaacatggaggctctgtcttcccttttctttgtcaccacatgtacagtaaagaactaggcaacgtggcactagccaggtagagaacccatctgcataacaaaagattagggtggtatggccagattttcacaaactgtgcaaatggcacacctagccctaaccagtttttcgcaccttatgcaaacagtacacctggtctgaccaatcttttgtgccctgtgtaaatcagacatcacctcctcaagcttatctataaaacctgctgcatttcactgcagaagcagaaacccattcgggtgccctctctctgcaggagagcctttctctttcttttgcctattaaacctccgttcttaacctcactccctgtgtgtctgcatccttgatttcctcagcatgggaaaaggaaccttggggttcattatcccagacaatgacgccacttcaagagtatgtctgtttttctgtttccctgttcttaatacagctatgttacttttccacctatatgtaccataattttttagttcactgtaaatttattattttgtgatatcttttcttttttattctactctctgtgaatcttaatcaaaaaatagattttattctcatttttttcttgtactttctccccatcttctacatatgccctgaagaatctatttcattgatttcttttaccctatagctacttattttgcaaaagaagaagtttgttttcttgaaaaaagttattgtctgttttcaacttatccctcttttactttggagctaaatacctggggaggcaagtccaggctttatcttaatcattctgaataatgtcataaaagaagaaaatggttttttgtagacagcatatgacaaaaaaattttttgctcttctccaaattctagagatttagaccagcactatatgaactcacgggactggcagatgaacaatgggtaaatggctttattctccacccaatgaggtttatagttcaaaggagacttagaccaccagtctgctctccatagagcagccatgatggtgaggttggagcgtaagccaggtcacagagctcctccactctgaagtcatcacagagtgtccacacctttcagaataaagccctcacataatcttcaccttcctgctgaactctgatcttcttttctacaactccctccctcattcactgcagccttgcacactgtcttccccagccagaaatgttctttccaagggatgcttatttgtagttcttccacttcctttagatcttttttaaaagtcatcttcataggactgtgttagccattctatccaaaatttctttctaaattaatttctgattgcttctgtaacaaattaccacaaacctactggcctaaaacaacataaacttactatcttacaattctggatgtaaggaggccaacaaggggcagggcatgggtagagctgtgatttttttctaaatgctgttcatccagacaatggcagcactccctggctcctgacctccttcttccttcctctaaggcagtagcagattagcgttttcatatctttttctgactctgacccttctgcttccttcttctgcatacaagaacccttgtgattacacggagtctacccatataataagaataatcacctcatctccactatatgtgattagaaccttaattcttctttgccatgtaatataacatattcacaggtcctggggtttaggacatggacatacttgggcaatcactgttctgtctagcatacatactcttccttaatatttcatatttctttctctaacattctctccttagtctttaagctattgaaaacactatatatttcccgtatttattctgtttgttttatgtttcctcaaattgaatgtatgttgctgaaggcagggacttttgtctttactttcttcttccctggaaaatggctagctagaagaataccaggcatatagtaggcactcaataaatattagtaaaataaataaagtagtgcataatgctagctgaggtaacacatggcaaataagtgtttatccttcaggagagattatgatgtaacatagttcttgtaatcttcatcattattgacccaaatactcatgatgtaattttgaagaaggtggggttattagtatttacctaggggtattatagctattgtatcatgaaaatgtttttgattagacctgaaagagatctctcctagttaaacatagactccagtgtgaaccaagtcattgttaattgtttttaataaagatttggaggaaacattaaaaacagtattttaatgcacaaatatgttagagatagctaataaggtgaaggataaaaaagagtaatgatagtactcaaaacgtaacttcagcagtgagaatataagtttctgttttcaattccatagctcagttacattacagttatgagagagcagattttgcattattttatgtgcaaagttactgagtttcatttcattttagtgttaaattagcctaaaatgtaaaatggattttttaaaaatactagtacattcttgaataatatttattcaaatgttatgttcatcattgcatttgtatatgattttttaaattttttgctaatgtgtttgaaagacaagaagagttatcaggttatcttcagtaagaaatttaggggccatattgtccaacttcttaactgtatcatgtcttaactctcctataggacttatgagccacttcctccaggagttctttcttccagaagctctcatcccttcaatcagtctagtgtcccatagtagcatcagaggattatataccagaaaactcacatataatcttctgaagacctgatgagctccccctactagatagggatctacttgatgatctacttgattcatcttagtctcccaatagcaaaggacctgtcaggtcgtatgttatagatacatgtgcatcaaatgacataatcaaatccaacaccaccagttcattactcatcatctgctttaacccatccagtaatgtgaaactcacaatctaatgagttatcattcttatatatggtattattcttatcttttttctacatatgtatatatatgaaaccagaattctttcttcctgtaactcacactatgtattgatagctcttttcctctcaagcagcacagaatacatctagttcctcttctacatgacagctctacaacttgctaaaggcatatatcacatccctccggaatattttcctttcaagcccaaacatccttagttatttttgctgatgtgttcatctcatgatttctaaaataaagcaaatggaactcacccagaatctacctgaagtctgacaatgcagaatacaagaaaatgattgcctgcagtgcattcctgggcatggaatttactacacgatcataatattacaaaataggtaataatatgtgctgttttatcttaataattatttatttccttgacacagttttctttccttatatttattagcgtctattgatttccttgcctttgctatcccataatcaattcttgccttaatgcttcctggcaacttatttattctggcaaaaagtattaaaagagtgacttcattgtgttggaaaagactcttttattttgcccttaaagaaagaagatataatttatttcaccagtaccaactgaggtgtcttactcagttctacagattttattctgaattaatatcaaaagaatgctctatccccatgtgacccagcaatcccttttctgggtctatacccaaaggaaatgaaattatcgcctcataaagacatgtgcactttcatgtttattgcaacattattcccaatagtcaatatatgaaaacaaagtagttgttcatcagtgggcaaacagaataagaaactgtggtatacacatataatggaatactattcaaccttaaaaaaggagatcctgccatttgctacaacatggataggcctgggggacagtgttctaagtgaaataagccaggcatataaataaaaatattgtgtgatcttatttatatgtggaatctaaaaaaagaggtaacacatgtaaagaataaaagaaagattataagggtcagggtatgggagagaaaatggggagatgtaggtcaaaggatacaaaatagcaaaaatacaagataaacaagttaaaagatctaatatacaacatgaggactagagttaataatagtgtattgtactttggatttttgctaaacgagtagattataactttctttgccatgaggaggagccaggggtagttgggggagaatgaataagtaagatgatgggtatgttaatttgttctactatagaaaccatttatatgtgtgtgtgtatctcttatgacagcatgttatatatgtgatatacaaaataaatttttaaaataatgttcaagtcataagcctaagtatgtctatagtatcataaagtgttagctcaaaatatagagttattggcccaagctttaattttaatatgaagcttttataacaccaacatattttagaagacatacaagaataatatcggtcaagctataggaggaggtttcgttgggagataggcttgaagataattatctctgaatgaaaggtcgatagactcaagagcaaaagtcttgggaaagtatcagtcatgtgggcaaactttatcatgtttccttaagcagaatttagaacaggatcacacagcaagaaatatcagaacaggaaataaaaaacttttaaagtatctcatgcaactctattctcactcaattgttttttttaatatgaattctataaatacatgtagaaacatgtaaaataaacatttataaaggacgtatttttcacaatgcatgtaaattaagagatacggagagaaatgttttggctagatggtgtaatggtttgacaaaagtgtaaacatacttaatgcaactgaattgtacacttaaaatggtaaaaattgtcaattttatattgtgtatattttaccatgataggaaaaaaacaatttcatagattaacaagaggatattgaggtaaaataatattgtaatgtgttctcaagtagagctcagatcatttagaatacagcatatcattaccatatgatatgaaatatggcaatacctagttactgaactcagactagttatttagaatcatttagggaaaatttaaatacattaacagaattttaagactaaattaagacataagagttcatcatttatactaatatttgttttcttaaatggagttactctattatcaaaactgttgagatgttcagcatcctgatttcaatcactgaattaaatattataatatttttgctcttgtttaatgttttatagattatagatgtttataaatattttataaacattaagtgaaataatttatataataaaataatacaatatgttaatataaaacattttaatgttttataaatgttaagtataataaacataattgtttaatgttttatagttgtagctacattttgagtgttttaaatgtcatttactaatcatctaaagcatataaatgaatgcatctggattttaactcagagtaaattatttcatagttaaggcaaacaattgtcaaatacactgattttaaaagaactattatttattggtttatttcatggaataaatgagtttatactgtttagaatgtatcaatttatattgtttagaaatgaacttgccatatccacttagatagagatgctgggaatgtttgtcaaacagcagtgtcaatacagaaatctttttattttctcatttcaaatgaaacacaaaatgatctctgtatctcttcataaatatttaggcaccagaggttttgatgagacttttcttttcagaattgttttaagctgttttctacactcaaatgtggaaaatttcagataatattagtttttcatgcgttttatttaataacagcaaagaaatcataaagggaagctatatggctggaacaaatggagactatttctgagaaattgcaattatccttgatttttgatttactcttatctaccacaaggtgataaatttgacaaaaagtcttcttaatggtttctgtgcatgaagaactagttttcattctcttaatgaagtgcttcatcatccactcttttcctgcctagtggtctaaggtactgttaatatcaagacttctgtctccagtgaaaatcaatgcttcaaaaatctattacatagcttacgacagaattgtttcactcttcgttctaaataataaacattatataaaatataaatacaaaattataaaagttacattacatattcacgtactgtatggtaaaacaaactttttaaacatactagaataggttgaaagttgatattggccaagtgaaatcaagggaagagtatgttttttggttcataaagttgtttggtattcatttgaccataaaaattatatttttaacccatcctttacgtttaaatttatctttgtttgatttttatcttgctttttaaaggttagatatggttttatccacagttattttaccaatattaaattcttaatgctaaatccttcattctaagagaatactcactcttattctgagtatataaactcacctactttatagaatttatcattgtaatccagtaagtgacctttaatactctctttcttcaccaatctctatacacctacttttcttattcttttattcctcttgtctctcaggagtgttcttcataagctgaagggatctaagagaacagcattgtccatacttccatttctggtcagattacccattatagcaaacctcaaaaggatacataactatacaagaaaaaaataacccatagtggccccatctgataaaatgaaatattttagataatttcctttattattttcatatattcagcctattgtccaggccttcttaattcctccggaacactgtaggatcataaacttcattgaacaacttccccaatctctttttattttcaatttacccaccttttctacaaaaatatatataagatttttttcacagctaaaaaaaatcacaaaacttccttttagatgatattgctaaacattttcttatctttactgccatatttcttgaaaaaatcacttgtatggtaaggtgtaattttctcatcatgcactcacttttaacatttgacagactggcttttattctccaaaactctatcgaaatcagaggagcttctttgtcctaagccattctggattctcttcagtaccgatactcccttcttagtggagttctcgaaggactgatgctgtccttattaaactctaccctcttttcaggtttacataacggagtgactccctgttttagtcctttaactttttgatgacttctggcccctattggcttaatgaggaggataagaaattaagagagaatggcaggttcagttgacaaaaagttttgcagattttgcacctcaacttttgttaagaaacatcagtagaccttaagtttccaggcaacattaatacataattaattgttaattaacttatatctaattcgtataccagatttttacacatacctctcaggaagtatcaattataaaatgtttaacttatttgaatgtatagtgtctgaaacgtatacttctcaaatgcatgttggtatttaaaaatcaatttacaaatttaaaaggtaacttattagttccatatgagaacagttttccattattttaagttcacgtaatacatcatattaaattcaatttgcaatatgttctaatgtagtgtataagtattgacaaaataaccatcgttgtggggtttctgcttcaactgtgacatggaaggcctactctgatcatcggtgaagtggtcgagtcttcttagcaaagtattcaacattcagatattgattgtttagaaatagagtgacctcatttatttaaaaggaaagacaaaatattccacatgcatagcctcctgcccttcctatgctactcatattgtatttgaatttgaaaactgctatttttcaattaacaatgggactggatttgaagatataggcaaacaaaatcaatgattttggtattgcaagattgtcaagtctctcctttctcccactataagcataagtctctattaatctaaaccaagcattaataacccttatatatatagcaatagaagctccaggatgttaccatgtattgttaaagcccaaaactaagtataactgaacccatccaataaatatgaaatgaaaagctattatagctggaagaatttgttttaaagtagacttttgaaaattttaaataagaccaacattgactgcttacctaacaaatttgaactttagaaagatatgttaaaaggtttattttacacaaagttcacttaaatggagatcgttcttcagcagcaaggaaagatcccatcttctttgcttaatgcgcatcgcactgaagctttatggctatattagaatatgcaactccccatgccaagatttaattaaagtttaaatatttgaagggctggtgataatgttgcctctaataaaaaatttacctgtcttgggatcaatagagaaataaggttgtccctgaagaatgctgtaaacgactctggcactgtttccataggtcgggtcatctgcatctgtggccttgacctggagtacatatgcacctggaaaataagacaatatcactctagcatttttgttttactactttcaaggtcatgactcttatctgctggactcgattttcctttggtatttgacctacgtcaagtacaccatgagtacatgatgtcactgaggatagtttaaccgttataaccaaaatgttgagcaatgatatagttagtgcaaatcataagtttaaatacgcattttaaaagttgtgtccatttccaggagctggatcatcgaaatgaaagtcatcatgatacctttattgattggcacaccaaagaaagcatggacaccacttatattagctcatctgcttactattgatgttttaattttatgattaggatatcaatagagaggctaaaaggtttagagtgtactgaacattagaggttgttaagtaatttgcaattgcaatttaaaaattaacaactacctactagcatcaggaagtctttaattagaaaaggaatatttgagaaattgagaaaccataaataattgcaaaatagttataagagcacttctttgcctcaagattgaattaacctaaagatatagtgacataagaagacaccacagtcaaatgatctgcagctttcctaatttttttttggcatgggtatattttttctgtactaaaagaagttgaagggagcttttctttgtattttccttatctgttcataagcatattgaaatcagtctctaaaaacttttaaagtgagtatctcttcctaatatcctgttcaagttactattctgagttcagaacaaagtgtaatcaaaagtacccaaattgtagcaaataaaatagacatatatatatatgtatgtgtatatatgtatatatatgtgtatatacacacatacacgtgtacatccaaagttatgcagtgagcagaactcccttaatctgctggaggcactcaaagtaactattctgtttagtgaaaataggattgttccttttcattccattactcattcagccttttctctaagagtacaaatttggagcaaaccatgtcttcctagattactatagaagctaaaagaatgaattactttttcatttctaccattttcttttaataaaatgttagggttgtgacaagagtaagaaacaataactttttgtagacattcaatgccaaggtctttcagtttaaaatggttgagtgaatcttggctatattaacagaggaaaaatatattacagcagcctttcccaagaaaagaaacttttagagggaacttttagagagaatgtagataaacattactaggaagtcaggagtgaagactaatattatccatcatcatcaccatcatcatcatcaacatcatcactatcattaaacacaatttgaccaatgtttatttctacccagcattgggtatctgtattaaagattcattaaaactacctttctataatcctgtagaaatcaacagtttattaagagtaaagtcctctcttcccaacagcattttcccccagaatattcatcaggatgttttctatccctccactatacatgtgtaatataggcaaagtctacaaatattcactactgtcctaattctggatataaatattacaattgaaaaactataaattgttctacatgttgggtatatttgaggaaaatgaaagtattatacttagtcacaaataggaaattaaaatatttgagaaataagaaatatttagtgaaaaacattaataaaatttgccaaactaataccgtattgcaatttatagtcgggaaaataaagatgaacacgtattgtctttactttcacatttttgtttttaatgtttacatgaccctccactatgctgaacaaatatgttcttctaatagttgtattaaattgtttatattaattatttttacagctcaaatatttaaaggagtgaattggaaaatacttcattaatgcatcgaagttgcaaatattttttcataaaaccccactttgtgctacttaaaaggatcactggatagcaagaataactgcattcctatcatatttcttcagctgtatctatagaattaaaagtaattgtccactgaattacagtataggttaatccttctttagtgaaagagcagattccaatgtaaattctccaaaagttcttaaagattgcctttctgggtgtttacaagaatggaactaaacaccacgatagcagcttctttgtcagctgcttgatgactgtcaccaaactcatgcaaaagacagagatttcatactctttccattaagaagtctcggtcaattgcctggagcatgcaaatctccgaggactacctttttcagtgcttggatagcacaccagctgttcctgacactattaaacactaaatacccaggaggtaagagcaggaggttgtggttggggcatgtttaatgtgccacaaggaaataatacagtcaatgatttgcacagaatctgaagtagtctggtatgtagcagtgagcttgaaatttattctcttatcatttgaatccagggatgacaatataaccactctaaatggttatatctgcagagagaatgcagctcatagagaaaacactcttgtataagtggtcagggccagagtgcagaatttgcaatggagagtatcaagtcacttcaagttcccatataacactgctttgttcagtaacaaattagtgtatatttagtaacaaagccagcaataaaagttattttatagtaataactatattctatatcttatactgtcactcaaagggaataaatatttataaaactatgataaagcaaagaacagagaaactgatcattgagtatgacagaactatgacgaagaggcatcaggagatgcccacatgatacaaactccaactaaataagtgatcactaacatttaaatgactatgagttagaattcacatgagatccgatttggatattgtattggtcagctcaggctgcaataacaaaataccacaggctgggtgtcctaaacaatagaaatctacgttctcacaattttggacacaggaagtttgagatcaaagagcagaaaaattgggtttctgatgagacctctcttcctggcttctcactgtgttctcctatgccctttcctctgtgctcagacagagagagggagagaggcagagacagagagagagagagagacagagagaggatctcctctctgttgtatctcccttttttttttaataaggtcaccacttctattggattaggacccacccttaggacttcatttaaccttaattaccacctgaaagggtctatctccaaatacagtcacattcatggttagagcttccacatatgaatttcaggaggattcaagtcagttcataacatatcattttagtatacagatatgtatatgttaaactatatgtggaaatttaacaacttagtaaagcataatttatttctatgttgtaaaattatagtcataacataatgtgatctcagtaattcgcaagcaaacattcatatcataataaaactctgatagacttattaaacaggcatacattacctagatgaattaacttaaatttgagtcaatattttttgtccaaattatgttgaaaacactaataaaaagtataatgtttcactttttagattcaattttgagaattcatacatataatatcttatatggtcagacaatacatttgagaattcatacatgtaatgtcttatatggtcagacaatacatttacacagacacaaatgcacagaacgatttaatagtttgtaattactccactcaagttaatgagtatatgaagtgccaggcacactgtccaaggtgctagggaaacaccttgaacaaaattgagagaccaactcctgaaatcttatatcttatctaaaggggaatgggaggagaaacagattcgaggtgagagattttagatggtaatcaggaaaagcaattttgtaaaatttcatttatgtagagacctgaataattttttgcactttccttttccccctaatttatttattctttacttgacaatattgtatgtatttcttgtatagagcacgttttgaaatatgtatacattgtggaatgactaaactgagctaattaacttatggattcccttacatatgtatccctttatgtagtcagaacacttaaaatctactttcctagcaattttcaagaatacaatatattcctattagctggagtcaccatgttgtgtgctagatgtccagaatttatttctcctgtctaactgaaattgtgtatacttcgagcaacatctccctagtcactcagtttcccctaaccacctgtattagtctgttctcatactgctatgaagaaataccagaggctgggtcattcataaagaaaaaaggtttaattgactcatagttgagtatggctgggaagccctcaggaaacttacaatcaggagggaaggtgaaggggaagaaaggcaccttcttcacaggggagcaggaagaagaagtgtcaagcaaaggggaaaaagccccttataagaacatcagatttcatgaaaacccactcactatcatgagaacagcatgggggaaaccgcctccatgatctgattacctccacctggttctgccttcaatccaatcagttctccagaaggctgtatatgctctgaatcagtgtccaatatatggtaccatttctcgcatagccaggattcaccagtccagaaatcaaagggtggacacggaaccactcaccatcacccctagtgatccactagcaaacttcttgcttcctgtttctgcgacattacattctgctggcctagtagtcttagttccagagggagaaatgctgacaccaggagatacaacaatgattccattaaactggaagttaagattgccacctggccagtttgggctcctgctaactctaagttaacaggctaagaagggagttacagtgttggctggcatgattgacctggattatcaaggtgaaatcagtttactacttcacgatggaggtaaagaagagtatgtgtggaatacaggaaatctcttagggcatctcttagtattaccatggcctgtgattaacatcaatgggaaactacaaccacccaatccaggcagacacaattggcccggactcttcagaaatgaaggtttgggtcactccaccaggtaaaaaaaaaacatgacctgctgaggtgcttgctgaagaaaaagggaatacagaatgggtagtagaagaaggtcatcatctataccagccacgaccacgtgactcgttgcagaaatgagtactgtaattgtcatgaatactttttctttattttgttaagaatatgtttgtgcatgtatacatttgtactaagaaaaatatcttcattttctttatcatgtgacacaagatttattgatttcatatcagcatttaagtgttgttaactttatgtaatagcatttaggttaaggattagtgtgcttcgggttgtatgagggataactgtattaagttaggtgtaattatgaccttattgttgtctttatttggggattatgtatgacttcaggagttgtgtatgggttcaagttgacaagaggtggacttgtgatggttaatatagagtgtcaacttgattagattgaaggatgcaaattatttttactggatgtgtctgtgaggttgttgccaaaggagattaacatttgagtcagtggactgggagaagctcacttgctctcaatctgggtgggcacaatctaatcagctgccagtgcagctagaataaagcagtcagaataaggtggaaggagctgacttgctgagtcttctggccctcatccgtctcctgtgctagatgcttcctgccttcaaatatcagactccaagttctttggcttttggactcttggacatacacctgtggtttgtcaggggctcttaggccttcagttacagactgaaggctgtactgttagcttccctgcatttgaggttttgggacttgaactggcttccttgctctttatcttgcagatggctgattgtgggacttcaccttgcgatcttgtgaatcaatactccttaataaaccccccttcatacatacatcgatccattagttctgtccctgtagaaaaccctaatacaccacaattctactcactgcttctgtgagttttaattccatgcagaggcagctctgggtgaaaaaggtcctgaaagtgttgagggaaacctcaggaatatcagagccaccttcactgcggatcaaaaatcagatggaagaggtggcagagaaaatggtcatgtatgactttttaagccactgttaggactcctgtggggtttaactaccctttctacattgatttatttttatctcattatctctacctatctagtatacttacccactaacctgtatttcagtttttattaacatgaaagagatataactaactacacattaatttttccccaatacaaaacagaaatttagtatacttgcacacaatttatacttattgtatggtgcaattgcattaatttaaaattacatgaaagcttaactaaaataaaaatatactgagtgagaatgtaacaaagtgagtagtactttacaatttgtaatgacgatttgatttacatagtattttcatctgtgattaaattttgttgttttccagtgtaatttcttgaaccttattttattcattaaatatattgaacaggcattttataaaagcacataaaaatccatctcacaatttttaaccaatttcctttcagcggacactttgttaagaggattttgtttatttcctctattacaaacaattctgctattagtaaattcttgccattgccacagctggatcaaaaagcatatagattcaacatattgagctgtattgtcaaggtgactatcagaaattgtacttctttacattcctatcaacaaggtatattttctaacattctcatcagcccatatcctaattatatgtattttttattttatgcttgaactttaacagcatgtagtttttggtcatttctagtgtgtgtgtgtgtgtgtgtgtgtgtgtataagctgcactctttcttaacccacttttttcatgtattatatctgtgtctatctgttgaaaggttaatttactaacttatctttatttggtttcatttttatgtggttattttaaatggttttctttcgtgtgaatgtgtttatatctatgtgtgcatgtgtggtatatacaccttaacaactattatcctttagttgtgtttggtaaacttatgtgggttttatagtttagtcttctgaatttctatacaatgagtgtatgggttctgaagcccagaccaggcaagccagcttaatttcatgacataactacagagggcttgcttctgctattttatgtatcatgtaataatcatcttttatttatttgatttaattaagactaataatataaaggcttgggataaattttaagaatcatctggcacaatgtttccattttacaatccaatacttgaaggccagtgatgttaaaatcattcttattggtacttaaagacattctcatccaaaaggtaggaagttgagagtggaactgagccccactaagtcacagtttcagttaaagtagtcatagttaattcattcatgtcttctttcaatcaattttgttaattcattcatgtcttctttcaatcaataagtatttacatttgtatactatgcaccagatgctactttcaatgaacaatataaaaagtatgttacataattatttattttgtaaaatgctacttctagcatgacagttttgtattctaggtattatttccattggaagtattaaataaacttgctaggaagacagaaaatagataaatataagcagattatattgaatatatggcctctagaaaatatttttaagattttccatatgtataggaatattctagtaattgcatgtgctcttgctttttatcactctgccattgtcttaacaggttgaggtcctcaccttctcacaattggaaagctgaaatgaatcctgtctgccttctccttcagccccttcagttcctttaacataggaacatgggagtctttgagccaactcacaagattgatcctattactttcattgattacaaaaataaaatggaaataaacaaaacagaacaaaaacacataaagctctaaggggtttctatccctatttttaaaaaatcatctaaactcattgacatgttctgaacagcgtgacatgaacagatttcaaatgtgccttgtagattagattccaactgtgctgccagagaccccatgctgtgactactcacacttatttactgtttatgatgaggctctttcatgcctctgcggtcttgaataggtgattctgctacctggaggacatttgcctcaccgttgatgtccaggtccatgtcacttgtgtgaactctttcatttctgatctcaaacagagataatttgttcactcctctataatctcatcacacttagaatattttgagctttcaaaactcagtacatgttttttcttactatagtaaaacaattttacaccaacagccttatcatatttatctttatacacccagcacctagcagagatctgtcattaagtccaaaataaatgtttattgattagatatgtatagtactcacatagacttttacacagaaaagacagaaatacaatacacagaattctgtaaagagtgacctggtagctggttatgatctttagagtcattttcaatactaaattgggggttctgctgatattgaattttctaatgtacttcactgttttcaatttagagagtacaaccaaaagtaagcagcattactttaagaaaaatcacataggcaagaagacttagccaatttatggaatgcaaaccaggagagttaatgtaaatttctttgcagaataacatgaacgtttctcagaactgatgcatgtaacaaaaagagagagatttcatgtagcaaatcagtttctttttgcttttgtcttgtgtatatacattgcattatgatctagagataaaacagaattaggaaaattatattttctaattcttatttcagaattataaatatactaaagttgctttcaaaataaaaatgcaaaagaaaattgaaatttattttcaaataaaattaaaaaattgtacattctattatataaaaaaggcattatgcagcagagaaatgtaaaacagaaagaatatgtgtgtgtgtgtgtgtgtgtgcatgtaagatgctacaaaggaatggaatactataagacattgaaacaagggtgtgctagctaattttaagtgtcaacttgactgaattaaggaatacctagagaactggtaaagcactactcctcgatgtgtctgtgagggtgttttcagagaagattgcatgtgagtcagtggattggatgagaaagatccacccttagtgtgggtagataccatacaatcagttggaagcccaaatagaacaacaataacaaaaagatggaagaaaagctattttctcttttgcatgtacgttctctcttgcccttctaccttccctcatggaatcatgcagaaagagtgcccatactggatgcaacttctcaatcttggactgcctgtcctccagaactataggtcaaatgaatttctcttcatgataaacttcccagtcttaggtattctattacaggagcacaaaacagactaattggtcagaaaattgatgccaattggagttgttgctataacaaacacctgaaaatgtgaaagtgactttgaaactgcgtaatggatgagactggaagaatttagaggaacaaactatgaaaaaacctagatcaccatgaacacagtattaagagaaattctggtgagggctcagaagaaaagaaatgtaggtagagtctgatagttcttagagagtttttaagtggttgtaattggaatgttcatagaaatatgagcagtaagggttgttcttatgcagtctgagatggaacttaagaacaaggtattggaaactggaataaaggtagtccttgtcatacaggattatgaaatacaaaccagaggagagttaatgtaaatttctttgaagaatgacatgaatctttttcagaactgatgcatgacaaaaaaagagagtgctatttcatgtttcaaataactggtagaattgttttcatatcctaggactttgtggaaagtagaacttaagagcaatgacctaagatactcagcagaagaaatatctaagcaccacagcatttagtgtgctgcatggcttctttaagccacttgaagtaaaatgagagaggagaggatgatttaaagacagaacttaaaattaaattaaggcagaaagtaaaatttttgagtattttagcctagccatctaataaatgaaaagtgtgtttatgagatcaaactaagggggtggccaagctaccctttgctaaagagattactatggaaagaaggggggcaggtgctattcttcaaaacactggttgaaggactcagaaggcatttcagagcacctcaaggcttcctttgccatcacaagcccagtgctctgggagggcagaatggttttcatggatagatccagagtgccctccacagactcactgctgagaactatctagggactctgcttcccacattccagcacaatgctcttcagccaccccagccatgtctcaagtgggcccaggggagctttgacccaccactcaggaaggtacaagctgtaaaccttggctgtagggtgtttattctggaggcatgcagagtgagtgggctgtaagatcatggtagctttcacctagagttaaaagaatgtcacagaaaccctggggacctagtcacatacttgtcacaagggcaaactcaccccagacagccccagctatggcaatgccctatacatctgtacgaatgaggccatgtgatatggttttgttgtgttcccacccaaatctcattttgaattgtagctcccataattcccttatgttgtgggagggacaccatgtgagataattgaatcatggggatggttttcaccatactgttctcatggtagtaaataagtttcatgagatctgatggttttatgaagggaaacctctttcacttggttctcactcttgtcttgtctgccaccatgtgagacatgcctttcaccttccaccaggattgtgaggcctctccagtcatgtggaactgtgagtccattacatctctttcttttgtaaattgcccagactccagtgtttttattggcagtgtgaaaaaggactaatacagcaaattggtaccagtagagtagggcactgctgtaaagatacctgaaaatgtggaagcgactttggaactgggtaacaaacagaagttggaacagattggagggctcagaagaagacaggaaaacgtgggacagtttggaacttcctagagacttgttgaatggctttgaccaaaacactgttaatgatatggacaatgaaatccaggctgaggtggtctcagatggagatgtggaatctgttggcaactggagcaaaggtgactcctgtcatgttttagtaaagagattggctgtatttttcccgtggcctagagatttgtggagcttgaacttgagagagatgatttagggtacttggtggaagaaatttctaaccagtaaagtattcaagaggtgacttgggtgctgttaaagccattcagttttataagggaagcagagcataaaagtttgggaaatttgcagcctgacaatgtgatagaaaagaaaatcccattttcagaggagagattcaagctggctgcagaaatttgcataagtaacgagaagccaaatattaatcacaaggacaatgaagaaaatgtctccagggcatgtcagagacctttgtggaagcccctcccatcacagatctggaggtctaggaggaaaaaaaatggttttgtgggcctgccccagggtccctttactgtgtgcagtttagggacatggtgctctgtgtcccagacactaaaaagggccaatgtacagctctgggccatggcttcagaggggtcaagcctcaagccctggcagcattcacatggtattgagcctgccagtgcacagaaatcaagaattgaggcttgggccagcgcggtggctctcacctgtaatcccagcactttgggatgccaagaagggtggatcacctgatttcaggagttcgagaccagtctggccaacatggtgaacccatgtctctactaaaaatacacaaattagccaggtgtggaggtgtgtgcctgtaatcccagctactcaggagtctgaggcaagagaatggcttgaacccaggaggcggaggttgcagtgagctgaggtcacgccattacactccagcctgggggacaagagtgagactttgtctcaaaaaaataaaataaaataagaattaaggcttgggaacctctgcctagatttcagaaaatgtatggaaatgcctggatgtctagccagggcggggctgccaaacaccagggcggggctgcccaacaccatgggaacccacttcttgcatcagtgtgacctggatgtgagacatgtagtcaaaggagatcattttggaactttaagatttgactgtcctgctggattttgaacttgcttggggcctgtagcccctttgttttggccaatttctctcatttggaatggctgtatttacccaatgcctatatccccattgtatctaggaagtaactaatttgcttttgattttacaggttcataggtggaagggacttgccttgtctcagatgatactttggactgtggacttttgagttaatgctgaaaggagttaagactttgggggactgttgggaaagcatgattggcttttaaatgtgaggacatgatatttaaggggtgaaatgatatggtttggctgtgtccccacccaaatctcattttgaattgtagctcccataatttcctcatgttgtgggagggaaccagtgggtggtcattgaatcacaggggcagtttcccccatactgttctcgtggtagtgaataggtctcaaaagatctgatggttttataaggggaaacccctttcacttggttctcactcttgtcttgtctgctgccatgggagacatgcctttcaccgtccaccatgattgtgaggcctccccagccatgtggaactgtgagtccaattaaacctctttcttttgtaaattgcctctttcttttgtaaatttcaccgtccaccatgattgtgaggcctccccagccatgtggaactgtgagtccaattaaacctctttcttttgtaaattgcccagtctccagtatgcctttatcagcagtgtaaaacagaccgatacaccatgtcagagagtccccaaccagacaaagcatagtggatccctgagagtagagctggtctcaagaaaccaaactgtagggccatcagcatgctactccaaactgggaaagctataggcataagactctagcccttaagatgtgctgggtataccaagcccagcaaagtcataggagtgtagctttctgaggccttgggggcccaaattctacccccatgtgtgcagacattattctctacctataagacttaatgttgtttaccctgttgggctttggacttacttgagaatagttacccctttcttcttggctaactctcccttttggtataggaatgtctatgctatgcctgtcccaccattgtattttggaagcaggtaacttgtaaattcacaggctcacaactaaagaggaatttgcttcagaatggatcacggtttgaatctcacccatatctggtttagatggaattttggactttggactttggagttgatgttggaacaagttaagactttaggggctactggcatagaatgaatgcatttgattgtgaaaaggacattaattttgagggccagggtggattattggcaccactcaccattacccctggtgacccactaacaaatttttgcttcttgttcctgcaactttgtgctctgctggcctgcaggtcttagttccagagaaaggaatgcttccaccatgacacataacagtgattccattaaactcaaagctaagactgccaccaggatactttgggctcctcatgcatctaagtcaacagtctaagaagggagttataatcttggctggggtgattgatctagaatagtgaggtgaaattggactactactccacaatagaggtaaggtagagcatgtctagaatacagaagatcccttaggttttctctagttttatcatgccctatgattaaggtcaatgggaagttacaataattcaatctatgtaggaccaggaatgacccagagtcttcctgtaaagaaccatgaacagctgatgtacttgtggaaggcaaagggaatacagaatgggaagtagaagaagatgttaataaatgccagctatgagcacatgactagttgtagaaatgaagactaattatcataagtattttttctatattttttagaatatgtttatgtgtatttatacatatattaagaaatacttgtttttctttatgttttattctttcatcatcaaatataaaatatattgattttatattagtctttaagtattgttaattttatatcatagcatttaagttatgggacattaggcaaagggtaagcatcacccaaagactttatctcctcttcaggggaaggaattaaattatttttaattgtacaaaggatacttgtatcatattagggggaattattaccttgctattgtctttatttggagattaagtatggcttaaggaaatgcatatgggtgccaagttaataagggttggatttgtgatggttaattttaggtgtcagcttgactgaattaaggaatacctagtggtatggtttggctctgtgtccccacccaaatcttatcttcaattgtactcccataattcccatgtgttgtgggagggacctggtggaagaaaactgaattatgggggcagtttctcccataatgttcttctggtggtaaatgagtccacgagatctgatggtttgttttatcaggggtttctgcttttgcgtcttcctcattctctcttcacctacgggcatccatgtaagaagtgacttgctcctctttgccttttgccatgattgtgaagcttccccagccatgtgaaactgtaagttcaattaaacctctttcttttgaaaattgcccagtcttgggtatgtctttatcaacagcgtgaaaatggtctaatacacctagagaattgggaaagcactacttctgtgtgtgtctgtgagggtgtttccagaggagatttgcatgtgagtcagtggactgagtgaggaagatccaccctcaatgagggcagggaccatccaattagctgggggcctggatagaattaaaatggcagaaaaaaagtgatttccacatgagtgtgcattcttgctgtttcaccttccaccataggatagcacagcaagaaagatttgtccagatgtagccattcaatcctggacttttcagcctccagaactgtcagccaagtagatttctgttcatgataaattacccagtcttgggtattttgttttaacagtacaaaatagattataacaataagatctgctttgttctgtgggtcctctttctgtttgcttagattcataaatggcttctccatcctctttatcttcagccaagacagcatataaggtattttacaagaattagtgtgtttttgtttttgatacagtgtctcactctgtcacccaggttggggtacaggggtataatcacagcctactgcagccccaacctggtgaactcaagcaattctcccacctcaggctcccaagtagctgggactataggcgtatgctaccacacccagctaatatttgtatttttggtagagacagaattttgtcatgttgctcaggctggtttcacactcctaggatcaaacaatctacccacctcgacattccaaagtgctgggattacaggcatgagccaccattcccagccacaagaatgactaacaacaccaattcttgggctctcatcagacagtttaatttaattgttcttcagtgtgacaggtaacagaatttttaaaaaaatttctgaagatgagtctggaatagtgagggctaagaattctcctagaagaacttatcaattaggagaggctgcatagcttgacattgtgattataatctttgtctctgtggcctaacttctgaattccagattaaccattaaacaattgtgtggtctcaagcaaatttatctttgctttagttccctcatttgcagaaaaggtgaaaaaacatagcatcaattttctagtggtattaaatgtgttaatatttacatataaaggaattataatagagttttccacgtagtactgctattctagggtatgtaaaataaaacaaataccgctgggcgcagtggctcacacctgtaatcccagcactttggaggccgaggcgggtggatcacttgaggtcaaaagttcgcgaccagcctgaccaacatggagaaacccctctctactaaaaatacaaaaaattagctgggcgtggtggcacacgcctgtaatcccacctactcgggaggcaggagaatcatttgaacccaggaggcgtaggttgcaatgagccgagattgcaccactgcactccagcttaggcaacaagagcaaaactccatctcaaaagtaaaataaaataaaataatgcaaatacctacatactcaatctctgttctcctgcaccacgtgtagggtatgacttccgaaagtgtgacacttgcaagactcctatcctcaactctcacccctgaatattcaaatactgatctggaatttatcttctgtgtattagaaaagggaggttttgaatatatatttaaaatatattaaaatgccaacaagtagataataatgatattggatcactttattagagacccaagggaaaagaattatacatttgttaagtcttcatgaaataatgaaaacctttaagatggactagaaaagacatgtcataaaaatcccccagagtagaaatgatgcctccttgaactgtacttctaagatcagagcatccaatttggtttttctctgcttaacaccccgaccttgctcagcgtgggccctgagtagccccagcacatctaatgctgtgacagcaacttatgatttggtattcagtccaaggccccagaagcactctaacgttataaaaccttcctcttagatctgtcctaaatatttcagactatacatatttacaccttgtgattcaaacctactttgatggataagtgaatccatttttatgagcactttatctctcagctgtgtgccaagaattctatagtaccataaatatcaatacaaatgctaatgcctgcgtccagtgacacacattgaactccaacttatggtgttgccttctttatacctaatgtcatttgaaattattttcatacttgctgttaggaaattccatagaaataatgatgaaatgtctgagtatgggatatactcactcaggggctctcagcgataattcagtaagctttgtattttttctgtgtagcatcatattattatagggcaaataaatcagttttgatgcaaatgtatttggccaaggtgttaaggaccagttcctgtgactaattagagtttaatgtacaccctacatacctaacattatttattttgatttgatcagatgcctctgccatgttaagagtaagatctatctatctatctatctatctatctatctatctatctatctatctatcatctattatctatcgatctatcatctatctacctatatatcaatcacctacctatcatccatctatctatctatctatctatctatcatcttcctattcatttatctgcatctatctctctatgtagttttaagtaaaagaaaaaaacatacatatgtgtattatatatatgcatatatagtatatacgtgtgtgtataaactagcagttagaagtactaaatcctaaaatcaacactgtaattaaatatatgatcttgtgcaagttatttcaattctgtaatgataatataattttagtggacagtgtggcaatcctccaaaaattagtcccacctaatcctatgaactgttcatatttatattaatatatcaccatctccattatacctccatgtacattagatgttgaatttcatggaggcaattggcttaggtctaaagcaacaaacccaaattcttccccctttttttctggctaataatgcgtgtttaagaagtatgaatgtaacctacttaaagccaacaaaatcagaagagacatatgctgggaacttctagaaaattctcttgtacccccttcggacactgatgtgcagatgcctggaattgctattgccatttaacacctctgtggataattgacaagattgtcacagaccagaggccacaaactttagtgtcacaggggagaaaaataaagagtctcaactaaacctgccagaagttcatcctccaagcattttgataatttgaaaccataaatcctcttttatgtgctattttttaaaaattttattttattttactctaagttctggaggacatgtgcaggatgtgcaggtttgttacataggtaaacgtgtgccatggtggtttgctgcacctatcaacctatcacctaggtatttagcccaacatgcattagctatttttccagatgctctccctcccccaccctcccccaacaggccccaatgagtgttgtttccctccctgtgttctcagtgttcagctcccgcttacaagtgagaacatgcggttacttttctgaggataatagcttccagcttcacccatgtccctgcaaagaacatgatctcattcccttttatggctacatagtattccatggtgtgtttgtaccacattttctttatccagtctatcattgttgggcatttgggttgatttcatgtctttgctattgtgagtggtgctgcaatgaacatttgcaagcgtatatctttgtaatagaatgatttatattcctttgggtatatacccagtaatgggattgctgggtcagaatctacaagaaacataagcaaatttacaagaaaaaacaaacaaccccattaaaaagtggtcaaaggacataaacagacacttctcaaaagaaaacatttgtgcagccaacaaacatatgaaggaaggctcaacatcactgataattagacaaatgcaaatcaaaactgagagacacaggactagctggatttcctaggctgactaagaattactaagcctagctgggaaggtgaccgcatccacctttaaacacggggcttgcaacttagctcacacccaaccaatcaggtagtaaagagagctcactaaaatgcgaattaggcaaaaacaggaggtaaagaaatagccaatcatctatcgcctaaaagcacagggggaaagacaatgattgggatataaaccccaggcatttgagcagggagtggcaaccccctttcagtcccctcccattgtatgggagctctgttttcactctattaaatcttgcaactgcacattcttctggtctgtgtttgctacagcttgagctgagctttgctcgccatccaccactgctgttcacagctgtcccagacctgccattgatttccacccttctggggtagaagggtgtccgccgcacttctgatccagccaggcggtgcccattgctgctcccagtcgggctagaggcctgacactgttcctgagccagctgagtgcctggggttcctcctaatagaggtataacattcatgcatggcccaaagtttcattccttggaattcttgaggacaagaaccccaggtcagagaacaaaaggcttgccgccatcttggaagtggcctgccaccatcttgggcactctaagaacaagaacccctagtaacaaaagcactatgagatagcatctcacaccagtcagaatggtgattattaaagaatcaagaaacaacaggtcctgttgaggttgcagagaaataggaacacttttacaccattggtgggcatgtaaattagttaaccattgtggaagacagtgtggctaatctttctaaaagattttgtgtgctattttatacttgagttgcattagaattttctgttacttccaaattaagattttggcaagtcacttaaacattctaaacctctgttacttcaaacataaaatgggagtatagagagtggggacctcatggaacttatttatgcattaattcatgtgaaaatgcatataaatttcttagcttaataactggcacttagtgagccctcatcaaaatgatggtttaaattcttcaactttgtaatgaatgggtagagttccctacttccagtaatttgttgtacaatttgaaacagaatcgtgtctgaactcttcccaaaatgaagattaatcttttggttacagggttttgaatataccattgctctgtccaaaactttcaaagcagtgccaattactgacatgtaaattacatcttctggtttcttccactagtgctggctcccaagttgctttccacagtgcattgtacttccggaagtactggacacaaacttcactcattgtcatgcttctgtagaatgcttccttcagcaatttaccttaattgaaatcttgctttcccctgagcctagtactatgattggagcattctggactcaaaacttcattccttcagcttatcattactgcttctaatttactgatattttctcctaagagagaatggtgtttcttacgtttacctttcttctttgcgggcattttttttttttttttctgaaacggagtctcgctctctctccatgctggagtgcagtggcacgatctcggttcaccacaacctctgcctcccgggttcaagtgattctcctgcctcagcctttggagtagctgggactacaggtgcacgccaccatgcccagctaatttttgtatttttagtagagacaggatttcaccatgttggccaggatggtctccatctcttgacctcatgttccaccttcctcagcctcccaaagtgctgggattacaggcttgagccaccacacccggccctttgtttgcattttaatggttgagacaaatctctttcttcatgttgtctctttttatggtttcttcaacatcatttactcttgactctccccctgagtctctgataactacttagcattctttacagactctttttcctctctctgctcatataccctgattttgtctctcactctacatgcctaactctacaatcttgttcatattagccccagtgactaaatcctgaccatcatttatactttccggttgcttcaatagcaaaactagctcttaactagaccaggataaatctggaggacattttaagcttttatttagcacttattgtttacatctggtatagtctctttcattgactaaacatttctacaatgttttccttatgcattctgccactacttttatttgaaatgtttactatttctcacctaggttatagtgttataatatttaatagtccaaatgttgcttgtcttaacctacaatccacctgttgcttcagccacatttgtctttcaaaaatgtaaatttaattttgtccacagcactatctccaatgctcttcacaaatgtgcctctctcatttccaggcttatctttgtctcttccctgtctactttatgttgcctcaatataatagagttccctaagattcagggctacttcatattatgccctttatacatgctgttgtcaaaatcagaaatgttctttttcaggccacatgccactggtggctcacacctgtaaccccagcattttgggaggcctaggagggtggatcatgtggagaccaggaattggagaacagcctggccaacatggcaaaaccctacctctactaaaaatacaaaaattagtcaggcatagtggcacttgcctgtagtcccagctacttgggagactgagggacgagaattgcttgaacccatgaggagaaggttgcagtgatcctagattgcaccattgtactctagcctgggtgacagagtgagattctgtctcagaaaagaaaaaaaaaaagaagaagaggtgagtgttctttttcattcaggtaaacttcgttccattttaaagactggcctcaatagctccacttctagaaactcgtttccatatgctcagagtgtcttgtttcctgtctcattttccactgtctcttccacaagtctgtaagttaacatctagagagtattactactttatttatttatttatctatttatttatttatggaatctcagaacctacaacagagcttggtatataataagtacttaatacatgtctattgtgtaagttaataaaggaacaaataagtctggctaagaaaatacttttgatcagctgatgttagaagttttcaatcaagcctttggatctcttgattcagccacaaggctcaatgtcaatagttacaatatcgatatcccatcaatagttatggcagtgatgacactgctttgttgtctgttacagaaatcaatggagcagcttcaaatgaaaaatgtctagagaaatcttcagagcagtgacaaaagaatgcaataaaccaattattagcattttggcaatcctgacacctcaagccatgctaagtctacagaagagtgtacaattctactttccattaccagatagagcatgagctttcataaaacaaaggactgcattgatacccattagaaaaatggatatcatgtgtggaaaatccattaaaataaagtctagaacttattatagcagttcacattatctgaaggcaagtgaacttgatactgattatttcataaactcaaagtcacgatgatgccacatgactttgcaatacttgcaaaagtgcttatgaatccagataagtaatgatagaaatagtgtctgtctacaaagtattaataactgtacacattatattgtttaaatattcctagctaatagagaaaactttatttgtgcatgagactctgatttcatattaaggttttgtttctcctgtgttgccatggttaaatgctacagtaatttagggtggtatttgggttagtaattgttacaaaaataaaagacttggaagcctacttgttttgcaagattcattgtaatgcaattactcaaagcagaagttcactgtagctaaatgaaaattaaactttattatatttcatatgccttctgatccaaattctccaaatacgtttattaatgagatcagtttcttcatctataaaatgggaggtttgaacaatactcactagtcacggtgtttcacacctgtaatcctagcagtttgggaggctaaggaaggtggatcacttgagcctaggagttgcagaccagccagggcaacatggtgcaaccctgtctctaccaaaaatacaaaaaaaaaaaaaaaaaaattagccaggcatggtggcatggcctgtggtcccagctacttgggaagatgaggtgggagggtcactggagaatgagaagcaaagtttgcagtgctgagatcctgccactgcactccatcttctacaatacagcttggatgacagtaagagaccctgttgaaagaagaaaagaaagaaagaaaagaaagaaaaaaagaaagaaagaaagaagaaagaaagaaagaaagagaaaagaaaagaaaagaaagagagggagagagagagaaagaaagaaagagagagaaagaaagaaaaagaaagaagaaagaaaaagaaaagaaaggaagaaagaaaaagaaagaaagaaaggaaagaaagagagggagggaggaaaaaaagaaaaaagagaaaaatgtctatgttgatattctatccaaaaagactaactgtattgagagttgctgaaattaaattttgatggatttttccattttccgttcacatgctatcaaatttttacttcacatggttctctctcaagagtggctggtatgatttgcatttgaaggagttacagtatagtaatcattctcatgatgacttgcatgttcacactataaaaaaaactttaaaagttggacagcagtttcaaagcccactgaaaacaaattaaaatatatatgtcattactatttcataggataacagtttatctattaaccactttgaactttttaagcagcacattaaaagaaagaaaagataagagccattctatcactaaagtataattttgatgcacactacagggaacagtgaacttaacctagtgcctccacaatacatgcagatatctggaagacgtttttgttacttatggcagtgaaatatatttgatgctactttaaagtgtgtatttgatgacaaaagttgaattaactatactattatctctaagtgaaagctacggctcttaatcaattaagttattattcccttatctatcatgaggcttctctcattatactaaaagtatttttaaaaatattttggtcaatatatcattatgtggaattttttatgtatagtattttttaaagctttcaagttgtaagccaggggtaaaatatagtgcagattaaaaaataaaaagagattaaaagtttaagggagagtgaattatagctagatcagattacccatgaatttattttatgacccagccaaagagatggaaaggaaacctaatgaaaagcggtcgacagcaagaacaaattcttcaggatcacaagaggattcggaatattaaagtcatggattcaattaatagttgatctaacaggtagatggaaaacttagagaatggcagttttgcctggtacaattacaaattataagtgagtggtcttaagaaagaagctgtgagcagacagttctgatgtccttgcttatactaatttagcagctggccccaaaagtccacctggcaatctggagtccacaatgcttgctgggactcagggtcagttccaagttatcagcttacttcttacagtactgaacctggggccacattcaggtagagggttcaccgacttggaagtttgaatagcagttttgttcattccctgaattgtaccctgatgagtacctatggctcaaacaaagttatatttccttccaactaccttacccttcagtcaacagtgttgctatcagtgttatcttttctatagaatctgttagtttccttctactggagtcatgcttatgtctttcttctagactgtgacgttagggcactaagttcttgtctgtagatggggatcatcccagcactggggtgctctatatacaatgcttttccttccttctttccttccttccttccttctttccttccttccttccttccttccttccttccttcctccctccctccctcttttctttcttccttcttttccttccttccttccttccttccttcccttctttctttccttccttccttccttccttccttccttccttccttccttccttctttctttctttctttctttctttctttctttctttctttctttctttctttctttctttctttctttctttctcttttctccttccttccttcctttcttttcttttgccctaacatttgtttatccacaggcactcactcgttgtgacgtctaatagaaagtagagtcccagtgcaccccagctctcagtatttttgatcgtgagagagaaagtttcatggagtcagggtttatcaatttcttgttctgaagagtgggattttgcactcaagtgcagagttgaatcgtccatcatttccagagtacagaaacataggaaacttcacctgtgtttctagtgactgtctctaaagttatatatttaatgccagggcacttctttagctacccctcggggagaataataaaatcttagttttttatttataagccatctattaagtgaccactattttagcagctcacactgcactatgcacagagaatataaggtataaaaatgaatgaaaaagaaaaatgaaaaaaaactgctgaaatgtagtattctaaaaactttattttatatgatttcttttgggaaactcagaaaatacttctcatttgcaactctctcttctttcctaaaacaggagaggaacttaacaatatttatggagctattacaatgtgtcaaacattgtgcaaaacattttatatgcattcttatatttaatgcttaaacccatcctattttctattatttgcaccatttctataaatgcaaaactaacatctagatgatgacgcgggttgtctggagtcttgacttttagttaagtggtggagctggggcaaactcaaacagttgacaccaaagccattgctcacagccactaccctagtccacctccagggaacagagaagttcttcataaaataactaagctgttttattttgtttgtttggacattcttggcacaacatattttttccattttttttaaatttggaattgaactttctagaaatacactactcatttttgtttacttaagtaaacaaatagtctatttggttaaacttcgtatcatttttatatattagtttatctgatacaaaatggttactaatggatctgcatatataatttcaaattacctgaatacttaaaaagtatgcaaggaattttccacagtagctacacttgcctaagatcagatatgcataatatgttttgaatcatggatcttttttcttttgttcttattaatatcatttaaaaatctagcaccattgtaattcacatgttgatactctgcaaaagtgagaagaaatcagtctaatatccaggctgtgaatgtagatgcattttgatagtttatgatgtattgattggaaattcaagataaataataagcgttttactaaaatgaaaactagattacaaagcaatatttgtaaagatatatcaaacaatattgccagtatttaattagagccaatgttcaggtttcagtaataccattttagcttcagacggttattgtcactggatttctttgttatgccattataaattaagcaatgatgcatcatgatgattcttccattactggaagtcacattttatctgaatttattctcatgtccaaatgtttgtgacgtatatttaatttgcttattgccacatgcacagccacacacagaggatgacgtaaagcaatcatagaaattaacaaaaagacgtatttttattactttatcagtatttcaaattgatttttaaatcagaaaaaaacaggttatttgaaccagacatagattggctgtattgctctcataatttggcagatgtctgtatgttccatttatagtacaactgccacatttatttgctttttaaaagtgatatattagcactctgtccctcactcgccgccgacaacctgtctcgccgcgcgcatgccctgcagccgccccacagaaatgcttcggttacccacagtctttcgccagatgagaccagtgtccagggtactggctcctcatctcactcgagcttatgccaaagatgtaaaatttggtgcagatgcccgagccttaatgcttcaaggtgtaggtagaccttttagccgatgctgtggccgttacaatggagccaaagggaagaacagtgattattgagcagagctggggaagtcccaacgtaacaaaagatggtgtgactgttgcaaagtcaattgacttgaaggataaatataaaaacattggagctaaacttgttcaagatgttgccaataacacaaatgaagaatctggggatggcactaccactgctactgtactggcaggctctatagccaaggaaggcttccagaagattagcaaaggtgctaatccagtggaaatcaggagaggtgtgatgttagctgttgatgctgtaattgctgaacttaaaaagcagtctaaacctgtgaccacccctgaagaaattgcacaggttgctatgatttctgcaaatggagacaaagaaattggcaatatcatctctgatgcaatgaaaaaggttggaagaaagggtgtcatcacagtaaaggatggaaaaacactgaatgatgaattagaaattattgaaggcatgaagtttgattgagggtatatttctccatactttattaatacatcaaaaggtcagaaatgtgaattccaggatgcctatgttctgttgagtgaaaagaaaatttctagtgtccagtccattgtacctgctcttgaaattgccaatgctcaccataagcctttggtgataatcgctgaagatgttgatggagaagctctaagtacactcatcttgaataggctaaaggttggtcttcaggttgtggcagtcaaggctccagggtttggtgacaatagaaagaaccaacttaaagatatggctattgctactggtggtgcagtgtttggagaagaggggttgaccctgaatcttgaagatgttcagcctcatgacttaggaaaagttggagaggtcattgtgaccaaagacgatgccatgctcttaaaaggaaaaggtgacaaggctcaacttgaaaaacgtattcaagaaatcattgggcagttagatgtcacaactagtgaatatgaaaaggaaaaactgaatgaatggctggcaaaactttcagatggagtagttgtgctgaagtttggtgggacaagtgatgttgaagtgaatgaaaagaaagacagagttacagatgcccttaatgctacaagagctgctgttgaaggaggcattgttttgggagggggttttgccctccttcgatgcattccagccttggactcattgactccagctaatgaagatcaaaaaattggtatggaaattattaaaagaacactcaaaattccagcaatgaccactgctacgaatgcaggtgttgaaggatctttgatagttgagaaaattatgcaaaattcctcagaagttggttatgatgctatggttggagattttatgaatatggtagaaaaaggaattattgacccaacaaagcttgtgagaactgctttattggatgctgctggtgtggcctctctgttaactacagcagaagttgtagtcacagaaattcctaaagaagagaaggaccctggaatgggtgcaatgggtggaatgggaggtggtatgggaggtggcatgttctaactcctagactagtgctttacctttattaatgaactgtgacaggaagcccaaggcagtgttcctcaccaataacttcagagaagtcagttggagaaaatgaaaaaaaggctggctgaaaatcactataaccatcagttactggtttcagttgacaaaatatataatggtttactgctgtcattgtccatgcctacagataatttattttgtatttttgaataaaaaacatttgtacattcctgatactgggtacaagagccatgtaccaatgtactgctttcaacctaaatcactgaggcatttttactactattctgttaaaatcaggattttagtacttgccaccaccagatgagaagttaagcagcctttctgtggagagtgagaatagttgtgtacaaagtagagaaatatccaattatgtgacaacctttgtgtaataaaaatttgtttagttaaaaaaaagtgatgtattagacaacattctgtgttttccctttttaaatatattcacttaatttttgaaactactgtatggggtaataacttattataaaaggccctgttttttgcttgtttgcttgtttgttgagatggagtttcactcttgttgctcaggctggagtgcaatggcgtgatcttggctcaccgcaacctctgcctcccgggttcaaacgattctcctgcctcagcctcccgagttagctgggattaaaggcatgcaccaccatgcccagctattttttgtgtttttagtagagatggggtttctccatgttggtcaggctgatctggaactcctgacctcaggtgatccacttgtctcagcctcccaaagtgctgggattacagagatgagccaccgcgcccaggcaaaaggccctgttttaagcacattccttgttttaacaaatttaattctcacaacagtatgagaaagtaactgttatctatattttacaggtgaggaaactaaggcaagtgaggctatctgtaatttacccaaggttgtacaactttagttttagcttattgtactgtagagctaattccagagccgctgttctcaattactatgccactcaccccttagtttacagagaaatggttatatgcctgttgaattgggtagctgatagcatcaccctttagcttcaaaatggttcactctttcaataaaggattcatgcaagctcaccatatacggtcaaacacaatttgtagatagcaaatctgagcccataacccagataatataattttatattttcctatcctgaatttgagttgcacttgtgtattgatttatatgagtttgccaaaaaatatcttcataggactttaagcagtcatcctttgccagtttaggatattcactttttatgcatattttgtttttatagagctttaattatgtttcttgtttgcaccctatttgtctctactatatcatcagtgctttccaaagactcactgatatcagtatattattaaatcttattttttaagtagttcccacaccagttctccatgcaccttctttccttcactgctttattagatgggtacctctgttctcttcatgtcacctgtaattcctgcttgctttagttccttattctgaaaagaagaccccagcatatcttccaaacatatttgggtagtatattgtatgtgaacttccttgaatttgttcttggaatatattggtcatttggctgaaaataaaatttttggttaagcaccatttttgtttgtaacataaaattcattgctccatttacttctagcaactgtgctttcatgttgctctctggaagtctaatgccactttgattctctatttaaagtggcttgttccatttgtttcttacttcttttgttctgattttgtaaaaattttctttcttccctctgaaattttggaaaaagtttcttcatctttggtattctaatagctaaaatgaagtatgttttttttcattcattaccaggcatattcactgggtgaaactggtaatctgtagcttgtatgcttagatgtgtgaaattataaattttgctcttctatcctttttctggaattcttattctcagattctctttgtttgtgttttttctttttattatttttctttttattaattttcctcatatatatgaggaaaaatagtaaagaaatagaacaaaacctcaaagagtttacatatattattatattatatataatatatataaatatatataaatataaaatttattatatatataaattcagaggggatatataaaactctttgaggttttgttctatttctttagaatatgcttctttttttccattaacatgtcttcaaatattacacataagcacttaatctctaattattccatttttctaatagatataattttattttagatataattgtaacttgaattttcatagatgttgggggaagtggtttaggtattcttatcgatattttattacttatctctcattcaatatttgtttttctgttttataatgtagttttcctcaaatgcatgatgatctttggtttttggcacatcttttaagatggaacaatgaagcagttggctatgacttggggccgtgagagtcatggagacaatagtctctggttagtttcctctagtgtgccatgcagattttcttattatcaacatgtgttgtgatatgacagtatcagtattttatcaatatccatatttacacgataaaattgtttaggattttcagactcattcactcatataaattaattaaattctttattatttctgagcttgacagtatctaagaagactttgcatttatacttccattttatctttctctctccactttagaatatctccctgatgataattctttgatactccttcttttatcccttctttcactccttgctgatattgttttcagacactattttgtatgattgataagaagtttaaacaagatgtttatgattcagttgatagtgatggacaaaaattaaaaatgcatgactataatatcaaagctataacaaatttaatattataagaaagtaactgaaggagaaattaattctgtctccaaatgaacatcaatagtgacttgaaacacttctgatgaatagacagatcttcctcccatagttaaaatctggctgcctgtgacttttttcatcccagtgtcccattcttcctctggagacactgcggatccatagcttccctattctccttcaacaatggaaaatcagctatcattttgcacttacacttcttccaattgaacatacccccttcttcaactgttccttgtataacatgattcacaccatggacttttttgagtagccctccaggtccttcatatatgattaaaattccctgctggcatctagaaatgaattattgagtttcagaagaatcactaccaggttgcatgaggccacagtttagtatgaacatagtcagggcccgggtaattcactgttatgagggcacaacagctaggaattcaaatacttttgagcagtgccaggagtagataacataagcaagaattgccccaatactgtattttttttttccccttagttccaggttttctttcacctctttccattagcactaattaacgagccagttcagtaagcagttgatctaaacaaaaagtctgagtataagacaaacaataacaacaacaacaacaaaacagtcacactaaggagggtctgaaaagactgctacattagccgggcctggggtagtaacatgcaggcaaaaaatttggttgcaatatggtgcaaccggaggttaagttctacagtgaggtccactacactgtgtaccaaatctaagaaaggacaaaagaacatacgcttttctctcctttttccctcgtgcttttaaaaatgtacattcagattattaaagggtaattttttcatatgaaacttagagacttacttttcagactttaaaaagatgactagtatttcatatcaaacaccttacctgttagctcatagagagactacatcactaacaatgcagggagataaatagcatctactttgaattgttcctcagtttaggaaacaatttgcaacgtttcctcacttcagagaagtaatactattaggaatgctaatgtaaatgacgagttaatgggtgcagcacaccaacatggtacatgtatacatatgtaacaaacctgcatgttgtgtacatgtaccctagaacttaaagtataataataataaaaaaaagaagtaacatatcttcatagaaatttaaaatcactcacaattcaaacatgtgggaggtatttgtgataatacttttaaagtttgtattgttattcctacatagatataagtaaattgagattatactatttatactatattgtaacctgctttttaaaatttaacaatatatattgataaatgttcagtttctaaatattattgatgtgcttttaatacatacctattttatgaaataaatgattatactagtttttatagccagtccattattaatgctactccagttgattttaagcttctatcattatagataagggcatgcttgtatatacaaataggtgcatattagaaaattagaaataagctgtcatgttgctgatatagtaatttatttctaaagaaagactaaatacttaaaatagaaaagcacatatgattatatatttctgataggaaaaataatatattttaggtgctattcatatttttaatccagaaaacgtaagatcaacatgctgcatgataagtaatgtttttatattttatacttaaactgagtttcaataagggaatgagaaaagtgatgccagcctcttttaaagaaatataatttgaacattaaaaatgtttactatcttaatttccaagccaataaaaaagtgtaagagctatttttcctgtatatattatcattatttagcaaaacaaagtagggagaagggagatgtggtatctggctcactgcagggggattattacaattcagatcaggaggccccctagtctgtgaacacattccctgacctgtcactgccagttttagcaaagctgtagttgcctgcacctgtaaagagagaaacagacattgcctttgtggggcttatcttttgaaagaaaaatatattaccaatccaatgttctgaagctagactcctgaagctgtttttacagaagcaaagtgaaacaaaatattttacctaaagaagcctctttccagtctgtgttcgcatgtgtgtggctttgataacacagctttccatgccatcagtatcctgaatgctgaacaaaatcagaaagtattctccagttcttctgcattctagacatctcaaaacaatatatggggttttgtttgctttctttctttctgctgtaggaagtaaccatgtccataaaagcaatactactatttctcaatatagatgatgaagaacagctgcctttgcctaaaaccctctttgtgttagcatcagagggcagagctgcttttcttagcatataagttaccccacactggcaatgtttgacttttattgcttacagaatcaggtaaaaaaacatcagctgtagtctaagacacttccttcttacaactatatttgaccaacaaaatataaatctcaaaggttcattctatgtttcgggaaatatgtaaaacacatttaaatgactgacacttaaatgaatcaacttcagaaaaattctgtttttctctttgcaaagtgtagtaaatacagttgtgcgtgggtgtatgtgtatgtcttacttgtatttctttcttttgtcaggatcttaaacatctactgtactttaattgttaagatttatttccctcattcgtttccctatcctcagcacccagcacagaatgtactacaaatatttaatcaatggttgcttaaaaaacagcatattgaacgaatgaaactcttaaatctttcttctatggtaaaaatgtctagagtcaattatttggtataataattaatggaaaataagaagagtaaaaagaaccccagaaagtcaattatttgttataacagctaatggaaaataagaagagtgaaaagaactatacagccttactttcagctaattatttggttaagaaaggatttcaattggtgtatttctcatgtgatttcactattccaccttctgctcagtttcaaattcaatggagggggataaaaataattatgtgttttacatttgtttatttgcatttgtatgttaacaaacaaggacctgtcctacagccattaaagcacaattttagagacagagtgattctacatacataggctttgcagcagagatgtatataaaggacaaacatgttaggattctctatatatttgaaaaacgaaataacgcaataaagctcattttataaaaggacactaaaaaagtgaggatactgtcaaatttaggttgggatagtaagtagtactatttagaattacaaagaaagagcaaaaatagaaaatttaaagaaacttgtcaaaacaaggaagcaagctgaaagggagaaaaattggattttctacaactggcatacaggttgtcaacgttatccaaagtatataaaccccattacgtcttcatagaatgccaactacattgtgaaaattccaataaatgatgataagcctaaaatttatgatatgtcaatatatctaccacatacctttccaaaggaatgacccaccagatctatcctgagttgtttatataaatcctaattgcaatttatagttctgtattaaactttatttgcaatcaattatctaagatcagcctaacaattgagataaagtagaactagaaaaagattaagagttcaggaaaatacactcctggagttttgatactacattctagtcacctttttacatctaacagtatcaatttacagctgtggaaattcagacatagccctatttttggaaaattcaacaaagaagtattaacattgcatctttcataggcttagaatttttgatccaaaagctatttaagataaaatctcattttgctttccattacagagatgacaaaaacagctagagatcatgaaatgaattacacacatcatgtggcctatactatcacagttgggagaagaaataaagtcccttcattcttcagtccaattctctttcctgtgaatacacacacacatacacacacacacacacacacacacacacactctttctggcaatgtttcttacaagtctttttagcagactaaacaaggatcagagttaatctttggattaagtgtttggatgtagccaaaatagttgaatttatctctataggagacaatcaatgttttctacaagcaaatcaatatcccaaggttacagtttctgattgtacttaattctccttgctaaatgtaccttattaattattttgaaacaagggccaagtttgtggctagatcaaatcaaaacttcaaaagaaggaaggaaggaaggaaaagaggaagaacaaaacagagaaagataagaaaagaaaactaggaaaggctccaaatctatgcttaattgatggctaccaatttgagttctcctgaacctgttccaatactgtgctgagaattttagctgatcatgactgctatgccaagctcatataacacgttcagttttaaatccattatgatatcttggacttccagttaataaaatagtatttaaattctgatcattttcagtaaaaataagaataattacagatctgaactgtatttggggagtaaaagatgcataacattttttaaatgctttctgtgataatgctagtaattccctttggttttgtttattaattgatatgcaattcttgataaacagcttctggtttagtcatgtagatgttcggcaaggctcagagtgatgtggttatcaatcatggtgatgagctgtcttgttgtttgatatgaactttcctagaatggaatacaacttcctttaaagaatcctggaactctagggtaggtggtgggtttagggtggtggcgggaaaaagtaaagtatttcattgttgtcacttttcgcaggttctgccatcacatgcagttagttacttaggccagagattaatttggattgtaaaagaaataagcttttttcttctagtctaattttattcactagggttttaaaagccacaaattcttcttgtggcagaaactcacagtatgtattaaaagtgtttatttttattttaataaatatataaagttttacgtttataaaaatgtttgcatcagtttacctacaatactaaatcttttggaaaataatttaaaaaatggttcacaaggatatgacctatggccattctcctccttaaaaaaatctgtgatgctgcctgatttggtttcaggaaaagcaaaagcatgatatccatctctgttttctccattaaaaaacccgcttgatctaagtattgactcaataatttgttgaaataataacttaattgaggaagtaatcatatcttgtaatttaataatatggtataatggttggaaagagtaaccaaacaaccagcaaagcttcacgtacaactaactggtcttgctcttgatagaaggatttagtacatcacgtttgcctttgatcccctttatcaccttttcataccctttatcttctatagtaacaaagttctcccgcatcttgctcttgttcttatcttttgaacatcaacatctgctagcagttatctcatttgtaccgcactgtaaacgacttagaagagttttgatcattgcctttcaagttaattgtaaaatttcaagcatgggtggatcatttgaatgcgtgtttgcagcaactatttagtctaagttgtggttgagggaaaaagaggggattcagaaattatactaatagaacctcagcaaaaacagggccacaataaaaggaaaattcaagggagtggcaggagagaacaaaatgaagtccagaaaggcataatgagttcagaaattggcccattagaaaagaagcgggaattgcagacatatctctttgtaagcagacacacctatagaaatatttgtgcatctttttcttgctaaatagtgcagcttacatttattgtcaccagtaatatttaacaaagccttagaatttttagtgtagtaccccaaaatcagtttggtagcacattcaactttttgaaaataagaacttcaagtattcttgcaattttgatgtctactgcaaaatgacatgagtgaagtaaccctgctactgattgttttcagtgggtgaaatatattttcttatctactgatatatagaaacaagcaagtgcaacattaagaatgaatcatgtcattcttctctacttctggttttgaagcccagtagagttataaagaaacaaatttgtaagaaaagtgtaccaactgaaatggctccttacataaacagctgccagtgagattttttttctgtcattaattataaccaaggaataaagttctttacaaccctttacatcacagaaaaggtatttgagttttttattttaattaattattcgctgaagaaaccatttacagtatttaacgcctgcaagaggtgctgagttaggtgctagtccaaagagatgagtgagagaaatagattttaaacaattaaagtatagaatggtactagcataaagaaaagataaatattggctgggcagagcggttcatgcctgtaatcccagcactttgggaagccaaggcgggtggatcacctgaggtcagcagttcgagaccagtctcatgagtatagtgacaccttgtctctactaaaaatacaaaaattagccaggcatggtggcatgagcctgtagtcccagttactcaggaggctgagacaggagaattgcttgaacccgggaggcggagtttgcagtaagcccagattgtgccgctgcactccagcctgggcaacagagggagacaccgtctcaaagaaaaaaaaaaaaaaaaaaaaaagaaagcataaatatctcaggttatgaatattcccaggacactgatttgattacaaatatacaaatgtattaagttatcacgagtatccaaacactatgtatatctattatgaatcaacttgtaaagtataatgtgtacttaaaaagtgtagaaacacaaacacatacatgtacacaaatacccacaataaatatgcagtttgaaagaaagaaaatctttctttatacagctatatttatttataattttattcagatcatttaaagaacattaccccttttttgaatttagttgcattctaggactccaggtttttttgaccagcatttaaaaccaaggcagagtttatttatctttcatctgtaaaaggggtaacccttggcaacacgaaaagaaatctaacattatcctttagtaataactaaaggatctttctctggataccttgtgactgctcctcagccctctaatatctcccatatttataataactgcatagagcataagtggttcaccatatttgctcaagtcaattaaaatgtgaagggaaattacttttaactgcaaaaaccaaaattacttttgcaccaactaatacgtagcaaataaattgaaaaaaaaaaaaagactagttctcagagaactggtctcttttagcctgctatactgttcctccttagttgactttcaaggctgttcagctgcgctcactataaagggacagtagtagcctatagcacagagaagaagacagagctggagagaaatgagtaaatgtgcaagaagcttccaaagtgattggagagaaatggaatgtatctccccctcacactccttcagcttacctcacataccccatgtttagaggtattatttgtgggttaacatatgtggtctaaaccataaatgtagcaaatatgggcattaagattccacatgggaagatacaaacaaaactgagtaggccggcggccctggcactgagtagagaagagaaactgtggttctgtcttcctatatgtcattaatgcgtggaagcttcttgacttagcccatcaggacgctcatcctgcccttaaggagctgctcttccacaagcagtcttcagtccattagagcagcagggaatgtttccagagctccatatgcatcaatttgggaaactgcatcaccttgttagccacacagctgcgcttttctttctcagggctcagctcagctgctgatgttagacagccttgtgccacaagaagtgtgtcagagcccagaggagccactgccccccacccagtcagggactggagttgaattctaccattctggagagaatctagccctgcccaagtgcccaggtagtagccttcatgattgaaggtaaagatcagcaggaaactggcttccttcaaataactgtgcatgagggtacagataggaagatcccccaggcctggaagcaaacacagcctgggagcccactctagcattgggtaggatctctcaaatctcagttattttcatcagtgtgtggctcttggctgcaacccaagcaccaggataacaatggaccaggcagaacaattcccttcccttgggagctagcagatgtgcagaggtgtctcttctaatcttaaattgaattaaagccctgagagaaggtgcattggcttccacgcctctacatagcgtaaggtttgaatgctgaactctgggcataaatgaggcacagtatctgctatgccagctggaatgacagccagcttaatcaaatagaattcattccaaaaaagaaattgagagtcaccgatggagagtgagagtgagaaaaatacaaatacatatttatatgagcttgaaaaattataatactggaattcctcttataaaccaatttgtttcagtaccaactcttttccaaacatagattattatcttcacagcttggacaattaaaaagtgtcaaaataacaattttctctgctcaaaaatctaaaagatggcatcctcttttcattatatgtaaactatttcacaagctgtgacatgaataaaatgcaaatcagattattacaattctcagcagctaatgggaactctacctctttctcttccattcaccattgaaataccagattgttataaaagcctttaaagactgaacttgagagaccgagtgttgtgtccaatggctaattcaaggtgatctacaacctaatcgatgtataaacaagtatagttttgctgttattttgaaatcaaagaatcaagtaagactgacaaatgatggaaaacacgtgaaacaaaaaaaactttttttatctaatgcttgatagatggctaaacttcttaacactgcccgcttcccagatatttcagaaaaatgagactatagattgacgaagtattaaatctgtggtagcttatccctcttgagtttattggcttatttattcttatcagtataatttgtctacaagcacatgtaaaaagtctcaatttagtatgttgctagagaaaaagtcaaaggaaaataaatagaactttgaggtttctgctctttattcagaatcattggaaaatacaagccaaccaaaaaaaattaaattctacctacaactaaatctgagaaaaaaatattgagttcataaagatgaacatataagttttattttgatagaaattgccaacaaatataatcaactgaaatgttgctcagtaaggagaaaggggaaaaaaaggttatataaatacaatgacagccaggtattgtcattttcaaagaccctatgcctaacattcacagggttgctttttacaaatctggttgacagaaattttcagcattcatccagtaactgaaatgtattggtcagtactataggcttcatatgactgtgagcatctagaaagctctggtttcctccgagcggatgacatttatctattttgtattttgcttacaaaaaaatgtttcccaagtgataccttgatattttatgaaaaaagatgttactgaagagaaataaagcctcaaatgtctgttacgttgaatgaaaatgtactgacaaaggtgatatcaagtttttagagacagtatcattagcctgtcccatattcttcagagtttctgagttactcaaaatgaaactgacaggattatggactatcatgtgaaattttgattgtattgaagccagctctaaaagaatcctagaaacatgaacatattacatcttagttttgtatacatatgcttgcaataaaactgcttttatagtaagatttcataaatattcctcatataatttataagataaaaactcaaggttacaaaacatatttatcagagctattttgaaaatgaatttaaaaaatacaaataaaagctaaattttgacttcttccatgtattacaatatttctttgtcttctgacaccaacaaaacattttcagcagattgaaattttaaaggcttctacactgtaattatattacagaacacaatgtcattaaaatgtaaagcaaatggaataggttatatgccatttaatgttctgatatttttatttaaattgagtaggttatatgccacttaatatttctgatatttttattaaagtcatcataaaattgacatgttctttcttaatgacaggcatgaccttatgtagtaaaagtactttcttgaatattaaacaactgctgaaatcaccagaataaataaaaaacttggcttactttaggaataaattataggaaaaatctatatgtagggccttttagtatacattaaattttttttctgtttttctttttaatattttattttatttttagagacagggtctcactctgtgagaccaggatggagtgtagtggtgtgatctcatatgtcatagcatcctcaaactcctggtctcaagtgattcccctgccttggcctcccaaagtgctgggattgcaggcatgtaccgctgcactcaacctaaaatttcttttaaaaaatctatttgagaaaggccaggcgcggtggctcacggctgtaatcccagcactttgggaggctgaggcgggcggatcaggaggtcaggagatcgagaccatcctggctgacacggtgaaaccccgtctctactaaaaatacaaaaaattagctgggcgtggtggcgggcgcctatagtcccagctactcgggaggctgaggcaggagaatggcgtgaacttgggaggctgaggttgaaatgagctgagatcgcgccactgctcttcagcctggcaacagagcgagactccatctcaaaaaaataagtaaataaatatataaataaataaaataaagtatatttgagaagagacaattgtaaaagttatgaaaaaagtttgagatagattcagaaaggagtcaagctgaatggagagatgtaatcatgaagaaaggagaggaaatctggtctgtatcgcttgaattttatcatggaagttaaaacaaaaatgagttgatctaagagaaggaatttatgagggaaaaggcagatcttcatggcccgaaactctgttttagtctatctcacacaatttctcctgctttccaggaaaactttacttttcacctcgccaatatggtctttccacctctgtgatttagttcttactctccttcccacctgggggttgttccctcctaccttttctgtatttgctgtaaattacccatccttaacatctaaatttaacaatcataaataccatggagttatctgtgatctttctagctagaattaattttcttctctctgatgctttcagaacagtttctgcttaaagtatttattgcatgccaccttgcattacaaatctttatgtacacattagctttattcctggttttatagatctcttgaaggcaagggcagtctgatttaccttgcattcctcataatactcagagaacctagtataaggccattttagaaaatagatacttgatacaattcagtgaaagcatgtcatggacatgttaaatcaagaccctagttgaggagtttgctaggaacgaggctaaagctacaaactttcaagtatatttgtgcttgggataaaatcaaggctgtgggctctttaggagagaaggagaaatctcaaaatttaaactcatttacaatttaaaaggtatgaaatatttgaggtcatctaatggcaaagcaatcagttttcagaggcatttgaggcatggcattcaaattgtcttggcaaagatatttataaagaaatgtatagaggattaacctataacgattgagaaagttatttaaaaggtttgttttaaaaagctcttattagtaataacaattattaatataataataacattcttctagcttttttgaatattaactataatatatgaaccatactaaatgctgtgtgtttattatataattttaatacttgtgatagaattcattttgttcttacaataatcactatataatttccattataaagatgagaaaatcaagactagaaaatgtgcttgaaattttataatcctcaagttattattgaacattttattcatatatctatatggaatttatatatacaaatccacagattttatatatctagctagatacatagatagttacaggtacttacagaccattttaaagacttaataaaagttaattttgatattaacattgaataatttggatcttcaatatatgctatttacaagcatcacttttggcactagctctctaaagtatacattcatgaatcccagagcatatatccatgtcttgtggtagctatcacaggaaataatatgtgcctcaattcctgtggaaggcaggagggaggcaataaagaaaggaaggaagaaatgaagtacaaagcaaacactataaactggctattcaagtaaacaatacgttattattctaacgataaccagttattagtgaataataatacaatctatatatgacaggtatgtagtatatttaatagctattctaaataattaaaatgccaaaggttatatcacatcatcttatatcatgttatattagctatagctgtacaaaatgctgttatacttactatgtgtaaaaacaaaccatgccaattcattaaaaaactggtagtgacctgggagctctgccaccgtaacaaccaaatgctggatattacactagaaatgtcatggtatttatcttttttcactaagggtggcccatttctgatttggactttgaacagaaaacacatatttcaataacaagtttaaaatcggtccccgactccgccagccaatgcccaccacaattgcagcacaattcaagagagtgctgaagactctgcagaattaatgcaatgagaaaaggaactttgatagcgaatgctcagaatgacgatgggctacagaatcatacagtcatctttaaaacctctgcctaaataaagatgataaatccttgagaaaagaagtgagcatcacagcccacatagcacatgccacactgcaaacaaaagtccaggctattctttctcattgttgtttctgccatgccgcatttctggcacagaacagttgctcagtaaatattgtgaaataatataaatgaatttaaacgtttgatttaaattcagccagagaagagattgctcatatttcttcagggttttctctaaacccttagtgaagtgatacattttatagtacacattgcacattttccattgtaaaatataagttgagtcatgttcaagaaaattttggggattttctaaggtcaacatataaagttcaatattgaaaaaaacatgtttttgtatgcctagaacttataagtcatattattatagtctaattccaatcctgagagtgaacaaaaaaagttaagtgcacctctgataattatgttcaattatggctgatttctaactggcataggtccatgttacacataataagatcccatgtaaaacttcagccattcaaacccaggtaaatagctttgagttcataattttcaaatatcttttttcaaaaacttgttggaactgttctacttctatgacattctttcccaactgactttagaagtgacatctcaatttccttttatttatgtcactggaactactgcttcaatgctttctgatttcatacctgcataataaaattcctgattcgcccatcacattttggcaaacaaccaccgccacatctctctggatactggctttatcaaccctccagattcatttcaaccagccacctccacatatgattttccaaccactttgaactcccaagcaaccaggtgttctccctcactatgatctgcttgcacctgatccaggcttgacaaacaacatcatcatccagcagtggtttatatccatcatgaggttttccaaacatcagtcattcaattatttccttcacaagttttgctccaactgtatataatttgctgtgttataattatgactttattgtataacagatactctatgataaaagggatatattcttgttctgctagccactgtacgtgcagagattacaataataatcgtcatgtactgctcacttaggaaacattgttgaataagcaagtgaacagatgaagatatcactggatggaatctttcaaaattatgcactatacgcaaagcaatattattcaattctatctttattctgctgccttctgtaggatctatcttagagatatgttgcctcttgattatgaagggagacttgcaagtgataaacaaaggtaaattgttactagtaaaccaaattgaggtgctctctctctctctacatatatgtataatataagtatatatattacatatgtattatatgtatatatgtatatatgtgtatatatatatatctccctcgctatttctctttctctctgtctcactcactgtctctctttcagatctttgctactctaagtatgtttccagagccagtggattaagtaccatgcagagagtttttgagaaatgcagaatctcaggccccataacagacttaatgcagaatccatggtttaacaagtacccaagtgattcatatgtccattatatctgagaagctctgtcttccatataatcagaaagagttaaaagagaattgaaaaagaaaatatgtttctcactaggtaacccagcattacttaattctaaatgagtgctaatagaactttttgcagtgacagaaatgttctctatctgctctgaacaataaccacatgtggctatttatcactttaaaagagactaatataaataagaaactaaactttaattttgttcaattttttttaaaatttatttttaattagtcaatgtagccaatggctattatgttggagagtatgactctattagatatgggtaacaacagctaaacattggggaacacttgtatgctgatttaaagatgttgcataaatggaagaatgataagacgaagaattgagcccatgaaaacattaggaaaataagactgcgcattcaaattattatgtcataaattttacaatttacaaatgagttaagacgctaatgataatatttcaaaataataaatggccaaggctgctacttagagttaagaaaatgaaaacaaccattaggtgctgctctccttcatatcccattaaaataatgataaaaataaatacaattaaataaataaaaattaaaatgagacttggaagaaacaataacgacaacattttaaattctgggaagcagaaaaataagtggtaattaacagtgtgccccaaatgttgaattctacacagcaatagtagggaaattggagagttactagaatttgtgctgcagatgctttatgagaaacaaggttggtgatacttagctccctgtgaaaatagtgctaaagaagagattgtaagtacgtttgaaaaacgtacgtaagaagcatgcaaatagatcccaacagttcttctctcagtctactcagctaggggactgtcttcaactcccttcctgcccttaccccttattgcctacatatgcttcagaagaaggctaagggttcgttatcttaaagggggaaaagagtgtcttggacaccagccttagctgtcagacaggtctcatcttaattctgaaaacagaattaagagaaatttactttctaaaagttaaacctgtaccggtttcccctatttggtgcctagaactccaacagccaggtttatataacagtgtcataaaatagaagtcttttctggatagttggatcagccgagagaaaaataaaaacaaaacaaataaaaacacaaatgaacaatagaagtcaaaagatacagtgagaaaatcttcaagaaggtaaggtaagaacacaaatagatggaaagtaggagccaaaagataagaaaactcaaagaaaagtatctgaatagtagttccagaaaaggaacagaaaatgagacacaaaaaaagccatcaacgacatcattcccaatttattccttagaaaaaaagacatggatttccagattaaaatgtcttgctaagtgtcctgcatgatggatgaaaatagacatgcagcaatattcaagactgataatttccaaccatcagggatctgcctctgtagtctcttctctttctctattaggcaattataactactgtctgcattgctgatttcctgccctaaattctgctaataaacttcatgttacatttttccccgtgtaaaaatgtttcactggtggtgtttgggttctttttcattgtataacacaggatctcaaaaagtttacctaccatgcatcctgttgcaggaaataattagtgagatatgctccaccaaaacgaggaagtgaatgcagaagaaaatcagaagttataggaaaaaggggagagaacacaagagacatgtggaaggaataataatgggatgattatcaaaatatcaccactggattttggaattcttgagagtaatcaaaccagactgaagctagttagataaggctaaggaagatttctttaagactataaaattgggctggcgtagtagctcatgatgtctgtaatcccagcactttgagaggcttggatgagaggatcacttgaggccaggagttcaagaccagcccgagtaacatagagagtccctgtctctacaaaataaataaataaaaataaaaaattagccaagcaaggtggcatgtgcctgtagtcctagctacttgggaggctgagacaaaaggattgcttgagcccaagagttcagcctgcaatgagttatgattgcaccactatactccagcctgaaccaaagcatgacagtgtctctaaaaacaaacaaacaaacaaaaaacagaaagaaagaaaaaggaaaaggaaaaggaaaaacagactataaaattgagaaaatagctaacatattgagatgtggtttataccactgcagggtgaaattgcagatgtattaacactaaggacatagaaaagtccccccaaataaccataaagttcaaaatttattaaactgagggaaaccaaggtgatgtacaggaaagaaaatcacatggctcagctataaaagcatttgcatagccattgcaatgtgtactttggatgtcaatcacaatttgtcctttagggatagatggtaaatagaaaaaggtatcaaaaataggtttaagtgggtgccgtagagcacaggaaatgtgtgcggtgaagcaggaagagagcagagagcttttataggggatggctttgttttgtagccttatcaactgttggactcaaagttgtgtttttaaaactcaaactataaaacacagaaatgacaaaacaagataaaaactaactaaattttaaaattacaaagatttgggagaatccctccaattgtgacgataccttaattttagcacgaacttttgattggatgcttgctaagcagactcttgggcactggaaatacagcagtgagtaaaacaggcaaaaatgactgtctttgcagtttgtcttttcctcagtgatacattggaaaatgtgaaagcacatctgccctataattttctaactccaggttttagaacttttgcaacagactacaattaccaggctctggccacctattgagtcccttacccgatcactctctctcagactcccaattccagtcaaacaactctccttacagtctgtgttttttgttttcctggactagaaagttctcacagatatcgcaattgtctcattcattctagttttgagtcaattaccatctcggcagagagacctcatcaattactatgtttaaagtatctattgttgctctttttccctctcccctttcactgctttatttctccttattgcactgaaaatactggatgtgatttgcatttatttgaacatatgtttattgtcagtatttttctgacagatgctgacatacaatagcaataactttcttctgtttgtttctaaattcatggtgtctagaacaatgtctggttaatagtaagtgctcaatacttatatttagaagaaaagaaggaagaatataaaggagaaagacaatagaaataacagattaaaataaatccataatatgttactataagtacatatttatatttataaagttattttacttcctaaccattaattaatatctaaattatttttaaagatggatattttaggtagctttaggtttgacggtggtcaagaatagattagtttcttgaaataggatattttccaaatgtgaatacaattacttgaagcagacaggtcaggggttttcatgacttcagtcatttcttttagggttctggacatatgtattcattgagcagacttttgtttttatagctttagtaagaatgaaatttgcaatgttctagatctgatatactgagatttgacacatactttagaatatagcaacaccttattagctgcagtatagcaaataggtactgaaaagaaatatctagacaactccgaaattcctcttgccacattactcttaagggaaggaaaagctgttaggaggtgctgaataataatcacagttgagtcactttctgacactgctgtcttgcatgatttactgaatataatccttcaaatgatctttgctttcttttcaactcccaaaaggagatattaatttttgttgtagttgttttctttaaaaaaatccgaatttaggcaactttattggaactttgggacctgtcaccgtttgtgagtctgtagatacatccagccatgtttttccaccctggatgcaacattcctgagctacagtcagttttctgataccctgccctctccagctgccttctgcctttactcacaaatatgaagtaagaaatcagtgtttttttagtttatttatttatttacatgtagagacgaagtctctctttgttgcccaggctggtcttgagctcctggcctcagaatatcctccctcctcagccttccaaagtgctgggattacaggcctgagccactgcgcccaggcaatagttctgtcttggtagagcccagctcctgtgaaaagcagcagcgactgcgctaaaccggctgttacaaaagacagcctcagtcttaatagaaatacaagctactgcaatactgttatgtgccggggagactgctcatataaactccagcaacatccccgcatgcattagaaaacctggggtgctacaggtctgcaatgctgctgccaattagaacatcgtaacgggaaagaggggtttaaaaaatacgcccaaatagggaagagttaaactgagaagctttctgccaaagacctcctgtgtgtgtacggggagtgggcagcagcacaaagccagcgacccagttgggaaaggaaaggagaatgggggataattttctcactaaccttaagagcagtgggtaggatttaagtggggactatctgtgaaactgcaaagcaagcacataaaatacaatttgctcctatgttggcaaagggagggccttgcaggtgggcacagggataatctgtatcatgccatggaagcccgatggaaacagttttagaaaagcatatgattgccacaaccaatttgaagttgaaagtaaaatatgattagtctgtgtctgggagttcctgtcccagctctaccccgggagctaagcaaagaatacccagttgcttgcatccttaccaaaatcctagagccagccctagggcaggatattggtagaaataggattcaggataaaacttctgctgctctacctggcttggaatttcatttttacattttagtagcagaatccagtgtctctcccttaaataaaatgaaagattatctgcccagacttggtctaccccgatacactgaatacgcagaatgatgtcacctcctcactgtacctcaattttctgttttaaaatggacataataattgggatgttctgatatttgagggagtttatacatgccttcagctcagaagaatgcccagtacattgcaactgatccagctatgtgaaagctgtaactattacctatcccataccctgacctgttgagaaaatggacaatttctttgtgccgctctgatggtggcctttatggtatttaggttgaggaaaggtagtgataaaagtctgcaaagctaagaggcttctcagttattttactgaataaagaggtagtttgttaacagtagaattatagctgggacaatagggaaagagaagaatgattagtgtggctgccagagcaattgggaatttggagagaaactgagtttaaagggaattcttaggaagttctgtgacagcaattgtaactgcaatcgtgaggacaatgttatgtaacaaatacatccaaactcgttttaaaaactagaataggcaattattctcatgctctgggtcctgctgacttaaactgggctcttttgcggagctatgtttcaatctgtgagtccagctgtgcttggctgccctgcatgggttgggccaagatctcatccatttgtcttcattctggggttgatgttgataataaatatctttattttctccagaagctctctccaaggcctttacagacataaaaagaaaaatgcactgaacacacatatttcaagcctgtttgggtcatatctcttaatatctcattgaccaaagcaagtcacatcatcaaaccccacatcagaaagcagagaggcacttctgggtgcagcaggagaagttgcaatgtcacatacaaaagggcacaaaagtgggaaggcgtgctcatcttcaatacagtgtcactctgccctctcctctgtcactgacaattccccagaaaaggcaattattgttcttcagacttttggaatcagattttggtgttggctggttgtttgctcacttaatgtgaatgcttgtgagatcttccccaacttgatagcagggtacgcatgagagtgtaaaaaaaaaattatttatttggatttccccaggatttctctctgatttaatggtattctggagctcagtatttgagaattatctttttttccttggcttctgtctgttttttgaattctattcttataacaaataaaccaaacaaaaacattaaagaaaagttcctcttccattgtttaataatttagactgcacctgtctgcacatcccacagcccaagcttctagagaagcctttatgccatgattccaatgtcttctgttcctgtgttcatctaccaaatctgggagttgtggcacctccagtaatgattattaacaacattgaagccttcattaatacctctgtgactgtatcataattatgcttgttttttaccccttttgttttaatgccccataggacatgcactaggccaggggctacctcaaacccttgccagcagcctctgctgagatgcatgaaggtaaatctgaactatctccaagaaaacagaaaatgataattttatgaactttttatttggcacaaaattttgcattgttcattagtgagaaatgtaacgagttgtcacatattacaattaggattaaaaaaatgaataggcaggtacaataaagtactggttctcacaactccgaatttctcaaaccaactacatttcaccttctacataacagtgatgataacagaaatactaataaaatttggggccagtaatatgcatttcaatactctattttcagaaataaggacaattaatgatgcaaaataaacatcataaaaatctaccacaattttaggttcgcctccttagagagacatgtgtaaacccaaaaactggcaagagataatttcagaatgaaggacaatttaactatatgaaaaaaagacatggctttgtcctgatatttttgcattttgtcactcattgattataacatcatcatagactgaaacctacaaaccaatatcttaaatatctgtacctgtaacccatccatttcaagagctagttgactggcatggaattccaaatgctatggaggtcatattgaaatttcctttggtcacggagagaaaatagctgtttttgacacagaactagagggttccagttgagaaacatctatgcttctcaactattctactatctacaggagtttgcttagcagtcattccccatttagcactcaggccaccacttatctaaatgagttgccatgtggaaaatgtgtatgtatttgcaaacagagcatcccacatgcattattcagaaatcttctggctacaagtgatagaaaatcaactcaaattgccttaaggggaaaagggactttattgactcacataacaaaaaagtcagcaacagcctggcatcaagaacatcaaattcagaagctccaaggatgtcatcgggacccatgcttttgatctcagagctctgttttcatgtgtggtgcctcatttcttagacagtgacgccgcacctgccagaaaattcagttttacatgttttctcccagccactgtaaaagaaagaaactgtccctttcttgcaagatcgtgcaaatgtatgtcctataattggaactcattgaccagaaatggtttggcatgggtctcatggcgtccctgaatttgcagtgggttggccaaatctgctttacctgaggagctgatgctactgtgacctacagcaaaagaagtgggaacatgtgaaggagaggtattttccaagagaaaggtaggatttatctttttttttttttaatcaaaagaatcagtagagaatgctgggatgctgggcaggccaaaacacagattccaccacaccaagaaacctcattccataaaccactcactaaggtttatctacaacaaaagccatcccctcttctgtgctaggaagaagccattaatagtcctcaagtgtttgctcttccagaggactcaataactcagatcccagagggtaagggagctagaggactcaacaatacaaatccaattagcaatttctgtctctggaataaaaatgctctctagtgatgtttttaaaggccttagccttgttaagtgaaactgcctaataataagccttgtagtgtttcaaagaaattattttgcaaagttaatttacaagagataaaaataacatatggtctgtcttccccaatgaaagcattaaatgtactttcttaaaaagtccccagacagagatagtggctgtttctcttcattgatggccattacgttatttatctaagcttaacaagttcttagagaaacactgagcttctcattaaagtcataaactaaattgtggtatatagaagtaacaaatcccaatacagcctataaaaataaaatcattctcagactataaattagaagtcagactcattacttatttttaagaatttactagaattcttaccattattgatcatttttacttttattttttattattgatggcttttacttaaggtttagttagaggactaaaaagtgaagggctattatatgaaataatactacaatattattgataatggtttttatttactattatgaagaagatactatacatgaagtatattttatgagatgtagatggataattaaacatgattaaagtcatatatagcttatattctctgtgagtttccttataagaattcataaaatattattgaaatatatgaactaaggatgcacgacattttaaccttgacatggtttattataaacatgcagttataattgtatttcttgaggaatacatgtatgtgtttgtgctttagttttcacagcttgaaaaatgggagtcaaattatttttatataaaatgctgtttaattcatcaaaagttaattctcatgtgtagtacattcaaattttatttttaagcttaattcaactttaattttttttgttttcccattaaaaagtttataacatttgtgattgtattagatttgtttggaatgtgatggttatattatgtaagttgaacaactttaagtattccaatttcaaaatcatgacaaactattgcctgaggaaacttggaagcttataaagagaaacaagttaggacagtctttttggtttgtttgtgtgttttacagttctcactgtaaaaatcagaagagaaaaagagagaaagactatttctaatagtttttaaaattagtttctagatgttctaagagaaaattaagaaacaaactatgtgattttgggatggccagttttgacacttttgatcttagtaaatagcaggtaaaatgaatatgatatttaaaaccagaaacatagtgtgctttctgaatgaaaacaaaatgagaaacagaatggaaatggactggaaaattgttaagcaactttttttttttttccaagggacttacataactcttaatcttacccatcgcctttacattcagtcaggtcacttcaaaaagtccttacataatgagattttaaatggaactcctgctttcttgggagagaaagactgaagtctaaagctgagaataaaagatatcaaactccttacacttagaaaggctgtcagccactaaggagaggtttgcccaagggtgatccaaaaccagtctgccacacatgagacagtagccactccagattatctgaagaaaaaatattcttgggcatgtcaataggaagaatgccttgaaggcagcagttgttaactttgactagacagtagaatcattcaagatgcccggtccacaccctaaacatgacatcccaattctgggcatggggcacaggcaagcaaggtaggtcaggtaatttctttattgtcagtttttgcacaaaaaggcagaggtaaattttgaataatagttttaggttttatggctggctttggggaaaaagggtgctggtttcttttttgtctgtttttgagacagagtctcactctgtcacccaagctggagtgcagtggcctgatctctacttattgcagcctccacctcctgggttcaagcaattcttgagccttagcctcccaagaagctgggattataggcgtgtgccacaacactgggctaatttttgtatttttagtagatatgggattttaccatgttggccagactgacctcaaactcctgacctcatgtgatctgccggccttggcctcccaaagtgctaggattacagacatgagccaccaagcctggtcaggttctggtttctatgattcatcttagggaagatggattctagtttctatggctcatcttggagaagaatgggacagagagacaggaggacagaagaaggtcaaagaaaaactattggttctgaggtcttcattttaggttagttgtattctgagtccccacatatttaagccattacaataatcatcacaattttttttaattaaatacttttacatttacatttctttcttgtgatcattttgggattttaggaaattttggagaaatgatatacgtgtatcttctgggaaagaaaaagagagttcacataatatgtaaaagtaaacaagtttctgtccgggtgcttaattcacaaattttccttcagtaacttcatatgttttgtgcagaatcaaaatcctactttcattagcatagcttattttataaattaatttatttttaacattaatcacacatatataaaatattatacatatattaatcagaagactagagacattatttcatatgttgtggggttttgttgttgttgttgtgttttgctctgagacagggtcttgctgtcaaccacgctggagtgcagtgaaatgatcacagcttatggcagccctgacctcctgagcacaagcgagcctcccacctcagcctcccaagtagtccctgtagtgggactacaggtatgcaccaccatacccagctaatattttcatttttggagagataggagtctcactgtgtttcccagactggtctcaaactcctgggcccaagtgaccttcctgcctcagtctcccaaaatgctgggtttacaggtgtgacacaccacacccagccctgtttcatactttgaaagtatagattctcagtgtttcatattggtccttttgatgccagaaaggactacaaactctgtcaaacagagtaagtcctcaacatacactaaggcattattgctttcattttcagtctcctaagatggcatagacactatcaatactttataagaaatccacactgaaaggggcttttgacgtgaaaaacctgagacggaatgactgaatccttttgcttttctcttcaatggaatatttgctattcatcttctacatgcaaagcactgtgagaggatattaaatagtttatatccaataagggtgaaagtcaagagagtgacaaaatttaggcaggaataatagatgatttaactgaggagcaggcaacaattttcaggaacacagagaagaactgattgtatcaaacatggtttttacagaaatatatctacaagtcatatgtatcctgtattttatacacatatatacacacatacatacagtgtatatatacatatatacatacccatacaaagagagagagatgggagagagattttattgaattggctcatgtgattatgacactggcaagtctgaaatctatagggtaagccaggaggctgaaaactcaggcaggagttgattctgcagttttcaggccaattttctttcttgtcaggaaacctctatttttgcccttataacttgaactgattggataaagccacccacattattgaagaaaatctcctttacttaaagtcaactgataatggatgttaactatatctgtaaaatatcttcacagtaacacctcaattagtgtttaaataactaggtaacttagcaaagttctgacatgaaattaatcatcacatgaaatgccaagttggatgtgtggttgaaatgagtatttgtttaaaaagtatgatatatttgaactatatgattagttcgacaaagactgacaaatgcagacagaatgtgagagatgaggcaagacagattgtgccttgctgggctaggattagccagtgtagagagaatgaaccaaggcagaaacctagaaacgaaggttaattcagcctgggaaggacctgaaaagttattgtttttcctaaaagcaaccagtagtcctgagagattttcagcaaaaagtaacataattagaatctgtcttctgaaagtataattccgatcttattattttatagcacaggttgaacaacaggctagacattagtaggggctggcatcaaaggttatatttacattaaaattgagaaattatatgtagcagaataacaactaatggttttttagtagtatgtagagaagaaggaaagcatgagaaaacaaacaaaaaaattcaggaagcgaactgcaaggtttgacccattagataagaaggaaggtaaagataaatataagaatttaaaaaggaacacaatgacctaactatggggcaagttaataataggaataagtgtaaggcacttggagatcacattagtacattcatttctgataagattggtactggagagtgtagattatacatgcagatagtaagggttttgagtttgaaatgccagatttagacagcttttccatcagcagtgatagactgggtcacaaaccctgctgttatttctcctccccagaataccaagcctaccaaccagtggaggggcacaccccttacttgggatggggaaaatgagtaatggtgtagggtatggagggaggtcatgctcaagaaaacagcaggaggaagaaagacaagttacgctccatccgctaagccttgggtacaccagtttctgatcatttgtgctgtgtgtgtgtgtgtgtgtgtgtgtgtgtgtgtgtgtgttcatgtattaaaagaagtgaacaatataagggttaggaaaggaaaaaaaataaaagacctagagggaggggtagaaaacaaggccttcatacttttaattagcaaaaatatataaacaacaaagtatgtgtcatactgcttcataataaaaaagcaatgtgccaatggatctgattcatgtttccatattttcttatttctccacctattcagtacatatttttgaacatctataagtaccaggcttgagtgatactgggccctaagacaattataataataatgcctacaacaacacaccaataataataattacagctatgtaagtattctatcttcaaggaatttagatagacaagccatatagccacatacataaaactatctttgtctcccataaacttggcaattagtgttatagtatctggtaattaggaacttaaggtaagtttcatgtttattgaatgagttggactcagaaaggtcaaaattatgggaaacttttacttgtttctactccagggtcttcaaataagctccagtgaaacatttttcttgtctttgcattaatatttcagcagatcaaatgaatcttatttgtggaattccaaagtttcccattgtcaaaacttcattttcattttttccatttttttttttcttggcagattaggcctattggaagccagctttgggaaaggaggaagaacacgatttacttctgcagtcttcctcactccaccaaacaccctttctcctcccctagtaagtgacatctgcttccagtccctccaaacttgggcctggagtggcctggagtggctggtggattgaagaaaaaaggccaagtttgacgggagcatataatcgtaattttaattgatgctgtccgatgcaactaacacagagtccaaggaatgcgtctctcagcaggctcctaggagataccccactaggcattttgtctcattctctgggccaggcaaggcttcattttgttagcatttgctttaatgagtttcactcacgtaggctctctatctgtggacattcttagtaaataaaatctcttgaaaacagctgatggacagctccattttagaagactagcacctggctcttaggcagtggcagtgcctttatcttgcagttagtggtcatagagctgccttctgctacacctttccctcctctccctctctaggcccccttttctggtcctctcacctttaacatttttcaggtgtggtttaagtactgaactctctgaacttcaagctcctcaatataccagtcatctttcctaagcttcccaaagcctttcatttggcttgagggacatggggagacaaagacaagagctggcacgtggcaccaatgggctctgacctggccgcatatgggaatcccctgggagcctcaaaaactcccaatgtctgtgccccatgcccagaactgggatgtcatgtttagggtgtggacggggcatcttgaatgattctactgtctagtcaaagttactacagttttatttgcaagctactgcagctctgaagtcattatataaaaattaccagttaaaattaactaatcttcctttgacaatttcaagatgtttctgttacattcttagctcctcagggagttttcattcatgtttacctttatgcctgtaaagtgcaattactttcagcactagacatggagagaaaatcatcgagtctagtgtatctttattttctatgtgatgaaactaacaagtgttctctgtaagaaaaaattagttttgagaataggtaaaatagagtgctgaacgtcctttcaatgaaacgctgaagcaccctatgggatgtggaactgtctggttaggctatttaaaaaaactgtaaaaatacaaataaatttacagaaaatagatagtaatgcaaatatttcttgtccatagaaatgcaaattatttatggttggtagaatactcttgattatttccctgtggaaagacttgattttcaaattcatttgaacactgctttactgcatataaatgtatgcatctttgctttctcttttatatcagttgtaacatcttactggttccctcttctatattaagataaatcaaatctttaacacataaactttttagcttcacattaaagtcacaatgttacctttttgttaaaactgccccttttatatctttaagatacatttttctatatagtatgaaagtaagtatgtattgctaataatatatatatgctgatacactgctatttttaaaagatttttcacatgtttcactgttccttaaaaatgcttataaaattagtattttatagtgttactttattattaatcacagcacactgaaaatccagtttattttatccagtttccaatatgcatttaagtgtgtgttgtaattaaaataatttcaatttctcagtaagataattcctattcagatgttacaattaggttcttctattccaaagcatatttttgtctaaaaatcctttttttttcagcaaagcatttgtattggtccattctcatgctgctaataaagacatacccgaggctgggtaatttataaaggaaaaaggtttaattgactcacagttcagcacagttggggagtcctcaggaaatttacaatcatggcagaaggcgaaggggaagcaaggcaccttcttcacaaggtgccaggaaggagaagtgcaagcagaggaaatggccgaggactacaaaaccatcagctctctgagactcactcattatcacaagaacagcatggggtaaacttcccccatgattcaattacctccacttggtcccactcttgacacatggtgattatggagattataattcaagttgagttttgggcaggaacacagaatgatatcatttgaaaacatttttggtataaattataccatcatattgtcatatatctaaattcagatgggaaatgcataattactcaaattaaaattgtataaatttaattcttgttatttccttattatcaatatctctaatgtatattctatatacttttcagttttacaaagtcatattgacagagacacatctaaattagatgcttgaaaagtaaaattttcaacttgttgcctacaagtaatgcaaatttcacttgattgctccttttaaatgtcaaatttgactaaaataccattaaaccaatatgataactgatataaatacagatggactgataataactgcaatgtctcaaagtatttacaaattttaaaaaatgctgttgtctagtcaaagctcatttaatttcaaatgtagggatgattttattttaagtggctttcatttacaaaataacaatgttttacacaactgagccattttcctcattcagttctctcttgttattgcttatgcagaaatatttgatcaaatttacttattttattgtattataaaatattatgtaccaaaactcaaagattcaaatagataatttagttgtaaccctatttttttttcctttactctttaggaaatttaaacatgtttttatcggacacaaaacccaacatgttaacgtttcaattccacttatgaaatgccattatttcataagctgcctattcaccctccacttctttcatgcaaattcttcttcctttctctcaaaaacgttatttcctttgcacagtctgtcattttcgcaggccaacccctagccacgtgcagtatttattctgaccattagatgtcaccaatctctttgtaagagcagctgtagatagacttgattcccggagaaacggactgataaatacataatttattaaatctaaaagtcaacaatatctgtgaagaatcatttagatgcattaaaaaattaattaatattgtagttactatttaaagatcatgataagcctgccgcatgaggattcagcattgacagaccttctcattgtcagagtttgacagagttctaatgtcagtgatgctaaatgacctcccttcaaatatttaagaaaagaaaaaatttctatagctaccactctcttgatgtttccagtgataatattaagaaaaatatcttcatgcctattttgtaagaaataaatgagaaaataatgaatataaattactcattttactttgtttcttatttcatttttagtaatattaggacatatattattttaaacctataattatggatagagataaaagacattcattcattcacccattcagtctctaatttattcgttgctacaacaaatatttatagagaccaacaatgcccaggtactgtttcagaaaattgggatacatccatgaataaagcaaagcagacagataccccaaccttgatgagacatcatgtgagcagacatgtaatgtaaaacactttaccaattacaataaatggaaggacttggacagaaaaaagtggcttgcctataaagtcagatatcttggctctatcagaagcctcagatgaatgtaagttactttgaatgactctggaacatcattctcagcaaactaacacaagaatagaaaaccaaacaatgcatgctctcactgataagtgggagttgaacaatgagaatccatggacaaagggagagggaacatcacacaccggggcctgtcagggtgtgggggccaggggagggaaagcattaggataaatacctaatgtatatgatgggttgatgggtgcagcaaaccaccatggcacatgtatacctatgtaacctgcacattctgcacatgtaccccagaacttaaagtatgataataataataataataatcttcaaagccaatatagccattttgtgacttggcttaagaaactattcagagaaacaacgtaacatcttaggatgctgttgtcacaaaattgaggttgttcactgcattcactcccacaattttatttcatttttctgaaccttcaacaacccaaaaacatttaggaaagtaactgagtgaaacaggaatagtagtgaggcaaagaaagaagaatcatgaatgtttagatagtcaaatctgcttcagtaaaagaaaacctcctctgcagcagatgcttggaaaccacagattttttcttaattctacatctgctgctcacattttaggaagcagttacatacagaaaaaccttttcctctaaagcattaaaattgtcatctctcttctgtctctgtccttgagggacataagattgatcaatgcatttgttgaggactttgttcttaggaaatgtgaggataaataaaagaaataaaaaagacacaagtcatgatgttgccccacatattagaagcacagaattatatggctatgagtggcatgatcctaaatttttttaagccttaaaatcataaatgaggtcaatgtatttatgcttagccttatctatatacttgtcatagtgtcaagatatgtttagcaaggatggtcctgcatcttctccatctggtcctgaaactaatctgtttagcttattcctacaaggaagtagatttgttctttttttgaatttgacttagttccttttaaaacaatttttttctgtcttcctttatttgctactgatggttgctctattctttctaacccaaactatatagggcttgagtcaaatgttagagaccattaccatcccatctgtataactcctttttgaattcatgaaagcaacttctgtgagtcacagcaacgtttactggagtcagtccaatgatcagatgaaaaagaaagacaatcctttctgttctcatgcctttttctctcttagatatgatggggaagaatctgacactacaaatttccttccatgcagtatgaactgaagttctgtctatttgtgcattctactgacttgaaaatgaacaaagtctatctcagaaaccttggggccatcaggagagacatggaagactgttcaaaacgtttttctgtgttaaactgctggccttcccctcctttgtcatcggctaattttaacatgtccatttctttgcattgcctcaaactggctaactcactgtcaaagcttcaaattgtttcttaacataaaaatccacacatcttttcatacaatgaatacctgcttgactggttatagtaacttcttttaccatgggggtgtccaacattgacagctttgtcaaataaggtagaaacgtctctgtgatttccactccctgagtaaccactgatttactacatttggtgtcatttgcccatagttctgaaatagcttacacaaatactagtgtaaatataatcctcaaactgaaaactctttagaagaatgtatttgtttatttctctctttatacacaggaacatatttataaaagattatcatagaatttcagagtacaggatcatataaaaaagcatctaagaaccagtgaataagtgtttgctacaagaggactgttaggaaaaaatgagaaatctcatttagaataaattcagatgagccttgcttcttaatggctaaaattatttcctttacaaaaacgctgaattatgggtcatcaaacctacatctgcttaccaaaaaagattattgaacatgcaataaatatgctggcctctgaactttctcataatatgtagtcaagaattcttgattatacacaaggtcaattctctcttgcaagaaagtgctcaggtaaaggtagatgatacgaacataattcaaattgaataatatcatctacaaggctcatacagacatacatatgtagacagaaatatggtttactagaaaaaataaatctttctttgcatgcagaacagttacctgcaattcaccctattcccttatttttcttttttaaagatccacttatgggcttcccgagagactaagatatagaaaagattgcttggatttctctatcaggataatattacctttctctctgccaatacaaggttgataattatctctccaatatcttgtctacatcatactcctctttttaagttgaatcaggctagtaataaatacaagaataaaaagaaagatgtgtgtatgtgtatctatatctatatctatatctatatctatatctatatctatatatggagagaaggagagaggagcacgcacccacgtacacactctccaataggtcaatttaaacacatatttaagcaaagactgtgttttataatttcaacattgccactttaatatttttcttgttgttttaatgcaataaagttttaacttcctatctatactataatggtggtgaataataatacagctaagttacgttatgtgaattaagaaattttgagattagaaaggacattccaagtaatcaaattcaaatttctattcaatgcaaaaatcttttaaaaaagattttgagaagcaatctccaacatttgtataaacacatgaacaagttaccctgtctctcgtgtgtgggtgtgtgtgtatacaattacaaatatataattaacttttattgaacccttgtaaatgttagtttttaattacactgacctgagatctttcccatatttacaactccatccctaccacatctcagctagttttctctatgttttcctagtataccttgctttgtttctcaaagcaaaactaaatagtataatgttccttccaacccttcaaatacctcagggtatctgttatgtttctttatgctccccatgtcttctatgagctggattgtttctgattcccgcagtgattccagagaaaatacagcagtctttctagcatatccatgcctataaatcttcaattaaaacttgataattctattatttttaataagttttgggtgtgcttcaaagagggataggtaactcatatggatcttggtataatttttaaccattacaatgtttttgttttctatgaaagcatttctcacagtcttgggttggactttagatccgttttttaaaatcgccattgacaggaataaatcaaaatttctcttttgcaaattgaagacatagggtaaattattggaacatgcagatatactactagcacttatgttatattggatgcatactgtcttcatagtggagaaaattaagagctgtggattgtcagagaagaattactaaactgtctccttcctctaggtactaatttagtttttccacttgaagtcatcagtgctcaaactgtaacaacaccactaatgcaattgctgactcaaacttggaaatagaaaaactaaaagtagttataattatagcaaccatgcacttttttccctgttgaattgtgagagaaacagcaaggtagtaagaatgaataaaggtgaagatgatgtgtttaaattactagctgtggccgggcacggtggttcacgcctgtaatcccagcactttcgaaggccgaggccgaggtcaggagtttgagaccagcttggccaacacggcaaaaccctgtctctactaaaaatacaaaaattagctgggagtggtggcgggaacctgtaatcccagctacttgggaggctgaggcaggagaatcgcctccactcaggaggcggaggttgcagtgaactgagattgtgccattgtactccagcctgggcaacaagagccaaactgcatctcaataaataaatacatgaatacataaataaataaataaataaataaattactagctttgcacttatcttcagtcctgtctaagttctagtaagtctcaaaacttacactggtgaaatgatgttgacttgtcccactgttgttgttaaggttatttcagaaatctgaaagacagcttattttaatgtcttactactgttggacaatgtaagaatctactgactttctcttttgtggcttacggttgaggtgatgtgaaaattttgcttagaacacttactatctacaattattcaaatgtggccactttttatgtagaatttactgaggctatcctcagaattttccattgatactagaaataactatattatttgagatactctattagaccaatgatatggtcatctgtatccaacatatagcatatgccagtatatatcttcctggagaatgcaacatatttaatttgatccagaattcagatatcatttttttctgcatttcaaaactgaaaacaaagcacaaacaacaaaacaaagaggaaaagttaaaacaaaaagaaaaaaattcccagctacagcgttactacagcagcaaagatgggaagatcaaattctgaatattcctgaggctagatccacattgctttattctatgtggaatcttcctacaaatcacaatccatttttacaggcttttcccttgtgaaaagaagacagtttgaaaaacatcatgaatatatgcaacagtggctctaaaggaaactgcttttcaagtcctccctcaaacactgcatttctgaaatatttgactaagtggacccttcatcatttaagtcaatgaatagaaaatgagataaacctctaattataactgacacaaacatatccacgtgatgtgacttgtgtctatcctattgactcttgtattcaggctctgaataccttttcatcaaaatccctagaatgtttctttgataatgtgttacctatgtttgaaattaaaagatgttacattttcatagaagccactattaaaatatattatgttaatggaagtaacactatcagttataagaagtattttcacttatttattcattgtaactaatttggttatttttcattttgctctttctgtgcatatatttacagtctttaggctcaagtttagacataagaactgtatccataatttatgttagatatatgcaataattgatgcattttatattacgggacattgttccttaatagaatgtttaattaataagagtgagtatatgcacataccatgcctcataacagtgggcaaaacaagctaggagctgggcacaggacaattgaaagcatgctgttatatcctactgactttctatttaattttcttggatatgaattatgactccaataacatgcttttgataaaaaaaaaagaaatgatttctggcatcttgtgggggaggatctgaagaagttttaaattatattttgtcatgaaaatacacatcttgtcatctttctttagatgttagaatctttcatctcacttgaaagttcagattgatctgtaaccttttttgaaaaaaaaaatcacgtcagacactttgatgtgttgtgcatatttttgctcaggaagctataggttttcgggcagaccataactgagaaatgcagttgaattttataaactatccactgaccttgggatagtgttgcagtgccctgggaatcagactgtcctagtttgggctgccctgagcaattcaatgacataattattgacttggcttaaattctgcagatgaggtttacacaaacaagatgaccttccccatttcctagacattggtggacattttctggaggtaacttgacttggctagaaccagtgaatatcttaatttagttcctgtctctctttgtctttcctctatatatctatctatctctacctctctcttggttttacttatataaaaatatctttagggcaacaccaccagtttcactggtacctatgaatgtgccagccttatggcttgagaaagagtggaataaactcttgagaacaggactataaacataaagcactttattaattccccaaattaagtaccctccataaaagcaagatttaatatctcttgttctatggaggaggaaggaggaaagaaaaagacttgctcgaatgatgtctttgaagaagaaaaaatagagattaatatatgagtgaaggggttgactttcagctgtaggagcgggagtgaaggccgagtgcatgcaggtagaactgtgtacaacaatagaggtgatggtagaatgttctctcctggttgctgttgttttcactataaaaaatgaagtaggatattagttgagagaaaacatggaggaggagttggtgaaggtttgaggaaacagcatatgagaaaaggaacgtttttaagattttctaggccagcagttgactaaatgaatgagggaaatttcttgggataaccaagcagcatatgggaccacttggagtttgtggtcatagcaaacaagtcagcatggctgtgtatttccgtcagccacagtacactgtcgtaatggcagatgtggagtaagtagagaggcagagttagccagggctggtgtattatcaagtaattaaggagcaaaattttaaattatatgcaagagagtgaaataacaattaaccatgacatttaagatgggtaaggaggaatagaagatgggtaagatggaagagattaaaagtgaaaaatattataataaatcaggccgggcacggtggctcacgcctgtaatcctaacactttgggaggcccaggtcggcagatcgcttgagcttgagtttgagaacagcctgggcaacatggtaaaaccctgtctctactaaaaataaaaaaaaaaattagctgagtatgatgatggcgtgtgactgtagtcccagctactcaggaagctgaggcacaagaatcacttgaacccgggaggcggaagttgcagtgacccaagattgtgccactgcactccagcctgggtgacagaggaagactctgctcaaaaaaacaagaaagaaagaaaagtattataataaattcataatagtgtttagtgtgtgggggaaggagtaaattattaaattattagaatctgattactagagggaaagaactggaaagactgtggtcagggattcagatgcttgcaattgagatttcagagtctggttattggtagtaagaatgatggtgaaaacaggcctggtgcggtggctcacgtctgtaatcccagcactttgggaggccgaggcaagcggatcgtgaggtcaggtgatcgagaccatcctggctaacacggtgaaaccccgtctctactaaaaatacaaaaaaaaattagctgggcttggtagctggcgcctgcagtcccagctactcaggaggctgaggcaggagaatggcgtgaacccgggaggcggagcttgcaatgagcccagatctcgccactgtgctccagcctgggagacagagcgagactcttcctaaaaaaaaaataaaagaatgatggtgaaaacatttgactatggtaataagaacaatgatgaaaacatttgactatgactatgatcatctgccatctttatagatattgaaaccaccaagaatcacaacataggttgttctggagagagacctagagcgggcttcaaggtaaagtttccagtattttgaaaggctttagtgaggacaaaagaaaaatgatccagaatagacaataaggaaaatgaaacacactcattctcaccttcagtgttcctagcatggagttagtgggagaaaaaatagccactttacatttggaggaaagcaatgttgtcatgcaagactccagtgctggttagagcaagaagatgaatgagagagcagacattgagaacattcaacattcaagattttgcttatgatgtattgcatgttccaaagcacactctagacaatgtcaggagttggaaaaggatgagcgatggaaacagaaaatatgcagtgatgtatgaggattagagtttatcagccatttgtgtcactgtttttttaagtatgctcgtgtcttctaaaaattctatcaagagtttttttttaattttgtattttttgtatactagttattaattgagctttgcatatttactcttggcatacattatttccttgccaatgaactgagtaatgctatcagatattttacctttttaatgtaattttacaagtcttttggctaatccccaaaatggaaaaatctacattccactttgtgtttttggtgatttgtaacatttgtagtataaattactctttcaatttaacattctttccttgaaagaagagcacatattcttgggtctttgatcattcttgattttccttcttcattctttgctcttccataaatgaccatcatacaagaccacccagaattcacccttcctgcacagatttttggcatggaagagagaaaaaggagatttatggtaatgagaatactattaggaaatcaaggggaagtgggaggccaaatatatattcaaaattgggctgtaggaatgtactctatatcagcggtccccaacctttttggcaccagggaccagtttcatggaagacaattcttccatggatggtgggtggagggggatggttccaggaagattcaagcacattacatttactgtgctctttatttctattattattacattttaatatataatgaaataattatacaactcactgtatagaatcagtggaatcctagagcttgttttcctgcaactagatggtcccttctggggtgatgggagacagtgacagatcatcaggcattagattttcataaggagtgtacagcctagatccctggcatgctcagtccacaatagggttcatgcttctatgagaatctaatgctaccactgatctgacaggaggcagagctcaggtggtaatgcaagttaccagggtcttgctctgtcaccctggttggaatcagtggtatgatctccgctcactgcagcctcaacctccccaacctcaggtgatcctctcacctcagcctcccgagtagctgggactacaggtgtgtgccaccacacctggctactttttgtatttttttgtagaggcggggttcaccatgttgcccaggctggtcttgaactcctggactcaagtgattctcctgcctcagcccatccaaagtgctgggattacaggcatgagccacagtgtccagcaataagatattttgaaagacaagaaaactgaacaatttcctacagatatatgtcctcctgggcaaagatgacagataatactgctctcatatatcctagataatcccacagcccaaaatgccctctggaaattctaccatggttcactcattttgagtatcagatggttttctgaagggcagcacaactccatttactgttattttggtgttagttactatgtaatcagaaattttgctttaccagttagttagtaacatagtaaatatggataatcttgatttggtagagacagtgtctcaaatcacagatttaatgagtgaaggatggacaaagagggctggcttcagtgagctgtgaaagtgattagtgcttatgtttggagcaagaaagagggtcttgaaaaagattgattggtaattctgagaggaaatgatgttgccatgtttaactgcttgacacatgccagattgcagcaccactgtttgctagtcatgattgtggaggaaacttttcttattattattaaatcaaagtttaaaatatagagagtgattttacattatgtggaagtttttacacaaagtgtaatcttagtaatacaatatccatatttgccagggacaatcttgatttacagtcatttcccatcatgccttttggttaattcttgtcctaggtcacattatcctagcttgcaagatacataatagggttgtcctgattataacctgtttcttgaaaatttagcgcactgtctgactctttgtagacactcaacaaatgttggtgatttttattagaatattaactcccatccctactatattccttcttgcatgatgctggaacattttattacttctccaagcctcagtttattcatctgtagaataagaatgtagcacagtataagtacataaaaaagttgtaacatacaattgttgaggttaatgaaataattcatagatcaacaacttcgtataataagaacatataaagttattgataattgatgtgtaagtagttaacattaccatcatttttattacaaaaatacctcaaatgagctgtatttagtattctagacccaaattagtggattattgaatcacatcccataacctaaaagggattttggaaggatttaggaagatcatggggagctggggaaaacaggtatgtgccaaaatgtctcgagctttatgtgtataaagtgctctcagtgttaatgttaatacataggcagattgttttatgacataacttttagctggatcattcacaagtccaagtggtccattaaattcacagagcctctatctttattgctagaacaggatatcttattagtattccagagcatatgatacaacaacttacaggattcaaatgcctgtgaaatttgagaacactgaaagttgtgatagaggaaaaaaaagctaagaagagaatagaaaaaaaaatagaacatttcctcacactggttcccagctgggattacagctgcttgattcataccatctgggggtgtctaattagaaactacctataataggcttttaaagaagtaatttgagaataaacttaacatcagctgcagttcagatcccagagggcctggagttaaggtagcatgaactaatggatcaatgaacaaaagaaatattcactaatagcggtgcttgaacaaagttactcctgaaaaaagcaaaatgtcacatgttttttcaatgcataataaatctgcccaagaataactgactttcaggttaacacataaaaatgagaagctatgcatattatagtgagcacagtctgactcccacattatggtttaagttgttttccaatcttaaatccaatttttaaaatatcataatgcactaattccaaaatagactgcactttagtctaccaatttggccaattatggttggattttccttcctaaaccttttcttgattttgtgtactaagactggccttaagaagagacaaattgattgctcttttcctgtttaacctcattagtaaagatttcattgaccaacaagattgattcagacataaaggtgtcatggagatttttagaaataaaaatcatgctgttgatagcataagtggtcaagacttgaaaggtggaccctgggggtgatgacaaacacaggttttttaatctttcaattttataatcacggcattttaacaacttttactgatgtctgttatctgtcaccaatgttaagttttacaaaacaacattaggatactctacacaaatgaaacaaacatgaattgttttacttttaatcataagatagtgattttattttaaagtgttggaattaactctacctcatatgctggtcaaatataatatgcaccagtaaaactatttagcaaatgggaacacgctatggcctaataaaagagactacagtcatactttttaaaaaattaattagtagcaaacttcaatgtttcattgattctattttgtcctctaaaaatgaaataagaattaattttctggatattggaacatcctttgatgtgcagttaaaaacacaaacataaatcattgtgattaaaataaaagtcattcaataaaaaattaatcactacattcttttggataaaaaatactcagctctctgcagaggaactctgacacagcaaagtttgaaacatccagaattttgtggtttctattaatttgttttcactgtcttgtctgttatcaaattataattgcacatcattcaaaaaataaaaataaaaataaaagagactagcaaggccgggtgcgctggcgcacgcctgtaatcccagtactttcggaggccaaggcaggtggaccatgaggttaagagatcgagaccatcctggccaacatgacaaaaccccatctgtactaaaaatacaaaaattagctgggtgtcatggcacatgcatgtagtcccatcctggtgacagagcaagactccatctcaaaaaaaaaagatagtagcaaatgttgcaatactagataaaatcatgtacaatttttaaaacatgtacattgccatcatgtcatagtttttgctgtttcttttctaattccaaagtaaaatatccacgtacaaaactctcactttctttatcattgtatctagtatctcaggaattgacagagctattttcaattgtagagaaaaatatgaaattgtatatccaacattagcaagctatcatcgatattcattaagtacattatctcatacataacaagtggaaaatgttctcttgacacacacgagagtttaatatttagatcacaatcactaagaatatttaaatctgaagcagataaagtttcatggttttaattcccaatttataattatttaatttaatgtcattatatttgtgctattattaattttattatgttgaacatcagttatctcttttttatacgttgaaattaaatatgagactaataggctgtatatcctaatgagacttgggtataactaaagtgaaaatgccattgggcctcaaatacagtgttctaagagggaacagggcagagcatccatgatattttttagtattccaaaatgcacctccagtaaatcaggtttataataaaacagcacttctaaataattaaggaaatattaacttgggcatatcaagattcattgcaaagtgggaggaaggtttatttaaaaacaacttttgatggaatatcatccatatattctacagcatataatactcctggggggatcctcttttgactcaagatttatattaacaaaacaagtagcagattagcacaggtggaaagagaaaatttgtcaactgagaaatgggaggttgctctagatgtaaattaagtggtagaaagtactgacataagaatgggagatggtaatggatctgaacatagatatctaggggagaaatttatatatggcaactgtggaaaagaggaggtggaggagaagcggtaaggcagggagaattcattacacatttgttcactgaactcaaacgtggcagtgtactcccctgtgaaacttttgtaatcagatagaagataaaactaacagaaagcacgaagcagtcactaaatctttttactatctatggattctggccacagccataagatttatttgacaaaaggattgcttgaaaacagcaaattgtgtcattgggtatttttctttggagaacatgacacttcaactttctcaaattcaatttttacagacttacagctccatattgagttacacacacccacacacacacactcacacacacacacacatttaagtggtttgggtctgtgtccccgcccaaatctgatgtggaattgtgatccccagtgttggaggtatggcctggtgagacgtgattggatcataggggcagagttttcatgaatagttcagcaccatccccctttggtaatgtatcctgagtgagttctcacaagatctagttgtttaaaagtgtgtggcaatttattatgcatgagcatatgtatgttatttcacccaatgtaatatgtgataatatgtatcaactgagcactgctcaactaaattatggtatagccatctgatggactactcagatttccaaaagaaaggtaaagtaagtattgatatggaaaactctccaatatacaatatcaatgcataaatggggatattaattaataaattcttctgttaaaaatatgaaaaagtcatatgcacttccatacatatatatgcacacaaagttatacaatgtgtggatttatgtatgtgcgtgtatgcatgtgttggtgtctgtgagtttatgtataccataaggaagcactagaaactctctttgatggtttctggtggggagaaaggctagagccttgccctcgttttcttctcccttttcctctttctccccctttccctccacattcttccttttctcctttttttttgacacggagtatccctctgtcacccaggctggagtgcagtggcgcgatcttggctcattgcaagctccgcctccctagttcatgccattctcctgcctcagcctcccgagtaactgcgactacaggcgcccgccatcacgcccggctaattttttgtttttttcgtagagacggggtttcatcgtgttagccaggatggtctggatctcctgacttcgtgatccgcccacctcggcctcccaaagtggtgggattacaggcgtgagccaacgtgcccggccccttttctcctttcaattctttctctcctctccttcttttgctgcttctccttctcctcctcttctacctactccaatcatatttggatggcttttcatatattgtgctaagtttcaaaatttacagtgcttctcagtgatgagatcatgggctaattttatatatgctttcattttctctaattttctatattaaaaatataatactagttattaaaaatatttattcagtttagacatggctatgcagacattgctaaactttcacaacattaagctctacatacctcaaagcatagccaaggaagaaatgattcttgtctaaactaatgcacttctagtaaactaagatgtaacatttccctcttttttatttttattttttgtgggtaggtagtaggtgtatatatttatggagtacatgagatgctttgatacatgcataataatcacatcagggtaaattgaatatccatcacttcacacagttatcctttgtgttacaaacaatctgattatactcttctagttattttaaaatgtacaattaaattatttttgactatagtcaccctgttgtgctagcaaatgctaggtcttattcattctttctaactatgtttttatacctattagtctgccccgctttcctcccaaaccctcactacccttctcagcctgttaacctttatactgtttatctccatgagttcaactgttttaagccttagctcccacaaataagtgagagcatccgaagtttgtctttctgtgcctggcttgtttcacttaacataatgacctccagttctatccacattgtagcaaatgacaggaactcatttttttttatggctgaatggtattccattttgtatatgtactatattttctttattcattcatctcttgatggatgcttaggttgattccaaattttggctattgtgagtagtgctgcaataaacatggagtgcagatatctctctgatatactatgtcctttcttttggttatatacccaggagtgggattgctggatcatatgatagctcaatttttgctttttgagaaacctccagactgttctccttaagggtcatactaatgtacattcccactgacagtgtacaagggttcctttttctgtatctccgcgccaacatttgttattgcctgaatttgggataaaagccattttaactggggcctcttaactttttccccacacatttcttaattccttgatgaaaaatgctaaaagataagtcactttcatactttctagatatagttattcattcactcttttatttttttaagtttcttatttaatagatatgtattaaatatttaccttgtctcagccaatgtaatgtgtgacaggcatacaaagatgaatatagcagaaagtttatgcctcttaagaagcataatgaagtcatttaaacaaataatagctacaaattttgataagcactgtcatagaggtaagaatattatggtggggtgggacggaagaaattaaaatatgtcaatctactttgcgttgtaaggaaaatcttggcaaagaagatacatgttatgatttggctctgtgaccccacccaaatctcaactcgaattgtaatccccatgtgtcatggggagggacctggtgggaggtgattagctcaaaggggtggttttctatgctgttcttgtgatagtgagggggttctcaggagatctgatggttttataagtggcagtttcccctgcatgctctctctcttacctgccacagtgtaagacttgccttgctttcccttcaccttccaccatgattataagtttacttataagttcagccatgtggaactgtgagtcaagtaagcctcttttgtttataaattatccattctcaggtagtatctttatagcagtgtgaaatggactaataagataaacttcaatagaatacttaagaaattgtggtaatcaactagtttatgaatggaaagaatcattttatcaaaggaaattaaaagcataacaatgtggcattaaaacagattaggcagttctgagggttgtaaggatgatggaacaggtacataataggacaatatgggagaataattaaagaagtcctgagggtaggtgactgaggccttatatgttataaaagggggattttactctaggaattgggaaagtgttttaagaaagagaatagtgtgattatatttgctttttagtttgaaaagaagtagcctggaaatgaatgagattacagccagagaagagagagaatatattttgatgaaagaatatatttggatactgatacaatagtccaggttaaagatgatttggaccctggcacatggaggatgctgtagggtcataaaggaagaaatggtaataaaaataactaaagttcaattggatgaagttttcaagccaacaaagcataaaacacagacacaaaaatgatgtctaaaatgatttcttagtttcttaatcatgtattaggtgtcaaccaagatagggaatacagacagagcagtaaagagttcagccccagactcaatcctatatgtgatttttgggcccatccataaacttgaccaagtgggtcccacagggagagctgccctccctacactagtgcatagtcctctaatggcagtttcagtaagggctgcagggccatgctcacacacagatcagcatcacttgactggtgcctcccctggaggcctctccactgtgggaccttggcagaccttccccaagcatgtttgcccaagacctccttttcatggggagaggaggaggagtcttgaagacaattgtcttccttctgattcaatactcagtgcttttccactaccagccttttcctgaccttccataaaactgcaggagcctgttgttcagggttcctttgatagacaaccccacatctgtgccgacccatgtgatccttgatagagctgtttcatggaggaaaaaaaggatgggaactggaccgtcagggctttttccagtttaacctcaaaggtttgttaatgtccttttgtcttgatgtcttaattgcctactccaacacctggctctctctccagagtagttaagctcctgatggctggggataaatttaatgactactgttttgtataagttgaggttaatctaattaatttacctagagggaaaattctgacctctatctgtcagacctcatttaaaacacagaggtcatgaagataaatctggcttctgccttcaaggagcttacagtctggtgaagatgatagctggatagctagacataacaataaaaccacagctgttcccttgtgataatttctgttatgagttatgtacagtggaatatgaaaaatatataaatggtacataaccaattctaggaggtcagggcaagcttcctgggagaaatgctgtctataggtagacacagagagacaagaatcaaagcctcttctgaagaagggttaaataaatctcaggcagataggctatgcatgacctgcttcttttatctgtcatttttgttgttgagttacttgctaaattttaagaattttatatatataatatatttataatattttatatatataatatacatatatatatatatatatatatatatcttctacatatcagtgctctgtcaattcagcctaattctggcaaaagcattaaggacttcaatttttaccaggtttgaaaggggagcagtcctttgaattagaattatttgaaaaacgtagggctattctgaaacaacaacccaattgaaaatgcatggacactataactattatacttccagatgcatacaaaaatacttttattgtcacatgggcacaaagatgtatattgaaagctgttcactgaaacagtatttataataatgaaacctggaagcaacatatctcttaatggggatatagacaagtaaagtacaacatacacatgttatagaaaaaaatgcagccttctaaaaaatgggtaagctgtatagatatagaaaagaaaaaagcattgtacaaataatatgtatactttaataaaagttgtactaaattttaaatgtaatataaatatcataccttctatatatatatataaaattatcaaaaaaagactgaattataatacatgaagagtaggaaaaaatagttgcactgagttttatattttctgaatgtttaaatctttccacacaatatgtaataattagacttttaaaatgccagtaaggtaatatatacaaatagctaattaaagcttaataagaactttggaaaaatatttttaataaaggttttacatacatcagggttacaattaaatttaacatgctttttattttgtcaatttcttttatttaaaaaatacttaaactaacttcctttttgctttttcctattaaaagaaaaagcattttgccctcacaaaagaaaattagtttcagattactagtaattatttaggtactaattaaaaaaatgaatctcagttactaaatacacaaataagggagttatatgaaactgtgcagtagtcattatatggatagtcatatttaaaataaaatgaaaagagactaaaatatgcatttgtgcttttaactctgaaaacctgaataggtattcaactgttgattctgagtatttacagaactttattccttctttggacatgctttggcagtttttacctaatgtatacacatttttgccttgttcttaataattaaaaatatgagaaaaagatattcaaaaagtggttttttgtgcgtactgatgataaacactaatataaaaagttacagaggtcgggcacagtggctcacacctgtaatcccagcactttgggaggccacagtgagtggaccacttgaagtcaggagttttagaccaggctggccaacatggtgaaactccatctctacttaaaaaaataaataaataaataaacaggcatagtggctcacgtctgtaatcccagctactggggaggctgaggtgggaaaatcacttgagcccaggaggcggaagctgcactgagccaagatcacgccattgccctccatcctgggtgacaaagcgagactccatctcaaaaaaaaagaaaagttatagaaataaatatgatgatatgatttactgaaagcaagtctcaaatgcctaaaaaaggccaaacttcctttggtctttggatatcattctggagggtgggtgagtctacttttgtttaaaacgtgttattttcatttatttttgagcaaaaatatcattttataatttacacttattgaacataattgtggaaatactactaaattgtctccacatggaaaatttcttgtgacatgtatttcttctaacttgtgaagttcacagctatttcaaaaaacagttaagcttgttccaaaaactcactgccatcccaccaaacacacatatggacttgagaataattaggctttcagaaaccattttagtatccaattaattgtagttttcttcagaaagtggtgtaaatctgattatatatagttgcttcatgtagtataaatctgattatacacaattgtttcatatagtatatatctgatgatatacaattgcttcatgtagttaaacttgttactagataatccacgtgtaattgtcacagaaagtcttacgtgtacatttggacaatgtctctatctctgtttctttctctctgtttctctctctctctctctcacacacacacacacagtcctttacaattactttggaaaaaaatcacaaaaaggaaaaaatcattaatctgagattataacataaaacccacaatttgtcggtaaaccatctttaaatctatgtttatacttgaaatctactaggcttatgagagtcaaagacttccaagctttgaatattctttttgcttcaaaaggaactgaaaatctaaatgtaatttggtacaccttttaaaatattcactgctgcctgccagctagctgcaggttattttagctactagaagcagcactaatttgcaatatctttctaagactatctataggtaaaaatttgacattggctgactctaaccaatgtcaagctttaggatagcaacatcatccctaaaagaaaaatgagaaataacctaactatctaaacatcaaaaacaaattaaccttgcctgaccatttttaggacaacataatggtttcttgagatttttcaacatttatgaaaagataaaaattaagatgagtcatttaatagcatgcatgcttgaaccaataaaatgatttcttattttatgagttgtttttaaaaaatgagcccagatgtttcaaattataaataatttgtcaatttatgcataaagccaaatttgaaaaatgtgactggtcattcccattaagaaactcaactgaaaatctgtttcactgaatcaagcttaaataagtaattgtgtacttagatgtagctgaattctaagaactatttggaccacaacttatagactatttatatattttgcaaactgtttgctgttctctgacttcaagtaagagagagatattaagtgacaaatcatacaacggaaagggagttatataggaagactctccattttgactcagaatacaatatgtacccatctttaagttttaatggggagaactgtgtggctgacttttttttttcccaatctagcttcctcatttggaagaatgttttgtttctgtatatgaaaactgaaggatttctattcaaggccactgtggtagacagaataatggcttactaaaatgtcgacgtcctaatttctggaacctgtgaaaatgtcaccttccatgacaaaaagacattgtagaagcaattatttaaggatctagagatgagaatattaaggtgggttatttgggtgttccaaatgtgaacccaagtggagttcttgtaagactgagaagatgccttcgagttaggaaggagatgggagatgtgtcatgaaagcagaggttggagtgacaggatttcaagttggagaaaggggttatagccaagaatccaagcagcctcaagagagtagaagctcttgatcttcacctatgtgactctattttagtctttacttgcagaactgtaagatagtagatttgtggtgttttaatccactaagttggtagtaatgtgctccagccactatgagacaaatacagtatatatatatatacacacacacacacacacacacacacacacacacacacacacatatatatgtgtgggtgtgtattaggaaaagtagtaaatctaaatctagattttctcattctcacctaggttcttatatttttaattatataactagttacataacattatttatataatactagttatataaatagtgctctattgttttccttgtattttaatttttctgttaaaagaaagtttaagaacatatgtatccatatatgtatatacacatgcagaaatgtatatctgtgtatgtgtgtgtgtttatatatgagtatatatattcaaagttctgaaatgtttttcaaagcaatgctggcaatggaattctcatttctatgtgtcttttctgtggaggtttaagtatgatttatttgggaattgctacattatcctgacaaaaatataacagtagtggcaatatataatcccccaaaaatgttaaatctccagataacttttaatgagttggcattgactagtatgagaaaaacaaggcacagagagtgatatggtttggctctgtgctgtcacccaaatctcatcttgaatcgtaatccccataatgcccatgtgttgaggggcctggtgggaggtgattggatcatgggcacagtttcccctagatgttctcatgatagtgaatgagttctcatgagatctgatggttttacaagtgtttgacagtgcctccttcacatgctctctctcccctgctgccatgtaagacgtgcctgtttccccttccaccatgattgtaagttccctgaggcctccccagccatgcagaactgtgagtcaattaagcctctttcctttgtaaattaccctgtctcaggtattctttatagcaatgtgaaaatggattaatacagagagtctacacatttctttatataagatatacttgttttctgtttatagttagcatttacaaagtttacagtaaaatttttacttacatttatataacattgaatttattctcaaaattttatgcaaccaattacatacattttagatctaaagtggactttgtttttttccatggaataagtattttgtaggacttctcttcaatattggtgtgtagaaaaaaaaatgtgaacttcaagtttcaatcaattaaacttttgcttaaactgaaaagccatgccaacacacaaaaaggtcatctggggtgtgccattacattaggattacatacgggtactacacactcagttgtgtaggaaataagaatggattatacttaaacctctaaaggatggcctgaattaaagagatagaaaatgggagttaatattgctagtgttaccatgtaaaatttaataattatttgcttaattattgtcttattaatttaatagtttctaaagagaaatttcattaacaaattaacaggaacagctacaaaatttgcagtgttcagtgcaaaattaaaatataggacatcttactcaaaaattatttaaaacttgacacgaatgacaccaaagaattagccaagtgatgggcccctgcaaatgagcagatcacataaatctatccctgaacatcagttagttataaaaaaaataagaaattaaggctgggacccatatccataattttacccatacctgcatttatatctgtatttatatacctataagagtatttagatctatttattcacaatctcagaatcagattgtagagacatttaaagattaactaatacaaacttgtcctcttacaaaagagaaaactgagccgcagtgctttgattgtatcagtagctaatattagaaataaaagcagcacattatcttaaatattttatgtttttcttattactaacagtttagtgctcctatgtattttgtagtacttctcttcaatattggtgtgtagaaagaaaatgtgaaccccgagtttaatcaattaaactttgattaaactgaaaaaccatagtcaatcccaatacataaaagggtcatctggggtgtgccattgcattaggattacatactggtactatatgttgctgttacatgctatttcactcagtcgtgtaggacagaagcatggattatacttaaacttctaaagaatgacctcaattaaagagatagaaaatgggagttaatattgttagtgttgccatgtaaaatttaataattaatataatgtctcatatattctgtggtgattaattggtgtggattatttaagccacgagaataagtactataaaagcaataatttataatagggtctttaatgatcagttctgttcttacacagcttcttccaactcctactccttggaagcaaccaagtggtatgagttggcccctactcaccccctccctggtgtcagtggaccatatcagggaagtgaggttattttttcacttggaggaaacaaagatatgtaactcagtaccctacttttgccatgaggttgccagtgggtggagggagaagacaaacttccacctaaccagtctacaagaaggaagtataagttagtactctacttttgataggatggtattagtaggtcccatcaggaagataaacatgcacacccacccagctctcaggttacacatcaatagggaaccatctacgaaataataagagagaaaagattctcataatataaaaaaatattcaggacacaataaaaatcacttataaaacaaaagaactaggaaatcataacctgaataagagaaagacaacagacaccaacacagacatgaaaaaggtgttggggctgggcgcagtggctcacacctgtaatcccagcactgtgggaggccaagatgggtggatcacttgaggtcaggagttcaagaccatcctgtccaacatggcgaaaccccgcctctactaaaaatataaaaagttagccgggtgcattggcacatgcctgtaatcccagctacttgggaggctgaggcaggagaatcacttgaacctgggagatggaggttacagtgagccaagatcataccgctgcactccagcctgggcaacagagtgagactgtttcagacaaaaaaaaaaaaaaaaaaaaaaaaaaaaaaagaggttggaattatctaacaaggattttaaagaaaccatcataaaagtgtttaaataagcaattatatattgtattctcttggaacaaataaaagttaaaattaaaagtaaattcaataatgacataagttataaaaagtaaatatgaactaaataaaattaaaatacaataatggaaataatagattcagaggatggtcacaaaagaagagagcacagagcagaagatggaatcagtgaatctgaaaacatgccaacagaatttactgtctgaacaagaagaagaaaactgataaaaaaaaaatttaacagcatttcaggaaactttagaacaataataaaagagctaacattcataatcacaggggatatagaagacgaggagatagaatgtgggactaaaaaactattaaaaaataatgacttcaaccttcccaaattggatggaagacataaacctaaatattcaagaaacagagcaaatcttaaatagaatacacccaaatacattcaatttctggaaatgaaaaaaaaaaattaaaaatcttgaaagcaaacagagaaaaatggcacatttcttacagaaaaacaataatgtaaaccacagcagattttccatctgaaaccatgaaggttggaaggaaacagataatatttttgaagtactgaaggaacagaactgtgaactgtaaattcaatacccagcaataatattcttcaggcattaaagtgacatagaaaacattgtctaatgaaagaatgctaaggtaatgtgttgctaacaaacttacctttaaagaataagttctctaaacagaaaagaaatgataaaagaagaaggttttcagcttttacaaacatccatctaaatgggtaaaattaagcataaatataatgtataatcaaacttctgttaagtttttaagccatttctaatagttgaagcaaaaattagtgacctacctggttggatgctcaaggaacatagaggaaatatttaagataattatatctaaaaagtagtgatagtaaagagactcatatggaaacaagttttctacacttcactcaaagaggtaaaacatcagtaacagtagatcttgacattacacatatattattttaaccagtgcaattaataaaaccaaacaaaatcatgtacaatcatgcactgcataatgatgttttgctcagcaatagactgcatatatcatggtggtcccataagattataatggagatgaatattacctagtgacattgcagctgagctgtcttaacattatagtctaacatatttctcacctgtttgtggcaatgatggtgtaaacaaacctactgcattgccagttataaaaaagtgtagcacataaaattatgtctagtactgatattgtttggctgtggccccacccaaatctcatcttgaattgtaatcctcatgatcctcccgtgtcaagggcaagacctggtgggaagtgattggatcctggaggcagtttccctcatgctgttctcatgatagtgagtaagttttcatgagatctgatggttttaaaagtgtttgaaagtttctcctagacacactcattctctcctgttgccttgtgaagaagccaactgcttttattccaccatgattgtaagttttctgaggcctctccagccatgcagaactatgagtcaattaaccctctttcttttataaattaccctgtcttgggtagtatctttatagcagtgtgagaacagactaatagagtaaattggtactgggagtggggcactgctataaagatactgaaaatgaggaagtgactttagaactgggtatcgggcagaggttggaagtgtttggagggctcagaagaagacaggaagttgtgagaaagtttgaaacttcctagggacttgtggaatggttttgaccaaaatgctgattgtgatatagacagtgaagtccaagctgaggtggtcttggatggagaagaagaactcattaggagctagagcccaaagatcactcttactctgccttagcaaagagactagaagcattttgcccctgtcctagagatctgtggaacttttaatttgagaaacattatctcaaattggaacttatgtttaaaatggaagcagggcataaaagtttggaaaatttgcagcctgaccatgcagtagaaaagaaaaacccatttttcaggggaggaattcaagctggctacagaaatttgcctaaataacaagaagccgaatgttgttacagtagccaagacaatggcaaaatttttcttgggcgtatcacagacttccatggcagcccttctcatcacagacccagcggcctctgaggaaaaaaggtttcatgggctgggcctatggccccgttgctctgggcaacctcaggacttggtgccctgtgtcccagctgctgctactccagctccagccgtggctaaaaggagacaatgtacagctcacctgttgattcagagggtgcaagccccaagccttggaggattccatatgatgttgggcctgagggtacacagaagtcaagaattcaggtgtggaaacctctgcctagatttcacaggttgtatggaaatgcctggatgtccaggccgagattggctgcaggggtggagccatcatggagaacctctgctagggtagtgcagaagggaaatgtggggttggagctcccacacagagtccccactggggcactgcctagtgaagctgtgagaagagggccactgttctccagacccctgaatggaagatccaccaacagcttgtactgtgcacctggaaaagccacagacactcaatgccagcctgtgaaggaactgcccaaggccatgggagcccaccccttgcattaacatgccctggatgtgaaacatggagacaaggagattattttaaagctttatgttttaatgactgccctgctgggtttcagactttcatggggtctgtatcccctttgttttgactaatttctccaatttggaatgggagcatttatccaattcctgtaccctcatggtatctaggaagtaactaacttgcttttgattttacaggcttataggccaaaacgtcttgccttgtctcagatgagactttgaactgtgggctgttgagttactgctgaaatgatttaagactctgggggactgttaggaaggcatgatgttgggttggaaatgtaaaaaatatgtgagatctgggagggtccaggggtggaatgatatggtttggctctatatccccacccaaatctcatcttgaattgtaatcttcataatacccatgtgttgagggcaggacctggtggaaggtgattggatcatgtgggcggtttctgccatgctgttcttatgatagtgagtgagttctcaggagatctgatggttttgttaagtgtttcacagctcctcctacacacaatccttctctctcctgttgtcttgtgaagaagatgactgcttcccatttcaccatgactgtaagttccatgaggcctcctcagccatgcagaactgtgactcaattaaacatctttcctttatgaattacccaatctcaggtagtgtctttatagtagtgtgagaatggactaatacaagtacattttacttagtaataataataaacaaatatattacattttcgtgtatttactataccatattttttattgttattgtagtgtacaccttctacttattaaaagaaataggcccgaggcgggcagatcacgaggtcaggagatcgagaccatcctggctaacatggtgaaaccccatctctactaaaaatacaaaaaattagccaggcctggtggggggcgcctatattcccagctattcgggaggctgaggcaggagaatggcgtgaacccaggaggcggagcttgcagtgagccgagatcacgccactgcactccagcctgtgcgacagaacgagactctgtctcaaaaaaaaaaaaaaaaaagaaataggcaactgtaaaacagcctcacagtggtccttcacgaggcatttcagagggcattgttatgataggagatgtcaacagatccatatgcattattggcctagaggagcttccagtgggacaagatctggaggtagaaaacagtgatgttgatcatactgaccctgtgtaggactacgctagtatgtgcatttgtgtctttgtttttaacaacaacaacaaaaaaattaaaagttaaaagatgtaaaattacaaaaaaacttagagaataaggatataaggaaataaagtatttctgtgtacaatatgcgttttaagctaagtgttattacaaaagagtcaaaaagttaaaaataagttaaaaagtttataaagtaaaaaagttactgtaggataagtttaatgtattttgaaagaaagaagttttttttacaaattttataaattcagtgtttataaagtctacagttttgtacaatgatgccctaggcatttacgctcactcaccacttactcactaactctcccagagcaactcctagtcctgcaaacttaatttatagtaagtgccctaatcaggtataccatttttgatttttgactggattttttactgtaccttttttttatgtttagatacacaaatatttaccattgtgttgcaaatgcctacagtattcagcacagtaacatgctgtataggtttgtagcctaggatcaacaggctgtaccacataacctagggtgtgtagtaggttatgctatctctatttacacatagaatacactatatgatgttacacagtgaagaaattgcctaatgcatttctcagaatgtaatttttgtcattaagtgatgcaacattgtatttaaaaacactataaataaattaagatggaaacttaacatgtttacgtaacccattggaaagcaagaaaaagacacagaggaataagaaacagaaacaaacagaaacaaataacaaagtggtagacttcaaccacaacatataaattgttaaacataaaaggcctatagaaaccaactaaaaaacatagattggcagagtagttaaaaaaacaaaaatcaaaaacgaaaaaacatggccaacaatattgtccaaattgcatttgtaccccataaataaataatttttaaaattctgtctatataaaactaacttcaaatacagcataggtaagataaaagtaaaaagagagaaacagtaaaataatttaaaaatgcaagtgaggttatagtaatatatcagctacataaattttattttattattattattattattattattattattattattattattttgagacagagtctcactctgtcacccaggctggagtgcagtggagcaatctcaacctcactgcaagctccacctcccaggttcatgccattctcctgcctcagcctcccgagtagctggtactacaggtgcccaccaccacgcccagctaatttttttgtgtttttagtagagacggggtttcaccgtgttagctaggatggtctcgatctcctgaccttgtgatctgccagtctcagcctcccaaagtgctgggattacaggcatgagccagggtgcctggcccagctacataaattttaaaaagtaaaaaaagtcaaattgcatttttaaatattttacattccattgccattcaaagaaataacattgttttcaatacgattaagcaagtatcattagacctagaaatagccacaatcatttcttaaaaagattattaatatttatttatttatttatttttaggcggagtctcactctgttcgccaagctggagtgcagtggtgcggtctcagctcactgcaatttctgcctcaccctcccaagtaactgggattacaggcacgtgccaccacatacggctaatttttgtatttttagtagagactaatttttgtacttttagtagagacagggtttcaccatattggccaggccggtcacaaactcctgacctcaggtgattggcccgcatcagcctcccaaagtgctgggattacaggcgtaagtcatcgtgcccagctaagatttctaatatttataagctctaccttctttcttggagaaatgactttataatttcactttctaattcagttacctgttgaaactaaattaaaatatattcatatgcaaaatgcaagtaaataaaaacagcagctttctctatgctaaaagaaagttcctttggagctcatttccttgacaatggaagaaagtacttcactgcactatcttcattatgcaaataaaggtgcattttagctcttttgaagaagaagaggaagaacatgtctctcaaatagcaggaaagaacaaatttccttaagcaagagtgagggaaagttcatcaacaccaaccctaggtacatcttcattcagacttgaaaagcttttgaatagcgtctgtttattcctgttagaactgaactggcaggaaaagacaatggagaagccacaaagaggagtagctaggtagcagcattcaggtccacaatgcctggatttcattattattattctactgtatcttcaggcagtttatgtaaatcatctgttattgagttctctcatctggaagatgagggtactaatagttccagagttcttacattagtgctgttgccgttagttatcatcatttaagtgtctgttcttattgttcaaagagtgactcgcagttgagagtccctgggacctgaagtagggaggtggagaattttgcattggagtatactgttatcttaaccttggaggcctgagtgttcttaggtaaaagactgctttggaggctgcaaatggaactagaatcccaccagatcacagccatctgacttggttgcatttttatggaaaccaggatgttgaggatgtgagactgatataaaagcactaggatattcacagggtaaaagtcaggaggatcataacagcacagtactagagaaccagtacatagtggtgtgatgaatgaaagccactgacataactttcgcatcttgtcttcctgtattctttccttctgtgacagttcttgagatcatgacctcttttggaatggtgttctcagaagtccttggacaatcagggtgtactgggagaaaacatgctgtgagatgggatgaaagtcttcaggatagacactatactttctgttattggaggattcggtagtttgaataagcatttgaatgaataaaatatttgagttgaggactaaattctgatttttttttttcatcttgcccaaattcctatttaaagaaactgggagtcagccctacgaatgataacatctctttacatgggttttttattaaccctatataatgtggcttgctttccaacctgactctggtacagcatcacataacagacagcagaccctgaaggatataaaaatattttgccctaaaatatatttctttgatgtgttttgaaatggctgttgcaaggccagcaaactgaggtagaggaaatttgcatctatggagaatcttcattaatgcagccatgcttcccctttctatgcctttccaggacctaggagtgattgagagtctgatacctttaaaggtctgaaaagaaacatttaccatctattctctctgagggccacctatgaggcttcatctacttaataagatccttggtctttcccccactcttatctgaactcaggcattcctttctatcgatttcaagactttagacaatagcataactctctcaaccaattgtcaactaaaggatccctaaaacccacttatgacgtacaagctcctcccctgacctacctgcaattacctgcaattggttgtctccttggaatgtataaaaacaaactgtaacccggttgccttgggcatgctttccgaacctcttgagatagtgtaacccaggccttggtcacttatactggctctgaataaacctctttaaatatattttgacagaatttgttttttgtgtatttttctgtgtatttctacctctgagaagaggagtaatttatactctttacaaatcatggtcaggtatgactggtgctagaatgaggatgaagggaagagaaaaggaagaaataattctccactctttgtttccaattttagttctttaaagtaaaagtacaaaacattttgtagagatgtagcttgtggtggcatggttgaaaaacttctgcactttatgattcctccactacagtgtgataatgttttaaatagcatttaaaatgtagattctgtccaatccttacaattaacttttttattgtttggaatccatgaagttggtatatgcatgagcagatacatatttatttaagaaaaaaaattaggccttacagaaaattggtttctcagagacatgataaaagttaccagatgtctctcagactatatctatgaaaaaatacataaccaaatagacaccaattgcaaatgaattaattacattgaaattctaataactttcatttcctaaactgacattgatggaaaagaattctaagatataaaataagctctacttcatcctgctttcaatagcacatgatttaatcagaatatataatactgttgagcacataaatattattttcattacttaatgatgataattatgactattttcattgctataattttggtcatgccatattgattagcaataaaatatatacttagctagagaggcagctaatccaaaacttttgggatttcttttttttttttagattattggtgctcctcctcctgtcattgaggttaaaattaaatgttacatattccttctctgtgtatgtgtatcttatttcctcatattctacctcttcagagtagtgtgtgtgagtgcctgcacacacacttgcatgtgagagcttctaatatctaaattaatgttgaatcattattcagaaacagagagctaactgttatcccatcctgactttattctttatgaagaaaaatacagtgattccaagttaccaagttagtgctgcttgctttataaatgaagtaatattttaaaagttgtgcataagttaaaattcagaaataaaacttcatcctaaaactctgtgtgttgctttaaataatcagagcatctgcctacttaattttttgtgtgtgggtgcacaatagatgtttaatgagatcctgtcatctgtctgcttttttattgtaaaacaggaggggttttaatactggaggaacaactgatgtacctctgaaaaagagagagattagttattaattgaattgagggttgtcttgtcttagtagcttttattctctaggtactatttgattatgattgtgaaaatagaatttatccctcattaaatgtaaaatcaacaggagaatagcaaaaacttatgagatagatgaacgttgtgtgagtggcatggtttaatttgtttggaagaagcacttgccccagaagatacacaatgaaattcatgttattgagtagagtagtaatacagtgtgttcccttgtgaagttcataaccaagaattttagtagtggataggtaggctgaataactgacttcctatcattttcaggttctgcgtttgattttttttacatattaatttctttgatccacattaagctcagttatgtatttccattttataaatgaaaaaaaataggcacttgcaaatgtcagatcacttgcctgtggtcattcgggtagagatttgtggagctaagttggtcttaatcaaatgtcaagcttttttttttcttataaaatataggttttaatatgagttttaaaataaaattaattagaaaaaggcaaattactcaatatatataaggtattgcatttgtaataggtaggtatttcattttctagttatggtgggatattattcagactataattcccaatgaaaaaactttaaaaaatgctagtgattgcacacttaaaacaccttttaaaaagcattgagagcttataaaattttaatgagtgatcaaaccaaatttgaagagaaaagaagaacccagagaggtaaggatataaccttaccagttgcaatttgccgatctctacaaatattaatatttattttgacagtttcagggtgaatgagaaagaaaccaaaacccaagactagcatatgttgtcttcttaaggagccctcccctaaaagattgagatgaccaaatcttatactctcagcataaggtgaaccagacagacctaaagcagtggtagcttggatccactacttgggtttgtgtgatggcgtgactcaggtaatctcaagaattgaacatttttttaaggtggtcctactcatacactgcccaggtattagggagaagcaaatctgaatgctttataaaaataccctaaagctaaatcttacaatattctcaagaacacagtgaaacaaggcaaaataagttaaaatcaacaaaaacaacatgaaacataattagacacacaaagacttcaaacattggaaaataccagagaaagataataaatattttactctttaaaaatttagttaaaagcttaaactaattgtagagaaaaaactatgttagtattatattgtagatgaaataagcaaaacatttaaaatacaaatgtgattacttaaattaaatataatagataatttaccaccagattagataccattgaaggaataattaatatactgaaatacaggtcagtagaattttttttcaattcagcatggagatgtaaaaaatgaaaattaatgcaaaaaataagggcacaaaaagaaatgagtaattttgatcagaaatgtattaaaattaataaactggaaatttgacatttaaaaaaagcattgtcatccaagtagatgtgtctattaaatagttgttctcatatccagtaatgtaattattattccctctcatgcagttcagattctggggtaatctttagacatcagttttgtcttttatattatttattctgtttactacattttattttgctaatgatatttttaatttctgacattctggagtattgcttgtaaaaggtatttttaaaaatactttatggttatttttgtgattcctattcctctatggacaccaaggctattgacattttctttggtttcttctgttacttctattttcttagtgtttatatcatttcatagataggatattctttattttttatttttatttaaatatttggtgattcttggttttctcagccatctattgtcaagtgttcttattaagcattattattaaataaagattatttcctctaatcacatgagaatctttatttcccccaagtaattgaaaattgcaatgccatgctgccatgtggtacagcatgggtttgggcttgctttcttcttttttttttaacttttattttaggtttgggagtacctgtgaaagtttgttatataggtaaactcgtgtcaccagggtttgttgtacagatcattttgtcacctaggtaccaagtactcaacaattatttttcctgctcctctgtctcctgtcaccctccactctcaagtagactccggtgtctgctgttccattctttgtgtccatgtgttctcataatttagttccccacttgtaagtgagaacatgcagtattttctagtatttggttttttgttcctgtgttaatttgcccagtataatagcctccagctccatccatgttactgcaaagaacatgatctcattcttttttatagctccatggtgtctatataccacattttctttatctaaactcttattgatgagcattgaggtggattctatgtctttgctattgtgcatattgctgcaatgaacatttgtgtgcatgtgtctttatggtagaatgatatattttcttctgggtatatatgcagtaatgcgattgctggttggaatggtagttctgcttttatctctttgaggaattgccatgctgctttccacaatagttgaactaacttacactcccactaacagtgtgtaagtgtttccttttctccacaacctgccagcatctgttattttttgacattttaatagtagccattttaactggtatgaaattatatttcattgtggttttaatttgcatttctctaatgatcagtgatattgagtttgttttttttcacatgcttgttggctgcatgtatgtcttcttttaaaaagtgtctgttcatgtactttgcccacattttaatggggttgtttttctcttgtaaatttgtttaaattccttataggtgctggattttagacatttgtcagacgcatagtttgcaaatagtttctcccattctgtaggttgtctgtttattttgttaatagtttcttttgctatgcagaagctcttaataagtttaatgagatcctgatatgttaggctttgtgtccccacccaaatctcatcttgaattataatctccataatcaccacatggagagaccaggtggaggtaattgaatctgggggtggtttcacccatgctgttcttgtgatagtgaatgagttctcacgagatctaatggttttatgaggggctcttcccagctttgcctggtacttctccttcctgccgctttgtgaaaaaggtgcattgcgtccctttcaccttcttctataattgtaagtttcctgaggccttcccagccatgctgaacttcaagtcaattaaacctttttctttataaattactcagtctctggtggttctttatagcagtgtgaaaatggactaatgaagttcccatttatgaatttttgcttttgttgcaattgcttttgacatcttagtcatgaaatccttgcctgttctaagtacaggacggtattgcctaggttgtcttccagggtttttctaattttgtgttttgcatttaagtgtttaatccatcttgagttgatttttgtatattgtgtaaggaaggggtccagtttcaatcttttgcatatggctagttagttatcccagtaccatttattgaaaagacagtcttttccccatcgctcgtttttgtcagttttattgatgatcagataatcatagctgtgtggctttatttctgggttctttattctgttctattggtttatgtccctgtttttgtgccagtaccatgctgttttggttaacatagccctgtagtatagtttgaggtcagatagcctgatgcttccagctttgttctttttcttaagattgccttggctatttggcctcttttttggttccacatgaattttaaaacagttgtttctagtttttgaagaatgtcattggtagtttgatagaaatagcatttaatctgtaaattgatttgtgcagtatggccttttaatgatattgattcttcctatccatgagcatgatatgttttccattttgtttgtatcctctctgatttctttgtgcagtgttttgtaattctcattgtagagatttttcacctccctggttagttgtattttaccctagatattttattctttttgtgaaaattgtgaatgggattgccttcctgatttgactgccagcttggttactgttggtttatagaaatgctagtgatttttgtacattgattttctttctaaaactttgctgaagttttttttattagcagaaggagctttggggctgagactatggggttttctagatatagaatcatgtcagcttcaaatagggataattttacttcctctcttcctatttggatgccctttatttctttctcttgcctgattactctggctgggatttcctatgttgaataggagtcatgagagagggcatcaaatctacacatatcaaatactaaccttgaatgtaagtgggctaaatgccccacttaaaaggtaaaggggggcaagctgaataaaaaagcaagactcaatggtatgctgtctttgagacctatctcacatgtgatgacacccataggctcaaaataaaggaatggaggaaaatctaccaagcatgtagaaaacagaaaaaagcaggggttgcatcctaatttcagaccaaacagacttcaaaccaacaaagttcaaaaaagacaaagaaggggccgggagtggtggctcacacctgtaatcccagcactttgggaggccaaggtgggtggattaccaggtcaggagatcgagaccatcctggccaacattgtgaaaccccatctctactaaaatccaaaaaaaaaaaaaaaaaaaaaaaattagctgggcttggtggtgtgtgcctgtagtcccagctactcgggaggctgaggcaggagaatcacttgaacccgggaggcggagattgcagtgagctgagattgtgccactgcactatagcctggcgacagagtgaggctccatctcaaaaaaaaaaaaaaaaaaaaagacgaagtgcattacataatgatgaagggttttactcaacaagaagaccttactaacctaaatatatatgcacccaacacaggaacacccagattcataaagtaagttcttagagtacaaagaggctcccacacaataatagtaggagactttaacacaccactgacagtcatagacagatcatcaaggtagaaaattaacaatgatattcaggatctgaacccaacattccaccaaatgagtctgatagacatctacagaactctccatccaaaaacaacagaatatacattcttctcatctccacatggcacatgctctaaaattgaccacataatgcctttcttttcagtggtccatatgtaagtcttttgaaagtggcagcatctctactgcttatgcttgttgcaaggaactctactgaatacaaggaactttactaatctctaatgcttgtgagtagattctgaactcatcatttagaaagctaaactgggggctttcttcccagagcaaagacataaaacaaacctcaattgagcgtgggacagggagtcatatgctgtaaatttcttggacagttattattctatggaccaattaccgttcccttgtatctctaattttgggattatttctggattaaaacacacaaaaaaatcagactgtaaaaagtcatcatttctaccagtgtgagaatatgtattcctcacctttactgggattcactgccagtatatatacaaatgacttatacacacacatacacacacgcacatacacacacacgtgtgtgtgtgtaggtatgtctgtaataggtatttatatgtttgcctgtctttctattagaattgagatacagcaaaatgcacagaaattaagcattcaatttagtaagttttcacaaatgtacatatttaatcaatatctcaatcaacgcaaaaaccattgtttcacctctgaagataatttttaatcttttgcaaattattgagacttatttaatggccgagactacatagtccttcataaacgttccatgtaaatttgataaaaatattttcatgaaattttttgtgtagtgttctaaaacttgaaattagactacattagttgatagtattattagaatcttccaaatccttactaatttttatttgttcatctattgtttattttgagccgatgattaaaatcttcaactatgactgaaagtctttctatttttctgtttagttctgtctgtttttacttcgtgcattttgacactctgttatcagttgtataaacattgagaattataatgcattgctaatgagcttaaccttttatcattccatctctgatatttcagcttattttgaatcctactttctctggtattagccagctacatcagttttacttcctttcattttcaaccaattttatgactctgtctcaaaaaaaaatgcattcattgtacagagcatatagttttgtcctttttaaatccagtctcagaattgctagctcttaatttgagtgcgttatgggttgaattgtctgccaaaaaaaacatatgttgaagtccttaccccagtaattaaggatgcgaccttatttaaagataggatctttatagatgtaatcaagtcaaaatgggatcattagagtggcctctaatccaatgtgattggtggccttatgaaagggggaaatttggacacaaaaatgccaccagaaagcacaacatatgaacatgaagaaagccatctaaaagccacggagagatgtctagaacagattcttctgcacagcctttataaggaacccgtaccttgaattcagacttctagccttcaggacttgagataatacatttttgttgcttgaggcacctagtttatggtactttgttatataaccctaggaaactaatataaatgttcaatccatttacatttaatcagtgatgtcagtgttgttaaatctaccatgttactatttgcctactattttcttatttgggtgatgttctcttcccttggttgttgatatttctttcttcaccagttcagtgttaccttccttagagtaaatggatatttttcaatatttcattttaattatgctattggctttatacccttcatacatgtattcctgttgatttgatgttcttggatctctgcactgaaatttttcatcaaaatttgaaaacactggcaattatttcttcaaatatattttttctttcccattttctgactcatccttttgagacttcatttgtgtataggtttgatggcttgatatcccatgtcattcaatctcttattttaatcattttcctcttttgtttgagattagataaattcaaaaatggttttcaaggttatttgtctgcttttcagatggctgaaatctgagagtataccctgccagtgactctttcattgtatattttgcacttgttacttcaacaatgttcattactgaaaatttccttttttgttctatcattgtgacaatatctccatagtctaaggacatattcataatatatatctgttcatttcaatgcctgggtcattatcatgtatgttctattgactgcttttttccccttgattatttattaaattttcctgcttctttgcataacttgtatttttgactaatacaccgtagagaatctagatgttgtcttcttgtaaaggggcctaagatagtcctttgaaagctgttaagtggcttccagatccttttgatctgccatgcctggtttcattatttgttaaggaaaatctctttcatttttgttcttaaatataggacatagtctttactgaaagaaatagtccttgttcttaatgcctggaatattcagtaaaatatcttccctgtggctagtcagtaacccaaacatctccttgtcctgttactactgatatcttattcccacagtatctgctttcagcaggtcttgcagatgttaaccctgctcaggtatagagcagcttttgacgaaattggtgccaaacacttattctggcttctgtaggcctaccccatgcctctttttcctttcctatacaaatttcagccgcttcagcagctctcagataacaatcacttaagcaactttaagctatttacaaatatcgatagatagatagatagatagatagatagatagagagatgatatagatagagatttaattctaattttagattcagggggtatatgtgcaggtttgttacaaagttatattgcttgctgctactgtttgggcttccactgatcctgtcacccaggtagtgaactgaatacctaacaggaagttccttggctcttgtccctctacccctacctctttttggaacctaattaaattaagagcttctgcatagcaaaagaaattatcaacaaataagcagacaacctacaaaatgagagcattaagctttaatctcttcctctaaactcgttatttttagagtctgcctccttgtttaatgggagaaaaagtgcccctagtcacattctctggttaaatgtggtgcttacctcacggctttcttttctcttgagtatgaaaaacttgtacttcttgtttgatgcataaaacctgtttccttatatatgttgcccagtcttatcattgtttatagtgaaaaggcaagtccctccaataattctattacggccaaagactaaagtgcctctgatatgacttatgtccttcagaaattgcttattctttagtctgttggtagaattcttctcaactttccatagttattttaataagtactatattttcctatttcaatggcaatttggaataaaggagaaataaatgtatttgtttggtccatctttgtgaattcaaactgttaagtcattacttttcacgtccactacacatattactgcacagtaattccttgtttacacctataatcttcctctcctgttttcctagtttctattcaagtatttggggtaactgatatttcttaaaacaatatgtattcttggaaagagatgtttctagaatccccttcttaggtgacttattaggaaaaattataagaagaatgagaatagagaagaaaagtaattgaagacatctacttcaactctaaatccccataggagaaaaatggctagcacttatttaaatgcccttcttaggtgacttattaggaaaaattataagaataagaatgaggatagagaaaagtaattgaagatacccacttcaactctaaatccccacaggagaaaaatggctggcgcttatttaaactcatctagggtttagttttgctgatgttgtttttccaataataatgtttcaattattataacagcaatttcagtgaaatatggtacttaccagctaagttttacacaaggaagcactttcctaaacacttccccatccttcttaaaagtttgaatccaaatcttttgtactccagggcttattttgtttttcctgcagcattctgcctttctagaattagcactagttaccctcaggaaaaacaaatacatggacccataaaataatctttggaagtctttcttctcctgctagttaccaaattataatcttcttattgtaaaaataaaataaaataaaaaataaaaagaactattttactctaataagtttcccattaagctaagcctgcttttgttgtattagagattaacatatgtagacagtgttctttttgactggaaatggggattagttatggttcaagtaatgcataaacaagatgtatttttaaaaatacattatatttatgcattatatttaagcagccatttgtaaaaagctgaaacttattagaaagtgaattcttcataatcatgtttgtattttcaatgtttaggattatttgttagcttaggtatagactagactatttttctaaacaaacaggaataagaaatataggtagtaaaatttacatgacctggtaaaatttaaaatatccattctgactaacaggcagtgatgagaacaataaataaaatatatcttggtttaaattctaagtaaatatatttgacaatagaaatataaacatactcataggagtgaattgcttctaattctggcctttagctaaataagcacttaatgctagtaagaaaaatacattatttcataaagataacaacttctttcagaaatagtaattatatttttaaagagtttggggaaaatagaagtgtatactctaatcttatagcaaagtttctgctaagttttcgtgatgccaatgttttcattatgaatcatttcactgtcaaacaaaatgtacgctattgattaaacacaggcaaaaagagaggggaaaaagggtatattaaaaaaagacctttggttattccggctgccaccaattgctttcttgtttcagctgaattttgaagtagctaatcatattttggcattttcttgtcatcaaagcatttcatgaaattatcccattacaatgtttttctcagaggcaaaattaacatggttgacagtttaattgacatatttctttttcgttgtgtgcctttgccaattaaacaaattgcaccctattttgatgttcattttgttaattatttgtaaaactgtagactctgatttttttttttttaattttcaagtgtcagtttcttggtcgggaatgaaaatagtgccaacctgtgataccttcactctaattttactttctgaggaagttttctgtaatagttacttggtgataattattaatactggtgagttttaaaaattttgctttcagcaattttccatttttttcagcatacttatatcacaatgaggcaaccaaatatgaatcctgagaatgaagatggaaaatgaatattttaatccaatatcgagttgttctttcaacatttttagttttagttttaactgaaaatataaagttacataattgtgtgaggaataatttttgcagagaaatttttaaaaattcacaaaaggaaaaagaaacctttaccatgagtctataacattgaaagactgtgtttaagtgattttaataaagccaaaccaacactttcagcaggaactaaatggcagcatctgatttcacgctgatacatatgtattagtgtggtgctcacttttacccttcattttaccttgggtcttgccattttctttctatttttacgtttttttttttttttttcttttggaagaggtaatttttagggagaaaaaaacactttttcctcataggtcgatttaaaatgttggccttaccttaatctcctctctcaaactcaatccactatgtaatgggtcaacatacttttctgtgaaggaccagatagtaaatattttagtctttgcaggccatatggtctctgttgccagctcttccattgtggtgtgaaagcagccatagacaacacagaaatgaataagtgtaactgttccaataaaaacagatgatatgttgaatttagctcacagagtttagcttgctgcccctgcaggaggcctttggagtaaaagcttcctgagaggaggaatttttgtcttttttgctcaagttctagctccagtacctaaaatagtgcctgtcacgtaggtattgatgaatatttgaacctgttgaacatacacctaaaataaaacatttggcaagatacagtactacacaatttggaaaacacttggctcccatagaaatcaaagccttcctgagtaattaattatttggcctgatgatgaattactgtgcctgagatgatagagctaatttatttttcaattcactcaggggacacacgttattttcactgtgaatttggttaaaatgaaaagatttcctgctctaagtcctggatagacctttatgtaatagcatactcttcactctttttgaatcgcatgcagttgtcacactggatgatttccagacagaggttccaagtctttcatcatgtttgggttaaaggcctcattaacatactagtcctgccatttgagtctgttctcttcacggaatattttcacctgaatcagtgggtataattcatcagtgtctggttgcttcaagttatttttcttaatgctgatgttaatgcatgcccatctttatgcctcaacacattgcacaatgaaaaacaaaaattattttggaagacacagctgacatctatatgaaatattcagtatcagtgattgaacttcagcaagctcctgtggccagcagggttttacggaggtgcaactgctctcccatgatcacttatcataaagccagagacaattgggccaacgtagcatcttgcctgcttttgtgtacaaaatataaatagaatagagcaaacaaggaaaaatagtcccgcagctggaaggcaactttaaagaaaaatgatgttcatagctatcttgccagtagctggcaaagcagtttttataagacatatttaatgtttacaaccacttggaggctggggaaggagtaatactttgcaaatatgtttaatgttgtgaaccactctgtggccgagaagcaactccggctaaaatatatttaatgcttagagtcatttggtggtttcgaaaaaaaagaaacttcttgttaatttttaacatttattgctgatcagtggctgctaaagtaactatcagtacagcatggtttatgtttagggacacgctgtgctgctactaacacaattcatactcttctctcaaggctacacaaaaagtgtcaatagcattacctttgcaattgcaccactaataaaaacacaggaatcaaacagacgaataaaatgctccctgcccacacagccataacatcctatggccctgaaaatagtcctgccaaactgcgtgcagtggacacttcacggctggcacaggagagatcacaaggccttgctcaatttcatcaaaagtgttaaagcgactcagcagattgtgaagcacaagtggaagctgataattggtgtttcttacaaatcaacggcttgtctccacacatcaaggtaaaggcgtcctctacaccaaggaaaatgtaaattgggatagaaggtcattatgtttttaaataaacttggttaaatttgtagaaagggcaatggtaaatactgagctcacatgtcagatggagagaaaacttgagaaaagggaagaagataataagctggaacctttaccatttagactttctctggctagttttctgagaatgatcatcaaactcttatgaggaccctttccaatgtattgactgcacttccccagggattgtggcaaatggtaaatatacattttctccttgctacttgcaataaccctctcataaagtgttactattattcacttgcaggtgagaaaatcaatgtaaaagaggagaaataacccacacaactacatacaactaggaaatgatagttggatctgaacaaaaggatatgcactcttaacaagttcaacatccaagtactattgcaagtacaagctgtatttcatggaaaaagaacagaataactcaaaaggcagaacgaagagcctagaggtcagagatgagaggcatgaataattattcacaggcgttgaatataatcaaatgacttgcaacatttaccactgggattttaaaatgtggtggaccaatcatcttttagtctgtgcattttcccatttttttcaacaggaatgtctagagatattattcctgttttgccactgtatttttggtgagtgtgtagtaagtaactggcctctttagtatcacaaagctggatgaagaaaatgtggtacatatacaccatgagatactatgccgccacaaaaaggaaatgagatcatgtcctttgcagggacgtggatgaagctggaagccattatccttagcaaagtaacgcaggaacagaaaaccaaacaccacgtgttgtctcttataagtgggagctgaacagtaagaacacatggacacagggtggagaacaatacacactgaggcttgatggggggtggagggtagggagggggagcattagaaaaaataactaatgcatgctgggcttaatacttatgtgatgggttgataggtgcagcaaaccaccctggcacatgtttatcaatgtaacaaacctgcacatcctgcacaggtactccaaaactaaaagtaaaaaatctaaaagaaaaaaaaaaaagaattaaacccaaaatcacttccccatctagacttgatttagatgaaaagctcctggactttgagctgatgctatagtgggttgaaaattttggggtcctcagaaagggatgagaatatattgcatgacagagcaacatgaatcattgagagccagagtatagacagtggtaggtagactgtaggagagccctcagtgatcccagctttcttgtattcgcgttgcacttacttgtagaatatggcagaagggatgtgatgtcactttcaagattaggttataaatagactatggcttcaatcagagggttttctctctgtctagctctcttttgggtagttcattctgaggaaagccagctgccacgttatgatgtaggcctgtgaggtccacgtagcaaagaacatatggaagatttctaccaccccctaactaagcctttagatcagaccgcaaccccagccaacaaggtagctacaaactcttgagaagccttgagacagaggtactcaatagagccattcctatgagaaacttaagtatctgctgttttacactgctaaggttttagctaatgtattatgccataatagataagttatatacaacctttatcaaataataaaagtaaccatcatcagtaatgagacaaatcaaaaaccatggcccacccaatagaacataatgaggagagtacagaattggttctgggatatttctgacaaagatgtatatgcttcattcatacatgaggaaacatcacacatactcaagatgggagagccattctaaaaaataactaggcagaaatcttcaaaaatattaaagtcacggaaaccaagaaaaaatatgaacctgtttcagattaaaggaaactaaacagacctaacattttaatacaatgtttgattttgaacttgaactttttgttatataagacactattgagacaagtgctaatgcttgaatagggctgaaggattagattataataatacattaatgcaaatttcctgattttaaacattgtagtttgattgcacaaggcgaatgtctttatgtgtggaaaataaatagtcaacattctgtcttcaagcttctgaaaaaactctgcttttagggcatagatagaagtggatgataattcacctgttcctctgctactaattgaggggctctctgtttccatggctggctcaagggataagagaatatatctagttttttatgtttcgatttgtctctctatggcatttttgtgaaaataaggaagtgtggagacttatatatgtttctaagttataatagttcattaatgtaaagtacagacacagtcttcacttttccttcttagaccgtttaaatatggccacgaaacaagtagtctctggttggctgggcactgtggctcatgtccttaacaccagcactttgggaggccgaggcaggcaaatcacttgagttcaggagttcgagaccagcctggccaatgtggcaaaaccccatctcttctaaaaatacaagaattagctgagtgtggtggtgcacacctgtaatcccagttactcgagaagctgaggcaggagaatcacttgaacctggaaggcagaggttgcagtgcgccaagaccataccactacactccggcctgggcaatagagcaagactctttctcaaaaaaaaaaaaaaaaaaaaaaaaaaaaaaaaaaagaaaaaagaaaatagtctctggttaaataacctctgaaaaactccaccaaaaatttcatcttagcatttctccccaaacttcatgtaaaataaaatagagttgagagaaaaaaagaaaggcaagggagtacctgttcactatttttattaaaccagtgttctactttattttaggtgtatcttttcttatttaaatgtcagctaaactttctttttaagatattgaatgaaagatgcccatccttcaggttttgtttaagcaagaatccccattctcaaataatataatataaactttccaaattcttaagtagatcatctgagattgaaagctaagtttaactttctcaaagatattttagccgcatgacacctagacaaaatggtatattaaattctgactaatttggttctaaagcaactaagaatcattcttactttcttatccacaggggttattaagttttcacattaaaaaaaatccaacagtgaataatactgcattggggttactgtaattgttaagtaaaataagaaatacaaatctttagttagatcacatggcacctgactactgcttagaaaatggtaagaattactacataaatcatgagtcactattgacatctactatatcatatcataggttagatatctaattataaatagtcaaatcagctgactcaaggtggcatagctcaagcaggggaagataatacaagttgagtatggatttaacactctaaacctgtcagcattgtaggaaaagtaacttaaaactgcacaccccacttatgcataatcatcagatattaaagagggtacattcctataatttattgttgctctagtgatcttaaagaattaagtccacattcataaagtccaaacttgtctccaaggatttgctttgactttgggagtatctggatcattaagtaatttccggaggtcagagtaaaagctttttatctctaaatattacttccctggaatattagatgtaacagaagtcagtaacggagtgatctttctcttaaacaattcatagattcactggaattttcttcaactttaggaaaattaaatatattccacagtgctgtaagtcttaaatattgattttcctctgaaatcttgactcatcctacccaccaccattctccctttgtacaatatgttctttgtaatgttcactttacacaagtgaaaattagtaatattagtaaattttcattgcaggtttatttgttcatatttctggatatataatccattactgttaaacttcatatcaatgttccgatatttcttcatcttatgttttatgttacaaaacaggttatttcactatatgtatttttaattgattaattcttccctttttttggaaatgaaacagaagcactctcaattattgggacagaaaagttatttcatagggaatacttcaaacactgatatctacaacaggcagtaagattcgtcacaacaattggtatactgtcaatataccatacaaagttccatctggtcttgattaaaaattattttagtattctcaggaaaatgatacagagggagaattgcctcgattatatgagagaaaaaaaagtatagaaaaacataatgttttcttagattattacagcagtgaactatttccacctggtaagaagggtgcacttgagaatggggttcgagtactctaggaacatagatgtaagttctggatgcacagtagttgttgcttagttgtaagttggaaatttcaaggcagaaacagcagataccacaactataattgggtctccttgttttttgttttatgtgtatatgtgagattatggggaaagacaaaagtaatgcatagaggtttattttttaacattcaattcataagcagtgtttatacctctttgtacttacttgaaaagtgtatattatgtaaatttagtataaaaacacttggactaattcataccatgtggtaaaatttcacattcaaaagaaatacccttctgttattaaaaataaaaaaaaaggagccaggagggtggctcatgactgtaatcccagtgctctgggaagccaaggtggagggatcatttgaggccaggactacttgagaacagcctgggcaacatagctagatcccttctctacaaaaagtaaaaaaaaaaaaaaaaaaatagctaggcagagtggcacatgactggctattaaggaggctcaggtggagggatctcttcagcccaggaatttaaggcttcagtgagctaagactgggccattgcactccagccagggcaacagaccaagacccagtctcaaaataaataaataaaaatgaaagaaagcagtgcactgaaaatcaatttaagtatttactggagttgtcttgaaggcccaatgggaaatttcagtaagggcacatgagaaaacactttaagaacctattcttccaaagatctttccagtatcttatgacaacacagtaaattatatcccactccaactgcaaaagctgaaactactctgctttctcacttacctacacttttgactttccaaatatatttctctctttggatatgatctgcaaactccttacacgaaggctccaactctgcagccctagttattatagttggcacaagaaaaatcctaattgttttatccaaggagacggaattttccaatactgtagaggcatgtgtgtgtgtttgctttaaggaagctgttttggtactaaaaagtcactgagggtcataaattcatgttaacacatccagtgtacatgaagtaggcaccgagttaaactatttgtctactatatagcatgtcatcttaaaagccttattttttcctcaaaatattaactttatttttctccctgtaaaatcaagacaccgttaaaatgtagcctccctcattttctgggaatactttctaacaagatatgcttctttccaattggacttctaaatttctagcaataataacagtgcataaaacaggcaaccccaaaagtgtagcaggtactgaataacagatttgcagccttgggtatccacattaaaatttgaaatctaagtgaattacttcaagctgatttcttaggtcaaggagagattatggtccttaaatgcctgataaggtcacatacacaatttcaagtgcattatagtaaatccatgtgacagctcctacagctactaacctgcttctgccctcagggtagcgtgcacaatcttcatcacaagtcctgggtggtggtaggagcagtagaaaccccctgggtcatgtcagatttagaaaatataagcaatggctcatacacgaattttaagttgtaacctacatgtgataagttgctttatcttccaaatgtaataaaaaccagaagttactttgaaataaattgaaggattagcagtggtgactgaggaataaaaattataatttaaaattgtccttaaagctggaattcttaacttactgaccttatatcctacatattataggactttgtaaatttaggctgatatggaaatgtatatttatatcaaatttaaatttttagaatgatggtgctactatattctaattgttaatttgataattgtaattgtaatttgttaatttgttctaataatgttttcatgacattattcatttgctgcttggcttgatggcacaacaagtatgggttatttaccctgaaaaggaaacagtattacccttccagaatctctatttacagctacaaaagatgcatcacacctgtttccggaccacttccagatcagatgtgacacatgctttagataatttactttgatctaggaattactgtctggcattttgtggtgtagggtaggtgtctccagcactatataggtgtctggaattgagataacaatcaatttcaatacaaaatacattttttgcttaaagcatgcaaggattctatgaattcaggtaaattcacagggtggaaaacaggaactaatgttatatattcctgtacttatcttcataatgaagcagaaagaaaaacaaaaaagttacaaaaataaatgaaaagaactgtattttctagaattgaaaaatattcttttagatgatagataagatgtttacatcaacctgcaaaaagtcaatgttgaagaggtctcattgtatctcacagaattttgatttgcctactcacccacaggagacatttctggaacagtagcaacataaggtccatccaaaaactttggctcattatcattaatatcctgcactttgatgatgaattctgattcaggctccaggggctttctggtttctatgtccacagcctgagcacgaagagtgtagaaaggtttctcttctctatctaggctccttattgcatgaatgtcccctgtggtttcatcaatggtaaaaacggtgccagcgccatctcctgagagggtgtatttcacagtgccctctcccttgtctaagtcggaatggagctttagggaagagaaggagagagagaggaagagaaagagaaggacaaagaaagaacaccattaaaaggatgtgccaaattaaaaagtcataatttgcaatacaattcctttaatcaaaaatgttaaataaaaatcttatggttctgttttctcgttttttatttctccaacttctttttataaaaatttcaacacaaaaagttgaaaactgtgcgatgaacgcatatatacctatacatccaaacattcctccattcgtctattaatctgcttgccttatcagatagatctcatatctattcttctgttcatccttctcttaacccatttttttttgaggtgttacgaagatcagaacaaaagtacaacctcagatatagcaacaggcaaaaaaaccaacaaattttgaaaatttgtatttagttcttctgtatccctttgggataacattttcataaaatgaaatgcacaaaacttcagtgtacttattgtttcattttaaataaacattgcaataaaaataaattagctcataaacaccacaaaataaactttccaagtgttctgaagatgaaatcaatgacctgaatccagtgggagatagtgcaaaggaactcagaaaacactaagcattttcatttgtaaagaagggaaaaatctggcaaatcaagaggttttcagtgatatagggcagagcatctcattttaacaggctgagtttgaatgagtttaccactatgattggtagaatcactgattatcctttcagattcacaaatagcttgttccaattcattctatatatagaatatttatgttgagtaatatgggaaagcattgaaattctactaatttattttaaaattcaacacatgtatggtacattatgttatagtatggaataagatacacatgaataagcgataaggaagagaactaaagagtagagagaattatcagtgtaatgccgtaaggcagtgttgttcaaactggagaccaagaataaatgaaaaatggacacagtcttaaacgtatataaattacgtgtaaataaataaatatatacataaaatattacataaaataaaatagtgcatcatatataattttctagtagtatatatttgtataaatatattcttatacataattatatatacatatatacataacatagtcttataaataatatttacattaatttttatgcagatgttgatttaaatgttttaaactattcttgctcatttgggtatagccatttgatttcagtatccaaatttttacatgtaacagctttttccagacaacagatcacccaaaagaaaaataaacttttgcagcatttctaaccatttgggctatgccttaaaaatctgcatatgagcactgctctttgcaaatcattgcttaagaatgagttctgttttcttaacatttcaacacacacacaaaaactctgaaaatattttaaattatataaatatcctgttgcaaataagcttcctgtgtattagtatgagtaattaaaagcacaaatatagcccaaataaatacaagttcaactgtagctacatctttgctcttaagctcaagagcgtgctttaagttcaataaaataatatcattgttcatattaatgttattaaggtaaacttattcattttgtgaccctgcatttccttcaatatttgttctaaaagtgttttgtatgagagtataagcaaaaccataaaaacctggttgggtaatataataaaaataatgtggcaacaataagagggaacaagattttgatgtttctttaaaagtttctgtatattttacttaagtataaagaaaattgttatgaatgataggaggaaggatttttgtccacctattaaaaaaaactgctgtgaagcataggaagtttcaagcataaaatcaagcagtagataaatgttctttgaacttatgaatttcaaattataaatttcaaccatgctattaaagatattcaacacagtgggtattccttttgctttcaaatttatctaaatatatgagacaggcaaaagctcaatgcaaaaggcatgactttataaaatggatccattttgccaacagctcaaagaatatatggtaatattgtgggaactgagtgaaaattcagagtaggttttgaaatgtgatacaagtagaattttaaaaagaaaaaagaaaaacaaaacaaaaatttctgtatttagctaaaatcataactgtttcctttgcaaactgacataaaaatgaagaagcaaaatgtgtctttagttatatccaagttccaaattcaagttaattactgctgctcctcactcttctaccttttccttcaaatttaaagatgggctttgcagagattaaagcttcagaaaaaaatatgggaaaatacgttaaaaggttgacctgtaaatgaagtggatgactataaaactcgtgagagaattagactttttgtagcagtttattacatgataataccttaaaggagatcacattcagtgatctgcgttgacaggtaatatttaaaattaagtgttaatgctgattaattaggcagatgggtggtagcctaaagtatagacatttttccaatattaattttgatattaaataaatgacattggctcttgttggatattataaaatttcctttacttcaactgtaaaataatttcaacagtgaaaggtataaagtaagatgaaaatttccatcatgatcttacctagagataacttctctttttttgagtcggagtatcgctctcgttgcccaggctggagtgcagtggcgtgatctcggctcactgcaacctccacctctcgggttcaagcaattctcctgcctcagcctccagagtagctggaactacaaggcgcatgccaccatgccaggctaatttttgtagttttgatagagacagggtttcaccatattggtcaggctggtctcaaactccttacctcaaataatccgcccgcctcagcctcccaaagggctgggattatcggcatgagccactgcgccctgcccttctttgttatttttatatgtttcagttatgtaaatatataactgaaagggtaaatatatataaatacatatttactgcacatttatattgatgtatatttctctgcttgtatctatctatatatatacacactatataaataaatgagtcaagatttttaaaacaaaataccataattatttttcagtatcatttgaaatttttcaaaattacttttttaaatttctgcatattcattcagtgaagttgaatgatccaatgggcactctgtattccttcataaactgtgtggtgaatgtgcgtgtgtgtatgtatgtatacgcacgtgtttatgtgttttctggggtttatttccttaaaataaaaaggcaactgtcaagactaaagctataataatttttatgaatcttagaaaatgttgaatttttagtgattccggaaattgatctctatcgatgaaactgctttctcaaatatgtcagcaatgggattcaggctttgcttacaatgtgaaggaagttcttagcctcatttgcacaaagaaggaaggagggctacagataaaaagaactcatagtcttttccatatttttgggtcatgttcactgtaaaaaaaatcacatgatgccatttttacacagcctttttaatctacacatacggcaagctaataattccacaaaaataatttctttcctttgtagccatttaaaactaacagctagaaatatttcttcttccaattattaaaaataagctgtttctgagtcggtgctgactacatttactgattgaagcagccaactccaaatatatcatcttttagtattgacacttaaaataaaatttctccccagaaaaagagttctataaatgatggctgtagaaataggcactgtccaggcagttgttttgtggaagtagtgttgttattttctggtgttttccaagtcatctcagatggtgcgtgaaaatgagatgccaaagaaggcttaaaaaagataccctgctccagcttcagaatgtaagcaaatctttcattccagcgcttaaaagttttgagaaagctaatctaaagttaaatgtttactagcatctctctgattatattttagaaactactgcacaaaaataaaacaaatttcttattttctctgggttgaaaagtgcacataaaatggaaaatgctttttataccactatttccagcagggattttattttcatttgtcatttgccagcctggggtatgttgggagaaggaacaattgatttttgaaaaggtggatttgtgtgaaaaccaaaagttgcgttcaacaaatactactactaacccacatgtggatatatgtgttttttacatgagtaaaaaaaaaaaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggccagtgatgatgagcattttttcatgtattttttggctgcataaatgtcttcttttgagaagtgtctgttcatgtccttcgcccacttcatgtaccctaaaacttaaagtataataaaaaaaaaaaacatacatacatatatgtatggcatatatatatatatatgctatagaaatgccatcaagttaccagtttacttctaaatgtaactgcttaatataaaatatgcatctttttgtagtacctaattcttgcaattcagtatatttcctggcgagaggtagagatgaacaaccctggacagttaccacatatggctcttatggaggtaatgaggatggttgtgatgagaagggtaaaaaataaaaaagttattacaaaacattttttaaggaattttccaaaaaatgattttaatattctctttgcttatggaatgatatttaaaaccatgatttctgtgtcctttaaaatgacttctgatttgtgaattgttctctgtgctccaaacttcttttatttgtccctgtgtttatgctcataaccattcatttccctcttttcccactgacttagcctctggggttgtaatgaacttactcgtttatttttgtgtatgtgtggggttttgtcttttgttttctgagaataaagtatatgagatcttggaaaaaaatcagaaaacggggaaaatcataaattcattaccaaaataatttctgatttggtattatagctctgcaaattacttcactaattgtgttcataggtactatggtacactgtacactgttttgtaacttgctttttagatggattatatcatatttttctgtatcaataaatatgaatttattacatcagtttaaactgatcaaaaacattttaatcaaagtaatacaattaaattgctaaatatcatagggaatcgaagagtttataatcctaaaccatactctttcttttcctagccagctggggacatttttaattgtttctattttcattctttctgtttcagttcttataaaaatacatatataaaattggctaaatgattaaatgttatagtagttctttaattataaattcgaataatatttgttgacttccaaactgcataccccttgccttgtccaagtaaaactgtaccactgtttattctctgtgttgtcaataaaacactacgtgatatctgagtgtctttgtttctaaatttcagttcactcagaatgtatccttttcttcttgcctccaatattttattatgaaattttcaaattcataataaaagtatatagtattcatctgtatacttacctcctagtctatatattttttacatactgtttataattgttttattattttctacccatttgtctatctgttaacccagcttaatttttgatgcatttaaaagtaggttgtagatacaaataaccatcaccctaacacccttcaatacaatgtttacagttgtttttttgacattggaatgtatctgtggtttctctatttcataggatcatagcattaacacctttacgcttccccttacatctccttccgtttcttctccccgtcccccaccagcttccatcatctgtattatacagaatctgtcctaaaaaattctgaagtaggccttaggtattttttgttttttaaagggtcttgttctgtggcccaagctacagtgcagtggcacaatctcagctcactgcagcccctgcctcctgggctcaagtgatcctcctgaatagcagggattacaggcacagactaccatgcttagctaatttttctatttttttatttgtagagatgaggtttcatcatactacccaggctggtctcaaacttctgggctcaagcaatctacctgcctatgcctctgaatgtgctgggattacaggtgtgagacaccctgtgtggccaggcctctttttaaaaataagcctgatagttaattttatatgtcaacttgactgagccataaattgcccagagatttggtcaagcattatcctgggtgtgcctctgtgggtgtttctgaatgagattagtatttaaatcggtaggctgaataaaatagattgccttccctaatgtggatgggcctcattcaatagctgtgggaatgaatagatcaaaaagccaaacccctccgtgagtgacagagatctcttcctgcctgactgccttcaagctgagacactggaattttttttctgccttttgacttcaattaaaacattggcttttcctgggtcttgagcctgcccgtctttagactagaactagaagctatcctgggtctacagtttgccaactgcatacctttggactagtcagcctttataattgtgtgagccaattccttataacaaatctttatatatcgatatatagagatatatattgatatatatatacctatatagagagatatatctatatagatatctatacctatatagagagatacatctatatccatatatagagatccatatatatcctctatatatggatacatctatatatagagagatctctctaaatatctctatatctataatctatatatctataactatatctacatctacatctatagctatatcaacatctaatttgttctttttctttgagaacacctactgataaataagccttctaagttttgtctatcagttgatgctaaaacattaaaaaaaggagaacaactaatactctttttacactaattagaacaatgtaaacctttttgttttattaccaaataatttgtatttcctatgtaattgctgtagttttattttgcatatggattttttttccgtaacatctttgtctgttagtggttttatttatgtatttttttaatatccttagattcatcccacttctgaggtctgacatcaaatcttttcactacatgcctctctttgggaggcttctttcttgctaatccaaacaagaacatctgcacaattgtcaacctggaatttactttattaatctcctggtttggaaacactttttcttggatgttatatttactttggtttactattttgttgtcttgcactaattttatatgatttcttaataatgagtgtatgttagacattttacttgagtcttttcatatcacagtatacctttattttaccctcatatataattaattttcatgtgggcatatatttccagattggaaatcatttctcttcatacattttaaggaatttatacatttgcatctgaaattgtattcattatcttctagaaaccaagagtggacttggtatccatctgattatattttctttgttggtaaagagcctcttttttccctttttattttcatcttctctttctccagtgtttatagtcttatttttatgaatgtagtctaattatttagaacactgtctccgagtatgtgtttatttgggtttgtgttttgaacattgcctccaggtgcgagtttatgtgtgtttatgtttcctatttgagattggacacttagtaaattttctcaattcgaaaactattttccttcagcactcagaaatttttatcaatgattatttccacgattatttcctgtccttggttttttgtgttcttaacctagaattcaattgtttaatgttagaccttacacatcttcaatgtatcatatatatttcactcatattatttattgtcatatcttttggactattgtgtgaaagcaataaatttatattactttatttattggtaatgctcttcattttcaaatttaatacacacaaattgtgcatacctacacacatataccgcagatacattcattttcaggatttctttaagtgttcttttaaaaataatcatattcttattttgtgaactgtgggatttcttgaaactttttgaaaactctaattagtctgtgtttgtgtggtttctttaaattatctcttccttcaggattacttttgtgtttggaatttgagtcttcgccattcataaggcgagcttttcttgaatacctgataactctgagtttcctgttcatatttaagaataaataacctaatttgaagttttgagtttttgagttgtatttattgatcagagttttggcctagaatgaataaaagaatcaatcatttcttctactttcagatattcggttgggggtgttctaagcacaatggtgtcccaacactgtcctaattctttgcaggttacctacagaataacgtcttttaaaattatttctttattgtttacattctggtcattaatgcctatattttatgcattctcaagcatatgggagaaattctgtatatagaatattagttcatctctgtgtttttcctggcaaattttatgccttttctttggaatcactgccaaatctgggtctctttcagagctgtgccttcattgctggagccctctcagtgtaaacactcgcatgtagctcctttgggcttgtttaaacagtcaccaatctttcacctatgtgcaatgttacagaaattggccatcttctctgatgacctctatgccactccctcccatcagaattacgggttgttatttttgttcctctgttataaattactgatgctttccgaagaggagttaaaggtgtttgggaggtacaccatttccctgtaccaaaatcatattaagtaaaacttgcaatcaacagaaaaaatagaagtaattatatgatgaaaatctatattctcaaaatctagattaaaccattctcaacattttgttgtatttgctttactttcatatatggatgatttgcaaataatttacaaacatcataccaattcactacacaatatttcagcaccagttttctgaaaataagaccttttcctgcataaccacattgtcacagtttcagttaagaaaattaattaaaatgcctgttatcacttaataatgggtcatattcaatacccccacttctctctccaaatatctttgtagcattttctttctttgttttctgaacacgaagccccataagtttcaagcattgcatttggattagtgtctttactttccttaatatagatggatcacatatttaaatattaacaatttatttgtcattatcttttgtcatggaactaggtccccattttgaatttttctgctggaatgagaaacttccagacatgtggtctaaatctttattgttctatctgttttactatcgctcttcttcagtctcaaaacatatatggacaaaagcaatcacataaaggtctgtcctacttaatacggacatctttataaaagcagttacagaatcttctgatagatctatacacacattcagatgtaagggatatgtttcttgtacaggatactctcagtacattttgttataataatcacatataagtggtaagacccattaccattcttgaaatctatgattataagtgatgtagaatggtttagtagttagtgattgagatttaaagtaatattgtcactgatttgtttacttacacacagggtttactcatttaaaccagtcaatatgagtataagaaaattttgcgtgagtttctttgtctgaaataattttattatgtacaacacaaactacttttgctagattcttcctggtaaacttataaaacacttagtgtttccttttttgaagttgcctagtttcaagctaatacttattctgagctcaagaacatcatagtggccattatattcactacaaagccattagattatacttaaggtatttatagatgaaagaagatcagacccaaagatgatctataactctgcctgagtaatgttatgcaaattgttctcttttcaaagccaccgaatgcccaagaatatttaacattctatgctagtctactctcctgaggtgactcatttgttctccctagtttaattgttgctatatgagcaagagggataccactttacaaggttaggaattccctctaacagcccaatgtgctttgagaactcccctgcctgagtaacagacccagagctatttatcatctggaaatatttcaccttctattgaagagagcagaaatccatctcaaaaaggcccccatgcatccccagtgtatgccaaagaagctcacagaagaaaaaagaatatttgcaatgctcaagagcaaaaaagcttatgtgctaggatatattacacatcctgttatagaaaaaaaatatgttattcccccaatgctgtcttttatctttcttactttgcttgaatattgccttcatggctacatataaaagccatcctatttcctcagattgtcatattttgcaactttagctcactccaattataatctctcatttcaaagtgtcacaatatgtgaataagaacttctataaaagttggagaggtcactggcttggacccaggatttgggaagaaaaatatgagagaaggttaaaataacttctttcctacttttccaacattgtaaaacatatttcacaagctgggttttagggaaaaaatttccagacaataaaccattcatatcaaattttcagtaatggaatctctattttgaataacagtaaatttgatgtatcatttcaaacaatgtagttatttttcagaatactatataaatgtatacgatttagtctagatttaaaaataaatgccaataatcagctattaataacaatacattactatagttacatatcatttcttaatttattgttagcatttcattatttccaatattagctcttatcgaatattatatactatgttaaatgccttataagttttatttaattttgactaaccactgatatgctatcatgaaaaatctagtaataaaatctttttaactgagttcaaatagtcccaagtgcaaaatataattttaaaaactatatgtcctacactaatttatttgcatatgcacttaataatcccaataaagcagctgaacccaaatctgaactcgaatgtaaaactccatctaacctaatttctttctgttagtctttattatcatagtcacttctatttatgttttattttctcctttatttttttattttaaatacccttttgtttaatggtataaaatgtctggctacataaaatcaaatcaattacgataagataaatataagtacgatttcaaaaagaaaagctaaatctagctaaaaattctaatttttaatacatgcaaagtatacatgatgtattagtaaaatgtaatacattgggagtaaaactttaaaaatatttgatatattcacatttcttatttgcagtatagacaaaatgacctatgaatcaagcattttgttccacagtctctattgttagctgtatgtctcagaaacagcttctttctcaagagagaacaagagggataatgctggatctaaaggcatcatctgaaaaagacaaagatatcaacaattgcaactatttggctttctgtccatcactgagacttttcataatctttccttcataaataggatctcttgatcagaacagaaaagttgagtcttaaatttcctgtatttatttctgactgatactgagggaagtgcaaatttggttgctatgattaaactccttgattgttcttaatgggactattttaataagtcaaacatttttgccatctaagtatattgatgagcgccacgttatctcaaatgtttacacatactagggaaaagcatctgcagtttctgaactctttgtgaatcagtatcactttttcatgttacttcagagatcaatattcagtgcattggttttatttaccatcttttctcccagttgatcttgtaatcatcagaaagggaaaaaaaatctccttcacaaagccctttgcgacaaacttacgtaaataataatctaaggacagctagaaaaaaaatacaccatacaggggaatagatccaaaattgatatctgcctcacctgtatcacctattgtattagtaactgcaaaggtaaataaatagcagagactagaatgtttccaaacgtagtagtgaaaactactcccctcctccccccatataacactacaacaggttactttggttacaggatatgacaatagctctgcaatatcagaaaaatgcctgcctggcgttgcggctcatgtctgtaatctcagcactttgggaggctgaggtgggcggatcacttgaggtcaggagttggagaccaacctggccaacatgatgaaaacctctctctactaaaaatacaaaaattagccaggtgtggtgacggacgcctgtagtcccagctactcgggaggctgaggcaggagaatggcgtgaacccaggaggcggaggttgcagtgagccaagatcattgcactgcactccagcctgggcgacagagcgagactccgtctcaaaaaaaaaaaaaaaaaaaaaaaaaaaaaatgcctacagtagattagaaataaggaaaaattgcttgaattcctaattttcagggtataagaagaaatctaggatatccatggacattcccagaaacatcaaggtttgctaaaaacagaaaattggaagtagaacaaaaaaagcggtgggaaaagcacgtaagacattgaggcaagccatgaggagtttgtcagtctaaaggttgaatagaggacctttaagaagagggagacaaacattaaattttcaactttctgtagtttgatataatactttccacgttctagggtttcattaaaacttcacaagcttttggattttttaacaaatattagggctgtgcttcatgcttgggttaatatggggtgaatagaaggaacagctggggaagaagagataagagacagattctctagtagaaattaggagaaacgtaagaatcctatacatctgcgtatatttgaggagtctttagagttcactaaagttcatggattggacgttatagccattttaatgtattttcattgtgacaggattgactttagaaggcttaagaattttgatgaagaaaaaaggggaaaaagaaggcataatagagagaaaggaaggaaaaaagaaaagacaaaagtgtagtcacaagattgtcaacaataagaattgtataagaatacatattcttcaagaaatgaaaataattagaacacacattatgcctaaatacgttttaagaaatcaaataaacatgtagtttctaatggaagtgcttcaatgtattagtaaattcttcccacaaagcagtttatctatttattgtgaaagcgattgagttttgcagtaccaagggatcttttgcttttaaaccagttaattagtttttattagatgcaatgcaatgttttgaccagacttttctctgtactttcgggtgtgtttccctattagcaggtaaaacatttatctcttgactaaaagtagatgacatctttccccaaccatgagtcctcaggttgttacagaggctgccttcctgactcactctgtaccccccattgcctctccctgagtttaaaaaggaaatgattaattagtcaaaagaatatgttaaaaatgtaacatattatgtttaacataagtaactaatgattagtcaaaaagaatatgctaaaactttaacacattatgtttaacataagtaactatattaaaatttagaatatatttatgatttccaaatcaatggtttgtttttgcaaaacctgcaccagaatgaaatgaccctacaaagtggagataatataaaatcctttttttccactgaaatttgttttagatactactaattctatcagtggctttctcttacccttaaatggatgttaacttagttgagagatgtgttcaattcacaatatttgataatggagcaatatgatacatttatatcaaatccctttgtgcaatcttattctttctctggctgatgtacacttttccaccacctcctatttaatttgtatccttctttctgtcatttgctgtggatttctatcagagttggtctaactttagaggtcgaagttttcttttcacagggatatgaaattagacacaatcacaccatatttagtgatttctgtgttttcaccagatcaaacacagatcacatggtccatgctcagtaatggtttaatgaactaatgaatttataaaggaatgaatgcatgcacatatagcaagcccatctttaaattttgttgttgttgtcgtttgaatttttgtttggcatatagggtgtatacaacataaaaagagttaaaatccatgatcctgagtatcagatatttgtgggttagaatccgaaacccatcacttattacatttgcgttattgtgtaaattactgaatttcttcatacctcagagtcttcatatgtaaaatgtagactataatatttatatcataaatttggagaatactgtagagaatttggcttcacagtttgttttccttcatttctctcccttcatatccaaataagcccagtatagcaatattcctttctatttatattaacttatataaatgtgcatgagaaaactgactggattcaataagattgtagaaaaagctatcaagcttctatattttgccaggcaactttctaatggctttatgtgtctaaacccactttaatactcagaaaaacactatgattacaatccttctattagcattctcatgttgtagatacagaaattgagggacaggcaggctaacttggctcaagacacacaagtaaaaatattcagagcagagattaaaccaggtcatctaaccccatgtgtctttgggactagcatttaaactgaatcatctcacttttaatttgataatacaatgccattaacagaaaaaaaaaaaaacttttgaaatatcttgagagaaaaaaaccaaaaaagctgaatctatgttcagagaattgaattagcaatagatataaactacccaagttttcgttttgtgacatcaatttgagcaaagccagatttgtattaccctgaatgcattaataacaatagtatcattgaaaaatactttcgactgcccattagtaattgtactaggtactagaaaacacaatttagtaatcgctcccagggagtcagttttttgaataaaatatttctctatggttgtgcacattgtgccataatttgctttgaaagacataaaatccatcatattaaaaaggtaatagagtaactccatttaataacagaaatggttattaaaatatctacattctttctcacaatgaactaataactacacagatttgtgcatgtgtatgaagatgtttatatgtgttttatgtgagagaaaaaaatgaaaaaatggtattttcttttgctcagacaagcacaatttttgcaaaataaatacaaaataaatacaaggccaaatatatatatacatttatatatatatgtttgttatatatataggttatatataatttgttaaatatataacatttatatatatgtatataaatctcaatgctcttaacaatgctcataagaacacaatctgaaattacagtgcctgcttattttcaagggtggtttgaaggtgacctattttttgtagcatccattactgtggggattgcttagtgtgttaaagcatgaagctgccttaccgaagtcttttatttcctttcctcattctatagtaactacttcaaatggatttgaatgtgtaatatcacaaatgcagaaaaaataaatacaagaacttagcttgttttctttgcattatgagtcaagtttttttgtcaaatttactgctaagaattaatatctcatggtcttatatcctgtaatagtatcataaatattatcttatttgcataataatttatacataatatttattttctgccccatagtgtgaaaatgagtaatcttaatcccaaagataaatattaactatcctgtgtaagaaatgcagtaagttacatcttgtttctaaatacaggttagtgagagatcatttttttaaagctctcattataaacacattaagaaaggaatcattctcagagtttacttatttcccaataggttaataggattcccaagaaactgccaaagagataatagttccattttgactttaacttaaaagaaaaaaataaaataagaaggcaaaaatgcaaaaacgaaaaaaatagatgtcacagatgctataacttgaactttgactgcttttagcaagtatatactattgaatgcctgactgaaataaattgatttcaggctgttgcatttttaaaggtcagaaagttttttgttttgttttttaaatgagtttcaggattatgaaagcaggtgcttaagtagagattgattgaggccttaaatgttgaatatttcttttaaagtttggttgcttttcagaagctactaatttattattattattattaaggttctcctaatgattcttggagtccatggaattatgtgtgtgcatacgtgttcgtagaacattttcttaaaactgacacatgaatgttattgaccatagaggtgcattatttccgagattaaaaaaaaattagttttcttactgatcatccactgttttttacaatttttccttctccatgtatcgttggttgcttattaaggtaagttacagacagaacttataaacggaatttccaagactaaccagggtccaaacatacttcagtgtattattttacatcataaaacttgatgtattagtccattttcactctgctgtaaagaattacctgagactgggtaatttataaagaaaagaagtttaattgattcacaatactgcacggctggggaggcctcagaaaacttacaaccttggcagaaggcgaggcacatcttacatggcggcaggagagagagagagatagccaggggtgaagtgccacaatttaataccatcagatcttatgagaactcactcactatcagaacgatgagggggacatctgccctcaggatctaatcacctcccactaggcccctcctccaacatgtggatattacaattcgagatgagattggcggggggtggagggtggacatagagccaaaccatatcactttggcttactcaatactgaactaaatcaaaatcaaacctgaattttcaattatgactgaaatgtaacctacagagtagtaggaagtattctacaaccgactcctagatttctctcccctgagtgtccatatcctgcataatctccaggactgtcaggacaatggattttattactatgcttatgctatgtcatatgacacagttaatcttcaaataagattatttgggtgggcctaaccctatcacatgagacctgtaaagcagaaagttttttccaagtgtaagaaaaggaagtccaaaacacatactccagccagcttggaagaaagcaaatacatgtgttaaagctgtggatgcagagaagcaacctgcaggagttgaactacctacaccccagctcacagctggcagtaacaaaggaaacctcaatcttaagagagcaaggaagtgtcttctatcaacaatatgaattatcttcaaagctgcttcttccctaagagcctcaagagacgaacacagccctgctgacaccttggtttcaatcttgtgagaccctgagcaaagaactcattcacactgggctgaatttttgcctgcagaactgtgagttaataaataagggttattttcagctgctaagtttatggaaatttgaaatgcagcaatagaatactagtacagataaatactgaaatctaatatttgcattacttcatttaaaaagaaatcatgccttaagagtaaagagaatttttatttctcggttatgtgctatagttctctgatacattttaatttgtttgcttatttatttttccctgccagtatcctctctccactatttctggttgacacttctgccccttcgttttatcagtgttttgatacctatcctctctgtgaatacagtgatattggtaattactgtattttgtcccttacccacaggctgagcaagagtcttaggtctggccaataatcatgggcagctttttagaaaaaagagtagttgcttcattactcagatggtccccacctcatcttgtgcactggacaacgtaatagagtcccttctaaaaatggagaaaatagagactacacacaaagggagacagaggtaagaaaattaagaaaagaagaaaggagttctgacaacatcatatcaattccaacaagtattcttgacttttccacatacaatgtactcatcagtctcttactctgaatttgtttttgttactctaaagaacaacaacaaaaaagaaaaacaatattcggcctaagtgacccccaaaacacaatttcctactttcttttccatgcaactggcatttattgaatactcattgtattcaagtttcacagatttggaacaagttcatcattatgtccccagaggtaacctgggaagagaaaccttgttccacatcaaagtcagtacagcaggttttgctactgcttcatcatttatacagttggaaacaactctgtttcttctactaggtcaaagtgaaattgagaggtgaagccggctgggcttctggtctggtgagacttggagaacttttctgtctagctaaacgattgtaaacacaccaatcagcgttctgtgactagctaaagatttgtaaacacaccaatcagtactctgtaaaaacggaccaatcagcactctgtaaaatggaccaatcagcaggatgtgggcagggccaaataaggtaataaaagctggccacctgagccagcaacggcaacggagtggggtcctcttctacactgtggaagctttgttcttttgctcttgctgctgctcactctttgggtctgcactacctttatgagctgtaacactcacggtgagggtctgccgcttcacacctgaagttagtgagaccaggaacccaccagaaggaagacactccagacacatctgaacattggaaggaacaaactccggacacaccacgtttaagaactggaacactcaccgcgatcacggcttagtgcttgaagtcagcgagaccaagaacctaccggaaggaaccaattccagacacaaaatgtcagccaatccaaacttatgaaggagggaagtctgggctgttgatctagtgtgtagtgagctcagtatagaggacagagctttcatcatgtaaattgatatgcaaagccaaatgaaacgtggtgtgtacttcctactgatgcgtcagggtataggcctctttttctgccattcaaataatggaagttaattaaattttaaacaaatgtatagattcattagttttactgtgctccatgccagtattctccaactcagccatcctaagcattttttaaaacaggggatttttgaaaatgaaagcttagcagccacctcattatactaaatgtctgtggaaaaatgcggggccagggttcagtttctccccactcccctttcccaattcataatcataggcacatacaggaagtatcaccgtaattcacagaacacatttaaatcttctgcttgaaactttgtggtaccactatttggctactccaagctaacctctctcctatccttttctgagggaaacgctttgtgctcaacataatttttgtttcattccaagttttgatgctgattgcataaaaaaaagcccacaactactgctgtatttttagtttaaaacaggctttatttagtgccttataaaatgttgagtacttttgcttccgtgatcatgctatgcttacagatataaaaattgccacccattttatgtcttgaatccttccctgagtagtcggcataacatttgttggttctgagtacacgttggtgctaatgaagcttgaaatttattgaccttctcataagaaggagaataatgagatatttgagcagtcggctcaggtacttataagttcacacacacgtttttttttttttttttttttttttttccaatgcctgcttgaagtgtagaccatgtctttctcgtactagaactatttctactacgattcttgagctggccattctagagctttgcacattccttgtctgaagggatcggccctcgccatgccagctgcctcccaaccataggtagctcctaaaccaaattatacttgtgatcaggtattgcaaaaataatgttagtgtaatataaattggtaagaagaaagtatagattttaaaagaaaaccaaatggtcttcatgcatggcttctgttggcataaaatcaggccgctggaactaggaacttccttagagaacattgtttcaattacttcatttcacaaatgaggaaattgagaatcaggaaggctaagtgatttccccaatatcttccatagagcaagttaattacagaaatcagaatagaaactgggttatccagtcctctgcccagggttctttccattacaccaaataaaattacctgctgctgtttgggctagatggctcattataggggccttttaatgtttcataaatcaaaatattatgttcctataaaatttaaaacagttaaaaataaaacaagttttgttttctgatggtttcagataaaatacattacattaaatggatttcatatgtaaatgtgttaccgcatttatatgaggaaaaattccaccagaaagcattaggaactgagaattgatggctgccaggattagaaaggatgacatcaagttcaagctccagtagcaacacagaaaaatataacatggagtaaaattagtagatagaagcgtcattatctgacttgggtgtgtttgaagagaaaaatgtaaatcaaaagaaatgggattatttgtttattaataatgacattaatattttctatttgaataattgctatagacctatgaattattttatagatattatcttctttgacattattaataatcgttttcttcttagcaatcaagatgagggggctaaaccttgggatattaaagtatttgtccagcatattgcagcaaacaggttcagagtctgggaacgaaactcaggtgtcctgactttgtctcaataatgcattttctctggttttattttaaattttactgtaatctattttagaagcttttcaacaatgaaaaagaatactgttcctccaatatttatccctgtttaaagggcccaaagttgtggccatgaagaagcagtaaatgatgaatattttctgcacttcacatcttttatcacatgttatatattgtggggcataaaattttatgaaattatagttacatgcctgaaatggattttaaatctcttcattttctatgtcaaaagtgagagctgtaaacctgaaaaattaaagctgcagtgtaatttatcttatccataaatagtttactatacattacacagtttgaagtaaacaatagaccggacttaaaaatgatatttctccatggaaaactatgtgataaatactagagatgccatgaatataactgaaattatatcacttaaatatagacagaagattctctactttctacttttaccttctttctctcatagtcaaaagatatgaaaatgtcaaataatatgcatattttaaagttgtttgcactgcaaatagataagcgaaatcgatctgcaaatttccaagctaagagatgattatatctaaagtaattcacctgattatttaggattgcctgtaaaatctacaatgattttattcctcacaatattgttttccaatttggggtaggagctaaaagttattgtatgacatcaagtgatttgagggatgagaatgtgtttccttagcaggaaaacttgctgaaaagaagagagattttttaaaaagttcttgctttgacctgtctggatcagatggtttaaggctacaacacgaggccaatatctgtatgtgaaggagacagaaacatcaatgtttggagtatatattgaccttcattcttactttgtcgttattctcttatgtaactgttaatttttcccttccttggctctatgtatttaattataataagctttacctacaagcaaaacaaaccaaacatgaacaatgaaaactacttttggtcatgtagaagaaacagcagtcaataaaggagagaatgaaactagaatcttttttaaactaaatctgagaaaagtgtaagctttcaaaattttaaatatatatatacatttgcacttcagtgatagtgcaattccagtccttccaccacagatcatgtgtagttttatctattagcataatgttagttttctcttgcatcttatgttgagtttacgtagtacagaggacacaaatagttccctgcttaaaatgagaactaatccttttgtgttattaataattacaatatcaaagtttacattaaaatttttaaaaatgtctgtacaaaatatcagaaaaatcagccttcttccttataattggctgggtaaagtttcactgatgttagatctttataaaatattttaagggtcagcattttaagcagaatagcagtaaatagttccttacataaaagcaaacttaaacatatgacagtgtcttctcgtgtgtcatttgaatgagggaaccacagctggtctcctgagaagctgttctacccttcattgcatgatagacagtaccctaggctctgtctttctttgttcttttccttctcaagggaaggtttcttccttcaaaatgaggcatagataaagagggatcttatatttactataacttatgcatgtttaattgttttaaaacacaatacagagaaaattaaataccacaaatgaaagtatttcatcttaaagtttgccttaacggtctccgtttccattcacagtgcttagaggtgaagtgcttccaccatttacaatttgcagcaggacatactggcaggaaatctttattaaagcaatagtagccctttccttttttctttatttattttacaaaccaacccttagttactatgctttagctgagacttaccaatttttcttcaagtatcaattaaggtagacatattattcatcatgagagaattaccattcagtattctctgggtgctttttctcacatacttttatcttggtcttaaaaatgaagcaccaacatttaaaaggcaaacatgagaccatctcttctgacaccaccattgtatctaatattgtctgattcaaaatgtgggtctaaaagcaaatgaaaattgactttcttttccaactcggcacacaaacccattgaactgtcccttcaggtttgatgcgctatcagttaacactgcactattttcacaagaaatatgatttgatctgagaagaactgcagcagcctgaaacatatattcccagatcatgtctctcagagtaccgtagccattaaatgtcttctataatgttcgtgataaatctgagtattagtgaacaatatctgttaaaggcatctctttggaacttcaagtctagtgtacaggtgcgcatctgcaatgggattttccagtcataaatgtcgataggtcaatctatcaaggttttcctcaaacaagtatatatactcagcactagtgaagttttattttttagaatttattttgtatctctaggtggatataatgtagaatatcacttaaatgcatagactttaaaatcaactgcctgggtttggtgctatgaccttgggcaaaataattaactttgtatgtgtaaaagggaaataactgtggcagttgggagaattaaataaaataataaaaaattaagagtttagtacaatgcaaatacttttgcactactaggcattacctagtatttccttccacccatttgtgtctagtttctttttcccatggttgtttgagccgatctgctcatttgctgttattaatgaagttcagtcacagtgtagaaatgtgactcctgctatttgctttttcttttcttttttcttattaaaattattttgtacagatggaatcttgctatgttgcccaggcttgttttgaactcctggccttaagctagtctcttgccttggcctcccaaagctctgggattacaggtgtgagccaccacactcagccccatgtgctgtttcttatgcttaatgttttttggttatttgtttttatctttgacagcctgagccaatatctatgtgtactaggaaaatgccacatagaacactgagcctggcatcacatcagccgttggcctgagtgcaaatgatatctgcaagaccaaacagataaagctatatgtgtaagtctcagaaagagcaggaggactcaactttggtgaacactttatctagttaattcaacaaataagcaaggggtgggactcaacctcttcattcttactgtagcaatctggaatcagtccatcaccatgactgtttccaggtgtaaaatgacataattactcattaatctccacttagaaagtgtgtattgctactggctggaaatactgcagcaaccaggaggaccttcacatttctaccatgtggaagaattaaagattattacattctgtcttcaagtgatgatcggatagtgcacaaatattttacgtgccatacatgtaaattcagccaatgtgcaatttagtttacaatattcttcagctgcaaaagggtacttatactttctttaatatctattcagctcgaaaaaaagcctatcatatctattaaaatcaatagactttttactttgcatttgttgtttacttacattattagaaaaaagaagtaatcagtgctgtagaaaatttcattgatgcagttttccttttcctgaatattttataaattagaaaataaaggccaagacatattaaataacttgcccaatcctaggtagctggaacatagggagtaaaaacacagacgtgacttcaccctctaaatttgtcaccattaattgttgtagctttcagcaaatgattacttcagaacattaaatcataagacaatgagatacactatctttgatttcactgaagctagtgaacatctattttaagcaatgtctttaacagtttcttagccttttgggatctgattgcaaagttgttaatgagcatgacagtcactgctagaggcctacccgatatcccgtccccctcctccttattaatagaatccttccatgtcacagcatgtatcatcaatggctgtattttgcccaattaaaatgctcactcctcccagaatgcctcagagctagagtacacatgtgactccatttcaccttatgcagtaaacatgggaaaaatcttttggggctttttaggaaaagtttttttaattattttattctattttttaacttttaggttcaggagtacatgtgcaggtaaattgagtgtcatgggggtttggtgtacagattatttcatcacccaggttataggcatggtacccaatggctagattttcattctgcaccctcctccttccctctgccctcgagtaggccctgcctgttgttcctttctttgtatccacctgtactcatactgcatatactttttgctgcttttttttttaaatctctcccattttttcctttgtcttttccatggcttgcccaaataatgattagagatgcagaaactggtttacgatcataaaaaagaaagccacatgtttgattgagaaattaaaaggtccttttttgatgttatcatggagttgctgtataagacccaggatgccaatctttgggttgctgtataagacccacgagaaaaataaatccctctttaagagattataattggatttccattctgtgctgctgaatccaaatctgacctaggaaattactaggtcagtatttttcttcatgcagcagtgtttatacttgtaaaagttatttatgactttataggaagaatcatatcagtgtaaaacatatgtaaaagagagactccaaaactcatttagtttgctctatactagtcagtaaatttaaaatgaaaaatattccaaacatttttattgatagtcatttaattttgtatttttaaatgacaaatgaatactttatgcaaagaaaacttactatgaactctctaataaataatgaaacaattattttgtaaaacattttaaaaagacaagaacatttaaagggaaatgatctgtattgagaatacagagctacccttttgttacaaatcaggtaactgttctatatactattttgcataaaactgctataaagtttgtattttaataatgcagttttccattttgtaaatatattttcttacaaaatatgagatacatttaaaaaatgatatttattcattggatttattctccatatcccttctaaaatataattaaaattcaattaaatcatttacaaattgtctggttttaatttatctgattgagcatctgtaaataatgtgtttgagcaaaattcacttttttataaaattgcaagtatgggtatcttttagggacatgtgggtgactctttcaatatagaagatcacacaaaatttggccataacatgtcacatatctccatagcctagagacacatcatgaaataaagtatttcattagcctgctgggacaagattcagtgtgcacagcaatatggaaaaaaaaatcaatataacgaacattttcataagctcagatttcctgattaaagtatgattctctgaagactgattcaaaatggatataaatataaatactttctcactgagcactctaagagaaagtttggaacacattctattttgagcattataaattgtgctttcaaaaatgatatagctaaagaaaattatttaaacaaaaaggggcttttgatttagtggatatatgcctaaaaactgcatagttttcactttaataatacctgtatgggaaatatatatgggtgttaagggatcttattgccagagaatggaatttgcttttataaatttatgaataattcttgccttatataatatatataaaattttcagtatgatgcatgtatattaaaatgtataaaaagaactataatcgtcacattttctccaagcatttatgtgaacaacatgtgagctagggagagaatcagaggtttatttaactggaattagttaatgaagtcatctgtcaccgttaatttcttgccttgctattccgttatcaaagcaactgaaatgatcttaaaagccaaccattacaatcattaatactcaaagtaaatattacatttatagatgcagtaatctcaagcctagcactttcattcaatcatagattctatcatatgaagaaagccaaagagacaatttcagagtaaacattgttaatggaaattacgttttgaaagggcctcaattacattggcagtgggccgtcctctgagcaccataagaaaatgtaatttcattgaataattctagtgttgcattgactggaatcaaaaagtgagtaattcatttgcacttataaaaggaaaaatacttcactaccacacagaaagtggagaaaaagcacactggactgtgagcttctaaagggaatatttccccaagacccatcttcatagtcaataaataaatgtttatttgtttcgtttcatgaaagaataaatgatcagcaggcccccgcttccacaaaaaaaaaaaaaaaaaaaaaaaaggatttacatttaggttaaattccagaagtgtaatactaagaagtgtcttttttaatttaaagcttcatgctatgttaaaacgtttttggctcaaaattgtcttctttttttgtcccatttctgtctcagcactttgaaatagtaatttagttttacaaatggaaatgatttgactaagaacaggagggtctgatgctgaaaaatcctcaaatcctggatccagattcaatgtatttatcttgatatcagtgaatgagaatacaaatgtacgcattaaacctcagtccatttctcttccgttcttctaaaacagccacccattaatttcttacctctgttcattattaagcagaacacatatggtttgcattttcataagacgcttgtaaactattccttcctcatgctgtttttctgtagtaattgtcaaagctagttatgaagccactctcagtgcatagaaatcctacactgaaccccactggagaaatgaggggactagtgtacattgttagcaataggaaggttcatatttcactcagtcaaacctaaatccttggagtggccttcaagttcctacactttctggcccctacactcattctcactgtttccttaacctcatttcctattactctcttctcactgttcatgcacgctgccctgccacctcagggagtttgcactgctgttcccatacctagagagctattccctagatatccgcatggctaattctcacttctttcagtccacattgttgctgaaatatcaaccaaattgagtattgttgtcaatcccactttattctgtattacaggtatgggggtacatgtgcaggtttgttacatggatgtattgggtaatggtgaggtttgtgcttctaatgtacccatcacccataaagtaaacattgtacccaataggttatttttcaaccctcatctccctcctatcctccccacttttagagccccaatgcctattattttcctctttatgtccatgtgtactcattgtttagcttccacttataagtgagaatatgcagtatttgatttttccagttatttcacccaagataatggcctccagctctatctgtgttgctgcaaaacacacgattttattctttttatggatggtatatgtaccatattttcttttttctttctttctttattgtatttatttatttattcatttattgagacagagtcttgctctgttactcaggctggagtgcaatggcgcagtctaggctcactgcagcctttgcctcctgggttccagcgattctcctgcctcagcctcctgggtagctgggattacaggcacctgccaccacacctggctaatttttttgtatatttagtagagtcaaggtttcgccatgttggccaggctgatctcgaactcctgacctcaggtgatccgcccacctcggcctcccaaagtgctgggattacaggcatgagccactgtgctcggccctagtatgtaccgtattttctttatccagtcatccattgatgggcactgaggtagatttcatgactttcctattatgaatagtgctgcaataaacatagcagtgcaggtgtctttttataaaaatgattccttttcctttgtgtagatatacagcagtgggtcaatcccattttaaaatgcaacctgctttgacctcaaacgctcttgatctttctaattgttgtgatctacttaaaaaaaaaaaaaacccactggccattttctaatgtattgtattaaaacatttttacctgatatttattgtttctttatcattctactggaccttaacttctatgagagcagagatattgcctgttttacactgcaaatatacccaaaccactcaaaacagtgttttgtttactgccactattagatactttttgaattaatgaatttataatcagtccttcaattattttttcctaaattgcctgaaattgtatacctagtcaacttactctcctactctctgcaatgggttttcaaatgtattcaaacttatggttaccttagaacttctagtgccaaccctttacctttgcagcttataggtcacctttgtgctcaggttggctcaatcctatggaaaagctttctatcctctttctaccaactactaaagctttttatcattttcttttggaaacatatttctttggcttctgaggcatcccactgacctgattttctgtctcctcatctggccctctttatcagtttcctgtgcatggttatacttccttgccccacttattgggtaactctatgtctgtgtttcaggccacctctcttcttttaattttttttttaatatagatgggggtctcactatattgaccaaggtggtcccaaacccctggcctcaagcagttctcccatcttggcctctcaaagtgctgggattacaggcatgagacactgtgcccagccaagcccacctctctgcttatttgaaatgctttctcgggtaatttcattcatttttacagcctcaatccttattaatacacctaaatatccctctcatctaaacttctgcttttaagttccagtctattgtttcagtctctacccagatgtctcaaaactttatgtctataaatgtgtaaataacaagaacttgatctatttagaaattatataatagtaaacattactcataatttaactgtgaaaacaccacagttttgaatcttatgtctgaaggctttagtgagttcacctatagatataacatttacaaactaataggtgagagattgggctttgagtcagatattggtttgagtccatgctctgttctttttaacttcattagttttcttatcttctctatttctcagggtcctcatctgtataatctgatcactgacagtaactagcacattaggtcgctctaagcatgaaaataggtaatgcatgtgaagtgttcacactgtaacaaccttgcattaatccctcagaacagctttttattattattaaaattagtattatgttttattttcctgtttatctcaaattataaactttataaataatacgagtcatttcctttaatattggcctatgaatcataaacaaataattcataggccaatattaaagagaatgaactcatgttatttaaaattatttatttacacttttgacaataaaaacagaattaccaaccagttgcattcaagtcactaaattaattgttttagaaaatctctattcttggattgcataggaaaaatctagtgtaacagtagatagcactatataaggaaaccaataaaggtaataaaagacagatcctggacttatcttctcgtgtattaacattaaatgaggatgataacaagctcaagagatctgttatacaacgtggtgaccatagttaatagcaatgtattgtatagagtgcttgaaaatcactgagagtagatttcaagtgttctcactttaatatctggtaagtatgtgaggtaagccatatattaattagcttgatttagccattgcacaatgtatacatagtccaaaacatactgttgtacaccataaagatatacaacttttttttagttaaaaaaatagtaaaatgatgatgacaaacacagaccaggaagtaatagtgtggcttccactaagcctattttagaaaaataaaacattctgttgtttgtatcagttggcctgcaaaatccagaaaaattattcctgtttaaatcataacactttctggtttcatttaattccactgttattgttaggttgagaaatgtaaataaatgtatagagatgcaaaccgaaaataacagggactaaaccttctccccatggtttcccaggaagaagatggtgaagttagaaattcttcctagtttcctttcatttatacaaaatcacacagtagctaggctatataatgttttggctgatgatttcaatgcctgttacacatatcattttgttattttgtggctttcctagatttttttcattatccttcatctgtctattttcagttgcaaaggaaatgtttgtgttgtatatgtgttgtgtacatgcatgttttgagattgagagaaaaagagagagacagacacacagggacagaaagagagaaaataggagctcatatggattttgtattcattagaaggcaagccccatgaaggtggtagacgtcctgctttcctcgctgctgttatttttgtattatcttggtgcttttggcactcaccatatatttgttggctgtgttgtgaaatgatattccctgctttcggaattatgaggaggagatgagttacttataaaagcacttagaattctgctcacatgaactatacaatttttttttttttttaaatggagtctcgctctgtcacccaggctgaagtgcagtggcatgatcttggctcactgtaacctccacctcctgggttcaagcaaatctcctgcctcagtctccagagtagctgggattacaggcgtccaccaccacgcctggctaatttttgtatttcagtagagatggagtttcaccttgttggccaggctggtctccaactcctgacctcaagtgatccgcccacctctgcctcccaaagtgctgggattacaggcgtgagccactgcacccgacttacaagctccttaagttgtatttttattatgaagaccctcaagtttcacagccacttgaggtttgatcgtatcctttgttttatctataaatttgctcagagacttccctctccatctgtttgtgatagttttgttgggaactcatttccatagaactttatctgagggaatatttgaggactgggcttagggtacattcctcagcataggatttgggtttgcatgtcccagatatctgggattgctcctgacctgcgaccattttaaaaccacatttgggactttaaggtcttctgggacccttccccagtgtgaaggagagcccatggagaagaattctgtcaggagtcctctctttcccttctctacacagaacagtctctgagacagtcatgattatcttccatcctcttctatggcgtagaacttgcttaattttttgaatgttttagtctcatttaggggtgctaatctaagctctacctggactatgtggccatagtccttgtttactgtctcacacttgggtgtggcctattaaatctcaaactctgcatagatgggaccccagtggtgtacttctaatgccatcaagagaacatgatgcaagaagctgaggcgactaatataccctgttcttacactctggatctaccaccactaaggccatgttctttcaggcttcccagctaatgaataagcgaaacagaattaataacgccagctcatccttgtaggatgtgcactcctctgactttggctacaggactcaccatctctctggccaacattaatgttttcagagctgccctattatatgagggccttcctgcacgtcctacttccattcacaaatttcagccttgcatcaaaatccaaaggctcttcctgtcttctctggcaccttcccattgatccttcacagaaatttccccccaaatttcttgaacatataattataacttggtgattagaactgacgagtaagtagcaaacactaatctaggacaagcatacttttcaaaaggaatgttacttgttgattctatcttttaagaatttactttacattaacatcaactcaactgtgcagtaaaaataaataaatcattaattttgacatttttatttttaatgttatgtattctagaagaaagtttgtagttggcccggcgcggtgactcatgcctgtaatccctgcactttgggaggccgaggcaggtggatcacttgagtccaagagttccagaccagcctggccagcatggcaaaacctcatctttactaaaaatgcaaaaattagctgagcgtggtggcggttgcctgtaattccagccatttgggaggctgaggcaggagaattgcttgaacctgggaggcagaggttgcagtgagccaagaaactgtctcaaaaaaaaaaaaaaaaaaaagaaaaaaagaaagaaaaaagagaaagaaggaaagaaagaaagaaaagttctagtttctcgttttaagagaaatgggtcagcactgtcttttccgtatcaacataaaacaattgtgtgggctctttgactaaaactaaaaaatgtatctgagaaatttatatactaagttatttttaatcttgatgaactattgctttaccatcatattcgaagctgtgttagtagtggcctaattttccagaattttgatgatgcatatatgtgagtatatcttaagctaatgaaactaattaatggattgtaaaattttctcttttgcttctcccttttccatgccagttttcacataaataggacaatatcttcttacttttcctgtgatcatgagaatgctggactaagaatttatgggcattaaccccccatctatttaaccacctatattacatgtgtccctgatgtaacctgagcaaacttagcaagtcttttattctgggtgaatgccccgcttcacccaaatcatgaatgctgtttgcttcatggaactctattgcttttgttcccagaaccaattatatcttagctaatctcttgcccctttaattatccttgatagttttctgaataaaatatgcaatctgtgaacactttattagtcccactctctggtttatccattcatgggtaaggatacagaattgtctgaatccagcttattataaattcattattctcatttgtgcccaatgacaaaattttccttgccctgggtcaacaacattctcagtcatctcgactatttaactgtaaatctcaaactatgtgctgtttagaattatatgtgcctatcccactctgccggacgtatgtgttcttttctccatgagatttacatcctgtaatgctctgattcagaattttggggcccaatccctattcatttgtgtcttaacagtctttgaagggatgtttgacttcaaggattccttgaagtttccctctgagcaaaggtgagatgccttttgattcatgcttgcgtcattactagcccaggtttagctgacttttttagtgtaggatttgcaattaacacacaataaaggctctctgaacttcagtctcttttcgagggaaataaccataaacatactgccactcagtacagatggagaggttagtgaaaataagcagcatttatgaaggcatgccagaaggactatgggccagccattttctctggatactggaaattcttcctgtaatgaagccagacctgcatagagtattaattaatactcaaccacacaaaattcagatcttacagaagtgcttttacaaaatatccttacaaagactcagagggggaaattacaagaaaatattctgtgaaacatcagattatttacttaaagttattgttgatggccattattttctgtactcttagaaaaagaataatgagagatattttcttattatgcagctaaaaggaatagttttgccttttattgaacaaaacaattgtgtgtatgtccatttaacttctggaagatctgaatcatgtaattgtgtctgtttttttctatttgtggatagacagaacacttagagccacatgtggaatacactgctagaaactaattcttcttggcatggactttgtatactaacttagtccctggtttcaaagaatttttatttttctttcattttgatgtcctcatctaattaattttattttatttcattctgttgggttatatgcaattataaggcacaaagtcttactgaaaaaagaacatgaaataagcaaatatgcaaaaaagattaatattctatgaatagttcatatctcatgcttatacataactatcaaaacacacacaatacttgacattttatacatgttcagcaaacatttatttaccaaatgaagaaaactagggattggaaaacaaagctgtttcttcaatattttttatttattaaaaactactactagagtttgtaatcctggctgacttttatctcaaaagagtcaactctgtattattgaagtgcagattaatggtttaaatattaattgcatccaaaatttacatactcttatataattaaaatatacactatatttctgaaaattttctttaattattaacgattgatttaaacaactagagatatagaatatatatgctattggaatttctgattagcaaattccacttggagtctgcaatgtacaatgacatgcaaattccattttccattgtttgtattgtatttttaaacatcaaaagaaaaaatgtttttaactttaactctaatataattgttgtcaaataagtgaaagagttgttagactttaaaaaaaacattacaatagtgagaaacagaataagttatttgtgatatgaaagagaaaaatgataagttaatataattttaattccagttgagttaagaaaatgaaaaagtgcatcattgtcgcttctacttgcaaatgatatttcttctatttttaagagtgtaaaatttgtctttcagttgacagtgagttacaggtgaaaagcttttactctgatgttttacagaactgctaaaatgtccatgtgttattctatggagaattgtaatagagtttagtagtatgaaagtgtgaaagatgttttttaccttaatatatgatatttacttggttgagttatataacattcaaaaatagagaatttggagcctgaaaaccttgatttcagtttagcctccactacttactggatttgtgaccttaagcaagttatttcatttttctcaaactgggtttcctcttagatgaaaataacaatatctaccttcctttcatgtgatttattgagaccaaattggagtaatagatagtataactagaacttggttttaagttatttaaacattatttactaggtaaaacttgtgcctgtataaaaatgagaaactttatctctgaatgcagatgccatgttttcattatttgatagagataaataaacatggaaattgtattacaatttataccaaactgcaaggggccaggtgagtcaaccaaattatacggacatgtcaaaacatgctgttttactttgttttcatactgctataaagaactgccagagactgtgtaattcataaaggaaagaggtttaactgaattacaattacgcatggctggggagacctcaggaagcttaggaaatcatagcagaagttgaaagggaagcaaggaatcttcttcacaaggtggcaggaaggagaagtgccgagcaaagcagggaagaactccttataaaaccatcagataacctgagaactcactcactatcacaagaacagcaaggggcaaaccacccacatgattcaattacctccaccaggtccctcccttgctaggtggggattacggagattataattcaagatgagatttgggtggggacacaaaacctaactatatcacattgagtgaatgcatgcatattcttaaatgcaaaaattgtaaatacatatataaatagataaatagatgtttagtggaatgtagatttctctaaatatctatgcaattttcatgaatttgaggtgcaggaacaataacattaagagtgtctaatattatctcagctcatactggctgtggtgtagaattcataaaaggaaggcagattaagttcccatttcttagctattcttaatataaagcagttttaaaaaccctggttataggatcctatgagacaagccttaaaggtatctgattgatttagatataaatgacatatgggtttttttcttattgtgaagatgttttcgtaaatctcatctttttaaagtgtctcttaatatacttctctttttaacattggcttctagaaaaaaataatgaagtaagaaaagaaaagggattctacatcttgagtgagaaattgccttataaaaatgaacaaatagaggctgggtgcagtggctcacacctgtagtcccagcactttgggaggctgaggcaggcagatcactttaggtcaggagttcaaacccagcctggcccacatggtgaaaacccatctctactaaaaatgcaaaaattagccaagtgtggtggcatgcacctgtaatttcagctacttgggaggctgaagaagaagaattgcttgaacccaggaggcggatgttgcagtgcactgagatcacgccactgcactccatccagcctgggtgacagagcaagactcctccgtctcaaaaagcaacaacaataacaacaaaaacaaatagaataaatgaagagatttgatcttataattggttggaatatcccataacactgcactgtttatgtttgcacaataatgaaagttcattgagtacatgttcactgacatatatggatcctcagaaatatatatcttaaacatatgatatataagtatatataaatgtatactcatacgcataactcagatgtatgcaaaggcttcatatatctagaatgtatattgtgtgtattctatataatatgtaatgaaggttgatagacataaccttttcttgatggtgtaggttaggaataattggttcatttagggtagggcagatttcacttgcactgatatggacaaatcagtgttaatgacagaatgcaatagagtcatcctgctatgtaaacagaagcatagataacaaataatacaaaatatgataaaattttacctcattcataacatcatttatctgaccctttcccacaatttatctggcctatctgccaccacttaatttaaaaaattacagtgattatatcatgactgctttcaaattctcactgtacaactctaaaaacatacacttatttgatagccttgaatttcagccgaaaaaataataattataagaggtatagactttaaaatatatcatatttgtgcagaatattttaagttataaatatgtatgcataaggcctagttgatgtaacattagtatagatgctacaaatgcaagttcattaaagaatattaagatattcttccctgtaaatctaaggaagcaaaacaatgggaaatttctcaaagatttaaagcaggagatgaaacagggacaaactgagtgtttgctcaaccataattgtgaagcaatcagtttaattttctcacagttgattttgtttaattaggagatgacattagctaactttgcagttctacatcgttggaaaaaggaaagaggaggttttgacatattgtgcctttactattaaagaaatatcattcagtgagttttttgtacacatttctatttgtgtggtttttttcactgaaaataatgcttttaaatttcagaatacaacagcttaacttatcacatagtagagatatacatattgtaccaatcccttttaaaattagtgctaatgtagcatgagggaaatgtaattcaacaagaaaaatggaaatttacatttttatctctgaaactgaacactgattctccaaaaatcattttcatcaataaaatctgccaaaatgtgttgaatatatgcagcatttagacaaatgtcaccattatttcttgcccagacatggttcaaggcccatgttcatcatgtcctttgttatatcatctaagcacattaagactgcaaatgactttcagctatttaaatacctaatcatgatataatgtccatggctttatagagtcccagcgtaattttgcatatattcttcaactttgttcttttacagtgaagtaccgtgacagatagttataccagagatttctgaaacaaataatcagtatacattcatctggcttaaaatatcatattgaatgttcatagatggttaaacaaagaggaaagcaaacaaactattaaaaggacactttatttcctatcataagcattacatgcctataattagtaattattttttaaaaggaaaatggactaagaaatttgcataatatctccctacttggtagaaatctgttatcatcttattaagtaggacagcatcatagttacacaataatctctttagaaatatataaagttgattttctattaagatatggctattggctattagctagactgaattagattattaacactattgttttgaaattgccattcactgatatttggggatcactgaatacattaggaaacggagaacatcatgatagcttcctcaaactgtagagtatgatctttctaggtggccagtgtaacaaaaggaaataaattaattaataggatcataaaagtgtacacagaacacttttgtgatgcttgctaatcttaattaaatgattgcagtaaggtttatgtaagctggtgaaagccatatactttgtaatcttttctgctcccatttatagaatcacttatataagattttttttgtttgttttttttggagatggagtcttgttttgtctccaggctagagtgcagtggtgcaatctcgactcacttcaacctccgcctcctgggttcaagtgattctcctgcctcagcctcccaagtagctgggactacaggaatgtccagctaacttctgtatttttagtagagatggggtttcaccatgttggccaggatgatctcactctcttgacctcaagtgatctgccctcctcagcctcccaaagtgctgggattacaggtgtgagccaccatgcccggccttgtataaggttttaaaagttccccaatttagccttcactcagtataagaatatcttgcacagcaactcttggatttatccagttctactctagtggtttattctcttctctgaagtaaacctttgcacttgtagataattctaatgactaacatcttgttgtgctagccaaatgagtcagccattttccttcaataactggggatattgagactacatttattgatcttgtttaatttctgtgctatactccttctgtcacagcttgtttctatttctatgaaaaatgcctctgccccactcaaaggaagacaatagcatctttgtctccactctatgacccaccattacaaactcaagctaactggatcaagggtagactcctgagcaaatgttggccaccatatcaactcagaccatagactaccttgctttgacccttgactcattttttttctctccctctcacctctctttccctgtccttccccttttgttcctactcctttgtcttttgaacgttggctgacagaccaccctgaaggcttacaaaaacagctcaaaaagactgttctgagggttgctggcaaagaattgtaccaatgaccctgaacataagacttcaaaaactgggaaaatcaaactgttgcaaccacaagtgtagtagcaattccagataaagggaactgtaacctgggctagactgaaggtcacatgctcctctctcctcctcaccctatgaaaacttcaatccagctgctaagggaattaactgtttttcagatgctcccttatgtatatcagatgaataaagtctttaatctctatttcattaacattaacttttcttttaaccctgaaaatgattcaaattctggtgaattttggacgaaatcataaagagactaatctcagaaactgtccttctattgaatgaagaagatgtaaatgtgggagccaagaatggcatgcagctagagaaagggaaagggttagagagaaatattgacagtaagtcgatgcagagacatctgagctgatttaatttttctactaaaataccagtttccctccattctttttttttttttttgagacagttttgctcttgttgcccaggctggagtgcaatggcgtaatctcagctcaccacaacacctgcctcccgagttcaagcaattctcgtgcttcagcctcccgagtagctgggattaaagacatgcaccaccatgcctggctaattttgtacttttagtagagacaagatttcttcatgttggccaggctggtctcaaactcccgacctcaggtgatccgcccaccttggcctctcaaagtgctgggattacaggcatgagccatcgtgtccggctgccttccttttaatatttagtccaggttatctgcttttcttggatattaagaaacaataatgtcatttcaataaatgtgtttgctcttgttgattaaattagtttgaagtacttcaatttttaaaaccaacagaaactaaacagagttttgaaaagccagtttgtctcaatttccctctctatgataaagacttatgagtgctaaccctaaaaagtcatatgggagcttaccataaaaaatgatagcatacatctttagtattgtataatttcaaaacactttgtactattaaatcttaaaatctgtaagaaaggttatgtgatcttttttggattaatgaagataactgggaaaatataactcaaaaaataatgtgatctctgtgattgcagtgatagttcctattccattcactgtgtgctgcacatacgttggaactttgtattttttgagtggatgaatgaatgggcaaatgcacaagaacatgcacaaatagcaagtaggtcctctgatgtgaggctatacttccaattacaccttggataaagtagccaaggacctttgtttatggttgttacataaaagtcaacaaaacattgttttaaaatatctttccaacagatagcactttctagtgttgtgctagaaatcaatggcaacatttaccaaaatgtgatgtactaatgactagtcctattggtagtgaacaggtgttacgttcagaaatgttggccaggcacggtggctcatgcctgtaatcccagcattttgggacgccaaggcaggtggatcatttgaggtcaggagttcaagaccagcctggccaacatggtgaaaccccatctctgctaaaaatacaaaaattagctaggcatgatggcatgtgcctgtaatctcagctacttgggtggaattgcttgaacctgggaggcggaggttgcagtgacctgagattgtgccactgcactccaggctgggcaacagagcaagactgtgtctcaaaaaaaaaaaaaattaaaaagaaggaaatatttcaatgtttctgcttaaaacatttaggatttctatctatctaacatctttccctccctttctctctccatctatctatggcctggcctgtcatatgtcttgttctatatgttggagaaaaagctgcaactaagacaacatcttcacctttaagtaccttatctttttgtgggtgatacaaaagtgaaaaagcacatacagtatatacttaagaatttttaggcatgattttttttccaacatattttagaaaatgccagttagaaaacaaagatcatattattatcacaaacatcacttggtccaaatgtttatatcccctcaaagtacctatgttgaaattgtaactccaatgtgattttattacaaggtggggctctgagaaggtgattaggtttagatgaggtcatgaaggtgcagccttcatgatggaatactgtcctcgtaaggagaggaagagactagagctctctgtctccatcacatgatgcatggcaagaagatgttgacctgcaggccaggaaaagggccctcgccatgaaccaaacactgatggcacctggatcttggacttccaccctccataactgtgagaaataaatttctgttgttcaagccatccagtccatgatagttcattatgacagcccaagatgactaaggcagacatcttacataatgggctggatgctgcattctttggataaaaccatcaataattaatgatgccttgagctcactgatgagaggaattttctaaactgggagtggcaacctaactgtcaatatgtgtgaaatcaaaatcttccaagaaatgcctgcactaagtctcaaagtgtgtattcttggccagtggctttagtccaatggcactggaccacttactgggcagagaaaaatgatacatagcattggagacgaaaaaaataaaaaagcataggaggctaggaggactggaagaatcttctggaagtgctaagtagtttgatctgattagagattcagatacatgttgaggtttaagaataatgatgctaattatcataacactatggaataatgactgcaagacagggtatgttagttggcttgggctgccataacagaagaccacagggtgggtggcttaaagaagagaaatgagtttctcatagttttggaggttaagaagtccaattatggctgggcgtggtggctcacacctataatcccagcactttgggaggctgaggcgggcagatcgcctgaggtcaggagttcaagaccagcctggctaacattgtgaaaccccgtctctactaaaaatacaaaaactagccagacatggtggtgcaagcctgtaatctctgctactcggggggctgaggcaggggaatcgcttgaacccaggaggcgggggttgcagtgagctgagatggtgccactgcactacagcctgggtgacaagagtgagacttcgtttcaaaaaaaaaaaaaaaagaagtccaacctccaagatcgagattcatgtcaattgattcctgatggaggctctctttctggcttgatgatgctcaccttctcccttcattctcactttgagcctgcacatggagagagaaagaaaaacctctctttctccctcttctgagaggccatcaattgtattgagttatcccccctctcatgacttcataaaatgtcaattaccacctaaagaccttatctccaaatacagtcacattagatgttagggcttcaacatatgaattttggggagggggcacaattcagtacatagcacagggactattgtaaattcctgataagaaatctttcttattaaacaatcttaacatttctaattggtgagtgctgtttttattactattttaacatgctatgatatcatactggaccagggagatggtacagactgaagattccttatctgaaatgcttgggacgagaagtgttttgaatttttcacatttgtcaaattggggatatttgcacacccataatgggatatattggggaaaggacccaagactaaacacaatatttatgtgtcatatacactttgtaactatagcctgaaggtcattttatacaatgtttttaataattttgtgcatgacacaaagtttgcattaagtacttatgtttggaatttttcacatgtggagtcatgtcagtactcaaaaagtttcagattttgaagccctttgaattttggattttctgattagatctgttccacctgtattattcttagggaaagaagaaaggagataggatctatcagaggaagaaatatgaatagagcagtcaaaaatgtgaacaaagcttgatgacctagggaaagtaccgaggcatcaagactacttgcaaaggtggaaaggtacaaattgatattacacggtacagatggtccctgacttaaggtggtttgaactatgatttttcaactttacaattatgtgatacacattcattagaaacttactctgagtactcgtacaaccattttgctattcactttcagtatagtacttgataaaatatgtgagatattaaatactttattataaaataggttttgcattagatgattttcattcaattggaatagggtgagttaatgctaatagttgagtaaaaaatatgtatagattgtgttggcttgatcaatcctaaatgcagctagaaaatgcggttctgttattagagcaaggagttagaatggacatgtggctgtccacattatttatttatttatttagagactaaggcttgctctgtcacccacgctgaagcgcagtggcacaatcatagctcactgtagctaaactcctgaattcaaaggatccttcaacttcagcctcctgagtagtgaggattacagtcacatgacactatgcctagataatttttaaaattttttgtagagacagagcctcagtatgtcacccttgctggtcttgaactcctagcctcaagcaatcctcccgcctcagctttccaaagtgttgggattacaggcatgagccactcagccagccccactattgactttagacatcatattttgaatctggtgatatggtatggctctgtctttccacccaaatctcatgttgaattgtaattcccagtgttggggaagggacctggtgggaggtgatttgatcatgggggtgggttttccccatgtacttttcatgatactgactcatgagatctggttgtttaaaagtgtgtagtacttcctccttcacacactctctcctgcagccatgtgaatacatggcttgcttcccctttgcccttccaccatgattgttaagtttcctgaggcctccccagccatgccttcgtatagcttgtggaactgtgagtcaattaaacttctttttttttaaattatccagtctcaggtagttctttgtagcagtgtgagaatcaactaatacatgtggtatcagctgattatatcatggacgaaataatagagcacagtattggatttgattatcttacattttgaagtaataatatcacaggctgagtatctaaatattaaaacctatagatctaagacatttaaatattaaagcctatatatctgctttctatttaataattttcttgctcaccctatataactttgatttaatttaaaaaccaaatcctagaagtcacctgtgacttttctcttcttctgatattccaaactttatctacctttacatactgtttgctttgcctccaaataatacataaatttacttgtttgtttttagctctattcccatcataaacagatttcattagctcatgtccaaagcagtgcaaaataatctaactggtttcccttcctttcattatcaccaatcttccaaaaatttcacaaagtaattttaggagctttaaaaaataacaattatctcatattaacccccccattaactctttagtaactttcaactatatttactgtagcatccaaattctaatgtctgcagggtcttacattatccactcttgacttctgtgattccatcttgttccactctcccatgcttaccaaccacactgagtattcacattctctcaaaatcaagctcttccatgactcaggccctttatatacacttttcttgtatgtagaaattctcccttcctcacactaatgaactctgcaataagatgtatgccacctggacattttttattttaataccctgttatttcttgccttcattatattcatcatgatttgtccaatgatatgcacacagaagtacttaaaaatctgtattaaataaacatgcaaacatgttgctcatttttgatatgtatcctgtgatgacaatgtggtctctgacttcatcaagctttcattctctatatttatctgtctattatctatatttgtgtgtgtgtgtatatatatataattctctgtatttgtatatatatatacacacgaatattctctctctctatatatatatatacacacacacaaatttctataatgacaggtagaatcaactaaacacttattacacaagaagcagactggtatcaaagtagaggcaaatttactgtaaagataaaaaatgtgttcaaggtatattaaaacaagcttgggtaacctgagttaataaattcattcataaattttagaggttaaatacaacaatggcttaactcacactaagctggttatgtgtttagggctttctagagcattcttccttgtagtaacccaagttagagccaaatttggctcctccctcttaacacagttatgtcatgtcactgatgcaggggacagaagatgtggaagatcaggtgacagatttaaattcacagctcattggccaaaagcagtcacatggccccacctaactgcaaagtgctgggagttgggtgagggcatatggaccattcatgatttgtaaatgttcccactaccatggggaggtgatttgagtattgaggtgaggaaaatgtattaatcaaatggaggataattaataattgagttttagcgacttgaaaatgtatgttactatctttaaaactacatgatacagtgactacatatacggaagataattacatatttatcttgtataatacattaaagtgtttgtccctttttcttccagaatgctacccaataatcctttagagctgcaatgtaaaactgcttatgcttttttggatccaattcagataaaacaaaacaaaacaaaatagcagacaatactcttcaacttaagaaataatttgcattttctcacttaaaagaccactgactatttctaaaaaatctagcatatataaaactactcactttcaacaatataaataacttgaagtatcatcatgcataaaggtaaatttactttatttatctatctatttattcattcatttatttttgatacagagtctcactctgtcacccaggctggagtacagtggtgtgatctcagttcactgcaacctccacctcccaaattcaagaaattctcatgccccagcctcccaggtagctgggattacaggcacatgctaccatgcctggctaatttttttgtattttagtagagacaatgtattgccatattggtcaggttggtcttgaactcctgacctcaagtgatccacctgcctctgcttcccaaagtgctggaattacagctgtgagccaccatgcctggccaaaagcaaattaaattagtacacagaaaatctaaatgtatggactactgtatgccatatatatcaatttagatttttgaaactttgtgttgggtgttaatatcagttaattaatttgtctttatagaaacccacctaaaaaattgaaatactgagtaaatacttttcaacaattgttcagccaacccaactgatactcagcttaaaatcaaaagaaacattactttactatgatgcctaataataaaacaaaaacaaaatcaaaccaccatccctgatttagtatttagaattctcagactctagaatttgattcagattagaatcagaattagaattctcagaatatagaatttacaaaattaatgatataggtctagccatggctaacacaaaatataaatttctggacacaagggagcttactttttggactctttatatttattgataaagaaattagatagatataatatacatatattcagttttacacccagtgtaataaaggaaatattgcaataaagcaaatcataattgtttggtttcccagcacttataaaagttatgttcatgctatactatattaagagtacaatagcattatatctaaagaaaatgcacacactaaggtgcatttaaaaatatttaattcctaaaaaaatgctaatgatcatctcactgaatagccttgccttggatgggcttgacttgatgttgatggttgttaactgatcagggtggtggttgctgaaggctgggttggctgcagtgttacttaaattaagataatgatgaagtttgctgcatttattcactcttcctttcacaagatgttcctctagcatgaaatgctgcttgatagcattctatccacagtaggactcctttcaaaattggagtcaatcctctcaaaccctgcctcccctttatgaactcagcgtaatgtaatattctaaattctttattgtcatttcaacaatgttcacagcttcttcaccagcaatgtttccatcttaacaaatcacttttctagctcattcttaagaacaacccctcattcattaaagtttaatcatgagattgcagcaattcagtcctatcttcaggctccacttctaatttttgttattttgcaatttttatcacatctgtagttatttcttccactgaaatcttcaaccactcagtcatctgtgtggaatgagaagtggaatcaatctcccccaaattcctattaatgttggtattttgaccacctcccacaaatgcaaattacaaacgttctcaatagcatctggaatggtgattcctatccagaaggttatcaatttactttgcccagatccatcagaggcatggcgccaggcacttagtgagggaacaggaatgattatttgcaggtggctaaaagcaacacaaatggggccaaactggttagacatgatccctagtggaaaggaactgttacagcaggctgtgctaataaagacggactgcagacaccctgctttaggtacagatgagaatgtaacaaaaaagaaattggccacaactggttaaatccaagacagcataaaatttgaccaactgctaacccttggtttcgttatgcctctattcccataaaattatgagtaaacctcccattcccatcatgcacctgatgctatgacagttccagattaaccatatttagtcaataaaagggtggcaccccaaatccaggaactgctcatccatttcccagaaaactcttccccttattatagaatattctatgctttcattatgcttctaatgagttagattagggttcagatcaggggtaggggtagggttaacattagggttagggtttcatgctttcattatacttatccatatagtgtgtgagccctgacaacactggatgtgcctcattcttttgagcacacccacactcctgtcttgagtttctatttacttacactccacaataaagtttctacactttcactttggtctcactttcaaattctttggtgcagcaaaggttagaacctgtactggcctaccagcagagcatcactatttagggcagctgtagtattatgaaaggtatttcttgcccattcagtatgatattggctgtgggtttgtcatagatagctcttattattttaagatatgtcccatcaatacctaatttattgagagtttttagcatgaaggtcgttgaattttgtcaaaggccttttctgcatctattgagataatcatgtggtttttgtctttggttctgtttatatgctggattacattttttgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtattaggatgatgctgacctcataaaatgagttagggaggattccctctctttctgttgattggaatagtttcagaaggaatggtaccagttcctccttgtacctctggtagaattcggctgtaaatccatctggtcctggactctttttggttggtaagctattgattattgccacagttacagagcctgttattggtgtattcagagattcaacttcttcctggtttagtcttgggagggtgtatgagtcgaggaatttatccatttcttctagattttctagtttatttgcgtagaggtgtttgtagtattctctgatggtagtttgtatttctgtgggatcagtggtgatatcccctttatcattttttattgtgtgtatttgattcttctctctttttttctttattagtcttgctagtggtctattaattttgttgatcctttcaaaaaaccagctcctggattcgttaattttttgaagggttttttgtgtctctatttccttcagttctgctctgattttagttatttcttgccttctgctagctttcgaatgtgtttgctcttgcttttctagttcttttaattgtgattttagggtgtcaattttggatccttcctactttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaagttgttcagtttccatgtagttgagaggttttgagtgagtttcttaatcctgagctctagtttgattgcagcaaaaactggaagcattccctttgagaaatgacacaagacagggatgccctctctcaccactcctattcaacatagtgttggaagttctggccagggcaattaggcaggagaaggaaataaagggtattcaattaggaaaagaagaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacggacaaacagagagccaaatcgtgagtgaactcccattcacaattgcttcaaagagaataaaatacccaggaatccaacttacaagggacgtgaaggacctcttcaaggagaactacaaaccactgctcaatgaaataaaagaggatacaaagaaatggaagaacataccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcccgcatcatcaagacaaacctaagccaaaagaacaaagctggaggcatcacgctacctcacttcaaactatactacaaggctacagtaaccaaaacagcatggtactggtaccaaaacagagatatagatcaatggaacagaacagagccctcagaaataacgccacatatctacagcgatctgatctttgacaaacctgagaaaaacaagcaatggggaaaggattccctatttaacaaatggtgctgggaaaaccagctagccatatgtagaaagctgaaactggatcccttccatacacctttaacaaaaattatttcaagatggattaaagacttaaatgttatacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcgtctgcacagcaaaagaaactaccatcagagtgaacaggcaacccacaaaatgggagaacatttttgcaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgatagagatgatgtggagaaattggaacacttttacactgttggtgggactgtaaactagatcaaccattgtggaagtcagtgtggcaattcctcagggatctagaactagaaataccatttgacccagccatcccattactgggtatatacccaaaggactataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaaggacaaaaaaccaaacaccgcatgttctcacttataggtgggaactgaacaatgagaacacatggacacgagaaggggaacatcacactctggggacggttgtggggtgggggggaggggggaaggacagcattaggagatatacctaatgctaaatgatgagttaatgggtgcaacacaccagcatggcacatgtatacatatgtaactaacctgcacattgtacacatgtaccccaaaacttaaagtttaataataataaaataaaataaaaaaaagaaaggtatttcttgaatgagacttgaaagttgaaattactccttgatgcatggactgcagaatgaatgttgtattagcaggcatgaaaacagcattaatctccttgaatacctttatcagagctcttgggtgaccaggtgcattgtgaatgagcagtaatattttgataggaaccttattacctaaacagtagctcataacggtgggcttacaatacctagtaagttatgctgtaagcagatgtgctgtcatccagggtttgttgtttcatttatatagcacaggcaaattagatttaacacaacttttaagggccctaggattttcagaaaggaaaatgtgcattggcttcaacttaaaatcactagttgccttagcctctaacaaaagagtcagcctgtactttgaactttgaagccaggcattgacttcccctgtctagctatgaaagtccaagatagcctcttcttccaacagaaggttgtttggtccactttgaaaatctgttgtttaatgtagctacatttatcaacgatattagcaagatcttttggataacttgctgcagttgtagacatcagcactgctgcttcaccttgcacttttatgtgatggcgattacttacttccttaaatctcatgaacaaactctcctagctgcagactttttctctgcagcttcctcatctctctcagccttcacagaattgaggagagttagggccttactctaaaataggtttttgcttaagagaacgttgtgggccaggcatggtatctcacacctgtaatcccagcactttaggaggccaaggcgggtggatcacaagctcaggagttcgagaccagcctggccaacatggtgaaactctgtctctactaaaaatagaaaaaattagccaggcgtggtggtaggtgcctgtaatatcagctacttaggagtctgaggcaggagaatcgcttgaacccgggaggcagaggttgcagtgagccaagatcctgccactgaactccagcctgggcaacagagactccatctaataaaataaaataagtaaaataaaataaaaagagagagaatgttgtggttggtttgatcttccacccagaccactaaaacttttgccatatcagcaataagactgtttcactttattatcattcatgtgttcgtggagtagcacttttaatttccttcaagaactttttctttgcactcacaagttggctgactattctgcacaagaagcctacctttcagcctatctcgccttttaatgtggcttcctcactcagcttaatcatttctagattttgatgtaaagtgagaaacatgaaactctttcttttacttgaacactcagaggccactgtagggacattaatttcaatattgttgtgtttcaagaatacggaaccagaggagaaggagagagacagggaaatggccagaggacagtcaaaacacacataacatttatggattaaatttgccacatctaatatgggcacagtttatggagccccaaaacaattccaacagtaatgtcaaagatcaccaatcacagatgaccataacagagatgataataatgaagaactttggaattttcaagaattaccaaaacgtgacacaaacacacaaagtgaacccatgttgcaaaaatggcgctgatagacttgctcaatgcagggttgccacaaaccttcaatttataaaaaaaaaatcgaatcaaaacaaaaaacaatatctgcaaagctcaataaagtgaaatacaataaaaggatgtatgacaatattataaatagaaatattatataatatatatttcaactacatatcatttatgaacatatatatgacatgcctgtcaactatgtgcttataaatattaatcataacatataatgtgcatatctagttaaaaagaaatacattctgggaattactgatatacagcctataagaaatttttataacctaaagaaatgaaaggatggtattactacagcaaatacctcttgacttcccattatatattaagtgtaggcgattccattttgagaaaggcattctagccttgatccttgcctgtgtggagcttgcatcttaatggaatgataataatatacaaaaaggggccaggcacggtggctcactcctataatcccagaactttggaagctgaggcaggtggatcacctgaggttgggcattcaagaccagcctagccaacatggtgaaaccccatctctactaaaaatacaaaaattagttgggcatggtggtgcacatctgtaatcccagctacttgggaagctgaggcagaattgcatgaacccagaaggtgcaggttgcagtgagccgagatcgtgccactgtactccagcctgggcgatagagtgagattccatctcaaaaaaaaaaaatgtatatacatatttttgtatatatacatatttatatatattttatatatgtattatatatgcatacatatttatatatatatagtgtgtatatatacacacacacacacacacacgcacacacacaaaggaaggactccagtgcagaatgctgaacttcaaggtgcagtgaagcagacagaagagatacctagccttgtcatggtgggacagaggagaacagactgtaagatgggaaaataagaaacattttcccccaaaagcttttctaaaatattcttaccacagccaagaggctatataaacatcttgcttccaaaaaaaaaaaaaaaatggggccaggctgactcagactattattttacattttttcaatgacaaaagagctataattttacaatgagtataaatgtggaaattttagcaatgtattttgttgcaaaatgcactggaatacatacattctgtgagtagaaaatggagctgtaatttattgctccaggaaattttctcattatgtagtctcagcattacaagaacaaaccaagcaaggttggaaataaaatctattgtccaagattttgtttctccacaattatttagacacatgcttgaattttttcacagcaattacctagccctgggttttccattatctcaactttgccaggattaacaaggacttaaaatcgttatccaaaatgttgcagaatagtgttattcataccggaaaggacactgatgtttcagatgagccaattatacaaaatctcatatttctgtgttagttttataatagattgtctataaacaccaatttgaatctgccctgaatggaaatatctaatatgactttggtggttatttgaaaaagagaaaatgcctctgcaagaaatctaataaagtagtaatgaaaataatttaaaattatgtctgtttttctttagtcaaaagtaatgtggatggatattgagtgagaagaagaaaacaggcaggaaaacacttggaaaaaatgaattcaggtaaaacaatccttacatatttttaataaagtgggacgaaccctgtaaatttcccacacagtatgagagcccagtcatgcccaggccactcttcctcacagagccctgtactctccctctttagcacttagcatttctgtcattataaacatgtgtaatgctttggttaataacactattctccctagctggaatataaactccatgaatgtaatgagtgtgaatatgttttcttcctgtctggcaccttgtaagtcttcaatacatatttaaagaaagttgctgggggagggtttgtttttggttttgtttttgtttttgagacagaacctcactctgtcatccaggctggagtgcattggtgctatctcggctcactgcaaccttcgccttctggattctcctgcctcagtctcccaagtagtggaggttacagtagtgcaccaccatgcctggataatttttatacctttagtagagaccaggttttgccatgttggccaggctggtatcagactgctggcatcaggtaatctgcccacctcggcctcccagcatgctgggattacaggtgtgaaccactgcacccagtctatatgtaaagaaaattgttgaataaaagattagaacattatttcataggtaacagaattctagtaatgtctctggagttactctggcttatttttttctatattgtaaggaaaaaacatatgatgcacggtgtgtttcccaaaaataccatactaggaactgtggagacatatgccttgcagcgaagatcccacgaccagctgaacattcctgctctgtctgccttcatgctacactaaagatgacaattaataaaggataattttctagtctcactcttttacaaagaataggacactattcacaggctggtgaacaaaaagtaaatcttatagaaaatcaaactttcatatttgaaaaacatttgtgctgtaattcttgaggagtcttccaggtgaaaaaaattcaattgccaattatcgaaataatgaaggaaaatgtgtcatgaagaataaagacaaattattaaaactatatgggagtctagaatatagatcctgatataagtaatttgacaataaaataaagctttttgatgtcctgaataagcaaacaataccaggtacagtaagtcatcggttaacgccattgacaggttcttgaaatctacaactttaggcaaaatgacttatggtgaaactgactttcttctcatcaacgttataatgaaataacattgaaaaaatgacattatttgaggatctgctgtacgttttttcacttcaagttgtggtttctaagaacgtgtcaatgatgttaagtgaggactttctgtagttcatataaagttcctttatatttagtcatgtacagtaatttgctgatatttcagtccctgtcttcattcaccatgagtgtctgggtcttctggaaaattggaatgatttggagttgtggtgtgttcttctttggcacacaaagacctaatcaagtagcaggataaagtagaaaggctatgttattagttattagcagattaaagggaaaaattcaatttatataaattaggtgcagtggccttgggtagttaagttaatttctctggcctgtgtatatatatatatatatgcatgtcataatgttaactaccggcatccaaccttatggagagcagtagagaacagaaagtataaaaacatgtgaaaactgtaaataactacatatatttcttgttttattatttaatacaataaaatagcaaatataataggttgaaaatgtgtctgaaaactcaattaccaagagaaatttttttaaaattagaatatcaatcatcatcaggtgtcctagaactgaccccaatttagaatgtaatattggtgaagaaaaaaaacttttatgaagaggtttacttcttctttttttacacttcacacatacacacacacacacacacacacacacacacacacacactccccagaggaaggtttccaaaatctggtcttgatttaacattgtgaaaaactaagacctttccaaaatcctaaaatgaaacttgaccactgtgtcaaatcttcactgtatttatgacagccattaagctacacatatgccagctgctagaattcattaggattatatgagactctctttgaatcctctgaaattcattgattgattctgattatctcccattcctatcagttaaggttaaactagaaacaactccctacagttgggtgaatgcagccggcattgacatataagggccattaactgtcttgtattatgcatttgtgaaaaaaagcaccttagatggtatgattgctgcactgaactaataatgaaaatgctttttcctgcagcttactgtttatcaattgatacatgtgctcttaccagaggaacatatcaatttttttagccttggcaaactcctccacactgcacctactgcttatggtgattgaatgctaagggtcatgtgaaatgctaaagaggaaagcatcttgctagagaattacatattagtaattctcatctagggactatagacagagttactggacaatagcagagctcatttccagtatggtatggtaatgacaacatgatgagataatccaaaagagaacattgtcaaaactaggaaatggggaccctttcagaaagccataagtttgagaacatttttttcttatggctaactgttcacgaacagacagagagatggaaatctgtcattgggctcagtttggactgtgcgtgtgtgtgtgagtgtgtgtgtgcacgtgtgcgtgcgtgtgtgttttgccaagagttattttggaataattactacatgcagatttttagaggcatgaaaatgttaatgagacttatgtacacagaacatctttctttgtcatctggaaatagaaaatattactagcttttagggtctataaaatttaatcaaggtttaattggtgttttaagaccctataaagatttcatatgaaaatatttttaataacatattcactaaactagcatttcccagacaaaggcatcaaaggacagcatttagataactcatttccttgatttaatacagttatttttcctaaaataagataattttatttttgattacttagaaaatgaatattgatcttaagaagtatggaataaaaattaatatttctttttaatcctcactggtagtttttgttaatcaactctaaaattgaaaatggagagaactgagagtacaaggagaagaaacaaaatttttaaaattagaaaaacatgaataaatcaaacattaacgtagacataagaaaatggcggcaagccgtaaagcttgaaaagcaatacctggtatggtgggcaaaataatgcctgctccacctcacaccttaatactcacatcctaatccctggaacttatgaatattaccctacatgacaaaagagattttgccgacatgattaatttaaggatttggggatagatatattatcctgggttgtcagaggggcctgagcagaaggattctaaagacagtcaaagaaggaaatttgactatgaaaacaaagaaccagaatgatatagcctgggaaagactgtgggccactcgtggcttttaagacagatgactgcatccacaagccaaagtattcaggcaacccttgtttccctgaaaaaggcatgaaaacaaatccctccaagaggccccagatggaatgcagtgctgacaacaccttgatttttttcctgttcagactcatgtcagacttctggcctacagaactgtaagatattaaagttgcactgttttaaaccacagaatttgtagtaattttttacagcagctataggcaactaatgaacccagctaactcaccggtattagaaagtagccttgctagagagtgatgtcagcaagatggcagattagaagcactcagtgttcatcctgacccaaagacaccccaaataacaaacaactatatgttgatagaaaagtgctagattacatcaaaagagtaacaggaaccccagtgagcacagaaattcagtatagccactagagaatgagagaaaatccatggcctccaccacctcattcccgagtcaggatcagctcaaaaccaagaagaactccttcttgggaaaaacaaagcaagaaaatcccagcagtccccatcaacaccttggacacgtacagtactcaaaagtagagaccactgaagccctcatgggcagtaagcccagctgaggaagcttctggagtccataccactgtgttcctctcagagaagaagctgacactgtgccctaccccctgaggcacagtgaaggtactgtactacacccctttggaaatgcaactactgctggagtgtatcctgctctggaggccactggcctaatacccttccatccttgaggtttcactacagcagaaccacctctgcctggtggcccaacacccccaagctaagctgtgatgtggcaatagaccctaccctgtggggccaagcatccctggagccaccccactcccagttgcagctgtgccctctctccctagggggctgagctgaagctgctcattgcctcctggggaaatggtgccttgatgttgctgctgtatctgcccctcccagccactgctgcatcctgcacatcagggcccaggctaaagctgcacaacccctcccaaagaaacggtgccatggtggagctgtaccatctacttttctcaatccttgctgtgccctgtctctaggggcctctgctgaagtttcacattgcctcctgaaaaaatggttgtttgccaaagtcactccatatacttctctcagccaccattcgtgcctaagttgaagcaatattctggctctcaagaaactgggccttggccatccagagcagtcatgcatcagttgacacccagagaagacatgattcccagtcatgagctgaagtggcacatcacctcattaccaaaggatttgtgcctcgactgagctgaggagttgcacctcccaggatcaagttgatgtggtaccccacatcccagaaaaccagaacaccaactaggctaaaatgccctccgatacaggccaaatggtgctagtactctggttcattggagctgcactggcttcctagactctgagatgctgaacgtcattcttcccggggagttaaattatagctgtgacgcttcttgtctcctcctgtccccctgccactgccccaacagggttcaagcaacagctgcactccacatggtggtcatgctgccactgcacctggacttacagagtctgggatactgccgagtcccactatcgcaggatccagggtctactacatgggagcctggttatccatggggataacccttggatctgagttgccactgagccctattggtctggttccaaaactgaagccatatgctgctccctgggcacaaacctccagagtacctcttcttctccagagctgggccctggtacccaggggcaaagtcaaaagctataatctatactcctgaacctaagctactagggggtgcctcagagtcacagaccccagctcttgtgggcaatctacatccaactttgcctcagagggtgaacttgcaccacaagacccagtgtcacaataggttcacaagaccctgagactaagaccctggctccacagccaatcagagcacctacatcctagtacctaatgccactgcaattacttgtaggccctgtcaatcccatcaccaagaaggatcagctctactaaatattcccattttggataaagtgagaataagaggaccccaaaagtaattgccactgaggaccctaaaaaccttactaccagcactgttgccacagacttctacagcctaggccactgaggtacacaaagtcattgctgatgttggtcacaactaaagaagctgcatggaggctataccattgtatctacttgaaatgagtcaccatgccctttccaaccagcacaccaagactgatctaaaagtgaaagtctttatctgtgaaagcctgtctgtaaagtttggaagagatgattattcaaacagatgtgcagatatcaaggtggtgacatgaaaaagcaaggaaatatggcaccaccaagagaacacaagaaccctccagtaataggccagtaataggccgcaaagaaaaggaaattatgacttaacagaaaaggaattcaaaataataatcttaaggaatctcagtgagatacaagagaatacagaaggataattcaacaaaatctgaaggaatgagaaatttagcaaagatagatatcataaaaaagaactaaacataaatcttgaagctaattcaacaaataaagtaaaaaaaaattacagtagagagcttcaacagcagaacaggtcaagcagaagaaacaatctctgaacttaaatataggtcatttgaaattactcagaggacaaaaagaatgaaacaaagagtgaagacagcctacagaacttatgggataccattaaatgcacaaacatttgcattataggattttgagaagttgaagaggccaagataaggacagaaagcttattataataattgctgaaaactccccaagtgtgggaagacatatggacatccagatatgtgaagcttgaaagtcccatatagtttcaacccaaagaggtcttcactgagacatattgtaattaaactgtcaaaaggtaaagtccaagagagaattttaaaagcagcacgagaaaagtgtcaagacacatataaaggaattaacattagactattagtaattaactgaacagaaatcctaaaggccaagagagaatgggatgatatatttaaagtgctgaaagataaaaacatgcgtgtcaagaattctatagctaccaaacttgtccttcagaagtaaaagataaaattttcctcaaacaagtaaaagatgagggaattcatcaccactagaccagagctacaagaaatgcttaagggagttcttatagtagaaacaaaaaatgctaattaaatacaaaaacatataatgtataaaattcactggaaaaagtaaatatgtggccaaattgagaataccccaaggctgttatagtactatataaatcatatatacatatatacatacacacacactattatgattaaaagtcagaacagtcaaaaatagcaatagctacaataacttgttttaaaatataaatcgtgacatcaaaaatataaaatatagggggaaaggtaaaagtctagagttttttatgtacctgaagttaaaatgttatcagcagagaatagtctattttaactttaagatgttttatgtaagcctcatggaaaccacaaaacacaaatatatagcagatgcacaaatgtttaaaaaaagaattaaaacttacactaaagaaaattacaaaaataaacaagagcggggaaaaaaggatctacaaaacaactagaaagcaactgacaaaatggcagtagtaagtccttatctgtcaataattactttcaatgtaaatggattaaattctccaatcaaaaaagtagaatggataatttaattaaaaagaaaggcaaccatatcaaaatctgtgctgcctagaggagacctactttagcctatgtacatataggcagaaagtaaaggaatggaagaaggtattccatgcaaatgataagacatcacaggtagctatacttatataacaaacaacagacttcatgttgaaaacaatcacaagagacaaagaagaactttaataataaatggcacaacttaccaagaagatgtaacaattatatatgcacctaacatcagagtgcctaaatatatatgtagcaaatactaaggggaataaagggagaaatagacaacaataatattaaaggccttcaatactccacttttagcagtggtcagaacaatcagacagagaagtaatgaggaaatactgcaattcaactgcattggagacaaaatgggcctaacaggtatataaaaaatttcttacttagcagcagaatacagattcttctcccatgcacatgaaacattctccaggatagtccatatgttaggccaaaacaagacttaacaaatgtaaaacaaattgaaatcatgtcaagtattatttctgaccacaatggtatgaaactagacatcgatgacaggagaaacttcagaaaccacaccaatacacagaaaatcaacaacatactcttgaacaatcaatgcatcataaataaattaaaagtgaaatcagaatatttcaagagacaaatgaaaatggaacgacaatataccaaaacttacaggaaacatcaaaagcaggattcagaggaaagtttatagtgacaaatgcctacattaaaaaaaaattagaaatatctcaaataaacaacctaacattgtaacttaaggaattagaaaaacagaaacaaattaaacccaaggttagtagaagaaactgaataataaagatcagggcagtaataaatagagacttaaaaaacacaaaagatagagaaagctgtatttttctgtaatgacaaatctgacaaacttttagccagataaactaagaaaataaggcagaaaactcaaataaataaaatcaaaagtaaaaaaggagaccacaaaagtgataccacagaaatgcaaatggtcatacgagactactatgaacaactatataccaacaaactggaaaacctagaacaattatataccaacaaattggaaaacctatcaagaatgaatcatgaaggaataaagaaatctaaacacagggactcacacctataattacagcacattgggaggccaaagtgggagaatcgcttgagcccaagagtttgacaccagcccaggcagcatggcaagactccatttctacaaaaaataataaagaaatttagctgggtgtgatggtttgtaactgtagtccaagctacttaggaggcagaggtaggaggactgattcagcctgggaagttgcggctccagtaagcagagatcatgccaccacactccagcctaggtgacagagtgagattctatctcaaaaaaaaaaaaaaaaaaaaaaattcataatagacctataatgaataacaagattaaaataataatacaatcctcatataaaagaaaagcctaggacctgaagtttttcactggtgaaatctactgagcatttttaaaaaatcaaattattctcaaacttttttcagaaaattacagaggaggaaattcttccaaagtcattctatgagaccagaattaacctgataccaaaacaagatgaagacacaaccacaacaaaaaaattaccggccaatattcctgataagtacatatgcaaaaatcctcaacagaatactagcaaaacaaatacagcagcatattaaaggattattcaccgtgagcaagtgggtttcatcctagtgatataaacatgaattaatatatgcaaatcaataaaggtgattctttacattgacagaataaatgacaaaaaccatatgatcatttcaatagatgcagaaaaagcatttgacaaaattcaacatcccttcccaatgaaaactctcaacaaattagacatcaaatgtatatagctcaacacagtcaaaaacatatatgacaaacccacagctaacatcacactaaacagggaaagaaagtttttccattaagatatgaaacaagacagagatgcccaccttctccatttctattgaacacaggactggaagtcctagccagaggatttagataaaataaaaaaataaaaagcatccaaataggaaagcagaacattcactgtccctgtttgcagatgacatgatcttatgtatagaaaatcccaaaaactctatgaaaaaaaaaaaaactgttagaactgatttacaagttcagtaaagttgcaggatacaaattcaacataaaaaagcaatagtgttgctatatggtaacagttaactacctaaaaaatatttttaatctcatttacagtaactacaaatactaagtaacacaggaataaatttagccatgaaggaaaagagctacacactgaagactttaaaactctgatgaaagacattcaagaggttacaaataagtggaaaaataccccatgttcatggattggaagaatcaatattgttaaaatatctacactacccaaggtgatccatagattcaatgtagtcactatggaaatagcaaaaatatccttcaaagacatagaaaaaaatcctaaaaatcacatggaaccacaaaaaattctaaaaagctaaagcaatcttgagcaaaatgaacaagctgtagtcatcatacttcctgactttaaaatatactacaaagctatagacatggtactggcaaaaaacaaaacaaaacaaaaacagacagatggacccatggagaatgtattagtccattttcacactgctataatgatactacctaagactgggtaatttataaacaaaagaggtttaattaactcacagttctgcatggctggaaggactcaggaaactaacaatcatggcagaaggcaaaggggaagtgaggcatgtcttacatggtggcaggagagagagagcaggaaaagaggaagtgccacacttttaaaccattagatagagtgagaactcactcactgtcatgagaatagcatggaggaaaccacttccatgatctaatcaccccccatcaggtccatccctcaacatgtggggattacaatttgtaatgagatttgggtggggacagagagccaaagtatatcagagaagaatagcacgcatagaaacaaatccacatatgtatagccaactgatttttgataaacaggccaaaaacacacattgcagaaaaggcagtgttttcaataaacagtactgggatatttggatattcacatgcagaagaataaaactagacttctatctctcaccatatacagaaactaataaaaatcaatgtaaggtttgaaactatgaaactactagaagaaaacaggggaaatgctacaagtcatttgtatcagcaaggattttttggatgaaacttcaaaagcacaggcaacaaaagcaaaaatagacaaatgggattaaaagcttctatacagcaaatgaaacaatagaatgaatagacaacttatagaatgggaaaaaatatttgtgaactgttcacctgacaaagggttaatatcaagaatatacgagaaactcagacaattcaacagcaaaaatcaaacaaaccaactaatattccaattacaaaattggtaaatggtctgaacagttattttttaaaagaagacatataaatggccaactgtatgtgatgaaatgcttaatatagctaatcataagagaaagcaaatcaaaaccataataagattgcaccttactccagttacaatggctattatcaaaaagacaatagataacaagtgttggtgaggtagttgagaaaagagccctttacactctttgggaatgtaaattagcacaaccattagggaaaacagtaaggaggcttcttaaataaataaaaatagaactattatatgatctagcaatcccattactgggtacatatccaaagaaaaggaaatcagtatgttgaagaaatatttgcactccaatgtttaatgcagcactattcacaatagccaagatatctaatcaactttagcattctttgaatcaaagggtaaagaaaatatgatatatatacaaaaatggtacactattcagccaaaaaaaaaaaaaaacaataaaatcttgtcttttgggacaatatagataaagttggagggcattatgttaggtgaaataagccagacacagaaagacaaatcctgcatgatctcactcatatgtggaatctaaaaaaagtttatctcatggaggcgaaagcagaaaagtagttaccatcggctgaggaggatagtggtaggagtggtggaggacaggttgtttaacagttacaaatttacagttaagagggataaatttttatgttttgctgcacagtatggtgactatattaaaaaatgatgtattatatattccacaatatctagaagaaagcattcagatttctctactctgatttgatcattgcacaatatatgcatatatcaaacatattatctcataaatatgtacgtgccaactaaaaataaaataaaacttagaagtagcattgccaatgtaaatataagggcatgtctaatcagaattacaaaattagaagcaatgttgagaaaactataggtcgtttacttgttcaagtagtgtagatgttctgattgaattgataatataacaaataaagtggacaatttaaaaataatttaaaaactgacaagatttagaactaaacatattaccaatttaattaaaatatttgttttacagcacatgaaaactgcaataattaattgagagcagccaagtcctgccaccattctgacaaagtagaaagaggcctgaattttaatccaaagattttcattcttgtctgggcagatataatagctactacctttataaattgagaaagtcactggtcatttaatttcttttttttttttttttttttttgagacggagtctcgctgtcgcccaggctggagtgcagtggcgcgatttggctcactgcaagctctgcctcccgggttcacgccattctcctgcctcagcctccggtcatttaatttcttaatgctctgttgtttttcttaatctataatgtgaaaatattaccttccagagaatcaaaatctaaaatatatataaaaagcagcatgatacagtgacacatggttgaaagatgttaactgccataaagtgggacatttttacactacatctgtgatgcacagaattgtctgcattagaagaaaattgttccttatggttcagactcatttattttttctttcatttttggaggtagaaagtgctttccttttggaaatattcccccaaaactggtgagcatctcgtcatgtttcctatgttttatttcatgaaggtgctataaatccacttggttaaatgttggagattcacctgttcagatgctcaggaaaagaaattatgtttgaggatgtcttcagggctagctgcccactgtagtctcagaaatgtttggtggcatctccccaacactttcaagcctaaatcctgaaaacacacactactcagtcacagtctacagaactttctgtttgatgttgtccaacatttaagcaagctggtctcctgaagattcagaggttatccttgtctatggattgaatctagctccaactgtgatgagctattctctagctcacaccctttcagtattattcaaatgtttgcctgctcactctaggatcccttccttaaactttcaattccatgatattcattctattctctcttactgtaacttatagacccttgtttgttttcttatttcttggctgcaggcttttcacctggtaccagatctttttgtttaattttgtttttgctaccacaattcttctaacgttgactaacatttaccacactttccataatgacaacttatttgggaatttaaattataagctcattctgtttaggtctccatacctatattttatatgcaggtataaaagaaaatatgaaagataaaagtaaacacccccccccacatccattgcctaagctattcatcatgcattgagtacatctttctgccaagcactctgctaggtaaaggagattttaaagctgaattcctaacacatgaaggtgctggcatctacttccagtttttacctacctcctatgcactgttgacttcaaaacctaaatctctaagcctatccacaagtccaaagtccacttaatacatccaacttcctactggtttccatttcaaacccaacatacctaaaattactcttatcatttatttcatcttttaactactcagtgtcctacttctaaaattctctcttcatcaaagtcagaatatgtgtgagatggtcacacagagacttcttagctaaaaccagtgaggtaaaggttgttgtaggatatcatggatacttctttttcagttcaccaacatcatccccttcttttgagagacttcatattgttttctccgtatgaatgtgttctatggagggctgtcaagtgggatacttttgtttgcaggggtaggggtgtgagacaggctggacaaatcattgtacccctttttgcctggacacatattggtcatgcattgggtacaggagttaacctggatctggcaaggtagaagtcttttttctttctcatcataagactgtgaggatgaaaatggaataaactaactctatctattgctttcattcctagagacatatgatctaacagaacaaatccatgtacaaagacaaaggcagggaaagaagcaaaaggtaaaaagacttcaaaagaaattgagatagagtactgatgatgcttgtaacagtgtagtacatccatcagtagaccaaaatcattcttaacaaatttatggttttccacaacaaattccgtctttttttgttgtcgttgttggggatttcgagttgtgttctgggcatttgccactaaaatgtgcaagtacaggtaaagatgctaaatatctttttagtttaaaatctagtcatattgaatggcggggaaaggtaaaatgactgatatattgatgacacaggataatgcattcaaaggaaaaaatattaagttgctaaaatatggaaaaataaaaatatcaagtgggggttgggggaagacacaaaagaattgtgagaggagaatgagaatgagtaggaaaaagggagagaacatatattatcatatgcaaagaacatggcaaacagcctaaattttgcagaacatgagaaatacaaacaaacaaaaatttgacataaaagtgtcagaactatttgcagacagagttagtaataacattctacaaataataataaggaccatgagaaaagacaatgataactcagcacagaactgtatggtaccagtagtgtatgcaacaatgatgatatagaaatttagtagaaagattaatccattcatactccaaaaagaaactatatttttattatttatgagttatacattataaagtatataatttatagtttgttgcttatatttatgcctgaatcatctctagagcgactagcatataatcttattacagtgtataaatgcaatcattgtcaacaaattcttaggttgcctcagtaaagttatgggttaaagatccctggctggtattgatacatacatatgctggtgttgatatatacatatgctgggaattagtggtctatatctattatcaacacaattctgatatccagaattcagcaactcttacaaaattatttgtaaaaattatttctattgattgagttttacatcattgtaccatgacacaccatgttatgtcaaccagtgatcatgagtccgcttcctttttccttgcccaggtttagcagcttttgattttaaaatatgtttctagtcctcttcctttttccttgcccaagttcagcagcttttgattttaaaatatgtttctagtcatcttcctttttccttgcctaagttcagcagcctttgattttaaaatatgtttctagtctgtcctattctctccctgttaatacatctaacttcctactggtttccatttcaatccaaacatacctaaaattactcttatcatttctttcatgttttaacaactcagtgtcctacttctaaaattctctcttcattaatgtcagaataatgtgtgagatggtcacacagagacttcttagctaaaaccagtgaggtaactgttgttgtaggatatcatggctatttctttttcggttcaccaacatcatccccttcttttgagagacttcatatttttaaactctgatgtttatgccaaagtcttcatagattctcttcctcaagtttaatccatattcgatgtatgcccatgttgccatcagagagtgctatcaaagtgaaatcgtggtaatttccatccttttatttaaactctctataaaatatatcccattttctacagaacaaagaccaagctcctttccatgcacagaattttgctcatgagctggtgcatttcaaacactttcacatcatttgtttcccctcccaaatttttaaattgtgcttcttccgatattctgaacatgttagagtttcctcaaaagtccatattgatttgtgcagccatactttccagatggatcttcctatgtagtatctctacttttttttctttcctccacaagttgattgcctgctacataaagcgtccctgatttttgtctgaactctccttccccacctatcttcccaactccctagacatctcagtgctgtattggaattatctattcatttctatagcacatctgcaatctaagttttcataataacactcaacattttgtatcatgcatatataatttcaaatatgtgtgactgtgagcttcttatcgtatttccaatgcctaaaacaaaacctgacacacagaggttcacaatacgtgcctaatttaattaaacaaatttagcaatctactggctattattattacaattttctaataggaatatctggttaaacttactatgtctaaaagttagatacttctaaacaaaacaaccattgcatgcattttctccttacaatgtcagttcatctgctatccaattatcaccctgttcagctgcacacacctggagttaatttggtcttggataactgtgacaattttaaactcttttctgtggcacattacaaaaaattgaggaaattacagtctgttctcaatacttggtatttcatggagagtttctgaaaaagctgacaatttggagcctatgattccctggtgagagttcaaccatgatatcagcaaacattgtaagaattttatgtttcatgtgcactgatcttaaaaataacatgttaaaatgcaatattactaccagtgttctcattaagctctgatgtttctcaaagtgcaatcactggaaaatctgattcacaaggatctcctggttaaaaatgtagattcccacatcctatggagacttactcaggctgtcattaaggaatctgaaagtctgctttttaaaacaaccacaattattccaagtaattgtgatgcatattaaataacttctgctttagagaaagtagagtgataataaaacatgacagctgttgtggagagatggacagctcctccttctgcagatggacccaccgggagatggaatccccctcttgccccatccttgatgttatttaaactctccaactctaagcctgttccatagaaggcacttaataattaagagatgtcgttattgcttttttatatggtaaagtcaattctaagaaaaattcacctagattccaaataatactttctttattgagttgccaattttaaataaaatatgatattttaattctatacataatttttaacatatgtaacatgatataaagaatatgatattgggtagatataaatgattccatgtaacattttgttgttgctgttggataaatcaatatggctaatttcaaagaggcaaagatgtttcatcctggctactccagttaaagaacagtgaccttggtcacgctgtattctttctctaagtgttatttttgatatctctgaaataataatatacatgtgacaatatataaattactacaataaaagagtctttcttttatccaccaaaaattattctggctggaatcattttaagtatttctcctcccctgatctttaattttcattaactagaaaaccatttcttctgtacttgcgaagcttaatcaaactaaaaggggagtgaaaagattgagaaaaaaagaaaaagagctggacagccctttcagagataggcaagggtgtaatttgaaaagagagatgtttcgggggaagcacatagatgatttaagaaagaaaacagtaagattttaaaaactattacttgcagattatgtatttccttcataatttccaagagctgaaagtaaacaattagaatattttaacatttcttttattacatgaaatattttcttttaactgcagtgactctctgtgatttaaacatgtgggtcacagttttacacacttcatttaccccttggttaaaatgtgatgaggaagagaggaaacaatgtgtgaaagccttcagcactttgtcctgcacaaagcccaagttaaaaacaacgctgtctattacattttatttttctttgattttttttctctcttataatcttgtttcaagtataggcctcctacatttttcccacaacattaaaagaatgggagttttgttgctgttttattttacaatttattggtttcacttcaatgagcataactggcaacctaaaactatgtgtgattatcttctcctttcagccagtgtttgtgaatattttctcgggaatcgttcacctatgacagcccaccctgcctccctctaatcccctgttcatgctgccacttaagcacttgtgtagaggcacagacctgaaatttaattttgacatttctttgtgcacctacactgagaggtgttgcttatactagtctatttcactcctttgctttctactgagacaagaaatggacacattttactcattttttttgatttgcaagatttgtttttccttaatcaacaaattgtattaaaaacttgttttgacaaatggtataggcattggttgttttctgcataacttttcctgtaaagcattatggagtctcttcttcaggtaaaataaacatttattacatttattaaatttatctttaagtttcctggatcatggtaattggtttttaaattctttatcatgaaagtaggccaaaaaataaaaacaaattaacagcatcaattccaagaggattttcagagcagagttcaaaatctcttaggaatatatcattgtatattttggcatctaatatttatgtaacaagaatattttgcacttaaactacattttaaaagagatgcttaaagaaagttttatctctaatacacttacttattgaatgatgatatatttttttaaatttaagaatactgagggtctctcgttttttttgttttttttttttaaatcattccagataaatgaagaagaatgcctgaagtaccactctgcatttctgatttgttaaaaatatttggcacggtgccttataagtcttgctgctccaaagctcttcacttccactgaaacagaaactccctcagcttttctgtatctgataattgagtaattgtgatgtccttcttcagggactgaattaacatatgtctcaagttataacccattcaacttcatctctttagctccttgaaagtgacatcatgaggatgaataatgtgtgtgacactatgtgccttcccagagctttcaccaacagccaggtctcatttaagagcttgctttactctctgttaacatgctttatgtgccaggaagcatattaaacactgtcaagtgttatcccggctatgcaggtacagcttctgtgtatcacggtggctgccattctggctttctatccagggagactcaattttggactctagttcactgatttcataagtgacctgtaactaatggcctgaaattccccatgctcccattttcttatctttatcaggcagaagacaatagtacttccctctagggggtgctgagataattaagaaaataatacctacatattctccacatggaaagcagaaaacactcgatgataggtgtaattatgactaacgttagagctcgcctcttacatttactcttaccctacctttaacgggtgtttccaaatgtaatctaattttatcattcataagcctgtaccaaagccatatttccctctgccttagtcttcatatctttaacagctaagtaattgtttaaagtcaccaagaatcatcttcaattattattgaaaattatctttgattatttcctggtagctgaagtcatttccaagacaattaggataatcaagttaggctagaagttgaagaacacgacttgtttttttttaatttttattatttacttggttgtgctcatgtcctatgatgatgtagtttttactctcctccctggtcaagggcattttttagtgctttacttctctgtatttgatttttaagctataatatagagcgtctgctaaacactagaaatcctactctttcaagaaacttttttagaaacaccatattcacttcatcatcacctcctcttaacttcttcacctactcatattctataaaagttataggtattttctagagctagaggaaccagtgagcttattgctccattatttctcacattcatatatatagatatctggtagagatttgagttttatatttttgaaactagaaaacttttaactggacacctctcatttagtttcggccttctaagaagactagaatctacctttgggtcaggctttttcttagttcttaaaagaactaatagaatggcctactttagatatgcagatatatggtaaagaaacttcccactgagaagagggcaaaattttataaatgaccattttggcaaagatctgcccatgtcttagcttatattgactgttaaaattagattttacctttcttttatctatctcatctaaaagtttgtaaaagagcagaataattttatggcagtaatatggagtctattgatgtgattacctgtgctgaatgtatgtacagtctctgattgaggccaaaaggtcagaggttaactggatctctgaaaacaaaagtcaccataatgattgggaaaatcgtatgttaaagccaagaataggctacaggacagtgatactgttttagacttagaatgcagttaattccacaatgggcatatcctgggcaaaatagctgcatgcaggtgtgtgatttaatagaattataacaacgtagtcataacctttaaggcccaggctgtataatttgtcatccaatttgacatccaatgtcacccactttaaaaatacaaatggatgctgttaataattttaccctaatatcaggtgtgtaatctgatattcaactggattattgctgagaagaaagcatcttcctttgcatcaggaggagcagctctagccttggaaaattagtagagtcctatgctgtagatcagttggtccttgcacaataaagagtgggttgttgcagtcagcacttcactctctgcagaggcagctgcaaagaagactttttcatgacagctgcaagccacctgagaaagaaccagccattctgctcacctggcatacagggacttgtttcctaatgatttcaaaatagcaagtaagagtgacctgattttgtaaatctatacaattgaagcctaggacttaatgggagtatgttgaaacctgcattttcattcctgacaacattctactcttctaagctcatattttacttttgtcctaaaagtctcacaattcttgctcttttccatttctctaaatcttatttgttcttctgaactctcccctaggaagcttactgtattgagaacaaattttttttctgtaagtaattattttacttaattgaattggattattcccatgctcagttatctaattattaacttaatagctgctcatgagcattacttgatcaaaaaaattcacttaatattcattcattcattaatcaagataatacatgtattaataaataaaatcataaaaataaaaacataatctttaaaatatgaatatgactacacttcaaaacttaccaaataataaaaattaagtaacaatatcttaaatatattgaatgccccatataataactaaaggttggtatttaatcctatcagtggaggcaaaactaaaaagtccttgacaaatttttagttagtgcatgtttgcacatattgataaaaatacatagtcataaataatacttttcaatttgaatttaaacattgatgttctaaaatataaagtcttttttgcatttcttctttgaaatacagaattttaaaagtttactatatatttgcaaaattttttagtacattttttattgtaatgaacataaataaggcagatgttatataaaatgagtaaatgtttaaaccaaccaaggaaaagcaaatagggtcttttaatgggtttaaaatttttctccattatgtataatcacatttatttaatcttaattgtgctacaagtctctatggtcctgatttgtttgttaacataaagtatatatttggttttgacctgaattccctaatatattgttaactctgaataaatgttttccatctgtgctttctaatagaaatcattgtaatctatacaaagtgagcttaatgaattctagtaatttttccacttaatgactatgtatctacaattatattctactattgttccaaacacatggatacattttgataagagaaggagagcttggaacatgagcatacttgtgctaggagattcttggtcaactaagaaataatcgtggaaatgagaatctatgtcttcgttgaacatagatagattcttcctatatgattcttttgttcaaaggaatgaaacgtgcagtctggtaaatctagagatctttctgtgaagcgcaaatccctagatgccattcagaaatactgcaatttctaaactgggcaaaaaattatggattgaaggtagtacagcaacgttaatgacacttggctgagaatctacatatattatcccacatgtggattcagtaatccccatgataaccttatggtttcctactttacagatgttttgtgtttttcctactttacagatgaggatattgaggcagtgagtttattccaagccggaaaagagccgacaattcttccattgcacctgctgttatttttttttagaggacccatttctgacaaccaacatctcccctaagaactttgaatctttcagacacaagatggagtgagcagttctgcatgttcacaaatgaaaacaccaagtctgtgatcctgttgtgtcacttgtaattgtcttaataaggctcagcattttctttttctgagtagtaaggaccaagtagtaagcattttaggtgttatgagtcttacagcttctgtcataactactcaacttcaccattgtagtgtgaaagtagccatagacaatattgaaacaaataagcatgtctgtgtttcaataaaactttatttacaaaaagaggcagcaggctgaacttagtctaaaagccatagtttgccaatcacttatctaaagttgtatttgaaaggctcctgaaaacatttatattttcctttattgcccaaaatatttacctggaattccctgatcctgaaataaaggacagcatgagcaggaacagccattaagcagcgaagcaaattaaaggatgctcagcacttgtcaattgtgaggaaaaaaaaaatatgtgtgacttagattctttatccaaactcaatatcagaatctctcttccctcccgggggtgagggatgggggaaaggaacagactcgcggaagggagtgaactctgtggagcctgtctattcaggtacagggaaactggggacatagatttctcaaaaatacctggagagtaaaatggctttcctctatcctctcctcctctctattacttccacttaaaccacgagaatggacatttgctacttgaaaacccacgaaagtcagatatttataatcactcaattacatggaaactcatagagtgtttgcatagttttcatggagcgatgatgaagatctatttgcttacaggcagtggagcagctaaatatgtcactggcatctctgtgttctccagagaaccaaagggtacgtgaggattcacaatgaaagtcgctcaaaaggttttaatcaaagggaaaaattactgagagagttgtttcaaccatttcttattatctggtttattttcaaagtttagttttccttgtattctatctatctatctatctatctatctatctatctatctatctatcatctatcttttatttatttatttatttatttgatggagtcttgctctgtcgcccaggctggagtgcagtggtacaatctcggctcactgcaacttctgcctaccaggttcaagcaattctcctgcttcagcctcccgagtagctgggattacaggcacacgcctccatgcccaggtaattttttgtattttagtagagacggggcttcaccgcgttgcccaggctggtctcaaactcttaagctcagacaatctgtctgcctcggcctcccaaagtgctgggattacaggcatgagccactgcacccagccttctatttatttttaaagctataccactggttcttcaggcatggcttcataaggtactatttgacatgtatttataaaagtacaaatgtatttgtccccagcagtaattccttgacatttaaaaatatattgaaaattttttggaaatctttaatgatactgcttttagagggatctagtgtatttttgtatatagattaccgcgggtttttttttaatctgttaaaatggcccctattatttcctaaatttccctttctttcagtctcttaagcacctttttaatgtacaaagaaggaagagaggaaggaaaggagaaaaaaagaaagaaagaagaaagaaagaagaaagaaaaagaaagaaagaaagagaaagaaagaaaaaaaggaaggaaagtggaaggaaggaaggaagggagggagggagggaggaaaagggaggaaggaaggaaggaaaataaacaaaaaaaaggttgactgattgtatctaacatatcatctttgatctcacttttatttttgactgtagttttaaagccagggttttagatgggttcagaaactcttattccttaaataaaagaatgcctcttcaattattttatatatgttaaattattcctagttcccatgtgcttcttttatgatactacacgagtacagctgtagacataagaaaaacattcagttttttttatttgtagacagctatgaagctaaggaagaatttttaggaattatctctgatcatgatcaggtagtgaataagaaagataggtttaaatattttcctagttgctcaaaaggttttaatcaaagggaaaaattactgggagagttgtgttttcaaccacttcgtattgtctggtttattttcaaagttcagttttccttgtactctatctatctatctatctatctatctatctatctatctatcatctatctatctatcatctatccatctatcgtctatctatcatctatctatctatctatctatctatctatctatctatctatctatctatctatctatgtatctacttttaaagctataccactggttcttcaggcatagctttaaaaggtactatttgaaatgtatttgtgaaagtaagctgacttagtcaacacaacacaacacaagaaaattccattgctccaatactaccaattcttgcctgaacttataagtctacacagcagagaactgtttttatggcctttagtatatcattggaaaatatcattgcacaattttaatgctcaacactttgtaaacaacatttttaattatctcatattatttatgatagatggctgaaaatatcataaattcatgtgaatatttccaaaccgcctcatgttatttcaaaattcaatagccctgaatacttggttaagtttaaaaaaataattctgtataaactttccactccttattactgtaaattactcttgatgatagtaaaagtaattcttacattttaatgaaagaatgaggttttcagtacaattttagagaggtttatgccaaacaattattattatccagtggctgagagacaacttatcttctattatttaggtaagaaaatatgtatgtatactagagaggttatatttatcaagaaggtaatttgtagaaaccaacatcactaagagccaggaatggacttgggacatttattcatataattagtgtcaacaagattcagaatgaaaaaggatgtgagctctaggagcatatgattttgtgtttactgcaaacaaaaaagaagaacaaagaatgagttcatgtcctttgcagggacatggatgaagctggacaccatcatcctcagcaaactaacacaggagcagaaaagcaaataccacatgttctcactcataagtgggagattaacaataagaacacatgggcacagggaggggaacatcacacactggggcctgttgggggttggggggcaaggggagggagagcattaggacaaatacctaatgcatgcgggacttaaaacctagatgatggattgagaggtgcagcaaaccaccatggcacatgtatacctatgtaacaaacctacacgttcagcacatgtatcccagaacttcaagtaaaataaataaattaattaaataaaaacaatgagagaaaggcaaggaactgtattgactaagcaattcagtaagctggcaaaggaagatatttaaatgatttctgacattactaagtcacagcactatgtggtgatgcttcagcaagtcaacacagtatacaagattggaactcaattcaccacaggtccctcaggttactgagggttttgtatagaaagccctgcaggttctttttttgagacatatttttaatgatgtttatatagcaaacaacattgaaaaattaagactgtatctttttccaaagcaaagggccacatgcttctacccagtaaaatagagaaaatgtcacgctccgaaacaaaggagaagagttgccagagctcctctcctatcatgtaacccactacatgtactggaatccattaggcctatctatctgctttgcccctatgttacttgaaggcaatgggaactgagtccattctgttaagcacattgtgctatagtaaaaaaaattcctttctctgacccaaacatctcatgtcttctttcagcattcatgaaattgtggaagacaaatagttcttgacattgacataaaacaacaaaatgcaacagcactctttaataatgagtataagtatgtactaaaggtctcctctaaggtggttacactgatatatgttatgtaggaaattttcttatgaaatttctgtgggaaattccacaggtagaaataatatgcttccttaatagtaatttcatatattatacagtgtattgattaaatgtcaggggcaataaattaggtcttgcctcgtgaacaatgaaacatatatagttagtaccttctgtaacagtggttttacttttttcagagtcaggaaagaggaatgtttctctcatatatgagctacgtttaaattttaccaaaagaattcattcgtattcaaatataggtttgaatggtataaccatggcatatagtcatgaattcaaagttgtcagaagatgagaatattaaatttgaaatccttatcattctgctcactcttgtgcactctatttttctgtgttatctgtggcctttctcaggattcttctgaaaccatcccactggggttcatttcttatcacctggtataatatacaaattgtagaatttcaacaatattagcccacagagagtactgtcttccaagaaatccaactaatattctagagaaaagatttctgacacatgcatgcacatataaacacagacacacatacacttattaattgtactgtgtggttggtgaaaaatgcacttaagatatttctggtgccaatataacttgtactatgtgacactctacattcttagtcatatggattgacatgtgcataagtgctttcacgtggctaatgattatgagatctagaattagaatcaaagcttatcctcactttaaagtaactatagtcaggcagacatccataaataagaaagagatgtggttaaaagaaaaggaaggattgaaagataagtaggcataggttagaacagcaggaggagagaagaaagaaggaagaaaaaagaaaataaacacagtgctcaaatcttagtgttcttcgttacttttgaaatactggttttaggtattcatatattgatttaaagatagttgaacttcattcaaggtcccgccaattcaattaaagtaaacacattgaacctttatggcacagctattatgaaataactagcatattatgaaacagctagatgcaataaataaattgtaaaggagagagaactagcatacaatggacatggactatttgccaggaacattagtatattgtgtcatttctttgctcaaattcaatttttaagccattttcctcttaaatgtattgctgtctaatcatattcaaaaatgactatttcaaagatagcctcatgtactgagaggctaaaaattcagggatatgtttaagaatcaagctatgcacttagacaataggcttacctaaaaacgcttttaaaaagatctggaattgttccttccactgttttgccacagaaaaagcagagagctaaagatgatttgttgagcagcaaggtcaacctatttggcagcagaatggatcagaaacaaagctttgatttaggacacttgaatacactgcaaaggttctcagatatgtaagtgatgcaggagtcaagaggagtttgcatgaggttcgaaataatcaagcagtatcaaggtggctttttctttgcatttttaaaataagagtgttcccatttctatcaactcagaaggagactaacacattagacagaacttgagacatacttctatgaagactgagttggtattatgagccttgaatcacaaatgaacaggaatcactctgatattgaaagctcacactttcaaagtaaactgcatgatgaaaactccattatgagtttctcaaaaagctacacaactcaataaccaaataaaggaatgaacaattgaacatataaatacatgttgagccatgaaaactatattttaaatatgttagtatattttggtgatacaatttgcatttttgttggatccaaatggtcatcctaaaattaagtatgaattgagaagaaattccaaatacacaaatgatttctgcaatgaaagtgtaactatcgtgctacttctatttttgtctttcttatttttttctaatacaaaacaacattatacatataattttaaaaaactgaaattttattgccactgccttgacctcatatatgtatttataaaagcatatgttcttattggtaggtctttctggacattagtgtttgtagtttcatcctggtttctcctggatttttcatttgtaagcacccttctctcttccatcacacagaccctataaatacacaataatgaatcaatttgatcatctatccctttttatcctttccttgggtttcttgctggtgagaaaaattgcacattgctgattggttctacccctttaatatcttttaaaacattacttcctttgagtcttaatagtaaaccagtacttctttcttttaacagactaactgattaccttctcttttacatcttactgggcctagtattcctgttagagttaattttatgtgtcagttttgctggtccagggtactagatatttggtcaaatattaatctagatgattctgtgaaggtgtttttttttaatgagattaacatttaaattggcggactttgagtaaaacagattagatgggcttcattcaattagttggaaaccctaataaaacagacatacttcttccaagcaagaaggtattctgccagcgtactgcctttggggtttggaactctctctgagtttccagcctgatggcttacactgcagatcggacatgctccttcacgattacatgagtcagtttcttaaaatctctctcatatatcagaaactgactcatgcaattatggagatacacacacacacacacacacacacacacacacaaacacacacacacacacagttgaccattgagcaacacaagtttgaagttcaggggtccacttatatgtggaaatgttcaataaatacagtcatccttctgtattggtgggtgatacatctgcaaccaaatgtggatcagaaatatactgttcatggtacgtgaaacacacatatctggaagattgactttttgtacctgtaggttccacagggcccactgcatgacttgcgaatgcatggattgtggtatctctggggatactagaaccaattccctgtggatactgagggaggactatgtatctatgtctctttagatatggataaatacacacatattctgtttttctggagtattttgactaatgtaaatttggtagcaagagtggttctagaggaacagaatcttaagaataagttttctttactggttttgggatttctggaagtggctctttaatatgactagctttaaatacactattgactctctttccagtagtaaagacagcaccaatagtccttggtgtgacggggcaacagagatatgtagaatatcactactggattctcctaaccaaagtcttgcaagagcgaagcatctgaagctcataacataatatttttgaacatttttgtcaaactaatgatgataaataatcatttaatgtataaaatgggctggctgcctctaacattactgaaaaaagtgaagaaacaaaaggatgagctcagggatttgaattcccagctcaagtaccacgtaagtcacctgtcagtttctctgtctgccctgaaaaagacccttatgtcttgtattgacagacgtgagattgttgggaaaaaaccctagactttcatcttgtgagtggctgaaatacaagaaaaattgagttcctagcctatgtgtctgctgttaaagtgagcaaagtaattgtaaagaaatggcacttggaaagctggaatgagcatgtttgggaagaccttgatgaagctggagacactaagctcataatttctgataagtcttcttaactccatcttgggagattaaccctgcattgcccagggaaactataatggcctcgcctgatgctgttaccttgcaagactgctgagtcttcccaggacccacctcactgctctctttgattctagttgtgtaactagacccaagtctttgcatggccctgaagttgaggtgcaagtgtgacccatgaggtgatgcattaaataccaaaagaactacttgagttttctaatttacccagacagaaatctggggagtacatgtgggaatagatatatagggtatgaaataatggcagaagaaacacaaagttagattggcggaatttattggtagggctcaataagcagagactctgcatttaatattgcagcacggggagtgagaaataacttgtgttttgtttgtttggctgaaacatggagccaaagtttgcccacagtaaatgaatgtgaaatgtcacaactttggtcactaacaatggaagacaaaactcaaaggcctagggacattggtaacgctagaatgggtttcttatttaatatctatttatccacactgggagggtctagaggacacacctttcaccaccacagacagaaatcagttagtgaggagagccccagcatcccagtgatcactcagctctctaggtcagaacttacagtaggaattgttgctgctgaattgggaaatgtaaatgcaataggaatcactggatcctgggtgacaggggccttgttgtagcgatcaatggccaaagtaaggttggcatgtttaccaataaaccatagtcaaaagagcaatcagaatgctatgacttgtggagacttctggtattggctagggggtcatcctgttcctaggaatgaaataggtaggaagcctattaaattattatttgatctgtacaaacagaaaggttctaggtcaggtacacaaagtctaacctgaatcataaaaacagagagtccttgcccctcaatcagtttccagacttgcaccagtttatagacccaaaatcccttgaatgaaggtaaggctgagatctcttggggaaggattccaatatgcttataaaatttatactattaatgtttctaattttttttaattttttatttccataggtttttgggggaacaggtggtagttggtgatatgagtaagttctttagcggtgatttgtgagattttggtgcactcattaccccagcactatacactgaacccaatttttagtcttttattccttacccccttcccatcttttcctctatccccaaagggacctatcactttttatcagggtgactgtactttggggaaaagaaaatattcagacctttgggggactactggacattagctctgaactaacataaattctgagacccaaattgtcactgggcctgccagttagcataaagacttgtggaggtcagcggaccaatgaagttcagcttgggtccatctcagtggagccagtggctcctcaacccattctgtgattacttccaaagttctagaatgtaatttgtatactcagcagctggaagattccccacactggttccctgacgtggaagtgaggactgtaattgagggaaagtccaaggggataccactagaactccctctagacagaacaataataaagccaagcaacatgacattcttggagaaactgctgagattagtgccatcaccaaagatgaaatatgcagggtgttgattcccaactcatccttattctactctcctatttggtctgtaactaacacagatggatcttgggcatgacagtggattatcataagcttagtcaggtggtgactccaactgcaactgttttgccagatgtggcttcattgcttgagagaatcagcacatcccctggtacctggtatgaagcttttgataatagcacataaattttctccattaatgttggtaaagaccaccattagcagtttgcttctggctggcaagatcagcaatacaacttcattgctctacctcaggggtatattaactctttagtcctatgccataattcatttcacagggatcttgattaccttttcttttacaagacatcacacaggtccattacatggaaacatgctgcttggatctattgagcaggaagcagcaactactctatatgtacttggtaaaacatttatttacaaagggtatgggatataaatctgacaaaaatgtattgccatctacctcgttgaaatttgtgggagcctagtactaccggacatattgagatatccccgaaaaggtgaagcataagttgttgcatgtggtccctcctacaacctcagaaaagagacacaacacttagtagatcctttgggattttggaggtaaagtaatttgcatttaggtacattactctggcccattgactgagtgatgtgaaatgctgctagttttgagtgggggacagaatgaaaagaaggctctgagatagatgcagtctgctacgtagactgttctgctgtttaggctatacgatccagcaggtccagtggggggcagtaatagtagtgtcagtaatagatagggatgctgtgtggcatctttggttggtctcatttgatgaattacagcacaggcccttaggatttggggacaaagccttgcctcctctgtggatgtcttcataagatatgaagtatccttcaaaagatactctcctttttagaaacaatggagcctgaccaacatggagaaagcccatttctactaaaaatacaaaattagcccagtgtggtggtgtgtgcctgtagtcccagctactcaggaggctgaggcagaagaatcgcttgaacccgggaggcagaggttgcagtgagcagagatcgcaccactgcactccagcctgggtgacagagtgagactctgtctcaaaataaataaataaatacatagaaaaagaaaaaagaaacagcaaaaacctgctaccagaccttagtgagaactgaacacttaatcatggcacaccaacttcctatgtgatctgagctgcttatcatgaaccatgtgctacttgacccagcaagccataaagttaggtgagcacagcactaccccatcatcaaatgaaagtggcatatacaagatgaggcctcagcaggcccttgatgcacaagtaactgacatgaagaagagacccaaatgcccccattcctgccacactctcttctctttccaagcctgtacctatggcctcatcacgtgctccctatcagctgagagagaaagagaagccttgagcctgtttcacaggtggttcttcatgataagcaagcaccatctgaaattgacagctgcagtattataggctctctgggacattcctgaaagacagcagtgactgcaaaccctctcagtggacagaacttttagcagtgcacctggtttttcattttgcatagaattagaaatgggcagacatgacattatatatcaattcatgggctgtggccaaggagttggctgaatggtcagggacttggaagggacatgattggaacattaatgacaaagagttctggggaagagataaggtatagggatggagccctcagaatgtgccaaaaaatgtgaagatatttgtgtcctatgggaatgtttacaaaaaggtaacatcagcagaggaagatattaataatcaagtggataggacaacccattctgtggatacctgtcagcctcttccagcagccactcctgtcatcattcaacgtgctcataaataaaggggccatgttggcatgagaccaacaacacacagacttccactcaccaaagctgacctggctatagccactgctgaagacctaacatttcagcagtagagaccaacagtaaatccccaatatggcaccattccccaaggaaattaaccagcaacctggtgacaggttgattacacttgatcactttcatcatggaaggagcagcattttgttcttactggaacaaacactctggatgcagattttccttccaagcatataatgcttctgccaaactaccatctgtgacctatagaatgccttatctaccatcctgatcttccacacagcactgcttctgatcatgacactcacttcacagcaaatcaagtacagtaatgaacccatgctcatggaattcattggttttgccatgtttcccaccagtccaaagcagctagcttgaagggagggtgaaatagccttgtgaagcctcagttacagtgctagataggtgccaatcccttgcagggctggggcaagggggtctctaggagactaaaaatgctctgaatcagcatccaatatatggcactatttcttccacagccaggaataaatctcaagccagaagtgactggtctgcaattatgaggtagaaatgagtgtgataccactattactcctggtgacatattagcaaaaattttgcttcttgaccctatggtgttatgctatgcaggtctagaggtcttagttccagaaggaggcatgtttccaccaggacacaaaacaatagttccatttaactggaagttgagactgccacccagcctctctgagttcctcattcccctaaatcaacaggtaaggaaggaaattactgtgctgtctggggtgattcatcttgagtgccaatgggaaattggattgacaccccacaatggatgcaaggaagagtgtgtctgtaatattggagattccttagggcaccccttatattaccttgccctgtgattaaagtcaatggaaaactacaacaaaccaatctaggcagaactagtaacggtctagatcagacccttcagaaattaaggttttgtctccccacaaggtaaagagccactaccagctgagttgcttgctgacagcaaaggtaatacaaaatcagtaatggaaaaaggcagttataaatacaagctatgatacatgaccagtgatggaaatgagggctataatcattacaagtacttcttccttattttattttaaatatgatatatttaatatcttttttcttccctctcctatccccttatcatggaacacaaaatgtattgacttgatatcatggtatttaaaaatcgttaattttacaccaagttgcgggacatcaagatgagtaaacccaaggactttacattcttttctgagaaaaaaggtttgtgtattttcattgcatgcaagacagttatattctgctagaagtatgaccttgttattatctctatttggtgattaaacatggtttaaggggaagtggacgggtgccaagttgacaaagggtggacttacaatggtgtgatatttgatcaatcatgatcatgggtgtttctgtgttctttggataagactaatatttaaatttgtgaactttgagtaaaatagattagcctctattatgtgggtgggacacacctaatcagctgaagatcttaacaaaacaaagactgatgtcacttgagcaagaaggagttcttccagcagactgccttcaggctcagaatggcactcttccccaggtcatccgattagaggccccactgcagattttgaacttgtacctacacaactgcatgaaccaatttcttaaaaataattttttgttccatatgaattttagcacagattttttcacattctgtgaagaatgtcaatggtagtttgatgagaatagaattgaatttttaaattacactgggcagccataaaaagaaacaagatcatgtcctttgcagggacgtggaaggacgtggatgcctttatcctcagcaaactaacacatgaacagacaaccaaacgctacatgttctcatttataatagggagctgaacaatgagaatacatggacaagggaggggagcaacacacactgcagcctgtcaggggtggatggggagggagagcatcaggataaatagctaatgcatgcaggccttaatacctaggtgatggattgataggtgcagcaaaccaccatggcacatgtttacctatgttaacaaacatgcaggtcctgcacatgtatcctggcatttaaaattaaattaaatttaaaaataataataaaattgtttgcataaaattaaaaataaataaataatattttctttttttctatttatatacatgtcttgtttgttctgtttctctggagaatcctaactagaataatatctgtaggattaaactgagaatatcaacagggcattcctcagtctccttcatttatgcttttgaaatatcatctctgagctgtacacatctcttttttctttctttatgctttagacaaaaccattaaaactattttgacaaaagtcacctctggatcactagttaccaaaaccaatggaacattttaagtcattacttaatttggcctgtggagttcaacatttgttgtcattccttattcttaaaactttttcctggtttatcttccatgacactaatgcttgccttttgcctcttactaattagatctatctaatttttttcatctgctttgaaatgaaaaatcagggttctcttaaattatctgtaattttccctagagtatattaaccacttatggttttaactaccatctgtattccaattactctctttgaacactagattaatgtatgtaaatatctatgatatacttcacctgtgtacttgtaagtaactaagggcataggatgttcaacaccaattatttcatttcttacttgagtcccaaatctacaagggatactaataaaacagaagtcagaaatctgtgtcattttttattcttccctttctttgattctctgtatgcaattacccactaatttctgcagattttgccttcacaatatttctctaatttgtctcatcctttacattgccatgatcaatgaatcttgaaatttttcattatctcttcacctttcaaatattctactctaatttcccatttccttcattgtacttcctacacaagcctattgtaactttctcctgcagatgctctccctatctctacacctttttccccgtcttcaatgcatcttttaattggctgtctgatcggtcattctagaattgcaattccattaatattaatcctcaaacgaggcattttatgggtctttatacttttaagaatgctactcatctgggtatgagaattgaacctttccatactttctgtatttattcactctaagtagttggctttacactctgaccatctgactttactgaaatatggctacctaggctcaccttgaagtttcaagcctcagggcttacaaaaacttttccccatactaccacttctagaaaaattaaatcatccttcaagactcatctcaggtacttcctcatttgtgatgattttcttgaattcttccatcttttggacggagtcatagacatttcccaacagtgtttctattatagcacttttgtgtgtgtgtgtgtgtgtgtgtgtgtgtgtgtgtgtttaggcttttattattattattatactttaagttatagggtacatgtgtacaatgtgcaggtttgttacatatgtatacatgtgccatgttggtgtgctgcacccattaactcgtcatttacattaggtatatctcctaatgctatccctcccccctctccccaccccagtgtgtgatgttcccctttctgtgtccaagtgttctcattgttcaattcccacctattattataacactttagtttaatagagtattgaaatgattgttagcacttaagagcctggcaggataataaaccatgatattttctggtgcaatggagctagaccacctggttgacatgttagcttaagcatccactgggtgttgagatatgtggaagtcatttaacttttctgtgcctcagttttctgatatgtaaaatagcaataataagaagatcagtcatagtgttcttttgcagatatgtaagtatatgtctgtaaagcaattaaaattgtgcccaaaggaagcactcaataaagtttaacttttataattgtaatctagagaccttcatagttacatttattcctataggcttaatactgtctcagttgtaatgcattcttcatcaaaaataggttaaataaatggatgtctctgaaactagggtttatatatgttttacttctttattttttgcccttttaaacagtttagatttaagaattgctgctaacagggatttatctgaaatgacaactcaatttcctaaattattcttcggggataaaagaggcagcatttctggatacctaacttggaggctatgaaaaaacttagtaccacacagatacaggcttgcaattatccatgttggtataagcataaatcatgttggtgtgtgtatgcacacttgtgcacatgtatatgtatgtctgtaataatgcaagtgttttgcttgtggttagtttgagcaactggtaacatatgaagtacaaatttttgcagataaagttaatttatttcttactgtacagtatgaaaacatacttatctaggtaatgtattaaattcacagtgtgtatgtgaggaaagctttacctctgtatacccttgtgatttatttgtatacaaagtaaagtaacatttttgttcaagtaatagcacagtttgtgctttcttgcaaggatatcagcatgaacatctgattctttaaatacaagggttgttgaagctaatgtcacccaagtcactcagttgcctctacaaatttctacatgaatacattcttttagatttgaatgtaagaaaaccaattggtccctaaaaatgtggagttgacaatgggaactatacaaattaatgatttccacatacgctctttctaccaagaaccagaaagtcatattcgaggctaaagatagtacagttgatcttagaacaatgtaagtttgaactgcataggtttactttatgtggattttcttccatttttgtcacctctgagacagcaagaacatccttcttctcttcttcctcctcctcagcctatgcaatgtgaagacgatgaggataaacagaacagagccctcagaaataatgctgcatatctacaactatctgatctttgacaaatctgagaaaaacaagaaatgggggaaggattccctatttaataaatggtgctgggaaaactggctagccacatgtagaaagctgaaactggatcccttccttacaccttatacaaaagttaattaaagatggattaaagacttaaatgttagacctaaaaccataaaaaccctagaagaaaacctaggtaatacaattcaggacataggcatgggcaaggacttcatgactaaaacaccaaaagcaatggcaacaaaagacaaaattgacaaaagggatctagttaaactaaagagcttccgcacagcaaaagaaattaccatcagagtgaacagacaacctacagaatgggagaaaatttttgccatctactcatctgacaaagggctaatatccagaatctacaatgaactcaaacaaacttacaagaaaacaacaaccccatcaaaaagtgggcgaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctagagatgatgtggagaaataggaacacttttacactgttggtgggactgtaaactagttcaaccattgtggaagtcagtgtggcaattcctcagggatctagaactagaaataccatttgatccagccatcccattactgggtatatacccaaaggattataaaacatggtgctataaagagacatgcacacgtatgtttattgtggcactattcacaatagcaaagacttggaatcgacccaaatgtccaacaatgatagactggattaagaaaatgtggcacatatacaccatggaattctatgcagccataaaaaaggatgagttcatgtcctttgtagggacatggatgaagctggaaaccatcattctcagcaaactatcgcaaggacaaaaaaccaaacaccacatgttctcactcataggtgggaattgaacaatgagaacactcggacacttgaagggggaacatcacacactggggcctgttgtggggtggggggaggggggagggatagcattaggagatatacctaatgttaaatgatgagttaatgggtacagcacaccaacatggcacatgtatacatctgtaacaaacctgcacgttgtgcacatgtaccctaaaacttaaagcataataaaaaaaaaactttatgatgacccacttccacttaatgaatggtaaatgtatttgacttcctctgattttctttatgacattttcttttctctagattcctttattgtaagaatatagtctataatacatatatacatatataaacataacatgtttatgttatatgtattctaacatgtaagtatgttttaattgactaggctatcagtaaagctttgggtcaacagaaggctacgagtagttaagttttgggggagtcaaaagtttcacttggattttcaactgtgctggggagaagtcagttctcctaaccccccaagttgtccaatggtgaactgtagacaactgatacttttcctaggcatttttgcattagcccttttcctttgctctgagttctatattatttataatactttccttttctatgagtaatctcaaagtctttctggaatgagtggaagcataaatatatttatatgtttatacatacatatataatggattaaattggtccccatgttatcatatttctattctcaaatctagaagcatcaagacagagttaatgaaaatttaattagtttcctgatggaaaagaaaccttggcatccactctttcatctgcattagaaatgtacattgcttgagaaccatgagtgttcattatccattatcaatgtggagccctgtaccagcggaaataatgctggttaaatgtaataataggttagatgttagacttactcctttttaattacatttataaatactagttcctcttttaaataaactggatgaattatacactgttaccgcaattataaagtggaatttcagagtatcaagcaaaaacttgcatatacaatcccatggactgttcggggagatgaaatactactgctatctaggttctaataaatgtcagttttatttttttaacctaatttcaactttattacctccaattctggaaattgaggtctatcgatcttctctaatcaaaaacagagaatttgtcaggaacctcaatatgatgtctagcttctgtcataaacagagttgaaataactgatatctatgttgcagacttttagattatgttccccttccatttgtcttggatttcaaaattccattcttacattaaattaattcaaaagaaacaagtataggagaaccacatgaaattatcttaccatagaaatgttagtgattgttatattccacaatcatatttgaggaattatataagcagaagctttatgcagtaacctccggggacttccatattttggagtgacttcctcaaaattttccaagaccttttatgtgactaaggctatctgtgggtggcaatgtgatctgagaaggtcattctggtctaggctggaaatgtttgggtctcagtgtccatttatcgtttggggctcactttgacattctactcaacctacaggttcataagtgccctgtggatctttagggattgcactatgaggttggccccgtgccacttgaacagcccctgactcctggtaggcagcctgtaaaggagatagttcatagttcttgcttaatggcagtgtgtgtgtgtgtgtgtgtgtgtgtgtgtgcgcgtgtgtatttgtaagatcactgagactggatgaccagaatggtacttatgggctgatttgatttggggtgactcaatttttaaacatagataggtgccctgcaaaaatcatttgcctgggaccacatatgccttagtggaaactctggttatatgtccctttcaacaaagtttctatttaaagaacttttccactgtataatttaatatcctttaaatacatttccacaatgtaatttattttaagtgtggtagaaataattcagatcttaaatgaatattcctcctttgacctaatattggaatcatacaacctattatatatctctttagtttatgttttcagaaagctcaagggatttgctgctcaagagtcatgatcttctataaccatttccaaacactcttcctatgatggttttccaattatgactttggatttattttaaactctcctcaagcatcaatttttctttatcaaaacccatggcaatatcttttacaaaacttaaaaagaattcacaaaatcaaaataaaatataatacttatttttggggaaatttttttttggtgtggtggacaagttatactgttctagacatgggtgaaaacaatttaatggaaaaaaaagcagtaaaacataactgtcctgaaacagatagttgccaccgagtattttgtgaaaaaaattaaatttccataaagttgcaataagatatttaaattgcatgctctgttgatgtgtacatatttgggttccaaaatttattacttcagccataaagacacttataaatatctgctgaaaatatataaattatttataaagcttaagcaagccaaatcgaatacttcagaaccacaatccaaatggcacatcacattttaacgggaaaggagaagaaatacattcttgtcattaaagaacaccaagatcagtttagattatttatgcctggtgattcttctctgtgtctcttattgctaaatatctccaatttggctgtgagcaataaaaatgatataactatactgatactatacttctaactatggttataattatgcttaataacattttcatactttaacttcatgtcttcagcaaagaatgtcaaaaattgaacgaaatatatactattttcattaaaataatcaggaagaattaaagcaaagagggtttaaatgatattctgaagcttacccgggccattgagtcaggaagataaaccaggtctcttggatttcaattccagtgttctagtcactggtttgttcaactcctgtgcaaaacatccatacaaaatacacaatgcatattcccccttcctatcaagcggttgtcaaaagaaatacgccattacctttcccacatactgaggctcggagcccacgtattcttccagcacaaaaaattgattccatacccagccacgtttaacacgttggaaatgtgaccgttgtcctggcagatggataacattttctcttggctctgtggctaaagtctgctgtggctgtggttgtagtggtgttaggagacctccatcaaacagaacccagagaagcagggataaacagttccttgtaagcattggcaaaggctttcctacagcagagtaataaaaactccaacacttaacgtagaattgtggaatccaggtttgaggtgtctgtggcctccaccacttagcttcttgttttattgcagaaatgatgatgcaggcattaatccttttgatgaaaaggcttctgctgtattatattccatctaaaggggcctatgaaatagatgaacaaagatacattaaattaatgaaattgcatgatgatattcatcacaacgctcattatatctgccaacatttaaggaaaccgagaagaaagactataaaagaattatattagtaaacggtcaccgctattcaacattttaacttggataaattatctgagtttttcacagacttgagaaaatattagttacaatgaagcaaaaggtgcattataaacagaaatgatattttcaaaaaattggcaaatcattttaaggagaaaaatacagaccactattttaaagtgagctattaagttagagtaggatcttgcaacttcagcattattgacatcttagggttgataattcattattgctgggaagctattttgtgcattttaagatttctagtagcacttttttcttctacttaatagatgacagtagcaccccttcccatatctggtttgtgacaagaaaaaagtatctccagacattgccatatatcccctaggggagcaaaaaatgccaaaattaagaaccacaatgtagagaataaagaaaacaatttttaaaaagcaaaaagttcctgaagttagagaatagaaagatacagacgatctaaagaacaagataaattattaaatgtaaaagcgaatcatcttactaaaatgtaaatgatggatacaatgttttaagtctttataaatttaaattttctttaaaaatgtttctctagcctggatataccagaaaccttgacaatgtgagtattactttatagacgttgtgtagctcagagaaaagctggatccctaccagatgcagagcttttactctgcatttagataaaatgacctttgaactttttcttataacaagcgtttttaaattcacttatctaatattcattgagtgtctataacacactgtctttaattatgtggtagataaaaaaacagacacaatctttgcctctctaaaatcacaaacaaaaaataaacagtcaaataaataactgagggcagattatgcaaatggaaaaaaaaaaagcaaacaagaatatcctgagggtaaaacctacgttagcaaaacctgttgtaggtgataattgcactgaggtctaaaggaataaaagcattcctatattttctaagcaggcatgatgaaacgtggctctagaacaagggtgattttatgcatttggcactagggtcacagtgcttcgagcctataaggtttctaaaggccgaaaacgttggaagccagaaaatatatataatgcttccaaaacaagagaactaaaatcaaatcaatgcatgtttaattaaatgtctataaaacatggtgtttttgtcaactagtcagctgcagttcagaacaatgtgtattcacttatgtgtaatgtaataaaaacatttaatgagttctttataaatattgaaatttaaacattaaatgtggaaatagtaattcaccatacttgagataagatatgagatgaggagtgtccaaaagttatactctgaaagtattttatagggcaaacctaaaaaaaataaaataaaaccggatataaatttttttcttctttataagagtgtaactgtaactgttagatattgacaaaaccgtaagttgtctttttttgcatcttttcattctgacaaaataatatttataaaaagttaagttagatctgccttgtccaatatggaaacctctagtcacatgtgcctttttagttaaaaattggcaatttgggatcatgatgtgctctacttttaaattatatgttgaatttcaaagacagtacaaaaaataggaaggtatctttttttttatcacttgacatgatattttggatatgttaggataaataaatacacattattaaaattaattttgcttctttctttcttttttctttttcttttttttgatggagtcttgctgtgtctcccaggctggagcgcagtggcgtaatctcagctcattgcaatctccgcctcctgggttcaactgattcttctgactcagcctcccgagtagctgggactataggtgcgtgccaccacacccggctaattttttttatttttagtagagacggggtttcaccatgttggccaggatgatctcgatctcctgacctcatgatccacctgcctcagcctcccaacgtgctgggattacaggcgtgagccacctcgcttggcctctttccaattttttaatgtgcttactagaaaattaacatttgatatgcaactcacatttacattttgaattattttcaattggacagcactgatttagacaatacagtttgaatcacaaactgtgatttctatttaagcaatttattcttaacattcaaagtaaaatatctaacatgaactccatcacgtttgcggtaaaaatacgttagaaagtcagagaatcttttgcatctatttcaataacgtgtaagcatggtaatgtatttttttctcatttgtttttaagtttaaattgctagggttaacctccaaggtgtattaatttcttaaattttttgtttcttccatgtttcatcccatactcataccaatcctattccaagcatatcagttcagattgggagataaatacaaggagaaaaatgggtgacagaaactctgacttcccaaatctattctagaatatgccattaggttgcatttctgccttcctgttctattaaaccttttctttcactattttggggatgtgaggtatcaacactcagactttagagaacactgacatctaaggtcatctctcaagacaagtgtctttttattgtatattagagatttttgaggttggacatatgacaacattcatcatcattgccgccagtctggtccaaattctccttttcgcttagaagtcaaatgtgtctaaaatctgagctgtggctccctaccagagtaatcttgcagaagtttccatccactcacatcactttccatctgttgattgtgctagaatatgtgtctatagtgtggaaaaattagtgaataagtgattggtaattagagagaaacataaatttaacatgcaaagtgcagtagtccccatttatatgtgaagaatgtgttccaaaacccccaggaaatgcctgaaaccaaggatagtaccgaagctgttatctgtcaatctgaacacatctctgtttatgtcttccacccacaaattttatactttttccatcttaactaagcccatatcatgggactgtaacttttgcagttttgggaggtgggacagcaaaactagaaggggtttctttttcattcttcacaatttcatggagaggtttattcttaccatagcaacctcagcatatgatttattttctttccttattaagtagagaactttcaccttttcacataaaaggaagactttatggcttctctttggcatatccaagttgccagcatcactattcttgcactttggggccattattaagtaacctaggctttcttgaacataagcactcgatactgtgacagtcagtctgctaaccaagaaggctaagtgactcatgggtagggagtgtctacctcttgaatccactgcacaaagagactatacacatcccaggtgggacagaagtatatggtgcaaaatttcatcatgctactctaaatggtgcacagttcaaaccttataaattgtttatttctgtaggtttttatttaatatttttggactgcagttgatcaccggttactgaaaccatggaaaatgacgcaggataaggggtgactactgtgtgttgtttcataagctaattcaccaacacataaacagtttgcatcaggaaacaacagcagctaaatgcaaactatggtaataaagctgaagttaactggagccacagaggagtgcaacgtagaacatgatgcccatttccctcaggcccacattctgttcttactttggctcttgttggacacaaattctatcatactgtgctgtgtttcttccagatttttatgcatttctctctcaaagtaggctgaactttacttgtatccatgttatcaaattaccttcttttttaagagtagaattttatgtttactagatatttatttagcaatagtttatttttgctgatattttcattgggatggtgattgctagtggcaattgcatgagttttggggatctgcacatatcttttttctctatgagctctgttattttaatatgaattttgcagaatgcagagcttttaaaaaacttgcatatcacacttagcagaagcacttgtaattaaaaacataaaactttctccttgcacgtattaaaatccagaactttaatatgacatttacgaatttaacaaggcctgcataatcgacctctgcatgttcaacccttgccattctcttcctttcctgagtccaaactccttagttttaactcatgttaataacagtaataacagtaatttatattaggagtgtactcatgtgattatttgtttactcttttctgggtggagtggtggcgtaaagagaagctagggaggagtaatgatgcctattttatcagccattctgttcctggggtctacactattacctggcaaattgtaggcaccaagtacatctttgttaagtttgaatgaataattcattgaatggtaatagctaacctttattgaaaacttacaatgttctacatagtgttgtatgttctatgcctatataacagccctgtgaaggaggtggtattattacacccatttgacagaagaaatggaggaacagagatgttaagtgacttgaccatgatctacatgttagtacatagcaggcaggcttgaatctgggcagtctgactacagagctcatactcttggatcctctacggtgttgcccctctgttaatagatataaaaatacacaaaacctcaggggtttccaatcctagtaaaacaaggaatatgtgcccgcaaacttgagtttcaagttatttttcaaaacctaagcaggtatttcaatactgggcagcttaagctttcagactcatttagctcttttgtaaaattaggagatttaagctatcaggtcaatatagttcctctgaagtccagagatccaagactcccagctttccacccacaaagatctgggaaggacataattttaggcagaggtaggaaataatagacatggtcactgttctcataggattgcacagtgactgaaaattcagaaagtgctccaacagcccatcaaggcactaaacaggtcaccaggttgagtgataagaaatagctgttgtacagaaaagagggtatgagggtttccaactgttccagggagctcttcctagtgatcttgaactgtggatgtagttctggggtccgatagatgagatggcagcctgtttgacctacctgacaattctacatttgaggattgcttctggcattgatattattaaaaataaataaattacttaatggattaataaaaatattgactttggaacaagaaagatctgaagtatcattttacatgaattcacagcatagttttatgctaagtaactatctgttaagtagcatttgaactgtgaggacacaatcaacaatggtcttttatttgtggagctatacaataaatatgactaagtaaatatttttcaatctcatccctcaatgagaacgtgtgtgagtgcatttcctcactcctgtcattgttttataatcctaaaatccatttcaagtctctataacactacagtccttcagtgaacagatgaaccaatgttattttcagtacaggatgctgctcccagcagatcccagactctggccacggttgtcagccagggagcttttaaagtgctatatcacaacaataataatgcaaggagattgaaggactccagttcttaagtgaaaggcaaacaactcccccaggcatgaaacacaggctaaattacaaggaaaaactatatcaagccatcaacctgggtatacttgccccagcaccaatggtgttgttataaaagcaagaacagaaagcttattctgggaggtcagtaccctatggaaatatgtgaaccttaaggaagacagatttgctacaaaggacatcaccagaagtaggttgtattccatatacctgatttcaggtacagtgataaaatatttatatttgtctatgcttcctcatcttttgtagagccagagtgacttttcaaagacttcttaactcggatgatgactctctggagcccaacatcccttttagcaggagggatttttttttttaaatggtcatatatcaaagcagcagatatttagttgtgaaatactcactgacagtaacacttccttgaagtgtgcctccaaagctaaaagatatacaaaggctgtggtttccctagttatttatttaaatggggagtgtttgcttttaagaataactcctgaaaaagggcaaatatattcaatataaattacattgaaagggttctctttgtcagggacaacttattaagctgaaagacttgttaattattaaaaggtgttctctattatgggtagcattctaatactaactgcatattggagaactctttaatggtgactatgcttgtggtctattttaaattaatattctatggagtaatttttcaagggcacttcttaaaatttaaaaggaaaataatacaacctcccccacctcctcttgtgaataggtggccctttaatttgaaatagtaatcaaaagtgatccccattgaacaatataagggaaggctttattttccatattattaaaaaaaatcaatggcagcataacttacgtaatccaaaaaatattaaaatgtcaacaatatgctttatattttttaatgttattcttcaccttgaaaacattattttatttgacttaacttcataaattaagctttctgcttcctattgtatgaaatgcattataatcagtaaatatttaaagacttcaagcaaatctgatagtttaagaatatgactcccaggaaaattatttgaaggtttcaacaggcactgttatgcaaattttaagctttgttcaggaaaacatggtactttttgaaaagccttgggaatgagcatacatccctaatgcagcttttttggttccagttaaacctatcccaaaatgacatatgactctctctctggtatagcaaacccttaacactcactcttttgttttatagactgcctgctgagaagcagacatagtaaaccaatctctgctaattcttatcagcaaaacagaggtgtctgtagatgattattactcaatgatcttaacttatggggttcattaatcctgcctctctggcttgtccagattctactccctacttctcaagtatgttaggaagccaaaatatgctatttgaattttatttatatatttatttatttatttattttttattattattttttgagacggagtctcactctgtcacccgggctggagtgcagtggcgtgatctcgtctcattccagcctccgcctcccgggtttaaacaattctctgcctcagcctcctgagtagctgggattacaggcacgtgccaacaagtcccactaatttgttttttgtttgtttgtttgtttgtttgttttttgcatttttagtatcttggccaggctggcattgaactcctgaccttgtgatccacccgccttggcctcccaaagtgctgggattacaggcgtgagccaccgtgcccggcccgaattttaactgatatgaaaatggctgctactagttttactgaaatgaaaatggctgctactggtatctcctacaagccaagaaaaaaaaaatgttaaaaaaaaaagaaactcaacatgggacatctttccagtactttatggcaagagacagaatctctctctttaaggagaaaagaaatcgatcacatctttatttttgtggtgtgattttaactgcattgtttgaaaacccttgacagtgtattctgaaattgataatttacctctgtggtctttcacccaaaaatccataaccccattctaatcataagacaagtctcaattgagagatgtcctataaaatgcctcactagtacttcttaaaatggtgaaagttgctgaaaataagaaaaatctgagaaactgtcaaagccaagaggagcttaagcagacaggacaactaaatgcaatggaggggatcctggaatattaaaataatcataggtaataattaaggaaacctgaagaaaatatggactttagataataataatgtatcagtattggttattcacctgtaagaagtatactatcctaatataagatgtacagaagaggggaaactgggactcagttatggctaaaataaggtacaatctactttctgtcagacactgaacgagtttacaagaagtgatgtgacaagaatggggaaaaaaggtcgggtgtgatggctcacacctctaatcccaacactctgtggggccgaggcaagcagatcacttgaggccaggagttcgagaccagcctggccaacatggtgaaaccctgtctctactaaaaaatacaaaaatttgcttggtgtggtggcacacacctgtagtcccagctgcttgggaggctgaggcaggagaattgcctgaacccagaaagcaaaggttgcagtgcgccgcaatcatgccactgcactccagcctgggtgacagagtgagactttgtctcaaaaaaagaaaaaaaagaatgggaaaaaaataatttgagtcctatttagacattgctttgtaatgtatagaaatcttcataaaaattcaagatctccattttgattatttaaccatgtgttgaagaaggataactgtgatggaaaatactttgaattttcaaactgcattcaaattctgtatcaacaaaataatggaaaatgctcctacagggatagatttaagaaagtttccagaaagccacccactggggattgatggtgagctgctcagaaaatcagctcagagtaagtttggagaaaattccagttgtagtaataccatcaaaattgtctgaagccacttagactctatcatacccctgtgtgatctttctgaattcccaattttatgtagttaatcgggactgaatttaaaaaaatgatgataggtgcattctgagagtgaaatttaaaagtaggatgcaatgcttctggaatggcagagtaaagagttatgctgacattctacacagcaaagcagcaagttcactgagacaattatttaataattatcatttaaagtctctagaaatggtcttaagtgtattcagcaaacaaaataacactcattgccagctgtgtttctcatccttcttgccagtcctgagttgtagaaacactatttctagtgggtgtggaggagagaaccaagacttccttttccccagcccctctcagaggataaaagctctgtttcagacccaccaagtcaagcatactgggacctcctctccttgccttaggtttcttgtagagcagaaattccacattcgtaggggtaaatgagaagactaaggactacaatccctatcaccaccaccactactaccaccaatgcccccttaaaaagggaaggtatcactacagggtatgagggtcccaactcccagtgttgttgcattggtatagacattcctctcaggggaaacagaggccaaaaggacaaagggctctacagctttgtctcagggggcatactttatttggacagagtgtaaactccttgtctgatgttgaaagtagtaaaaacccagcaggtagcaattatgaggaagctggtggctctgtgatacacgcaaagggacaatcaagaagacctctcatgggaccaagatcaactctggaaattggtaaggtaatttatacacagtaagccttgctttcttactaccaaccaccgcatggcatgaggcagttgtgaaagtgtcccccaaggtaaacacaaaacttttgatgtggcaggagccccacctgcacaaagggcttaaataaaacttcataccaaatactgactgaacaacatgctactctgactcagacgcagcagtacaatggtaaaaagtaaaaatctaactggctacgggggcttacaaacagccattgaccagcaggctgtttacactgacattagacaatgtcatatgtggccatgattaaagatagaaaacagaaaaattctgagcaggcagaggctgaaaactgtgggggtaaaagattccgcaaaatgagttcatccaattcactaagagataaatgaccaagcaaataacaacaacccccaggaaagggactggtggttcagtaattagaactgttagaatatagtatttataaagtcaattttccacaatgttaagacatgcaaggaaacagaaaaatgggatccacacactgggatggggggaaatcagagaaactagttattgaaggagcctagacagtggacttggcaagcaaaaatgtcaaagtaacattataaacatcttgaaagaaccaaatgtaacaatgcataaagaattaaaggaaggaagacagttgataatatctcatcaaatgaaaatgttattaaaaagataatttactttttaaatgccacatggcaattacagagatgaaaaatagaataacagaaatgaaaacatttactagaggagctcaacactagatttgatctgggagaagaaataaccaagattaaaattttaccacataccttcttcatctaagatataattacattaaaaatcaactgcagaaaaaaaatttcggtacattttagaactacagaagaaaatatgagaatttctgtaactggggaaattaaaaggtgaaaaagtcaaacaatgccgtctaaaataaccaattatttaaagaataaagtatagggaaattttaaaaaaatgagattaattaaaactagaatagaacatacaaatgtatgtaacaaagcagtgagcataaggagatttataactgtaagtgcctacatttaaaaattctcaaatcaataatttaaccaccccaataagaaagaagaaaaaaagaagagcaaactaaactcaaaacaatcagaagtagtaaagataaagactgaagtggaaattaataatgtaaagaatgaaaacaatagataaaataaacacaccaaattgttcctttgaaaggattaacaaaattaacaaatgcttagttataattattacaaaaaatgaaattactaaaatcagtaaagaagaaacatcactatcaaccttctaacaattaaaaaacgtactataacaaataccatgaacaactttatgccaacaaattaaacaacattgatgaaatggacacatttttagaaagacaaaaattaataatattacctcaaaggtttagaagccctgattaggactataacacataaagagatcaaattagcaatttcaaaaacttcccaccaagaaaatttcagaacaagatgtcttcactgttgaattctatcaaacatttcaataataattaatataaaacctctgtaaactcaaaaaaaaaaaaaagaagttgagggaacataccctgacttattctatgcgacctttaacattacaatactgaaatccaaccaacacttgacaagataaacacacacacatacatacatacacacacacacacacacacaccctcctgaataccaatatcccttatgaatataaatgtaagaattctcaacacagttctggcacagcaaatccagcaaaatacgaaagagattatacactatgaccaaatgggatttatcttattactgcaatgttggtttaatgtccaataaatatttaatgtaatacccatgtcaatagaataaagaagaaacaaaacaaacagaggatcatgtcaatgatctagaaaatgtatttgataattttcaatatgttttattgataaaaacaatcaacaaagtaggaagaaaacaaaacacctgcaagctgacaaagataatctaacaagtctccacaagtcatatcatggtaaaggtaacagactgcatgttttctctccaagaacacaaacaagaaaggaaggtacactctcctcgtgtctttacgacattctaatggaggttttattaggcaaattagacaagaaaagagggaaaatttaccagactagaaaggtagaaaaaaatttgtctcaacttgcagatgacatgatcttttatattaaatatcctaaagtgtgtgtgtgtgtgtatatatatatatatatatatatagcttagtaaatattttaaagtatatacatatagtttaagatatttgtgtgtgtgtttgtgtgtgtgtgtgagagagaaagagagagagagagaaacagagggagagtgttagaggcctggcagcatacaagatcaatatacaaaactcaactgtatttctatacactgaaatgtcattaaaattgaatgccattaaaaatggcactgaaaattgaattaagaaaatacttccatttataatagtgtctgaaagataaaatatttagatcaaaacctaacaaaagaagtgaaaaatgcatatgctgaaaaccacaaaccattgttgcaagaaattaaagaatgtctatgtaaatgagtgggcataaaatgttcatagattggaaagttaatattattaagaagacaataaccccaaattgatccttatgcaattcctgtcaaaattcaagccacgatagtacagcaattgaaatgttcattctaaaattcatgtagaaatgaaagggacccagcagaatattaaaaacagtcttatacaaaaaagtaaataatttggagaactcacacttttcacttttaaagctcaaaacaccactgcaataagcatgacaatgtggtactggcataagtatacacccagaagccatagaaaggaatagagatcctaaaataaatgggtccatcctgagtgaatttttgcatatggtggcagtggaggattaaattagtcttttttttatgtggatatccaattgacccaggcccattgtatctaatactgcttgtagcaaatcagttgcctaaaaataagtttattttagggtctctattttctcagtaaatgatcctggggcaattggatatccacataaaaatgacttttatcctctactgccaccatatgcaaaaattcactcaggatggatcatagaccttatttaagagttaatcctgtaagattcttacacacaaacatagaataggcaattcagtgtgtttaaaaatatatgacttcaaaagcccaagtgacaagataaagacaagctggactttaggaaaattagcaatttcttgcttcaaagaatacagatatggaagtaaaaagataacccatagaatgcaaaaaagtatgttcaaattattcacttgacaagagacttgtatctcaaatatataaagaccatttattattcaatagaaagataatacaatcaataaatgagagagggctttgaatagacatttctccaaatcagatacacacatggacaatatgcccatgaaaggactgtcaacaccattcattagtcactaggaaaatgcaaatcgaaaaccacagtgaagatggctataatagaaaaataacatagtaacaaatgttgaaggaggatgtgaaaaatcagcacccgcacacatggctgctaagaatgtaaaatggtggagcttttttggatattattttggtagttcctcaaaatgttaaaatatagagtttatgagatgatccagaaatttcactcttaggtatctacctaagagaaaatggaaaagactcatccacacaaaaacctgtatacataacctcccagcagcattattaatcatagccgaacagtggaaacaaattacataaaaaccaatgggattatttgatgaacaaaatctcatatattcatatgtagagggttcaagggatttggggactgatcaaggaaaatgatgtcactgtgagaagcagttaacacacaacaagctttagtgggtggtgtttgcacagcctcacatgagagtgcacatcccttgcagcatggggctgatgataggggctattatccagaggacagggggttcagagaggtggtttacacaaatgatgttattaagcagcatggtcaggtgtctctgggtcagagagatccaaagggctgtcgcagcttggatttcataaccacaaagctctagcttatctattactagcaggtgtggggtgaggttttgaagggtaagtaaatcagacactctcttaagtggctaaaaatctacttgtttggactatttttaaaacaattgaatgtatgaaaatttgagtttgactctggtggggtttggagctcatgggtctcaacttgtagtgaagaaataaactaagggtacatataaaaagtctacatttagctcatttacataacaccatgcaattgattattacatggcaatgaaaagggataaagtcctcatgcctgctacaatatagatgaaattttaaaacattttgcaaatgaaagaagtcagttataaaagattacatattatatgattgttatttatattgtttttagaataggtgaataaagacagaggggaaattaattgttgtttagggactgtattttgggtatgacctggagaatgattgccaacgggtttggggttccttcttgggcgaataaaaatgttctaaaatcatattgtggtgatggttgcaacactatgtgaatatagtaataaaaattgaattccatactttaaataggtggattgtgtgatatggaagttatatcgcaataaagttgtttaaaaaatgacttcatgatagacttcagactcaagattttgggctgtaattagtggacctgaaattgtctttgcttcttgaagcaaattaaatcaaacaaggtcccaattcatgtgttaatatattttacataatattgatcagagactacctcaatactaacttatggctcatatttgagagtatttccactgatttacatgtgctagtgcctcactgcttcaccatgaccacctgggcagcatataaatcctctaaagttttatagaaaccatctgggctggaaatcgcccacatttgctttatctgtgctgcagagggaaatcaagaggcaaaccgttacacagatgaattttcccaagacacaaaggcagcacactcctttaaacattccaggaagcagtgaacatgggggaaagaggagtctgaagccatgcctcagcttattttctagactaagccttggaaccaacttaagaggtgacccataagaatctgactgactgcaagcaagaagagctcttgggttgcagaaatagatactatgctgctctttacggagaaccacaaagatttgaataatgtcaatacataatggtatgagtagttttattcaccagaattccagagggactaaatctaggatgaaaatgaagctgagtttagcacaaagtacatttctcagaggaatgtgtacaagggagaaggtaaggacagaaactatcgtaacagtagggggtggcatggcctgtaagtaggtagtcatgtgggagagggggagaaagaagaaaggagattttaggagacagatttgaacttaagagtgtattaatgggcatcaagaggcctcacaatggcccagctacatatcagtatagatttaaagatgcacaaacaattggaactgtcaggcctctgagcccaagctaagccatcatatcccctgtgacctgcacatacacatccagatggccggttcctgccttaactgatgacattatcttgtgaaattccttctcctcactcatcctggctcaaaagctcccctactgagcaccttgtgacccccactcctgcacaccagagaacaacccctctttgactgtaattttcatttacctacccaaaccttataaaacgggcccacccctatctccctttgctgaccctcttttcggactcagcccgcctgtgcccaggtgattaaaaagctttattgctcacacaaagcctgtttagtggtctcttcacacggacatacatgaaatttggtgccgtgacttggatcgggggacctcccttaggagatcaatcccctgtcctcctgctctttgctccatgaaaaagatccacctacgacctcaggtcctcagacccaccagcccaaggaacatctcaccaattttaaatcaggtaagtggcctcttctcacttctccaacgtctctcactatccctcaaccactttctcctttcaatcttggtgccacccttcaatctctcccttctcttaatttcaattcctttcattttctggtggagacaaaggagacacgttttatctgtggacccaaaactccggcgccggtcatggactcgggaaggcagccttcccttggtgtttaatcattgcagggacgcctctctgattattcacccatgtttcagaggtgtctgaccatgcgagaacacctgccttggtccttcacccttagcggcaagtactgcttttctgggaggcaagaacactccaactccttctctccatgtctctaccccttctctgcttttctggggggcaagaaccccccaatcccttctccttcacccttagtggcaagtactgcttttctagggggcaagaaccccccaaccccttctctccgtgtctctaccccttctctgcttttctgggggcaagaatcccccaatcccttatttccacaccccgaccccttatctctgcaccccgatcccttaattccacaccccaacctcttatctctgtgctctgatcccttacttccatgccccaacctcttatctctgcgccccgatcccttatttccgtgccccgacctcttatctctgcaccacgatcccttatttccgtgccccaacctcttatctctgcaccctgatcccttatttccacaccccgacctcttatatctgcgctccaaccccttatttccatgccccaacccctttcctgcttttctggagggtaagaacccccaaaccccttccctctgtgtctctaccctgctctttaaacttgcctccttcactatgggcaacccttcattcctccttctcccttagcctgtgctctcaagaacttaaaacctcttcaactcacacctgacctaaaacctaaatgccttattttcttcttcaatgctgcttgaccccaatacaaactcgacagtagttccaaatagccaaaaaacggcactttcgatttttccgtcctacaagatctaaataattcttgtcgtaaaataggcaaacggtctgaggtgcctgatgtccaggcattcttttatacattggtccctccctagtctctgttcccaatgcaactcatcccaaatcttccttccctcccgccggtcccctcagtcccaaccccaagtgttgctgagtctttctaatcttccttttctacagacacatctcacctctctcctcctagccaggcagagctaggtgccaattcttcctcagcctccgatcctccaccctataatccttttatcacctcccctcctcacacctggtccggcttacagtttctttccgctactagccctcccccacctgcccagcaatttcctctttaaaaggtggctggagctaaaggcatagttaagtttaatgctcctttttctttatcctacctctcccagatcagttagtgtttaggctctttttcatcaaatataaaaacgcagcccagttcatggcccctttagcagcaaccctgagatgctttacagccctagaccctgaaaggtcacaaggccgtcttattctcaatatacattttattttattacccaatctgctcccaacattaaataaagctccaaaaattaaattctggccctcaaaccccacaacaggacttaacctcaccttcaaggtatgcaataatagagtagaggcagccaagtagcaacatatttctgagttgcaattccttgcctccactgtgagacaaaccccagccacatctccagcacacaaggactccaaatgcctgaaccgcagctgccagagtttcctccagaacctcctccctcaggagcttgctacaagtgccagaaatctggccaccaggccaaagaatgccccacagcctaggattcctcctaagctgtgtcccatctgtgtaggaccccactgaaaatcagactgttcaactcacctggcagccactcccagagcccctggaactctggcccaaggctctctgactgactccttcccagctcttctcagcttagcggctgaagactgacactgcccgatcgcctcagaagccccctagaccatcacggatgctgagcttcaagtaactctcacagcagaaagtaagtccttaatcaataaggaggctacccactccacattaccttcttttcaagggcctgtttcccttgcctccataaatgtggtaggtattgacggccaggcttctaaacatctttaaactccccaactctagtgccaacttagacaatactcttttaagcgctcctttttagttatccccacctgcccagttcccttattaggctgagacactttaactaaattgtctgcttccctgactgttcttgggctacagccacacctcactgccaccttttcccccagttcaaagcctccttcacatcctccccttgtatctccccacctaaacccacaagtataagacacctctactccctccttagcgaccgatcatgtacccctttccaccccattaaaacctaatcactcttaccctgctcaatgccaacatcccatcccacagcacgctttgagaagattaaagcctgttatctctcacctgctacagcatggccttttaaagcctataaactccccttacaattcccccatttcacctgtcctaaaaccagacaaggcttacaggttagttcaagatctgtgccttatcaaccaaattgttttgcctatccaccccatggtgccaaacccatatactctcctatcctcaatacctccctccacaatccattattctgttctagatctcaaacatgcttcctttactattcctttgcacccttcatcccagcctctctttgctttcacttggactgaccctgacacccatcaggctcagcaaattacctgggctgtactgctgcaagtcttcaaagacagcccccattacttcagtcaagcccaaatttcttcctcatctgttacctatctcagcataattctaataaaaacacatgtgctctccatgctgatcgtgtccagctaatctcccaaaccccaatcccttctacaaaacaacaactcctttccttcctaggcatggttagtgtggtcagaattcttacacaagagccaggaccccaccctttagcctttctgtccaaacaacttgaccttactgttttagcctagtcctcatgtttgcgtgcagcagctgccgctgctttaatacttttagaggccctaaaaatcacaaactatgctcaactcactcgctacagttctcataactgccaaaatctattttcttcctcccacctgacacatatactttctgctccccagctccttcagctgtattcactcttcgttgagtcgcccacaattacaattgttcctggcccggacttcaatccggcctcccacattattcctgataccacacctgacccccatgactgtatccctctgatccacctgacattcatccaatgtccccgtatttccttctttcctgttcctcaccctgattatggcttgatttattgatagcagttccaccaggcctaatcgccacacaccagcaaaggcaggctatgctatagtacaagccactagcctgcctcttagaacctctcatttcctttccattgtagaaatctatcctcaaagaaataacttctcagtgttccatctgctattctactactcctcaaggattattcaggccccctcccttccctacacatcaagctaagggatttgcccccacccaggactggcaaattagctttactcaacatgccccaagtcagaaaactaaaatacctcttagtctaggtagacacttttactggataagtagaggcctttcctacagggtctgagaaggccaccactgtcatttcttcccttctctcagacataattcctcagtttggccttcccacctctatacggtctgataacagaccagcctttactagtcgaatcacccaagcagtttctcaggctcttagtattcagtggaaccttcatatcccttaccatcctcaatcttcaggaaaggcagaacggactaatgatcttttaaaaacacatctcaccaagctcagccaccaacttaaaaaggactggacaatacttttatcactttcccttctcagaattcaggcctgtccttggaatgctacagggtacagcccatttaagctcctgtatggacactcctttttattaggccccagtctcattccagacaccagaccaacttagactgtgccccaagaaacttgtcatccctactatcttctgtctagtcatactcctattcaccgttctcaactactcataaatgccctgctcttgtttacactgccggtttacactgtttctctaagccatcacagctgatatctcctggtgctacccccaaactgccactcttaactcttgaagtaaataaataatctttgctggcagaactatgctgaatctccttaggcactctctaattagatgtcctaggtcctcccaattcttagacctttaatacctgtttttctccttctcttattccgtttactttttcaattcatacaaaactgtatccaggccatcaccaataattctaaatgacaaatatttcttctaacagtcccacaatatcaccccttaccacaaaatcttccttcagtttaatctctcccactctaggttcccacgctgcccctaatgccgctcgaagcagccctgagaaacatcgcccattatctctccataccatcccccaaaattttcgctgtcccaaatctttaccactattttgttttatttttcttattaatataagaagacaggaactacaaagctatcaactgaatttctaaaaaccaagaaaatattgtgtctgtttcagataaaaaaatacttacttattaaccagtctttaaaaatgtatgcatccctgattctaaaccttaaattaaacactagagaagttttccttgtaatttattggagggatagtgagagatatattgaggactgtgcgtagagactgaattataatttttcaaatagaaaaatagtaagaggtgacaaaaaggaaggaaatactattaagcaagagagaaacatttagtaagcagcaaatatgctctaattccataattcctggcaaaaacaagatcacacaagtctcacgagacatttttgtccttagaatttacctcacattttgatattaagtttaactcttgatgtgtctaattacaaaccttcaaatatgaatctgaaaaatgattctgttactctctataaaaatcttaccagtgtcactatggctcctttatctactatatgccatacattagacacacacacacacacacacacacacacacacacatacactcttttatttagataacccattctactttaaataatacatttagttaaattataaattactgcattacactattgatttgttaaaatcaccctgcatgttgtggtcctcctgaatttcatataccactggggatataaatgggttttcttattttgagaattattcaataatttcacttattaaaatgttttatttagaactcattcaaccagatgagttatgtccattgtttaccaaggtatcagctgccttacatgaaatttattcttgatttcttttgctgtattattttacaatagattcttatttctaaattataaaatcaaatgtgttatgcattgaaatcactatttttattacaaaaaccagatattacctgtatgtaaaaatttgcaaatgtgacgcaccaagaaaataaaattacttatattaatgcccagaactttgctcatttcttcagcatgcaaatatttattgggtgcctcatattatctaggaacaattttagacaccgagacttttactgagcaaaattcacacaatttcatctccatacagatattaaaaatgaggttgatgtaattatttgaacattttattcccatatttaaaagactggtcgtgtactcccggtatgtatgtattgtatatttatatgtattgttatgggaaatttataatatatttgcaacattatagaacacaactgtttttcttcttcttctttcttttacatacttccaaaactttcttaagatctgggtctcagcagacaacttagaatgcaacaatgactatttaattttcccagaaaatggaaagtgtattgcttccagagttcctgtggaccatagccagttttatcttaggcttcaagtctgcacagaagtattttccatcttaataaggaacattaaagacaaatgaagaaaattaaaagaaaactcaaaaattaaggtctatgagaaaacacatagcatatgaaaaccacttgctccattgtttttaattttataaactaaaagaagtagaaaatattatttccaaggaaatgtgatacaagtgaggaaatttataaactgcagatgagaaaactgggatgcagatttctattaatgttataattcaggtattggcaaacttctgagaaagaccaaattgtacacattttaggctttgtggagcttaaggtctctgtcgcaactattcaactctgccattgtagctcacaagaagtcataaccaatatgtaaccaaatgggtatgactatgttccaatagtgccatatttacaaaatcaggaaatgacctggatttgactaggggccatagattgctgacctctaaaatctgaagattcttttaacagtatctttagagaggtgaagtgaaaatatatatttataaagtcactgataattggatattggcgtcagactttccccatctttaaaactgttatgtttgtttaattttttccccaaatatatgaagtgttttaaaatcaactttggaatccactgagataataagacattatgacgtccagagagctttctccatcctttaccagcatttattttttgtaaccaagatacgggttctcaaataatggctcctgggtgctttgaaaaagtagtgcgatggtttgaatgtgtcctccaaaaagcatttgttgaaaacgtaatcccctggcagggcacggtggctcacgcctgttatcccagcactttgggaggccgaagcaagtggatcatctgaggtcaggagttcaagaccagcctgatcaacatggtgaagccccgtctctactaaaaatacaaaaattagctaggcatggtggcggtcacttgtagtcccagctacctgggaggctgaggcaggagaatcgcttgtacccgggaggcgtaggttgcagtcatcgcgtcactgcattccagcctgggggacagagtgagactccgtctccaataaataaataaataaataaataaataaatacataaataaataataagaaaatgtaatccccaatgtaacagtgttggggggaggggcctaacaaaaaatgattaggccatgagaactccgtggattaatgcagctatctccagagtagattcacgctctctctctctccctaccctcttcagccttctgttcagccatggaatgatgcagcaagaagatcctcatcagatgccatgaaatgagctaagacagatcagctcccctttaacatactgtaggaaacactgcatcccagagtgaggaacaggcacgcatctacactgacctatatcattaggggctctgcagtaatatccccagtgtggctcgtgtacgtttcccactctgctgattaatgaacacagcatttcagcagatgcctgctctgactttcagcacttagagacaggcagataggtgacagagaaagaaaaacaaaagccatactaccatgacagcttctaatctcggatcttgaatgtatctggtctcatggaagtaaatctgacaacctttctatttttaaaatttatgatgacgatgatgatgatttttcttctttcaccctggctctgtctgtcttaggagttgtgatgctcttatgataggtgaaaaataggttaacattgaacttaagacctgatgcagttagctttcattcttacaaccagccatccaaatgatagaggaaaagatcttagcacctctgcagctgctcatcaacactgattttctcaaatgataaataaactgccctctatttgctggtgtgaacacgtagatgaatattgacttagacaggtgctgagctcctttaatttcataaattgcattgtgttccttctccactgcaagcagaatccttatcgcttcttatgcagctaatcgtttattgcttattaaactgctaataaaatccagaaactatattgctttactgattaatacagctcatgaagaaatgtgtgtaattctaggctttcaaagtcactcattctgaattgaaggttatatatcaaaggcagtgaaaataacatagtactttcatttctcatttaatctcagaaagttatgttttccatttatttcatttaacatgattttgtagtgaatatttatccaaatgcaacatcagtgacagagaagcatatgaaataatgacactatgtaagtaaaggaagtcacatctgcttgtcaagttaggtttttggcaataaacataaatttgtcaaggtactctatcgcactttgcatcattatggtttggaagaaaaatcaataatgcatttgtaagggttgtattcactgaaattaaacaaagcaacagtctctggtgaggctgcactttaggtgaactcacaatggaaagttatgggaaaatttaatgacaaaacctatagctttatagattgagaagctaatcaaatagtaacagaaaccttgaaagtaaatagatatcatacctacattatattgagtataccatacaaaataaatatttatctgttatagccataatgtattagaaaatactaaaaaataattagctctcaagtagctattgcaaatttccttgtaggcatttgaattagattatataaaaattagtatcatctgaaatgtttttggatcaaagttccacaaatgtccacttttgtgtgttaaacagtctttgtgaagtatgtatttggaaagagatattgctttattttaagtcaaattaaatgagaaaaaagaaaaggaaagaataaataaaagaaagacctgagtgtgaaaggaaaaaaaaaactttgtttttaaaattgtttgttttgttattagcagggatatccctgaaggaaagtgtatcttttctaagaatttacaataggatatctaccccaatctgttcaggaacgtgtgcattagaaatactggctgatgttgctatatctttcttcaagtggaacacagtgatttacaaccctaccaaaagtctcggagagcccatagtcctttatcctccagaatcctctttacttcagactttttgatccttaccagcctaataatagttggtatttgattttaatttttaattgtatgctattatttttatctctttttcagtgagagatgtatacatttgctagggctgccataaaaattttacaaagccacccataaactgggcggcttcaacagcagaaatttattgtctcacattctggtgaaattaaggtgttgctagggctgatttcttctgagggctatgagaaagaatcaggtgcatgactctccttgcttttagtggcttcatgctttccttggctcatacacgatatgctccctgtgacttcacatcatctttccctgcgcgtatgtctgtctctgtttccaaatttctgcttttcttttctttttttttgagattgagtctcactctgttgccaggctggaatgcagtggtacgatctcagctcactacaacctccaattccctggttcaagtgattctcctgcctcagcctcccgagtaactgggattacaggcatgcaccagcacacccagctaattttttttatattttcagtagagatagggtttcaccatgttggccaggatggtcttgatctcctgacctcgtgatccgcccacctcggccccccaaagtcctgggattacaggcatgagccaccaagcccagcctcatttttcaaataagaacgccaggctgggcctggtggctcaagcctgtaatcccagcactttgggaggccaaggagggaggatctcctgaggtcaggggttcgagaccagcctggcctacatggtgaaaccctgtctctactaaaaatacaaaacttagccaggtgtggtgttctgcacctgtagtttcagctactcgggaggctgaggaaggataatcgcttgaacccaggaggcagaggttgcagtgggctgagattgtgccactgcactccagcctgggtgacagagcaatattctgttaaaaaataaaataaaataaaataaaataaagtaaaataaaataaaataaaataaaaacatcatttgtgttagattaggccctatcttaataacctcagtttgacttgattgcctctacaaagaccctatttttaaaaataaaggtcacattctgaagtataaagagactcagcatgtcttattttggggaggtacacaattaaatgtatcacaggataatataacttttccttaaatgttaagggctttatagctagtatatagttgtcagatgtattgtgaatattatttccaggttggtatatgtcctatgattggtttgtggaatactattgccatagaagtttccatttttcatggtctgatttgttgttctttccatgaagatttctctgtgttaaagaaggaaaccatagacactgggttctacttgagggtggagggtgggaggagggagaggagcaggaaaggtaactattgggtactgggtttaattcctggatgatgaaataatgtatacaacaacccggtgacatgagtttacctatgtaacaaaccttcatatgtatccccaaacataaaagttaaaaaaacaagatttctctgtgttttgtctattttctaatgtttttctctagtactgtcatttcatttttatgcaaattttcaatcattttggaatgtatcttgacatacaggataaggtagatattcagctgtattttacctagtagatgtgctaattgtcctaatatcttgtattgactaattcatgtaataatgttatataatataacaagggaaaatatttattgaatttgactatgttctaaactacagacactcttctaaaaactttatgttatcagtcatttaatactttaaaaacccctccattgtttttatcatgtgcatttcactgatgaagaaactgagacagaaaagaattctacctgcctatcccatggctccaagcctgtgcattcaccctagctgggaaaacgtccaagaactcctcatgcttcagaaaagaatatccctccaacagtatgcactaaaaattactctgtatccatcaagtaataacttgtgaggatgcttatgtttctctttgctatgccatccaacagttttactaaatggcatcaattttacctagtgtaagatgtattaatattgagttatatgcatcttaatagaaatataactttgaagaggagtaaaaatctaatagatgagccttccagcatcactcagatgataggaggaacaacaaaggaaggtgtttttgttcatttcccttggacttgtccttagcttctttcctttttcccagctacccattctactggggtcctagactgtggcaattcaactccaagtgcccaaaggatgtcaaaattagccttgggacaatgccacaatgccacatttctacttttttttttttttttaagatggatttttgctcttgttgcccaggctagagtgcaatgtcacgatctcggctcactgcaatctctgcctccgaagttcaagcaattctcctgcctcagcctctggagagctgggattataggcgcccaccaccatgcctggctaatttttttatttttagtagagatagagttttactatgttggccaggctggtcttgaactcctgacctcaggtgatccgtccgtcttggcctcccaaagtgtgggattacaggcgtgagccaccgtgctgggccttctgctcttcatatatatatgtatatgtgtatatacgtatatacatacgtatgtatatatacacatataataattatatgtgtatatatacatataataatcagtaaattgttaggcattaggctatcttctatgtcaaaagtctcattcccatgtgataaaatgtgaagattaattactttggtaaaaatgaagaataattatactgaaaaatcttttatatcaacgatactttaccaaaagttcataataagaagaaataaaaaggtaaacaaagggggcaggggataatatacatcttactggcctgtattagacaacgtgaatacactataatctacttttcctatgggtccatgaggagatacacacgaagatttttatcattatattttttgttgtaacaaatagaagagtcacatatctgtgcatcactaaagcagcagggatataaaatgtgttacaggcataagatgagatactataaagcaatcagaagtaatgaactaaatttacatgcagcaacatggatagagctcaaaactataatgttcagtaatagcatggaactgagcaatatttttaacaaatataatttttgcaattaagaataatgcatgatattgtttggctgtgttcccacccaaatctcaatttgaattgtaataatccccatgtgtcaagagcagggccaggaggagataactgaatcataggggcaatttcccccatactgttctcctagtagtgaataagtctcatgagatctgatggttttataaagggcagttcccctgcacaagccttcttgcgggctgccatgtaagatgtccctttgctcttccttcgtcttctgccacgactgtgaggactccccagctatgtggaactgtgagtccattaaatctctttcctttataaattacccagtgttgggtatgtctttatcagcagcatgaaaacagattaatacaatgcataatcaaaaagataatatttttatgatactcataaggaaaagtatgaagagtatagtagaaggattggtatactctggaatgattgtttttagacacgtgaaggcgtggggaagagggatgaagataaaataccataaggaatcagaattgtggcatcttgccatgaggctagtgagccatgacctgaggtatatgatcaactcaattttgtacagctgggctctgacagagagaaaaaagtagataggaactcatcatatgggcaacttaagcctgaagtttaacacttagacatagagtgattttattgctgtggaaattccatcctgagtgataacacagatgacaaataatgacaggttgtagatgccttctcagtaataatatgtcttatgtcacattaggctcataatgaatttggaagggatttggagcactgatccaggttttttcagcaacccccattagaaaatgaaagctgtatgtattgcattactttaaaaaatataaaaatattacagatttgatacaactatttttatactttacaatgcatattttgaaaaagaaaagtttataaatttttaccaagcgattaccagaatattttgagacaaatactggataagaagaaacatcattaaagggtgtgaaaaaatactacctactttataaggggctgatcatcataattcattttactctttatgatatttggaatttgggggagacaattttccatgcatctcttgtgtttctgtatagcctgcaaatgcggtactaactggcctttagttctgaaccatgttttcaaggatggaagacagaaatgaattctttcactggagcgaagggtaggtctagttacagctttgggagatagagataacatccccctccagagcaaaagtcaagcatgcctactgcccattataaatgattcagaatttccaagttcaggagtcctctgctgtaatgcaactactgcatgtgcaggtatcacttggtctttttcacatcaccttatgggatttcaggttcagggaacaagcacaaaacatgctgataatactgtttactgctgtcactatgagtaatgaagtacattgcctctgacctgtcagtttcatgccttctaccagcatccatgaacccagcatgctaagctgttagctcacaagcaggctgacatcttaagcactttacagtccttaacagtaatcaagaggaaaacaattggaaacactctgaattttgatttttgtttgtatctgtacctataccacaaaaagtatattttatttattgaagactgttgaagaaagtactcagattatcaaaggtattgtagaggaggcaaaactcaagttctgtcctcatagagtcccagcttagtgaaaaattcaattgacataagacagattagcaggaaaaaagggcacatatttacataacataagttttacctggcacagaaagaagccctcataaggacaggaaaaccgaaagaagtagttggagtcacttacatagtgaactgggcaaataatagtacattttgaaattagacaaggtaaaagggcctggactagggtagttaatttggcagaaaagggactgggaagataaagtttagtttaacaagatttgtttgtgcatatttccctaggcttcaatctcctgtccttcataataaaatgctagtttctttttggtatagggaggacatctttcctatgagagttttatctcctgtttttaagcaacagaataaacaccagcataaacatcttgcacctgctgtgttttgtttaagtgcctttaattcaaaatagccaatatgccagagcaccctatttaggggtccttcttcagggtgaacctcttcttcatctgacaggttcttcctgctggtgaacacacaaagacaatggcatgacagaaaaggaaaagtttaatagacatgaggccaggtacgctacatgggagacaggggtagtactcaaatcaatctccccaaaggcttggatgttagaagtttttcaaaggtaatttgggggaaggggtgggggtggctaggcaataggcactcacttctgattggaagacagtgcaatcatagggttgtgggaaatggtcctcctgtgctcttccttgcttctaggtggggctacaggagtgtttggtgggtccagatggagtaatcagtgtcatacatgcaaaatacctgaaaagatatctcaaaaggccaatcataggtgctacaatagtgatgttatctgcagaagcaattggggaagttgcaaatcttgtgaccttgggaataatgtttggtaatcatttatgtctacaccttagcagatttcaggctcctctatcctcctagcctggtggtctctcattaatgttacaaaggcggttcagttttggggaaaggctatcatcatttaaactataaactaaatgtctcccaaagttagcttggcttaagcccaaaataattaaagacaacttgaaggctaagggcaagagagaggttggtcatatcagatctccctcactgccataattttctcactgtatagttttcacaaaggcagtttcagtggcatattcttaactccttgagtgcgcaaccatggattctacaaagagagttgaaatagttactcaactatattccatgatctgagtacttcaaaatgttccccaaatcattactttccttttattttcttgggtgggtgggtggtggtatttattcattgccctttcctgtgatctcctttcaagaaataccactatggaggtaacactcttgttacaaccaaatacatatttatttgtcaactgattctcttagatgacactaacaaaatgggctaaagagagatatacctttaaaagttgctctttattgtacaataaattaaacataaaaatttaggtaagaagagcatggattatatgtagctgctttcccgttttccctgagaccaaccctttaggctctgatcataaatctaggaacgttctctgttctctatactttgttgaataattcaatttgcgtttcactatgcatttggtgctcttggttacaagtgaattttttcatttacataatcatattctgcccacttgaatattccctgcacagttgcacttttatataatatacttgttcaccatctgtcctcaattttggtcaagagatgcttcatattttccaacactttgcatggtaattgtgctaccccaaaagtcatttttgttaatacacatcttgcttatgtggaagagacactttccgttctcactggccaaaagatggcctacctttggaagctttacatctacctatcataaacaaagagaaagttcttacaaagccatcaaatatatttgaaatttgaaatgcatgtatacatacacgggtactataatttttatgaaggaattgcttgaaattaatgacttttcgtgtctatattacatgtatttctgttctagaattcatagtaaagttaaaataagacataaaaataatgtaatattactcatattatttgaaaatcttcttcaagtaattccctataacattatacaataaaatatgaatgtatttagaaattatttagaggccattcaagattatcaggtaaattaaactgctctgctatttgtttttctgctaaaatgaaaggatgaataaaagtatatagcaaatcaaaatattttgtaattgaaaaaaaacacttcaacttaactgaatacatttcctgactttttctaaaaagcactctgatgtgagaactcttgataagcctgggatgctttttccctaggacaaggggaaaaagttttctatttcaaactctctaattttctatttcaaagagaagaaaaacatatttttcttgttttttctttttgatgcattcatatgtgtatacatacgcacacacatttctcttcattaaattcagcagttttggccacacttgccacatacaacaagcccacttttgattatgttttttagtcagatgagtacatgagctactaatccaaacacacgctaatttaaactaaaaggtcagtagagttatttgaacttcctcttcctcttgctataagtattttgtaatatagattaatttcatagtctgtcatggtcgttttttttcccctcaactcttaattgcatttaaaaactctaacactaagataatatcgatctccaagctcagcaaagctgaatcaatatatttatcaaaataattagccaagtttgctagcaatcttgtcagggaggcataacagtgtaatggtcagagaaacgttttgaagtaaaaatccctgcacatgattacccactctgtaacctcctggctatatgactttatgctagtctttttctattttgcagctaaatgtctctaagcacagatatacattaaaggggcagtttaacagaacgttcatcttataatgtgagagaatataagcaaagagatgagtacaccccatgacacatagtgagctttcaatcaagcatggtcgtagttattttaacattaagatgaaatcatcatctgaggactaaactccgatatttttgtcttgtccaggttcctatcaaaggggcctggggagtcatgccctacaaatcataaattctcatcagatgggtgttatttaaccctatatatctgacttactttacaatcttactctggcataacattacgagacaaggaagaaaatgaaaatattttaccccaaaacatgtttctttgccatatcttgaaatcgcccttcaaagttgtcctttgtgggggaaaaatttacatctgtaaagaatctctattaacatagctagatttttttaattctaggctctcccagtcctaaagagattaactaaaagtctagcaccttttcaacacttgtcacctattgtctctaagggcagccatcagaagaatcttggtctccatgatctttcatcttaacctgaacatttcccttttatgatcccaggtctttagataaactcaccagttatcaatcagaaaatgtttaaatttacctatagcctggaagtccctgcttgagttgtcccacctttctggaccaaaccaatgtatttcttaaatatatttgattgacgtctcatgcctccctaaaatgtataaaaccaagctgcgccccaaccaccttgggcacatagtctcaggacttcctgagggctgtgtcacaggccatggttactcatatttggctcagactaaatctcaaatgttttacagagtttgactcttttctttgaccaaaaatacagttattctaataaatatcaaaatagaataatttcttattctctctgcttttcctctttgctttattataatctcccttgcaattatataggggtcattcctattttaataatatttcactattctctgctttcctctgagctttctgcttactctgacttcagccaatcagaagcagtggagggcctctggagagccggagggaaaaacctggatatttcttcttttccaatatgacatcaggtggcatctctagcagctggcttggagtttccacagaagaggtctgcttggttccagctctcactgggtgacccagccccagtgttttagaaatactgcatccccacaggaaacagcagtaggagctttttgttacgctgccttactatacctagttggggtctcagctattctacttcctattatcagttccccgcattgaattctgtctgtttcaaatgctctagaatagattttgttttcttggttggagtgtgattggtactgtgtgccattgaaaccttcttttatatgctattcctacatgatataaaaatatatcattttttgtatgatcattttctaatgatataaaacttcttctttagtctttactctgggcatattctatcttgcccttgatgattcctttagagttctggacaattggttacacctataaatgtatctaactatagaaaatagtcacaaagaattagattcctaaagaaaatgagtataaaggggatctcttacattattaaacagtctccttattctcaattgtttattgagaataaaacaatattttgtaacaactgttatcatgtaaactgctgcacatgtgttatttgttgtttttaaaaataaaagaataaagacttcttttcttcttatattgttgcttaatttttggggaagagtagtgttgtggtttccatatatggaatcagtgtgtacataaggattctatttgaagccacgttatgtcagatagtttcttccttcacattgatgtgcacaaaagaaaatccaggatattagtacattacataccatttctttctgagagggagaaatcaagtaagagtgtccaatcgcttcactttgaagaataagaaataaaatagattcccagacaaaacaacacagaggatttgaaaacaaagaggtgaagattttgaagcattacttgttcattgcagcaactgcaaatctcaggagaacaatcttgaggccaacaatccaggaacaaagaggtttaaagtttacatcttggtttcagtcaataaatcccagggtaatctacattctcttttaaccacccagataaacactcttttatttacatagatgctatttgatagtattcaaacactatcaaatcttaatgctcttgatagtattgacaacatgactttcagttatctcccaggactgccttttatatacagactgtggagcgctatgcattttaaccaaaagactacgttgtctatttccataatagctatgtttatggaatacatcttagttccttggtttaacttcattttagaaattataatttattcttaatgttttcagaacattcacgtagttacaaacacatattttatactcagcttcaaaaatggatatgataataagatcagaacctgcattgtaagattagcagctaaaaagacattacaatatattgccatcaactgcttcacagcaccaagttttttactggttgtacttctgtttgaatctaccattcataaaatatacattggctatagtattatgtgatgcatgttgcgtttcattatttgacaaattggaaatgcaataagtttgatatcagggctgataccatttcctttgtagcaatattttagctttgggttgtgacaaggataggcacaattttggtcctcgcgactttttttttttttttttttttgagacagactctcgccctgtcaccaggctggaatgcagcggtacaatctcggctcactgaaacctctgcctcccgggttcaagcgattcttctgcctcaacctcccaagcagctgggactacaggcacatgccaccacacccaagtaatttttgtatttttagtggagtcggggtttcaccatgttggccaggatggtctcgatctcttgaccttgtgatccgcctggcttggcctaggaaagtgctgggattacaggcatgagccactgtgcccggctggtcctcgtgacttttatctcctcatgtcatattcatgaacatgttacattatatagcataagtgattttgcagatgtaattaaagttactaactagttaactttaaaaaagggagagcaccttagtttatatgggtgggaccaacctaatcacatgagcccttaagaaagcagagcttccttttcctttatggcagaaaaggtagtgagagatttggcaacgggaaaagttagagaggttcaaaacataaagacactacaggccattgttggcttgcagatgaaagggggccatgtgtcaaggaaatggaaacatcagtcccacagttgaatttacctgaattcttccaacaaccaatgcatttaagaaaagaatctggccgagacgggcgggtcacgaggtcaggagatagagaccatcttagctaacacagtgaaaccccatctctactaaaaatacaaaaaattagccaggcgtggtggcgcgtgcctgtagtcctagctactcaggtggctgaggcaggagaatggcatgaacctgggagatggagcttgcagttagccgagatcgtgccaatgcactccagcctgggtgacagagcaagactctgtttcaaagaaaaaaaaaaaaacaatccaagccccagatgaaaagtgtagcccgggccaatacgttggttttagcctagtgatgccttaagcagaaaagtagccccaccacagtagacttcactcccatagaatttcacttctgtatataataaatggtgttttaagccactacattggtgatcacctgttacaacaacaatagggaactaacacagtgacagatgctatcttcgttcagctaggctggagcatctgcaagtctctttttttttttttttttttttttaatgccagtgaactttttccatcattactggtttccaagtaccttgattgctctgatacatatttttttttccctcttttttcttttttcctgttgtttcttggtcaagaaatgaatgaacagagaagcaatatgttatggtagagtgacaaataggggttataaagtccaattctaggccagcctctgctttactggagttcgtaaactcactcaagttaggtagcttttctgggtcacggtttcatctgcagtacacaatgaaaggtaactctaatttccatgccactgtttaggtgctatgactctatgaaatattgatttcacttcttgtatatactaaattatttctagtagctttaaagaataagaaacaagttgaagacaaagagccagactctaaatatcttatttatttgaagtgacttgaataaacatacgaaaatcctaaatgaaagttatgagagcataaaatcaagttatgaaatgtgtgctccagaatccatgcactattctattccctaaaattatatacatgcatatataaattatatatatataatatatatattatatatataatatatatattatatatatattatatatatataatatatatataatatatatataatatatatatatatatatagtgtgtgcgtgtgtgtttgtgtgtgtatctctgccaagggctattggtccttgattttaaaagctggacaaaatccagttctgaagtgatgagcagaaatgttattcgctttaaatctataaacgataaagagtgcttaagtgctgggcaacagtagaacagcaaagatatgtgagacaaaaattctgatttaatggggttacatcattgcatgtatacacttatatgggtgtatctgtaataatactgatgttagctaagcaatatcctatgtgaaaaaaatgtaatgttataatgagaaaaccttcccttgttgtttcctttagagtagacttaacatagataacataatttaattttacaataattcaataagattaagtgctatcattactcctattttacagatagccaaagtggctagaaatctaaataatttgtgcacactcgtatatgaagaaaatggtgaaaaaataatacagagacctcaactctagaaccatccagaatcaagccattttcctacaattacctctattctttcctaagaaatataagtcaagtatatccaactctttgtttattatatctgcttagatacacagtcccaacaaacacaattttttcacaacaaaatgcgtgatttttactcaaattcagtcctgctttaatgattgctattcatgtggatgggacatccagtttattagctgcacaatctggaagccacttaaattaatcttaaatgaatcatttttctattccctctcccacaaaattcaattttaatacatcactcagtgtattgtttcagccttttacatatctcggaaatattcgttgttgtcgtctctaaaaccaccatctcactgcttgctacaataacctcttgtgactctggcctagactgctatacaccacttcatgattaaagcattgtggtggcttcctgattcaaatgcatttaaaaactgaaatatttaagattgactcagagctccaaattatgcatttagtctctttatgtcatgtgtgaaaggtatatacctttcacacatgaaaaagtgcatagaattttttactaaaatgtctgccttttctgattctccaggatcctaaaatgtcaaggagtcttcactattacacttccaaaaaatattgtctccctctttctctcaattatgcacagacttccatttactttgtttggttctcttctttctctcttcaccattttctgcatcatacatctgaacgtgtcataggcagcttccttaaggactctattattcttattaccctaattgcttttctgactagaataaaaacaaggagtatagttggggtgggggatagttgaggatgaagttgttaagcaggccacatggaaagttctgttctggggagtgataattgcagtgaaaaagtggagtattgacagtgaagatgataagaagataaacaatttgagaacaagaagaagtaataggatcgccttttcaatttttcctatgtacatctcttggcatctaatcaagaccttgagtgctgagaaagtaaagactgtgtacattacatgcagatttcgttgtcaggagtcaggcaaacactaaaccttgctcagtttaagtcctctctcttcttactataaagttgtgaacactggcattctttttggctttgatgtacccagtattgctaaagaacagtgtaacattggacactactcaatcttctacttcgtttttttttttttttttttttctgagatggagtcttgatgtgttgcccaggctggagtgcggtggcctgatctcggcttactgcaacctctgcctcccagttcaagcaattttcctgcttcagcctcccaagtagctgggattacaggtgcatgccaccatgccaggctaatttttgtatttttagtggagatggggtttcaccatgttggccaggctggtctcagactcctaacttcaggtgatctgcccaccttggccttccaaagtgctgggattacaggtgtaagccacagctccccgccaatcatccacttcttaagatgcattggaaggaagggttgacatttaagtatataaattatgggtttttgtcaaaaaacttcatgccttcatagccaaaaggactactgatccctacaaggtatccatgcctcgattatcttttttatttattcacacaaagtagtgtcatttgcatgagaaagaaaaaaatgaaaatgtgacatatatctaactttcaaatggctaaaactccaaatacgtatcagagttcctggtttgcttggagataagtgatttccattgttaaacattggtattattctcaaaataaaaggatgctaataaaaacttcattaaagaggagacaatttgcatgtgaacaagaaaacttcattccacaaagaaaaagggttgttttctgaaagtaaagcaaagtgtaacaaacttgccttgctgcctgttactgattatttttgcacccctaggaaatcaaggggaaaaatctctgatactttatttccttcagctttgtacaaaactgaatcatcactttcttttttggtaactgaaactcccagagctactgttttcttatggatccaaattctcagaggttaattgtgtttttattgagtatcatcatagttgtgttgcactacataaacacaatgttaattttgtccttggcatcatggttgaaaactagaaggaataccagtaataccaggacagaaaaaacaaatatacatattcagtggaatttcaattagcctcccatcctccattccccaagaataaaggacaaacattatgtatcagtagatgaagtattacatgtatgagaaaaattacatttgaggttaaaaaagcaattggttattcaagctccacaagcaagagagaaacaccactataataaaatgatatgttgacatgtttatgaaagatgtaaaagtatatttgtatagattttacattatttttgacataatgaataatatatttaacttgttctttaatatatggaaatgtgaacatatttatgcaaaaagaacaatggttgtggaataagtaagaatataatttatagaaataatttataaaaactcatttggcatttgtttttgacatgattttgtttacttttctttcttttctttcactggattgagactaatgattacagttttgactctttaaaataatctggaatccagatggaaggcaaagcattaatttctttattcaatttatcatgtaacttctatacctcaaatgtacaggttttttaaaaatcaaatttaataattttatcatcacaaggttacttttctggagaacccaatagagacaacacaagtaaaatcatttagtggaaaaattgttttaaaatactgtattaagcaagtaaatatttagcaacattatatgtaattaaattttttgaagttgagcttatctcaaaattataagattatgaaggcaaaacagtgagtttatgtttcacttaattccaaatttaaaattcagacttatatctatattatgagcaagaaagagctcttttctacttctgaatgttgacaggcaattctccatgggtatctagcagttctacacatattgggaagaggcattgatggcatttgtttcagattctcatttcaaggatgtttgcctagtaaatggccttggaagatagagataatatctcctttcccttgacaaagatcaggtatgtttgcaagcagcccgcttataaaatcgttggtatcctaaactcaggggtccttagctgttacacaaagctacccagcaccgacttgggctgtttcacagcatccatttggcatttggagggcaagaagaactaacaaagacatgcagttcatgctgcctaatacgtcatgaatgagaaagtcttacgtctgattcgggagtctcatgtttctagtaccttctctgaaacttgttaatttgcaagtagggtaaaaggtaggatctcagacacttcacaattcttgataattaacattaagtttttgtctataatgtcctcattgtaaatacagtataagctgtatatgaagtcacttaaacatttgtgtatacatatttttgtgtattccttttttcatataaagggctattaaattttatattcataaaattcctcatgtctttagtatatagctacaacttagttaacacactgatgtacctatcaagaaacagaacattaccaagccctctggaaaacccctttgttcacttctagttacaaatccgccatcaaagataatgactgcctgaacttaaaacatcatagattaattgtgccatctttttactatattacatataggtgcaattattgaacaggttagcttcaaagtaaccactttgaccaccacagatccttcacccatgcctgaatctgatcccacatggcagcaattaaaaaaaaaatacttattaggtcatgttagttctctgctcaggatctttcaatgcttttcaccatttttagccatatattaaaactcatttctgctgggcgcagtggcttatgcctgtaatcccagcacttttggaggcctaggtgggtgaatcacctgaggtcaggatttcaagaccggcctggccaacatggtgaaaccccgtctctactaaaaatacaaaaattaggtgggcatggcggcacattcctgtaatcccagctacttgggaggctgaaggaggagaattgcttgaacccaggaggcagaggttgcagtgagctgaaatcgtgctgctgcactccagcctgggcaatagagtgagactccatctcacaaaaacaaaaacaaacaaacaaacaaacaaaactcttttccttggcttataaggccccacaagatcttccgaaggactcatctcctatttcccttattcctcactacactaccagctttatcatttctcttgctttatcttttcctcgtagtacacagtgtctcctgacattcctctatagacattaatttggttataagccatctatttcagtggaatgtaagcaccatgagagtctatgctggatgtttttgtgaggtatttgtggatgagattaacatttgaattggtagaatgagcaggcagattgcctgttgcaatgtgagtggccatcgtttaatcagctgaaggcttgaataaaacaaaaaacctgagaaagaagactctctctgcctatctttgaactgggatattgaattatttcctgcctttggactctaactgaaacactgatcagctcttcctgggttttgagtttaccagcctttggactggaactacatcagctctccttgttctcaggtcttcagactttgaaatatagctaaaccattggctctcttgggtctctagcctgacaattcatcctaaatatctggggagttcttagcttagataatcacgtgagccaattccttaaaataaatccatatgtgctatagaaaaaatgtttgtgtctcccccagaattgatacattgatatcctaacatctaacatgatggtattaggaggtggggcttgtggtaggtataggtcaatgaataggataaatgcccttatagaagagaacttggagatctccctcattccttctgctatgtgagcacctagtaagaagacagtcatctatgaacaaagaaggggcgtctcacctgacaccaaatctgtctatgtcttgatcttggccttcccagcctccagtgctgtgagaaataaatctgttgttagtaaaccacctagtctatggtagtttgctatagcagtccccaaaactaagactatagtcagatattatgtatccttttggttctttttctatgaaaaagtctgactaattcgggaagtcaagatgacaaatccaaagtttagtattagcaactgggtatgtagtcgttcgatttattttgaggtctagaaagccagagaaaaaggaattgaaagacaaaaattccatctgagatatctcaggttttagatggttataaggcatacagatgattgatttttgttttttccttattctattttaaaactttgaaaagaaaaatgtgttgcctttgtattctgctctgtcctacgcgattttgcagtaatacagttaatcctcataacaaccagacaaatgagacctaattgttttcctgattttaaagatgagaacataaatattgaaatgtcttggtcagacaaggtcaaccacattaggaaatggcagcattagaatctgagccaagctttcttttatgccaaagtgtagcatttaaacaataaggtacattatttcgtttccttgagttttttaatttttaaaaaagttttgtaatttttttattttttattttattttttattttttttctgggatggagtctcgctctgtctcccaggctggagtgcagcggtgcgatctcagctcactgcaacctcagcctcccaggatcaagcaattctcctgcctcagcctccccagtagctgggattacagcgcgcgccaacactccctgctgattattattattattattattttattttatttcattttttttgagacagagtctcgcttcgtcgccaggctgcagtgcagtggcaggatcttggctcactgcaatctcagcctctcgggtagctgggatcacatgcgtgggccaccacgcccagccaattttttgtatttttagtggaaacacggtttcagcgtgttagccaggatggtctcaaagtgctgatctcagtgatccgcacgactcggcctcccaaagtgctgggattacaggcgtgagccaccatgcccggccttgcttatttttttcaaaaccagcttacttcctgaggtctgtgcatgcccttgccatctcatcctactgtttgttgttgttgttttaacctctaacttccttttttcatgagttacacattttattgcacataatcaggagcaaaaatgatggcatgtggtctttggaagcaggtccttcagtgcctttttcctctttatgttgctttccttcttcctttacttacatttatttattaatttatttcagttaatgtatggatcccatactctattaatcttcttaaatttatctttccctggatctgatcttcacatgggtgaggatctttgaatgtatggaggcattttttattttttcctccttatcactctgggccataaagctctgcttctttcagaacatgtgcatgagatatttatacagctcttcagctaaggttactaatatgcagccctgtgatgccaccagttataattctattactgcattattactctttcaattaaaaagaaatagtagaaaaacaaagcaaacaaacaaacaaaaggcaaaataattgcatttcagaggatgtctgttcctgtgtaaggtgcacctgtccttgcttcaaggggagtgggttacttttttttaagtttttatattttcaagattcggggtttgatacaaccatttttttttttaactttaaattctgggatacatgtgctaaacatgcaggtgtgtcacataggtatacatgtaccatggtggtttgctgtacctatcaacctgtcatctaggttttaagatccacatgcattaggtatttgtcctaatgctctccctccccttgtcccccactccccgacaggcctcggtgtatgatgttcccctccctgtgtccatttgttctcactgttcagctcccacttatgagtgagaacatgtgctgtttggttttctgtttctgtgttagtttgctgagaatgatggtttccagcttcattcatgtccctgcaaaagacattaattctttctttttaatggctgcatagtattccatggtatatatgtgccacattttctttatccagtctatcattgatgggcatttggacaaccatattttttgttgagttttgtttctttagcggcttagccgtctctgctggttttagttagttccagctgagtcaatggctcatcttagactgcacttctaccaccaacctctgcaagtaaatactccataggacttctggcctagacctgaggttgccatggattcatattgagcaagtgagttccatgtacacatcccagtgtttcctcaagtagcctgcacgccctgtctccaccctcagtttaagaacaccattgaggtttttgagatgttcttcttactttctgccaaagcaagatatctgatagaaggagaaaccctgtattgactccctcgctttttgtttattccaaaattatgctctgtctggctgacacattgtgaaatttaaggggaaaattagaccttttcctcatttcactttcattgtttttttttttttaaatctattgtgtatttcattcattttgggggggggacaaattctacaaactgctttaatattgtcctttttttctaatattcacattaactttttgtgtaaaacataccaatgcttttaataaagcttacataggagtaaactattatagacctgcatatatataagtacacatgtattaatctacattaaaataatggattttattctgtgaagactccaagttgctcctgggtgctaagtgaagcacttagggaaatgtgttcagtctttgaggtcataggaacattagattatatcaaaggaaacctggagtcatcagctaagtggcccttctgtcctgtagatacataaaaactaatgtgctctgctatgcggctcactttctgctattagatattatgaggcactaagaaaaaactactgcctgcatcatacctttcttcggtttgagataaagagattggccagaactgtatacaagtcatgaaaggccctggtgtacatttttcaaagtagtgcagattgtgttgaaattatcagtttatcttgcatataaaaaaaacttatatacactttgagtaaaatataaaaagtggtaaatatcaggaaaagtttgttttactatagccatttcttgttctattctatttgagtatttgctctatatatttgatatacttccagaatgcatcctattcacaaagcaggcaattactctatcagtgaatacagttgcagagtctctcatctattcagcttcatttgtacctccactccagccacttgcagaaatggcggatgcatcaaaaagactggttacaggccttgcaacctccaagcggctaattaccaagatgttaagtaaatgaccattgctctttatcatccccaatggcgtataaaaaggatgttaaacaggttctctcatgttccccatacatttattcattcccgtgttaaaatacgtcttatgggaaaaacaaaattcaccaaagaatgaggaagcgaacatgtgttaaaagagggacttctggctaattttacaaagaaggataaaaattctcaaaatatgtgtggggtggattgtgggggtattacatattcatagcatgccgcagaaatcattttaagtctatcaaaaacaactatattgtgcattttcaaataagcacatataaaagatgagctataagaagagagaaggatgctaaaataaataagtgaaagagaaaaatggctgggcacggtggctcaagcctgtaatcccagcactttggggggccgagaggtcaggagttcaagaccagcctggccaacatggtgaaacctggtctctacaaaaatacaaaaattagctgggcatgttggctcatgcctgtcatcccagctactcgggaggctgagacaggagaatcccttgaacctgggaggcggaggttgcagtgtgccaagaccgcatcattgcactccagcctggacaacaagagtggaactccatctcgaaaaaaaaaaaaaaaagagaaaagtaggtgaaaagaagtaattaaatggtaaggaaagaataggtcaggacaggaatccaggatgactttactatatttgaaccatagaacattaaccaaaatcttatttttcttcccctcagtagtttgaagttgagcaatatctgtgtcttttgcatcacattctgaaattgcaaattatttcttgtcctttcagataaatgattatgcaaaagaagcccagaactggcacaatttagaagatttgaggttgctctcatgtgtttgtagggtatgctatcatcatcccatagcctaaggctgtagtactggactctctggaagcagctctgaatgtgataggatggagataattgaagatacaagcagccattatgtgtctgaatattggtttactagaagagctagatgtgtaggagcacatccttacttgacaaatgtctgacagaatgacctggcaccattactgttttaaatgtgtaatatgctatctcaactgggacattttatgaaagctataggttgtgacctactgttcattacacttagtttctgaggtgccaaagattgatgtgtgagccaaagttcattattgttcttcactggatctttgcatttattagtctgatgctaatgggattcactcttgagttggattgatggtcaaggttagagccacagatgagctcctgatcttgaccagaaatgatttgcccattgccaattagaagaagaaaagggcaaggtggaggttgaacttggagttaataggaataatagatgctgagggtgcaagatgaaactcagtaagataatacactctattcttagactggcaaatttacatagtagagagaacttttatcattgtcatccaaagaaaatataatcctaagagaaaaagtccagctagttttttttttcttttttgttacctgctcataggatataaacttatttctatcacacataggtatcattttctacacttaaaacacttcttctatttcacacaaatgacaaaaaatgtccttcaattattttgacacatgatctctcaagatacatatccttttatatcaactataagtacaaatttaaaattttgataaaagagaaataacaggaataaaacaaagcagtattttttaaaactatagctgttcccctaagatattctcacactaaagaatttttcccacttcttctcccccactgagaagtacagtcttcaaaaattagtccaggtattagtgtttaccaaggaggaatatttggaacaagaataatctgatgctacttttcatttgtcaagtacattttctaaattatattctaataagacagaatatgcacatttgcatgtcatgattcttacaaatatttactgagtactgtctccctgtaaagagctacagtgggatggatttaagatatatgatacataatttttcatcttcaaattgttcacattttgtagagatagtaacttgtgcataaatgactagaatgttaagttgctaagtgacaagtgacaaaaacgtttaacctgtaaaatcttccccttgggaaattgaggaataaaaacttccaactaaaggaacaaagattgtcatgaacaaagttgtataaaaaataaattaaatgtaggataataaaggtagtgtattaaagtgagaagggttaggatttcttaggtgacagactggcttgattttgtgacttgtgtgacggtagcaagttatgtaacacctctgagtttccatatcttcatctgtgaagtagacatagctgaaccaaccacatggaattgttgcaagggtgaaatgcaatggtgtgtgcaagttgctaggcagtgttggactggatctactattacactatacaaatgacacttagaatttttacagttatgcttaatattgtcataattccaggaaatgagaaaaatctcagcagaggtacaaaacgggcaagctctgggcaaaatgatcttagtgggtttatttcaaaggatgcttgaaagtgatctgtggaaaacaaaattgacaaaaagtgcatgttgaaatggaaattaacaggtctttgaatgttaagacaaagatagcgggcatgctctttcatctatctatccctggcccttagcacacctggtgcttttcagtgctccagctttacgtgtttaatcgttttttttcattcgaaataaattttctcatagatatagaaaaccagcaggcaataaaatatatattctgagctgtgatttagtggtattattacttagcaacagtgtgtaggatgaattacagaaagcaaaagtagggcataattataatcactaagactaattatcaatataaacttttgccagaataattgtaaagatatggagaggtgatgcacatgaaaaacacattaaaaaatcctaagattttgccaaaataagctgtgtaataaaacaaagagagaagaaattgaagaatatgatgaagtttaaattgaagttcaaggtgttttgcatgaagaaagatgagaaatttaaatttgagatatgatgagtttatggtaggaaattgagataccatattttgccagttggactagacctcacaaaaatactcaaaataagtatgcagaacgcattagtttagatatatttgaagagaccatgggaaaaaaggaaaaagggaggagtttaaagagtcaaacaaaaagatgatggaaaggcagtgggagacataaaagggaaccagaaatcttaagaggagaaagtgttctgaagaaacacacaaagtcaattacttaaaaagttgagaatcactggcagtgctggatgatcgtgacttttttctctatttcagtaagggggtgatggacattagaatgcaagagatggatgaggtatggaagtagaaggaataaatgtcaactattattttaaaaaatttgcacagaagaagcaaagtaggataagagcttaaaaataaaggttctgtttattttcattttttagtcatagggaaaatgtgggcatgttaaaagaaaagctgaatgtaaaaagggaatgagaggacaaattgaaatagacatgggttcaaatcccagatcccactggacatctctgaggcttactagacatcatctgtaaatataagataaacacctaatataaaatgtgttcagctataagaagtttgagttagtgtatatgatttttagaaaatcaatttatcatatacaataaaacatatattaaattagacagtatgatgcatattgacaattgtatatcccctgcacatttccatcatatatgaaaacttctcacatgccctcaccatctcaatccctgatcacaggcaaccactgatggaggttctgtcattatgtacaggatatatcttttctaaattttgtataagtgacatcatacatgtgcattattttgtttctgtcttctttatctcagcatcttgttttttgaaatttgttcttattgagtacatcagtggtcagctccttattattgcttagtgtatctcattttaggaataatgttcattgaatttatccattttatccattataattttgagggaaatttggggtttttccagtttggggctaatattaaagctgctatgaacattcatgtacaactctatgtatagatatgtctaactgtcagcttctatataaacattttaaaaatcactatctctaagaaaactaggaaatcaaacatctggaattcggcattggctaccaattgtagatgaaacatactttttcaatgatttagacacaactgtcacagcttacaaaatgcatcttcaccaattagttacctagttaggctctgcagacttaattgtttatctctgaccatagtcctaacccaacttggctccatagttgctgggataagatagattgattttagctattggtatcagtattctacttccccacatgcctatcgaaaaatgctcttagagttttagaactggaatggcaaaatttatttcctgagtgattaaatggctccactcctactattctaggtcaccttgttccttgttgagagatagccacatcctgaatgtggctcttttctctcagctttgcacacactgtcaataggcaaatctcagttgcaagaaactctttaggtagaatggaagtatttttctttctgctacatgaaacctgaaggaagtattctcagattatccagacctaaggaaggatacattcatctatagctccctctcaatttacagaaatgtttggttggtagagagtcttgcctaagtatttaatctggcccaaggtaaagaaatactgcaacctcagatctactggccaaggggagctgggttgttttgaaaggcactgtaatgtgccccctttttcttacacagcagtgggcatgattaggaggcaaaaagctatggaaaggaaaacttaagttcttccttataagaatttaaaacgtgtatctccatggagggcctgcaaagtctttataggatattttgcctttgggaacttctttttttatactactatttcaatctcctcacctccctctctgtctctatttctaattagatagatcacagatacaggtatagataaacatagatatatagatggaaggccttgattggaagtgctacaacctccttccactgttgagtggaagcacctgcttgagggatgtaccagtttagttaggaggaggaaatgaggaggagagtctgatggaggaaaaaaataaaatgttctgaagtgattgagagcacagagagtttcgaatagacctgcaaacagggggcccttgctaggaactagggcaaatccatgaagtgactttgctgttgtgtttacattatttgtctttttccattagatacttgccacagttatattacgcatccacgattttaagatgttgctgttttgggatgcattgttttatttcccccgagaacacagcagccttgtgcaagaggcattgtgcatgactaggagaggaagaaataacaaactccttaagaacaacaggagggggaaacggggagtagttgtttagacaactaatagtcaatttccaggccttgccaggtcaggaaaggaaaatccctaggtggggttcatacctgtagtcaaatacaagtaaaaccaaaaggtagggcctaatccaggcacatttatttttccccaaatactttcaaaaagagagaccactgaaggagtgagggagtctcagggttttaggctacatatgcttttcatccaccttgtctatgcaactcgggtccaggattccttccagccatcactaactgaaccaaattccaaggagccactgcctcacattgccatgctccgtgttttgcacagaggcttcagttttgatcaaacatgttttgttttcgattatcacacattccactccaaaactaaatattatttcccgaaaataatttgtcattttagaaactgatacaactctgaaatgattttatctgtttgaatactttgatgatcatctcagacacataagcagaaatttaacataaagagttaaagattgataataaataaaattgtttttcagattcattgaaacattctcaatttttcttctataagaaatgagtaaaattgattttgttatttaatatttctagaggtgcttattttaactagtatcttataactagaaggtatctgggtcttcaaaagaatttcatagcatacctttgatcatttaacttggcaagtttgtctttcagaatatgttgtagtcagatagtcgagaatgatcattagtgaattctcatatccatccatctatttcaagttgtactttgccctaaatccagttcagaaatctgtgggaaaatttagcacttctgaaattttagaaactagttaaaagggattgaattcagcctttctgaggcactgaagataaaacttagactcatatttgtaattcaacccaaatgacaaatttttcagttacaaattttaatctagtttttaactacctcatgaaatttttaccagtaagttctaaataaaataattcaaaaatctgattgtcagaaccactgcaatttctctattatgaatgtatttacaagtcatcctgcatgtaaaagaagcaatttcatgtggataagtaaaatggttaaatttgtttatattctatacatctatacataattacgtgtacatatacataattaaacttatacccttgttgatggtgaacagttaaagtatgctagtcttcacttaatcatgttattttaattcagcataaaagatagttacagtagttatctaactagttaatttgatttttttcggttattcttatccacaagtaaggcttttagatagatttgaaatgggataatggtggaagatgaggaactaccactgatcaagtagccatattagcaatgatgcagtttgcacagggaaaacaagaaggaacaaataagcaaatgggagaagaattacagagaacagtacccaagatgcttcagttcagataatattttgtttcattatgagagtctgcacttaattttccaccagtttaccaagctagcgtgaccatcatgaccttgtaccatcttcagattccatgaatggtagatgaagagttctacccatcacttctaataggcaaagatagcacatgtctacatgcactgatttggaagaaggacaaggctagagatggtgagcgttccgcttgagctatgggctattagcttgtggtaaacatgacttaatagtcagtgatatggacttcactggcaggtctcattcaaataatcccacagttcttctacttcttaatataatattttctaggatagcgggtggggtgtagttgggtgatccatcaggtgagttgagaagaggaatgtgataggaacttttgtcactgttggaaagtgcgtgggtggtgacattgaatagattcactcagggagacaagttagcatatctttcatctttttataagcagctgagtagaaagaaattgagcagcaggaaaggagggacaggatacaagaaagtgtcttttcttcctctccattcttacaatgtcctgattcttcagcccagagctttaaatatttttgtaactactttcttggggaactgtcatgttaacagtaattttgtatatattgagctcctaaagctatggatgctttataaagctacaatgtaaatttatttctctccataatccctgtcactttccctgtctccacataaaaagcaagagacttaacatttcattattaattacagcaacagcaagttggctgtcagagtcaaacctccacacactccccccaccaagctgctgagcttccagccatttactcattaagctgatgatgatggagtttttaaaacctgctctttgtaatggacagtagaccttaaaaatctgtcataaattgctcaattgaggaaatcaaatggcaaagagagtgaaccagtgtaagagcaaacaaattgcaccataaaagaaagtagtgtctttaactgagcttttatttttacaaagaatgtgagagcaacttggagactataagtggatgctgtgagactgtttaacgaagagcagttattcacattaaagaggctgaacacataagcaaaaaaaaaaaaaaaagaaagaaaatcagaccaaacaaaaacaaaggaacaaaaccaccttagagtgtttttgtttttcaaatgatatggtactgctgagtaaaaatgactaggtccatttttaagtgtatttttttccttaacattttaaaaccagactacataagataaaagcatatttcaaggtgaatactgatcaagttaaggatctaagcgtataacagatttttctgtcatatttcataagagatttttcaaaatgcacattaattctgatatttttattcatttattcaggaaatattaatgaggactgttgaagtcaaaatagaaatgtaaagaggaatctctaaatttaacatttaatttagaaataaataattcgcaaatcagggcatatattcagaccgagtggtcttcagcatgtctgaagaatgaagagaaggctggaggttttactaaaaaaagaaatattaattattgctctttgagaaagttcattagcattggtaaggttctgggaagctggaacgtctgactggtgactgatggtgggtaaagtaagtcttagatttgtagcaggtttgtttggcaactattagataaaacagttgtgaggttacagcaggcactttcagcagccagacttgcagtgaattacattttgggagagcaatgttttgtgtcctgagtgctttttgcccctgccctcttgactctgttttcactgggtatgacgagaatgccccaattcaaataatcagctttcacagtacctattatggtccagttcttttctcaaacactttggaattgaagaataaactaaacagaagaaaatctgaccctgaagaagaaagtagcaaataagtcataagtataatggataggtaagttatattgcagatttgaaagaaatatgtgatgaaaaataagagaagtagagcaggaaaaaagaaattaagatggtaggtgtggtggaaggagaggaggtaaatgcaggctcaaccagaaggtaagaagtcaacaaacattttggaaggtaggagttatcaatatggacaacatggacatctaggggaagagttccatgtggagtgaggttaccctaaataattgaacttgctggaaaaaaacacaactctcaattttacttcatagaagctcttataaatgagagcagatgagctgttacttgtgttgtgtccccaaatgaaacagctcattctaacatggggtagcgtgcatcaaagacaaatcatgccatctcacaatatgtatacccaccaagaaccttttggagacctatatttggcactaaaaataccattatgaagaagaacttgtatgcctaattgcacccatgctttggtcaatcctcaattatatatacattataatcaaccacatacaaaagtctaatatgtgcatttaccctgtgattctgttttattcatattaatagaagcatgtttctaccactgtggtgtcatattattcaattattttgagttttaaatcccagggaccgactttacctgagtattgtagctctaaagttggaaagaaaaaataatgctgataccgtaatcagatagacataaacaaaagtgggaagaaatctgctattgtgatgaagcctatatcatttaagacctgaaacttgaccaagcagaataaatgaatgaataaataattaaataaattaataaaatgattctggaattgtaagcaagggaagatgaaatgatcagtagcaaataaccaaacatgagctgacatcatgaagaaaatagcaaattcatgaattattctaaaatcgaagcatttgttagtcttaagtgtgaatatctctctatgaaattctttaatctggccttacagtatgatttacaaagcacagtttctatttctaagagcctcttacaactcaaaacttgccttacaaattttcttagaagtaatcttgacatcaaacacatattgtttgaactttgtttttcatattttgtacattaattgccattcacgttttagtagtaaattctacatggtcccaggtgtgtgactgtgcatgccagttatatcagaacaggccttcccagctttgtcttatagttataatatgcaaactattggcataattctacatctccctaaagattttttgagtcttttgggattgatagtctctctccctctctctggatgctgctttaggacatttactaagtatactactgtgtctttctcagtgattaatgatgactagattaattggctttctctttcattgtaagttcccctttaacatttctgattttaattgtgagaaataaccctgcacatgcatgtattagaagtcagagaagatcctctcgatccatcccatcaatttcccaggagcaattggcataatttaaatcttcatctaactattctccttcaattgtaattggtgccacctatttttaaagtagcctattcttgtaacattaacattattttgataatttattgcgaccccattgccaaaaacaggcacaagggcgccataaataaagcagtctgataattgcttaaacaaaactgggccccatggaccagcaataaactgtcattaaggttaggctggagaagcacctgcaatttctctggataacctcttttatttctctgtgtacactactgctcatttcagaaaatgacagttttgaaagatatcagcaatttgttgaaacaaagaatgagaaaaacatggtcttggaggtataatttacttttacattttgaattaaaaaatagaaaaagatatgctgaaaaaaattatcatatgaaaaccataagatttctactgtagagctagagctatttcacagtttaaaagcttgctccctttgtggtaacttttatttgttatttaaattcaagttaatcttccctgacttgtagtacttaaaaaatagtactcatggtcttttattgttttcaagcacaatttagataatgtattttagtgttgcagcttggctcagcaattttgaagatttaggttctgaaagttgttcatcaataaaatggcctatgtacctcatttgcaatgtgaaagtgttagaaatatgaaagaattatattttttataatataaaatttagaaagattaaaactatatttaaaaccaattcagaacacacaagtaggtatcacttaaatgtctttttcaatgtcagtgacatttttagttgcttttctttcttaaaatttgctcctaaagtggccataataattgatattttataaagttggggaaaaaaacaaaatgaatgtcttccttttatatttatcaaaaggttatttaaatgaattcttcttgaatttgatggaagcattttttaaattatgttaattttaacacatcaggtgcatgtttgaatacaaataagatcaaataggtcttgagtcatatctgcaggatcttaattttaacatcatagagacaaagattttagttagtcttttgttttgctgtcaaatttccctctaattttggacatgacacattttatcttattgagtttcaattatatatgtataattatatatataattgaatatatatgtgtacatatatacgtaatatatatatatatatatatatatatatatacatgttggactcatcgatgtacatgaagatactagctttgaatgaaacaatgtcaattgcaaactgttgttcatgcttaatataaattcaattatgaacagaaatcctttaagacaaaacagggaaccaggtactcctataacttttctcccaataatttgatgttttggaaaaatttagtaccatataatttttccccaaatattacctttattaaaaataatagtaataattctggagagttatttacactgtgatttattaaatcaatccctatgatttaatgtagtgatgaaagtggtctttatatttaaaatgtgcatgttatattgccagtttttactgagcacatacattgtcggctaatacatactcctttgtaggtgagtgtttagcgaagaaagccattgctccattggcaaattagcatcattagttgaaggagcccaagggtttaaattgcaggaggtttgcaggaagcatgtgcgctggcagagctgtgtggtcaggcatctgcaataaccgtctacattatgcttccatttaggtggtgtcatcactctgtcactttcatctattccataatttgcacaaaaagaaagcacaccacaacaactctttaaattccaaaaatgtatggtaaactgtcagtttctcttgcataaagttgtttatctcaggattttacttggcgtgcaatttctcaatagacgtatccttccttctgaaatgcaaaggaaatcccattgatcaataggggttgcagtacttatcaacatcacaacggagacagcttaattcctcagattagcatttggctcagatcagcaaatgttttctgagaaattactatttatacatttaaaagtatccaacttccctatcttcctcctatcagctcaaaatataagccagggccatgtggctgcatcttaatcacgttcgagctggagagccatcagttgaaagcctgtctcagttcatagatatgagagattgtaatattttaacatttcctcctgccaagttgctaagcaataaaactatcttggcactttcctgccagttcatcatgaagaactactttagtttagcttagtctcttgatgaaacaaatggaaggcagctgcaccaaacggcctttcagaaacgtgttgccaaacaaatccccggaactttcacccctttgcatagctaatttagatggcttgaagcagagaaatcccatgttagtatcagcatagaaaatcaagtcttaaatatgagtgattaaaaattatacaaacaatagctcatcataatttttgccgagtgctattgtcacatattacctttctccaaggtatacctaagtgtgatgatttctcagctaaaaaaaggcacatttttcataccataaagtcaagtcagacatactagacaagctattggctaaatttgaaatgtatttctacttaatttttacttagcttttgagagttttgattacataagtaatgccaaaagaatgccacacaataatttcaaacaacagagaaatgtatacatttaaaagtgtataaagtaaaaagagaagtaagtttcctttcgcattcatccaatcctgtatatttgtatgtgttttttcacaactgcctctgtgcatgtgtgtgtgtgtgtgtatttgtggctgcatatgtataaactaagaattttagtctataaacttacagcaaatattgacacatttctttattgctgttattgtttttattaaaattgaatcatatcctgagccctcaacttgccattacatgactaagttcttcccatctcaggaatcagaaaatcccaagaatctttatcacaacagaatgttctgggagagtccccttggatttaggacacacaggtcaccaaggaaatggccctgtgcaaactcacaccatcatgtgaagtggacatctgcattctagtgctacacagactacaccgtctgcttcagagagtttgcaggtgatcttctctcagtctgtcctcctcacatttcaggtccttcacagagccaactcctgctcactgttatcctcagcctgaaatcacaaagcttccttatgtaggccttctttatcaactcagattaaattaaaacctttcctcctagtggacaacaaggcactttttaatgtatccattatcatacttctcaaatttatttttgccaactctctgcttccttattaaactatggtatccataagggtagcttacagtgctcaacatttattcattaattggacagatactcactgagcttctactatggtgaattgatgtgctggatgctgagaataaaacttctatttgaatggcatgattctctctcactgtccctacctttgagacagatgtgaataaaaaagctacacattattacttaattagaatgataaatgttatactatctatgtgagtagttggagcaagttagtctcgtgagagaggtgagtgtttcaggaaattctctggaaaaatttgtatgtaagttgagacctgagaagtaaacacaacttcattaggagagaagagcatccttagttctttagtgagactggaaggtgtgtggagtaaaagccttagagaggaggaggtggtggacacacattctgaaagacgaagtattctaaagccaggctggccagcaaggattttatattaccgaatcttttggggttttttccatgagaatactgtgaagccataagcaaggcagcaatatgagtagatctgcaattagaacatgatggtggacttggccaagatggtgaaaacaaacagaatagaattgaaaaatattttggagttaaaaataggagaatttagcgattcactgattgtgggtctgaggcaaagaagataaaagttaaaaaatataagaggaaaagcaatagttaacactcataatgcattgctaggtactaatcattaagtttctcacatgtattagtagatttaatttgcacaataaccataagaagtaggtgctattatactcaaacatcattgatgaggaaagtaaatcaaagggttaataaataacttgcccagagttgtacggccatagggtggtttggttccagaatctattacttacacattactcctgggcttttggaatgagaaactgaggatggtgttgctataaactggaacagggaacattggagaagcagtgaatctgggttaaggcacaagatgatttttgaacaggttgaatttaaggtgcctctgagataggcaactagagatgacaggtctggcattctaaagttgaatataaacagaagatatcattttgggacttatcaaaatagaaatgataatgaaagccatgagatgcatgaaagcattcaggattacagtatagagtaaaaaagaaagcctatatgaagtagaggaaggggtactggcctcattgtctagggaggaactgctagggtagtagaacaatgggattatgctgtcacaaaaaccaaagaaaaaacataatttcttaaatcatggtctgtcactgaatctggttataaaaccttatcttgcactagaaggatctgtagcttttccagctgagaatggggttcaggataccgaatcaacacaagaaaagagagaaactggggatgaagaaaactcagctaaatttcctgtaggaaggagagattttgacagtgagtagtttttcaaaattcaattcttacatcctaccattaaacagaactctgagtttaagcaaatttggatgcaatcataacaaaatcaaataagaccatggctcaattacacctgccaaaaatgtgggattaagaagtgtttaattagttcttatcattttggtttactcagaattagttatactagatccattcttcttttttcttaataaatgttgtgtgataattatagtcctttaaacaatttaaactttcttcttccttcagcactcagctgtatgctgggaagagtctaccaatcttgctggcaagtctgattctttttttgatatggacctgttggtctatgtcatcttttcagaagaaaagcatttaattgccaatgggaggagaagcccataatgttactgtaacttgggtattatgttaaatgtctgttttaaaagaaagtagcgttaagatagatcagtaaccaaaatcataggctttttctgtgcatttaactttgtgaaaattctgtataattatgacttactagtatttttgaacaatgcttaacatactaaccttacatacactctagaccaaaataaggcatcataatttacaccttaatctcaaaaattaagcatgtctttggtgaatggttttatatatacataaacctaaagcatataagacaaaaatttatgtttggagcctgtgttctgtaaagagaaggttgatttgtcttttagctatcgtatttggagtggaactataatacaaatgtataatattcctttttttttttttttttttgagatggagtctcactctgttgcccaggctggagtgcaatggcacgatctcggctcactgaaacctctgcctcccgggttcaagcaatttcttgcctcagcctcatgaatagctgggattacaggtgcccaccaccatgcctggctagtttttgtatttttagtagaggcaaggtttcaccatcttggtcaagttggtctggaactcctgacctcgtgatccacctgcctcggcttcccaaagtgctgggattacaggcgtgcaccactgagtccagcctatattcttgtttatcagttcaaaaatgttctgctctgtttttgactctttaaaaataacttagattcaaatttatagtagaagaaaaaaaatctttcagataagaggtgttctccagaatggaggaactacttggcatgtaagaaatagcgtcagtgtcctaatgcatattgtgactgtttgcatatacttctgtttgtaaaaatatcagttttacttttcagaggatttgtaagaaacatttaaattttcattgaaataaatgacaagtcatactgccacttaaaaaaaaaaagacctttgtcaaggagagtgcagtcaaccagtaaattgcagattctcagaatgtttattgacgtactgattattcattctgttatactctaacatctgtatatttttaccagtattctcagaccacttctaccaaaacataaatctgtgattgtgatctctgaaagtcagtccttttatctactcaagtaagtgcaaattttagaaaataaatcattttccctagaaatataagttgttcttttcttaatttatccactaactgtttagaaatatgattagcttctaagatttgaaaaacagtaaattttaaatatcatatctattggttacagtttaaaatacttccagaaaataagcagaattgagttaatgttaactttatccaactaatacttgaaaaggatcattgatttatattactgccagcttaaaccattttaattaatgtactactaatcataacagtgttagttacaattttgtcttcaagtgcaataaagacacatagatttgaactcttttgattatttttggcctcctggtcaatgcctcacagtcaaaattttaattaagattttgcactaaaagtaaaaagaaaattgggataaaaatgtgcagtgtgttttattcgttatgtggaggcatctttcctatatccaagtttaactaatactggttctctacctgcttagattaactggtaagaatcttataagcatttcttaccatcttgttataaaccaaaaatggcagtctttccacattttgacgtaataattttgagcttgttacaaattaaaataaaaaattaaaaacaaatattaccttataaaaattcaaaccgtatgtattgaatattaatttaaattactgttattaatattacataaaatacgcatgttgtaaaattttaaattactatctggttaaatagactatatatattctgtagagtcaaatcagatttcggcaatgttgtagaatttaactgaatgcccagatggaggaacttgattatattataaaaaggggactacaatcctagagttggactcaagcacaagtatttctcattattttgcagaagaagacactaaggttttcagaaattaaattgctttttggaaaaggtgggagattctgggaacatagaaacttgaatccagttttcttcaactccacgtcaagacagttgcattgtgtgagaaaatagctacggccatttgtgacaaaatcacatatatgcaattatgtgaaactaactgtgtatatatatctgtgtatgtgtgcatgtacaatatataaactatcaatatttatcaaagtccgtacagctgctagcaatgagggggatctaggattctatcacatgatacctttttatgaggcctttgttctttccagtacatttgtcagctcgttcatgaaagagattcttaattatttactgaaatatcacaaaagtgatggtgagctaggttgccacattgatcctgataggtccttgacaaattcatattgactctccacaaataaaactctaaggcagtttttcccattgtgatgcttttgtctacaatcttaattgttaactcttccaaagaataaacacacaatatatcaattttttaacccatttaggtagaaatatgggtatatagaaaggaagaaagcaaggctaacggtgagcagtggctaaatgaacaagagaacattcagttaagtatttcatctccaaaatggtataaactgtggcagaaagttctttgttgaatcaatagtttcgagacagacatacagtagggacatcgaaggtacaaaatagagcactgatgaaggagtgaattatcatcttcacagatgagtagagaaagagaaggtctaagtattgagatgagaatatagaaatttctgaagcacaacacagctcagaaattcaatctgaatatattccaattcagtgccttgcaatagatccataatgatcgcctatctttccatcatacaaagcaatgcatatcatttaaacatttttctagcatgaaaatgtgcctgggttatgcaatacacactttaccaaaatatgattctggtggctgtaagcacttaattgtaatgacctgtaaaatgagcaacatttttaactccgaaattctaatcaatattagttaatgaggtgtgtgaaaacttataatgcttttaaatactcttagtagccatcataatacaaattctcccacttacagcatatttaattttaatccttgcaataatataaatgaaatacatctaaaatacttgatggtaagcactcaagtaaaagtccccataacatggccttaaaaaaggttaatcttttaacaacggggtcatgaaaacatttttgttatagatatttttatgttcctccttgtatcaatcaggattaaattttcaaatgttcataacatttaacaacagactgaataaataacaaagttgttaacacaaaatgaataaatgttttgtataagttaaaaatagaagatagaaaaaataacttggtaatgtgtttaaaatattttatggcctctaccccattacgttattccattttctcataactgtagacctttagctaccaaacagagggaaggagcattgtacactagttacctagaaaacaaatcatttataggtcttattttttgaaaaggagatatcttttaattcaactaaaatgtaaaagattggaagtgtccccctatcaaggcttagttttactattgcttaatatagatgaagaaaaaataaatcatatataaactcgggaagcttgggttttctcttaaagtaagccatgctgtgattgttccatctaaacagttatatcaactttactttgtatcatatgaaaacaacagcctgctgaatgactatgtattgtctatttccacctgctaaacaagacaagaccacatgaaataggatcagcttagccattaccttcaggaagcttcagacatattgtttattgcaaatggacatatattataaatgtatatacagacacatctttgtgatattacttcctgaagtatgttcttatggaaatttaactttgttcatccagtcagatttccagaaatttatctactgtgataattaatatattattctccaactctttgttattctcattctgtacttactttgctttcatcaaagacattttagcaaaattaatttccaggaccattttcttagtgaactaatgccatttgatcaacaatggccattttcgtttttatcttgaggatcacattgggcatttgtctctgacttttcactcagtttataatgcattcttgttccctttggaggatgtttgttctttttttctctgcttgctcccaacattaaaatccaaggtaaactcttaattaagtggagttgacagaagtcacattttctctataaagaacaattggaatccactggatttgccctatcaagaaaaaagaaaatcgtatctccaagagtaggtattggtaattaattaatccctaatctttttgaaaagtatctgtattagtccattttcatgctgctgattaagtcatacctgagactgggtagtttatcttaaaaaaaaaaaaaaagaggtttaatggactcatagttccacgtggttggggaggcctcacaatcatggcagaaggcaaaaggcacatcttacatggtggcaggcaaaggcaatgagagtcaagagaaaggggaaatctcttataaaatcatcagatctcctgagacttattcactaccacaagaacagtatggggaaaactgtccccccataattcaattatctcccaccagttccctcccacaagatgtggaattatgggagctacaattcgagataagatttgggtggggacacagccaagctgtatcattatcagatatcatattcatctggtagtggtcagtacatctgtgcacaacctcagagttggctgatttttgcttttccttccttactaactcacaccagtggtttccatcctaaagtacacaaaccatgttatttttctgctctttgatttcctaagcagtataccagctactttaggactgtgttcctgtacagcgccccttttcttcacgaccacctacaaatctattaagtacttaaagacttttttcctgtgatggggattttgatgcttgtttgttctttctatgccaacttcatacacctctgagtctcatccatatgtcccaactgctccctctaaaactaaaagctactatttattaagtatttgctgcatttccaaaatcactctaagtactttgtctacattgtctcatgtaatcttcacagttttctgagttgtgcattatatgttgctactgtccacattccttcactaaagttatggattttagtttattttaattaaatggccaatgaagattttgagaagtaactagtatcacatagcagaggtgggaatgcatttgaagagatctatattaattttctaaggctgccatagcaaatttgcacaaacttggcatcttaaaataacagaaattgattttttttacagttcagaaggccagaaatctgttttctcacagtttgggccagaagtcagaaagcagcagagttggttccttctggagcctcttaggaaaaacccatcttattcctctttcctagcttctggtggttcttgtcactccgtggcattccttgatttcttgattagttgtatcaatccaatctccaactctgtcattgaatggccttctttcttgtataactcccctgcatctttgtattcaaatattcctctcctttctcttttaaagatactaaccactggctgggcatggtggctcatgcctgtaatcccagcactttgggaggccgaggcatgcggaacacgaggtcaggagtttaagaccaaactggccaacatggtgaaaccccgtctcactaaaaatacaaaaattagctgaccgtggtagtgcacacctgcaatcccagctactggggaggctgaggcaggagaatggcttgaacccaggaggcagaggttgcagtgagccaagatcgtgtcactgcactccagcctgggtgacaagcaagactccgtctcaaaaaataaataaacaaaagatactaatcattgaatttagctcccaccttaactaagtaggacttcattttaacttgactacatctcaaaagaccctatttctaaaaagggtcatatttataagtaccaaggattagaatgtgaacatatattcttgagggacacaagtctacccactaaaatgtgtaattccaaattgcatgctcaattttacagtatacagcactaaactacatcctactgctttactgggtgactgtcttttaaaggcctgccatggtctttaccgtaatgcttcaatttattttgcttgagttgtcctatatgtttttctagacccaatctcaagccatccttagcaagaattttaagaaaatctcccaaattgtataagtactcagtcaatgcagaataagcagtgctttccctgattagttctattctgtttcttctgcttcctgaacctctagaaagatctcacctgagtttcagtagagtctctatacatcctacatgaatgatctaatctccaacctcaacagacttaaagtcagtaataagtaaacagaaaaactttgactcatgtttaaaatatttcacttgccttggcctcccaaagtgttgggattacaggcgtgagccaccacgtctgggtggatcacaaggtcaggagttcaagaccagcctggccaagatggtgaaaccctgtctccactaaaaatacaaaaattagccaggcatggtggcaggtgcctgtaatcccagcttctcgggaggctgaggcagagaattgcttgaacctggaaggcggaggttgcaatgagccaagatcatgtgactgcactccagcctgggtgacagagcaagtttcaaaaaataataataaataataaaataaaatatttcgctcataaattaattgattcaataaatatttcattcaagtacgtacacattagtacatggtttcaatgatcgttgatttaaaaccttggaaatagctttaattctatattacatttacatcgacatccactcaggtatgaatattctgtagaaaagttttggtttttccctttccattcttttgtgaaatgtttgtcttccttgtctgctaacactttttaatatgacaattatcattaattattcacaaagtgagttaatatttgctacatatttaatgtctaatttgtttcactattttaaatgtactgtacctgccttctgaaaagaatgcaaagccctcaaagtcaagtgcataatataatatccttatggttttgcagcctactattcattcagtactcaataactagcaatgaacagcaaatgtaattatatatatatgtatatatagagagagaacacttatgtatatgtagaacatatatatgtatatatatagaacacacacacacacatatatatatatgaaacataagaatttatgtatagctatgctgaacatttggctatcagataaaactgtagctttacaaatacttaagaacagaaaaactgagattgctcctagatctggggtggccaaaagaaatggaatcagatgtttttgttaataggtaatgccccaaatcttatcagtcataagcactgggccagacagacctgtgcttagatattctaataaggtatacctttactagtacctttgttagaaaaaaagatatcccctctaggtggacaaatcagaaaaacagaccagctcttaacaggtcaagcttaagagcacatagcttggtgatggtggcagagaaggaattttagactctccggctccctccacaaggcactattgtgcagcacacacattgcacaacctcacagagtagtcttggccttagctgaggggataaaaagaattgtttagttaagaaatgagatttagcagcttacataaatcattaaggtgttttacgcactttttgtacatcagtgccttacattaattaatccatttaattctacctgccatgagtctatccacacccattttactcatgtggaaaccaaggcacagggaggttaaatggcttgtccaaggtcacacagcctttgagtggtagattctggattcaaatacatgcagcctgatactgaaactctgtttgtgaacactttattgcctttaaactgatgaaattagaataaatgtaaattcctgggactattaaaaaagtgtaataagctgtaagaacgaggcattatgaagtaaaggaactcactttgggaaataccagcttagaacttaataggcttatgatagtatttataaataatcaaaggatcaagttgataagccattctgtgacttgtagataaatatcttatcagtttttgtaccctgctgaaatccttcctcaagagattaaatcaccaaaagggttaactctttttttgtgtgtgcaatttttccactgccaataattttgttccctgagcagtgaaacaagtaattcacaaatcaagagcatgttaggactataggtcctcattttcctaactgcaaagaaaattattttaaaagtaattttcccctcagaagcaattccaagactgaagattaaatatacagagaagcaatgattcaggcttttaaaaaaatagctttttaaaggagtataagtgaaaacagttaagtcaatatatttaattaccaagattttattgtatcttttactcacataaaaagactaaaataaaacgtttctggttttcacagtaactgatctgataatgtcaacttttgaaaacagatagttatgactcaaggctttgagaatgtaaagagaccaccttcacttgttgagaaatggtacgatttcacgttatcagtgcagttccgttctcgggggaaaggtaagcacatagctaactccagctccaagctgctatttcatgataacagctcacggagctgtgggcctgctaagcctttcccatctcgttctggaattcctctatagcccatccgtactaccaggagactggatccgcaaagtagacacttggtctcatgaagccactgctgggctccagagagaagggaaaactaagaggttttaaaacccctaccctccttggtttacctccatcattaaaaaacaacaatgacaacgacaacaaaaaacaaaactaaaacgacttattatttattaattatgttgtggcagacaatatgctgaacattagacataattaaatctttttaaaaattgataatttatctctgttttatagaagtgtgaaactgtcaggaagacagatgaaatgatttgcctgaggctgtatcatcaaacaagaaattcatattcacctttctggaattcttaggataatgattacatgtgttcaattgttaaaaattggcagataaaattttatgtatttaccacgtacaacatgaaattttgaaacatgtatacattctggaatgactaaatccagctaattaacataggtattggctcacatatttacttttgtggtgagaacagttaatatccactctcaacattttccaagaatacaatatattactaactatagtcaccatgttgtaaaacggatctcttgaagtattcctcctatataattgaaattttgtatccttggaccaatgtctcctcaccctactcactcctcaaatatccctactcttggaaaccactgttctcctctctctacttctaggatatcagctttcaagagtgagatattgtggcatttgtctctctgttcctagcttatttcacttaacgtaacgtcctctaggttcatccatgtgcaaccccctaggttcatgtccttttttaaggtttaatagttttctattgtgtacatatgccacaatttatttacccatccacttcttgatggatgcttcagttgtttctgtacctgagctattgaggacgatgctccagtgagcattggagcacagatatttttacagggtggtgatttatttttctttggatatatatacccagaagagaaagtgctgggtcatacgatagttcttttcttttcgtttttttcttttctttttttttttttttagaaacctccatactgttttccacagtggctgcaccaatctatattcctaaattaaacttcaatgtgcagatgaattacctaaaattctttataaattgcaaatgctggtttagaaggtgtgctgattttgatgcatttttaagacccccctcccatcccgtgtgatgttcctactccactcactgatttcccatgtattatctagggtcttaaccacattgcttgtttttctattagagtttggaatgggtcacccatgctctgaggctctatgaaaccctgaagggagaggtaaacatataagctctgcaatccaactgcttggttttgtattttggatttgaaacttagtaaccattttcacccagaggaaattccttaagctctgtaagcctcagtttctttatctgtaaagtgggagttacagtggtattatctctcactgtatttttaaagaccaaatgagaaacttgatgtaaataggaacctaatgcctggtacatagtgaacattcaatatatacattcatgagtatttttaattaaaacatgttcattgcaacattattcacaggggccaagatatgaaatcaacctaaatgtctgccaacagatgactggataaagaaaaggttatatatatacatatatgtgtgtgtgtatatatatatatgtatatatatatatataaatatatatatatatacacacacatacacacacacacacaaacatatatatgtatatatgtgtatatgtgtatatatacacacatacatgcacagatatatatgtatatatatgtatatatgtattacaggcatgagccatctcgtctggccaattattattattattttagaaatttatcagtgatgcttttctgttcagctttaatgaggtgtaatgacaaaaaaattgaatatatttatgtatgctgtacactgtgatgttttgatatatgtatatattatgaaatgattaccacaatcaagctagttaacatatacatcacctctcataattatctttttgtgtagtgagaacatttaagacctactctctaagctgatttcaattatacaatatagtattactaactatagtcaccatgctctacattaggtctccagaaattactttttctgcataattgaaaatttctatcctttgaccaacatctctccatttcccctaaccccagtttacacacacacacacatatacatatatagtgaatatatacacatatatatgtacacatatatatgtacacatatatatgtacacatatatatgtacacatatatatgtacacatatatatacacatatgtatatatgtatatgtgtacacatatatatacacatatgtatatatgtatatgtgtacacatatatatacacactatatatgtacacatatatatacacacgtatacatgtatatatacacatatataataataataatatcaaaaataaaataaaaattgcttagaaatttcaaaatacaataccttccactgaacttccttaatccacatagcactgtatttttctgtctattgcattgtcacaaatttagccacttaacacagatttattattgcacaatttctgttggtcgggagcctgccacattttggccaagtcctcttctcagggtctcataaggctatcagggtgctggccaactgcatcctcatctggaggcctgactacaaaaagattggctcaaaggcccctcagagtgttggcagcatttgtttccttgtggttgtaagattgaggtccctcttgcctcactatcagtcagctgggagtgacctcacctcctccaggctgctatcagattatgccacaggccccttccgtttctgtaataaagaactgccctcatattgaatccatatcacacctcagatttctctgatttcccttctgctttcaactagacaaactctctgcttatagaaaggctcatgtgattaaattgtgctctattttaaggtcaagtgtgctatgtaacatgaccaaataatgagagtaaaatctattatagtgacattccctggaattatgtagaagcgaaactattgctggaggggtagtctttggggccaacttagactattgattattccatgttcaaggagaggtggcatataattggagagctaagaaccgtcaatatctcaacatctaaaaaaataaaaattgtaattgtatttaaaatgttaggaaacatagttagaaatttagggttttaagcagatataaagatcttttaatcatgctactacctaattacaatattagataaagaagaacaattaagcctagtctatatgttagagaaatatagtaattttttctggaatgatttattatgtgcagactttgggttattggaatagatcattgaacatatatgttttaaagtacttaaaaatattttataaataaagttatttttatacagaacagaaatagttgatattgaatcagaaatactgtattagcataagtcatatgtttaaggaaatatattcctaaacaataggaagaaacacaggcaacactgatgtaaaaaagatttacagacatgagcttcatgcacttggtttatggactagaattctatgccttctagaagcagaaaatatgcaacgactcattctgccttatggccatttcagagcttttaatctaataaaacctatatgtcagccagtagcatgtcagggtcttattactctgcttccttagagtctgatatgggaggttaagtccctgcacaaatgtaccccttggggttccctgaggtggagccatgcaggtttgcatctttgcttactgatatatatatataaaagataacattaaatattctattcctgttttcacttatgcgttcactaagaatgatgaaagtgggaactgtgtggcatggcctaggaattgtgcatgagcacactctattttacatgtctcatcagaagtcagtttctaaccttcttctgtctgtagacaagcatatcacctaagctttctcagagattaaaggtataccacctagcttaaatggcccaactaatgaaagagaggtacacttaaattgcatcttaatgagaaaaaatatgaaaaggagaattaatagagatttctcaaaatttaatgagcataatttttattattgaacaatgtttgcctataaagtcttactcaacttgatgaaaaaatgctaagatacatgttaaggagtcctcattttaatactttatgtaaaatcgtatatacatatacttaaagaaaaataatggcatatttgctgtctttaaatcattgagaaaaaaaagactacatgtgtcatttaatttagctaaagaaggaaggtgactgaaaaatacagtttttacataagatactaagtagctggctgggttttgctaatgttcccaaatttgaaatcattttaaaaagaacactccaatgagcaccagagaactgagacattttaaaataaaattataactgcacttaatctcatattgtctccttagccttttgacattttaattgctgtgccatttttcactgagatggcaagcattttttacatatgcataatgtagcctgtgttaatgcgtattgattaaagtagacagtgatgcgaggatgttggaattttacccactgtgaccctactgaatgtttccctctgctctttttgttttctttataaccagagggggaagaaaagcatgtattttccaacaagtctctatgctatctgaactctagtattaacaggtgaaaaatgacatgtttaacaaaagaaagactagaaagcatctacatcacaaacttgtaagtctttcatttctgcattggagacactataggaaaatcaataacttcctttgagtctagtgatctagctgcttacaagaaatttacatctccctgacaggcagtttgtaaggtctggttcacctgggtcacaggagtacacataatttgcatcttgagcaatttctctctttccttctacctgttccatgaggaaagaagattgaacctggtcataaagagaatctcattacgtctcagctgagaagagtaattttgtaggtgttcttggattgcaagagtatcatataatgataatattttctcatagctcttcagacctatgcacacaccaggaaatgaaagtaacatacacccaggcacatttgaagcttctgagctgtcattcaccaaatgaaatttaagtgttccatcaaagtcatttgcaaatatgatctcaagatggatatccagattctttgctaacaaaaatatacaagaagatagacatttagcttacctctcataaaatctgaaaaaaaaattccccttctattttattctgcccttcaaaatacacaagatctgaatgtcaaataaatgtttatattatgatatgctaataatgcctggcatatattttcctagttagttctgtaagctcagttaaaaacaaataaaaaccaaggaggcaatgctgaaaactttttgaatcaaaaatagaatgcaatagcatttaattataattaagtctttaatatgctaatttaaatctcacatacttttaagcatgggtctatttgcaaattcatctaaataaatatttggcatgaagtctaaatccactttattccaatatgtttttttttccgggataaagattataatgagattcaaatgtaataattttcatcctgtattcatgaaaataattgtctaggtgtaaatgaacgtattattacaattcactatgtgtactcatacctagtcatgaggtcctcatatataaaatagagggagagtacaactttaaagtgttttatatatccatttcatattttttctctttgcaatttaggatgaatcttcttagacaaatggttatgttattaatgcaccaacattaacctagaaaaggctacttagtactacttaacttgaatactaatcaccctggcctcagtagcccaccatatcttgcaaagtattctgaaatagtattggtgataaacaccatttggaaaggaaaaatggctgtatctgtgtttttacatgcacgctcccctcattatttttgcatatgataaaatagataatatttactgagcacttatcacaagtcagttgtcttgttaagtgatgcagaagcattttctattagtccccagaaaaccactgggaggttggtacaacacagttccattttatcaaaggatccattcatgaagaccttgtactcacataatgaaagattaatttcccacaggagcaaataaaaagctgaatgggggtgttctttagaaatatcacggtggtaattcagcttgatttagaatgaatttctaaacctatctctgctgcactatacttggtggcttgcttcccaatattagccgtgtacaccttacttttatatcattatgacagaatacactttttgtttgcatgatgacaatacatgtttaaataaaagactatgcatcagcaaaagcactcacaggtgttctgatccacttcaacaactgcttgatttacaatatgttgacaaattagctcaggtcatcatttatattatctaaggtactagtgctacatacaaataataaaaacaagaattataatggtgtcccttcagctttgaaattctgtgactcttcataatagctttgcattattttaaagttagcatataaaataaaacttcgttacttaaaaatttgagcacagttaaattgttggcatcggttcccctatgtttttgaatatacaggttcctgaaaaggtccatagttttagcagagtagactttatagcagtggtgaattttgagggagaaaatagatgaggaatgtcatgtgcaaaataaagacctagtaaaaaatcagctagaagagaaagaaactatcaatgcacaccactcaacagcaaggacaaaagagagacaggacaagagaggatctgttgacaatggtacaaaaagaaggaaatagaaaatactgattttcaactctggtttaatatggtgacttcttatccaactgccttaatgttgaaaatgaatagttttctccaaatttcttaggataatgaggatatgcctacacattttcattagaaaatggtgcatgggtaaaattttctttaatgttttgtagtgtggcagcatgtttttctgccaggtatattaataaaaccatattatattgtgtcttttctgatctataattatagcttacatggttcagatgaatttcctctctggcagctctctgtttgacttaatcgctgctgataaacactatcactcattttttacccaccaaataaaatttttcatcttgatgcattttgtctgcattgcacatatttaaatactcaataactaccacagcaaaaactcacttcggtttttaccttgtagacaaatggcttatctatttagcttaaatccataaactttgttacagcgttatcaactggatgagtttaaatatactggaatcaggtttaccatgacataatttaaatagtttaatagttcattaacaagatattaacaagatcaaaattattactccttactgaaaaaggcagctctatatactaggacatagtcaagacagtagcaaaatgtgtctgtgtgcgtgtgtgcgtgcatgtgcatgtgtgtgcctgtgtgtgtatgattctttaaggtaatgttagagacaacaaatggtaatagacggagtaaaaataaaatatgtaccaggccaatgaaaattagaaaaacttcacctatctattgcaatatacgttgctcttctgttctggctcaaatgggtatgtgttccagaaagttgcaaaactcctcaaagactcttcagttcaatagggtatccaccatctgacccatacagttgagattgaaaatagattcagtctggcagaaaaatgtccacagaaggcttttctcctttttttctttttagaaaaaaacaagataaagcaaaacaaaataaattattaacatgctgctttggatatgttagatgtgtttcccaagggacactgtggtatcttcatggctggatattttcagaacatctcagtgtattttcttatttactgcccttggttctcctagacttttgaacattgagtagtcacatgaacgttgtttagcaaaaggaggtgaaccaagtaaatcattctctgagataaagaagtccatgggaattggccttacctcacagaaacaaaccaaaatgaattgtaatattaatcttagtgcattcaggctgctataactaaaatagcatatactggatagcttataaacaacataaatttatatttaacagttctagaggctagtttaagatcagggtgctggctgatttagtgtctggtgagggcccctttcctgcttcgtaggtcacaccttttggctgtgtcctgtgttctcacatggtgaaagggaccaaggagctcaactcccttgggcctatattataagggcactaatcctatttatgaatgctccaccctcacgactaatcagctcctaaaagaccttacctccaaatatcatcaccacaggggttacttttcaacatacaagtttgggggaaaagcaaacatttagatcatggcaatattcaatatcagaagcagaagatgattcatgctagagggtcctcgacaactgtgtttgggaaagtcatgcatggctctgcacggagtctctgcctggccctcatttaacactcatgacccttggaatgcacaggctctgtgaccttgcccaaatcctgaagctttcattccataatttaaggggaacatacacaagtgtatagaattgagctgtcatagaagcttcactattctcatcctctctcttctcatttcttatatcttaactatgattgctaaccccaatgacctctttgtcaacactatgttatggagttcccctaaaactttttgtttcacctctcctcttcggtcctgtgttctgaaaattaaagataaaatttttagatgatttaagaatccttatgaaaaaatgagctaactctggacatttaaaatactaaaacacctaaaagagagtatcatattgcaagaataatcaaaaacaacctaaagaaaaatatctggctgggcatgttagctcacacttgtaatcccagcactttggaggctgtaatgggaggatcactcaagctcaggagttcgagacctgcttggacaacatagcaagaccctgtctgtatcataataataataataataataaattgccagacatggttgcacgtgcatgtaagaggcggaggtgggaagattggatgagctcaggagttcaagattgcagcgagctataattgtgccattgaattccagcctggatgacagaacgagaacctctcaaaaggaaggaaggaaagaaggaaaaaagatggggaaggaagaagagagagagggaggggggaaaagaaaaaaatccaaacacctcaaatgtggttaactgcagttgggaattcaatttatatttgagctttctgaaatctgagatactagagaaatatatatttaaaaaataacatgcataataactttattacatttatttgtaaagactcatatgtttattatagaatgggggattaatctttcattaaactggtcttgtcgaagtcactacaacattcacttcccagccatgtctgtataatgacttcctatcagtttatgttgcttcagcatccattttgaatactagtattgctttctcatactagaagcagggctcagtcaccctttacacagtttttcatcctacagcatacccaaagggctgaaactggtggtcatatataaaaatttagaggcatgtcttctgcctagcagactgaacgctgctttcttgcccctttctttaaagggaccattcagtcatttgctctgaactttgaaggcccacaccctaatctttatatagtgtgctagttgccacccgtttctctctctttgtctgactcttcatttctgcctgccatgactccaggataaagaactgccctccagactcattataccctcccacacacccttacttggatcctggagtctgcaagtaaaagtctttgaacttgttccttattttggtgttacattaaatttgcactttccatctgaagaatcaggagctgcctcaggttgggttttccctggaacactggggagaatacaacgtcaagctcccaatgccaaagtgttgaccaggcaggcgtaaaccagacacaggtcagacaagaatcacatgtggcttgccagtgtaagttttccctggtcgcaagtatgatgtgtttatttttaaaaataacatcatgcatatattaagtttatttgtaataaacttacaaataaagtttgtaaacacccacatccaactcctcatcatttgcccttagtgcaggtttgtcagctgctctagtactggacccataatttagctggggctctgacatcatggaatattttattttcccttacctagctctcaatacaccctattatgcaggctattcctctgcagtctcttttgttggttctttctcttccctctgactttttttttttttttttttttttgagacagagtctcgctctttcgcccaggcaggactgcagtggcgcgatctctgctcactgcaagctccgcctcccaggttcatgccattctcctgcctcagcctcctgagtagctgggattacaagcgcccgtcaccgcgcccggctaattttttgtatttttagtagagacggggtttcaccatctccatctcctgacctcgtgatccgcccacctcggcctctccaagtgctgggattacaggcgtgagccaccgctcccggccccctctgacgttttaatgttgcatctcaaggttcagtcctcggccctcgtttatcctgtttatatacatttggttggacttctcatccaatgtcaggactttcaatatcctcaatatgatgaccacttccaaatacatatttccagcccagactccctccattcctgtatattgcatgtacataacacaaagaatcatgtatcaatatttaccacttggatgtctaaaatgcatctcaaacttggcatgcacaaaactgcaccttcaatccatgaacacacacacacccatctatttgtagtcttacccacttcagttgacattcacaattcagaccaaaattttttaagttgttcttgattttctttttattttacatgctgcacccatgccattggtagaatactgccccaaatattcataatttgaacattttcaccatctttgttagaattatcctgacatgagacaccattgtctcttgcctgaagtattgccatttgtaacaacacccaggatcacactgtcaatgagattcccaagaattagaaatttgatccagtattgagcttattaataatttcaagggtacatataaatgcataatacaggtgaagcaggaagaattccatgacaaccagtatgactccctaggtcattttttcatctcactgttatgtctctttcaggtaatagatgagacttctaataaagtacatggtcacctcacttacaaagaaaaagccatttagattatagaacatcacaatttcatactcatatagttacataattcacattatgttaatcaggaagtatgtcccatgaatctgtagattccaggtttatttaccagaagcaattacagaagaagcaagtacatcctgcccaaaacttttcatagtaaagactctcatcctagtgttaccaggggtccttgctcccagagctcccaagatggtcgtgggccacttccaaaatggcggcgggccacttccaagatggtggcaagcctcatgctctctgacttggggttcttggcctcaagattccaaggaatggaatcttgggccatgcagtgagtgttatagctctattagaagtcgtgggtcacagaagagaactgtggaacccagtgaatagtgttcagctcaattaggatgaacccaggcacttagctgtgcaggaacaatggcaagactttaacccgatggggagcgacagtgggcgcctcgctgaatcaggagcacagcaggcaccctgctggatcctgagggatggaagtcagcggagggtctgtgacggcggcaaaacagcagtggtggacagcgagtgaaagctcagctcaagccgtaataaacacggaccagaagagtgcagttgcaagatttaatagagtgaaatagagtgaaaacagagctcctgtacgaggaggggaccccaagggggttgcctttgctggctccagtgcctgggtttatatcccgatccttgtccctcccactgtgctctcaggcaatagatgattggctatttctttacctcctgtttttgccaaattagcatttagtgagctctctgattggacagctgtgagctcagttgcaagccccgtgtttaaaggtggatgtggtcaccttcccagctaggcttagggattcttagtcagcctaggaaatccagctagtcttgtctctcactagcacaaaccatgtagtttaattgccaggaggtctgtcattaaacatgacaatgtttaataggagattagacttctcactgaatgtgtttgtttcccaggagcactgccttgcgaaagggaattaattcatcatttcatcgcagacctgctgtgtaaacattttcatctcaccgcataacaatgtctctgctttcactttggccccgacattctattctgaacacagcagccaaaggggctggttaaaatgttggtctgatcatgtcattcctttgctcatcaccctgcaactaatccacatttcattcagggtaagagtcaaactcctgacaatggccccgaaagccccaagtgatcagttcttgttacttctctgagttcatcctctgttaatctcccttcactttctccatgacagacacactagcctcgtagatgttctgtggatttgttaggagtgttcctgctgtgcttttcatagatacacacagtgacaattcctttacctcttctaaatcttttctgaactcttactttttcaatggatgaatgtttgatgaccctatttaaaattgcaaatatccagcctcccaacacacatacacatacacatacacatacacacacacatacacacacacacacacacagacattccaagcatttgtggtcaacactcttactgtgtttcacttgttttttccttatgtcagaggcctttgaaccacagcaactccatcttgagtaggggctgggtaaaataaggccaagacctacggggctgcatccccagataggcattctaagtcagaagatgagataggaggtcagcacaagatacaggtcataaagaccttgctgataaaacagactgcagtaaagaagtcagccaaaacccaccaaaaccaagatggcgaggagagtgacctctggttgtcctcactgctacacttccaccagcgctaggacagtttacaaatgccatggcaagatcaggaagttaccctatatggtctgtaaaggggaggcatgaataatctgaataatctaccccttgtttagtatataatcaagaaaataatataaaaacaagcaaccatcagccctcagggctgctctacttatggagaagccattcttttattcctttactttcttagtaaacttgctttcactttactctgtggactcaccacgaattcttttttgtgtgaaatccaagaaccctctgttggggtctggatcagggccccttttcagtaacacttatcaattatcactttttttaaaaaaatacataatggctagttcctatcttacactgttagaatgcaagtttcagatatgcaaggatatttatctctcttgttcgttgatgtatcccaaacccctggaagaggacctagttagatagtagcttctaagtattttttaatgaatatctgactgcactgggaattatatagctgttcatttatattggacatctggtcatcccttgaatagaagtcaatgggtttttttgcttatgcccataccatattgtctagtagttgattaagattattttccctagaatatatttctcttaaaaatattttctccttctaaattaccagcaaccaaattaagatgcttcaagtattttgctaaaaagattttaaaagtaggtcaattagaataaatccaaagaatagcatttttactataatgcactgccagtttcttatatggcacaagtttgccaaattatgcaaaaatatgtacacatgcttttaaaatattttgacagattaaaaactacatagtaaaacaactgtaaaatgattacaaagaaagcttcatttcataaaaatgctgtttctctaatatatcaaatttgagatacattgttaattcaatgctcataattgaaaaaattcttacttttagaaatgatcactccctagcgagaaagaatatatcttatattattttaaaaaaagcaaaaaatgatggcaaaagtcaatttgaacccagttgaagtaatcatttaactgataagtaatactctgtaaatatctgtttcttcagtttcagaagaaacttcagttgttgatcttcaattcctatgttttatatgaaaatattttgaaaagaaaataagtgttttccaactgagcataataaaggaggctaaacatgattattcataatttgcagtaatatacctttgacaggcatgaaacatacatatggatgagaaaagagagacctcaatttgtttagattagacccatttcaatcagcaggagaaaacacatataagaatggatgtggtttgtgaaacactgtgttagaatctctctgtttatattctgaaggatgctagtcatgtgaatgattttaagcagcagaatatataaatgccaatcaagtaaatcattcacgaagagccaaggcatcgctgaaagaaagataccccagggaattggaatgaccttactctgccaaaccaaagcagattgaaaagtttaatgccatggacagattttgacagtggtaatggtattggtgtccttcgcttgttcctactctggggagttataactttaaaagctttgatttttgtttatcatgacaagttcttcaaatatatagctctttggactcaatggctctgccatgccccatttctcttctgtaggcctggaatcaactatgagaaaagaacgcatagccatatatatttttcaaagacataatttaaaactataattgtactttgatccttacagatactataaatttatagtgctataaatagttaataacatcatgatgagtattaaatactcttattttacatagatttggctattttcttttacgatgtactatgtctgtgactcccttaggtctgctttgttaatgacattaaaggtaagctttgaaaatccatattccatttctaatagctttcctctggcacatgggtacacctgatctaaagggtgacatcatcctttactttctcaatcatcttgattttcctcaaactctggtcaaaacaccaccattagatggacacattttccattgtttttataaggttctttttcctctcaatacgtgtaactgccacatatagcaaccgaaggatgataagagaattttcatggcacccaaggtgagaagctgaggattgtcagagaaaggtggaagtgtttatttttctttcttttctctttgattcactgtagttctgtaccgatatcatctttgtcctagctgagcatgcctcctaactttgtggaataatgtgctatatgttcatgtgcataaagataatatgtatatttataatatgcattaatttgaatgaatcaaaattaaaattatgtgacttttttctctcatgtcccctcttccgttattacactactagtcccctctaaacccactgacactgtccattgttctgaatttgattccagagttagagctcaattctctgcctaatatagtattttctgtttacatagtgattgctcatatattttgctcttgtcagaaatcttcgacggacttatgctgcataaaagtgctgaaggaagaagtcatttaattttaaaataatttgtttactatgcattagagtctaacaaagacagatggatacacatttatggtaataatgcttatttctctcatttccttctcattgtattaaaactaagagcaaataagcacaattcggattttgtttgtgtgattttttacttttcaacttctttccatcctgactctccttgcagctttcacatatggacacatattatttgtgttgaacatgattcaaatactgttttgagttatgttgtacaatgtctgatatatgtcatatataaaaataaagggtctaatatattccttcaaagaataatcaaggtaagtaatgtgcgcatggggcacacactgttcaaataaatactacaaagagacagcagtctttgctgtgaggcacacatcttccctagtgacctccccttgacaataactacgctccactaaggatgaataaggatcatttctttttctctcagatgagaaaacagtacaactacactagatgcatttatcttttgtctttgcaactgtctttctgcttctttgtccatccaatctctgtttctctagtctaattcagacctgctcatttccctctcctcctgtctatgtctgtcttcctgtctccctctctctctgcctttctgtcctatttttgcctctcaatttctctctacttttgttttcttttggtttgtctttctgtctttttttttcactttatcctcttctactcatatttatatatgcatataaagagatacagaatttacactttataagttgaactcatttctgttctgctctcttgcatagtaaaatatcaatcacactaacctgcttactgagccaaagttcttccttacagttgagaaaccttctatgcatctaaaaatgaacagtcgtatccataacagtgacagcatgcatttgatttgcatagtgccttttcagtcaaactgttatgcagcctagttagacctctgactttgaggatgcagacagaattgtttaacacaatgaccttgacgagcctcacagtaaagtctcattctgagaaaatcacacttgaaagataaaataatttacacctagcattctggagtataattacacccatgatagacattacttttcagggctgaatctatggctacattttatcatgcaaggggaaagagagagatagaaatgattgtttgttgaatgcatatcactgactaagcacaaagctaattgatacataatatctcattgtattctctgtgtcacatgcttatccttctgagttacctctgttttatacatgagaaaaccagagttctaaaatagtacattaacttgtttaaggtcatagatttaggaagtggtatttttgagattccatcctgagccatgtgtactgaaaatataggttctatacttgttaatatatgtcttccatatattcctatgagggtcctatttcttaaagttatataactttactgcttattaaaaatatgcctaattgaaataaaccactacaattttatttgccattacaatctttggattaattttccaaaaatctaacacctagcaaattgtgaaagggtgaaatgtgtagttgaataacacacctacaaaggcagaaagctgaatgtccctcagaatagtagaaacaattactggggctgtggagggggaacgataatagccagacctgcttctcttgaatatattttattgaagatatcaatattcaaaggcaaaagataataataatgatcaaaaactttaagttgttctgattttcttgatgtatcttctaggtgtgttagtttgagggaattgaatgtattgaataattcaactgacttttcacatttcacatactaacatttcctgaatacttttaaggcaattgtacttctttgacatttttaaggctaacaacaatcctaaattgtagatataatttactgtagttaaataaatcattacctgaagctgggagggtttgttttacgttcacttagagaaatggcaattcaaatgatgagttaacttacatataagcttcttatatataacttatatataagcttcttatatataagttatatataagcttcttttttacattttcaaattcagtgctttcctctaattatcattcttcccaggctacttctgaactcacgtttctatgtcaaagtaatatgtctcagttaacattgtacaatctaacctctggcagcagaatcacgaattcactgaatttgggagctggtgccacattttttgtgataattatgatcttaatagtatgacttttttctaacttccaattagattgaactttaaaattaacatttatcttattttacttattttgtccatagctactgttaagtagaattttaattaagcagcagttggtagcagttagtttcaagttgttagaattcgtgatcatctaaaacccaaatgttagtagatatatgcttaaaaataggtgctgtcagaggtccacaaatacttgggtctttttgccagttttaacagttaaaattagatatgcttccatgttatttggaaagaaacaatccaagaatatctagtccaagaacttgcatggtccactgaacagcatcattgacaaggaatcaggcctttgcttctattcctggccacatgctgcaaaagtcattcagatttatcatgcagatgactggctttgcatatccctatcattatcactaacgctgagataacaattcccacttaccacacaggaatctctaatgattaattggataatgttcgttaagtgctcccagctacttagaataaatgtactagatggctattaagcattgttattataagatgttgcttagatgtaataccagtgactgactgctccatagttatgaggaaaattacttcctctgataatatgagtgtaatacatattgacttaaaatatacattctttggcatacatttagactttccaaatgagctaagcaaagggcggccttctatatggtttgttagttgctcatttaagagtgcatactatctgtgtggcacttttataagcacttcatccttacgataatactgaatgccaatgatatatccccactttttataggaaggacacagaaacataaatgccttggctgaggccacacagctagtaagtggtagggtcagaacttaatccttttaaaactggcttcaaaccactcatgcttaaccactcccttagactgcatagctcctatatttacatttgtattgtgtttatccctttgctcaagaaagtggaagtgtttggttatatatcacctggaaaacttgctgatctatctttttaaagacaaattgtgcaaggttaatccaggaagatcccctagggaaaatcagttaaggaagaattgagatataaagaaggcaggtgtaggagtgagaaaggtaacctgagttccttgtctatgtacaggtgtcatcacttcctattaattggggaagatattttaagttcattgtgattttgaatttagatgcctccaattttttgaaaatgcagaaaacaaattacagaaatgctatgtgaagttatagcatctgggaaaaagaacaaatattttcttctctaatgtttcatcaagtgaaatgatttgggctgtaaataaagtgctagtacaatatattttcaatgataaaagaaattatcatctctccaaacaagacatccaaggcaaactgacttaattttaaattcagcacctcaacagcatcatcaaggatccacactttttccctctttattcactatactcctcagcatgttacctgagcctcttatctcctccttgaagatgacggaagcagctccatctaccaattgacacacatcaggatctgcaagaacgagaactcaatcttccttgtttctctcttaaagccccacaagaaatcagttcccttgtatctcattggctgaaactttgtagcatgtttgttcctaaaacaaatagcaagaggactaaaaggttcatagttagctaaattagtcaagattcacttctttcatcaggaactgggaggtctctttccttaaattccattgctttgtgaatgaatgtggttttcggaacataagtcatagtctctaaacagggaagagggatgtctgttgggtagatgactgtatactgtctactgttactcttatattttattgaatgcatttccttttttctctattttttaatatttgcatggtgagaatgaattcatttaatttattttaattttaaatctatattaatgcaaattttacatagcaaaatgaaagaaatttttagttcattagatgctgtgtcattgtattgtactgaattttctcctaattttgtaattctgaggatgaaccacaacccatcttttctcaaactcaaatacagacattacccaagactcattaatcagaaccaatgacatttttgtctggtttgtattttcttctagatgtcaaattgacatgtgaggattaacatatccacaaaacaaactttatcaaactaggctgtccatttctacgttctgtcctccgtaatacatcatttacattttgctttattgattttcatttagcataatacttttggtagtggtggtggcctgtgtgtacatgtatgtacatacatgtgctaaatgtacacatttaattacatatatatgatttgttatataattatataatttatataatttaaattttataattatataatttatgtaattatataatataatttacattttataaatctaatataatttatataatataatttatgaaatttatataattataatacatacacttttatataatataaatattaataaatattaataaatattaaataaatattaataaatatttcaaatgctttaaaatatttgaaataacctgtatatagaattagactttagatatctaacccttatataggattaggcttggatatcctggacatccaaatagaatcctatatacagattagatattcaaatattttgaagaattacttcgatttttacaaccttggttaactcttcctttctatgagatggtatgatgtaatttttactacttttattatattgtttgtctgctgtgtgctgtagctattcatatactaaaattgttactcctaccacatacactgtgatagtaaaagcacaactaacacttacgtaatgtgtaatttccttagtattttcgatgttaccataattttttgcaatactaattagtattttatgataaagtacgcttaaagaaatgtggagaatcctagtctagaaaaaatagttgagcctgtaaaagctgatatgccacatgccactccaagtggaatggagatagtatgctgcatttcccaaacatgtttggccaggaatcacttttggttatactcatagaattactagtattctgtgaaacacattaggtgaatataaatattgtgatttgtaacgcatgcaatgctttacgaataaatatcatttcattttcacaaaacatttgaagtaagtagatcaataattgttagtattctcattctatagatgacaaggttgatgtaaaaaatgtggcacaagattcattggaaattcaaaataaaatgtcctcaacttcgactaaatcctgtgttgtcttcattacactaaacacatgcttaaagctctacttctcttgtatttctttcagtaccttgcacagtaccttgaactttgtaaatacttcaaaaataaaacttgcttcaaatttcatctaatttaatagtaagttaaaattaaagcaaaaacagtaagtatgactatgtccctaatagtttgtcaacacattgatataacaaaatggtttgtttaatcagttcaagatccaatggcatttctaaaagcttttcaaaactgtaattaagttttgttttttaactaaactgcaagcctagaatttagtgaaaaatcaggcagaaatcatgaattggaaaatatgtcctgacatagctttaggtaagaaatggaatgattaatatagaccgaccataatgaatacaaatggagttctgcctgttctattaagtgaaccacgggaatcagtcaataccatttatcttgaggacaagtaaagactgagtcaaaatacactaaaaagagggtatattaatgtggatttctaattaaccgaatccaccacactctggtcaccaatgataaaaagttgcaaatatgctttatatatgcacaaccatacagataactaatgtcaactcaatttgcaaagctataaattttaaagaactgtctttaaattgtattaattttgaaagaaattttgctgtgccaggaatataagacactaacaaccatctcaaggctctaatgactctatattatttattagtcttccacattaatgttattattataaatgtcctatacctacttacctagagttaaattaatattttaaaataaatattaatgaattaaactatgtattaaatgcctaattatttagcacatacaaaaaccctcattctcaatcaattacatttcagatttaaagaaatgcttttactttgtgaattgtctcataaataaatttagttctttcttttaggtttaatagggtttctaaacatgcctggtttaacagattatcagtatttgttacacattgtgtgtaatagcattaatttagaaaatttaatgtacagacacatttttcttcttcacaaatagtaaaccatctatccatgtcagatgtagaaaaaattgtttaaagcaaaatatggtagcttcttctgtgtctatcaggttattctgttaaatgccagaaggactcagaagttcaggatcaaacagaaagctaatataaatctatttggaaaacttgagaatgaaaaaaaatatatgtatatatctataaatgtatttctttgcctatttcccaggcttgagttttcctaagtatcagaaggaaatgtaaattttttataaccaaaattaagaaatatatggtgttaattaaaaagaatagaaaataaaataatgcagctaaagatttataggttgaatgggacatgcctgtaaaaggaatctgtataggtggtatctatgtaggtcaacctacaacagaaagcgtgaatgctgatggcagaatgaagtctaatcagggtaaggagagaaaattctagatatccctgatggctcatctcctccaccctttcagtgacttagcaagaaactggatcagctcacctgaactagcgcaataaataggaccagaggctgagctcaggagctttctccttttaactcggccacttcctaaaccaagaagcaccaatcatcacagggttactagatgtttattttcttcctttctccactcctaaaaatgtgtagatcattatagggctggtatctccttcccggaaccctttctgtgctgaatccagtccagctcaatctgctttaacacgtctctatggattattgagcaactgggctcatttgactcgtcctagttctcagtgtatacattatcttcaaacaaactctatcacatatatacacttcggggtattagggtgtgaatgtccatatcatccttataatccaggacaaactttgtatatctgaatgcagtggcaagattttcacttttcatatttgaatgaaagattcaaaaccatgtaaacatgtaaatcccttcattgttttgttgctttgtttctttttttgaaagtctgtctccagattaagtttaactgatcaatatatagtatcttaatccatgtgttttaggaaacagtctttctgatactttaaatagctgtgttcagatgatcacgtttgttatataacattctctgctcaattatcttctattttgctttcttcctgccttcctcacctaaataagccagcagctttgtttctcataccaaatgctaggtgtcatctttttattccttccttatctattccaatagcagagtctggttagttctaccccaaatgtcttttcaatacttgcacttggtatctctccattatgaatactgtattccaagctactgtcactttctgcctaactgccaccctatcttgtctctctgcttctgctctcctaccagtcaaaccagatctcttccacaggggagtgggagtgatcatttaatcagatcataccactcttctgctaggagcatatccaaactcagagccctcatagagttggggcactttctacctctttcacttcctcctgtatcacctctgacttccctcactatcctgcagccccatttgcctgcaatgccctttccctcgatatcttcatgctttgcctctttgctcatgcctcaaccaagctgccatatgatcagacaagccacccacactactgattcacacacaggcatatgctcatatctgctaccctccaaccctgccttttattgtaatcaatagtatttatgataacctgacataatacgtatttgtttcttgcttcactgaatgtaaatggtattataaatggcatgaaacagggattttgacttcctaggtggttactctaccctcagtacttagcacgttgcaggttctgcagaaatcctgattaatggaaatgttgacacaaatcccatgattattttatggtgaaatcacaaatttccctacctatttttttcatacagaagtcgctttgcttttttctcattagttgtatttatcttctaaatgaaatgaaaatatattgcagaaacaggagtaagtttcctgtaatttgggtgtgggaatccctctgtagaacttagtgcctgaaaaccttgcttcacaggggaaggaataatgaatctcatgtttaaattatgtagcacaagtagatatagtatcaacttaaaaaatttcacaaattctttgaaaatccaactattcaaagaaaatccatattcaagcacagactttaatttggagttacccttctattggatctctatatagctttgaaactgattaaagctggctttgatttccacatttagaaattaatcacacatggctggatcacggccatgggggctgctattctagagcaacctctctctgtgagacttggaaaaatatgaggagagccacccacctatcacaccatcaaacacttatatagacacacaactgagagaggggttgcttcatgtgttcttttctctaaaaaaaatcctctggacatttctctcttagcttcaacgactctgttggtttttaagtagatagagagatggtttgacaaattaaaaggtagctagcttactaaacatagcatggtgaacacttaattccaatcataaaataacattttactatgttcaaattgtgaaaaacagacaatagtaaatgaagatatcactactgatggtgaaagaaacagaaagtaacatgattgctgttgacttctccagctgcatcttccctcactggcatgtatccacaccgtgtttcaggaataccaagatatttattatttcctaaatagtcaaggctacctctcatcccttagatctaattggtcatgcccctctgcccagcagaattttaacacctatcctttctcatgctaacttctatttagatttcagattagatctcaaagttaaactccttcagatgtggactcagctcaaataccatggataccagagatatcattgacttaattattcttatgctcattaaagccttccttgggttgttgtgatagattattgtgatggggatatcagatatcctcaaaattataaatacctatggtattaatagtaatatttttgcagaaaatttacttttgaatatctatgtatttctaatttgtaaaaccacttttctgttataaacaatgaacatctctttatgcaacagagtttattcatcaatctttgtgtctttttctgattgtttctattaattaaactcttagaagctgaaattgctagataaatgctgttaacatttaacacatattggcaagttgccattctgaagagtaacaccaattcatactcttaccaatagtcctcagggtacccttttcctcacatactgtgaactctaggtattatcaatctttttaactttgtaaaactgagagtcaaataaacttgttgttttgtggttctactataccaagaaaagatataatagacatgaaaatgttggcatctttatgagtctggaattaaaggaactttccctttctgctttctaatttgatttaaggaatatattgcactttaataacaaatgcactaaaatgatttgcatttgaaaatctctttaatattttaactctgaaaagacagacttgcacaatggttaagattgtgaggtgaggactcaagtgggtctgagttcaaattgaagcatatgcacttaaaatgcagttttatcatctggaatacaagggtgataatccttgctcttctaggattaaaatgatctcataaatgttgagtactgaaagaagtattggcacataataggcagttaataaatagcagtgaggagactcctggtaaacatagcatttcaaacttatgcattcttccaaacaaaacagaattcatctatgtacatggacatgtatttcttatgaggttttcttcaatagataatgaatgtaagaaagcaaaattaatttgcttgtgattatttgtgttgttatcaaatatgggtttatgacatactatagagtattctttggaggcaggttaattgctttcatccaataagaggagatttagtactataaatagaaaatgcttaaagcttttcagaatttgtcttaaaagcaattaaatttaagtttaaactatgatattttgctcattatcgtaaagttggaagataaattaaaagtttcagaagttaattattttaatacaaatctaaaattcagtcattattcttctaaaatgcaataaattaaaagattataacggcttgaagattaccttaagaacaactttttagctgatggtacatagctcctgtgggtcagaatatgtttttaaagtttctcaatttgatcacattagcatttgcactggataaaaatgagtggtgccacagaattaagcaacgatttcagaaacaaattcaaaataaactcacacttaagtaactaaacaaattggccttccatctattaatttagcacctatagagttctaaagttgagagatttaggaaggtactaagagtgacaaatgtgtgtcatctgcatcttaaaaaataagaaacattaattcaccaaacagagtggtattaccaagtagaggaagccactaacacatgcaaatagagtgggtaaattcacggtgacttcagagtacttgtggttgttgtgtgggaagcctaacatggaagatcatgaatccaagtcagaaagataattaaggatgaattatgttaaggagattagatctcattaatttccctcatttatgaaggaacttggacattcttagaaattttctctctgcaataacatctactgcaaacatggatcacatcatgaatgccacaggaaataacctagatcataaaccattcgactgcctcattttgctttttttcctacctaactcaccctacagccactcactttcctcagtccttttaaatttcagctctggtttcatgaaatgactttgttatctacttagagaaaactggacttattgatagagaaccaattaatcttttcttcccacaacctacaacaaactcacctaagtctacagtggcttaatttttttttccttttacagtacatcaatcatctatttttgtctgtaagactatccttttgccaaagttttcaatactcaatacaaaaatcacagtttttgatttttttttgtttatttttttattttttattttttattttttgagacggagtttcactttgtcgcccaagctggagtgcagtggggcgatcttaactcactgcaacctctgcctcccgggtttcaagcgattttcctgccttagcctccgagtagctgggattataggcatgcaccacaatgcctggctaactttagagacggggttttgccatgttggccaggctggtctcgaactcctgacctcaagtgatctgtctgtctcagcctcccaaagtgctgggattatgggcatgagccaccgtgcccagccagtttttgaatttgaatgcccatagagaatacactgcagttacccacagaatctataattgtttatgactttatatctagttgtcctgcttgtattgagtcacattatttgttagacatcaaaaggcacataatttggggtaccttgaattacattatctctttgatgtatttgacattgactacttaactaaatccttcccctgtgtatgcaaaccccttcacattacttacaaaaatagacacacagaccctctgttggacagcagatcatcctctcttctccctcacaagcaaaattatcaagaagcgttgtataccgtctgaatctctgttcatttctttctctcccactaacatttgcaactggctctaatttcccttcaaattcctactacttgtgaaagttgttgatagggtcacgtataaagttccatgtgaacaaatctaataaacattagtaagctttttttttgcattcatattcctagagatacttgatgacccccttcacctagaaagtcttccctctcctttatcacatagaagtcccctattctcctcagcattcttccccatcctcctttacagtctccttagacatctcatcttctatggaaacataaaatactgaaattctgaaagactcatctttgcctttttttcttagagatctatattctctccctacataagcacatttatgtctagagttgtattgctattttgtgccagtgttcccaatatttatatttcaatctcgggcttatttatatttttttatttcgagattctttttagttttattcacatgcacttaacaatttccaaatactctttggtgttatgttttatggcacatttaatataatgtacacaaaagcagacactatcatcttgccctgtttcttccatcaatatctgtcttttttcttggctcctaatttcagggaatggtaatttccctttctgcaaattagacatctgggagtcatccttgatctctctctctctctttgattcctctctgccccatgccatccatatatgagtacttaaaatttttaatcacatattaagaaactactcccaaatcatcccggaagtcttgccacatctctccatactcactacaatctttatatcccaggctatcttgatctctttctggcaatatcttctactctgctgcactccatgcactctgactttttcagtctgttttctaagtatatcactcccccactccatctttaagccctataattagttttctttgaatttagaataaagactaggtttatagtttttacgacctgaacaattagtcacattctcttatttcttctctctgttcaaatatactgatctttcatttcttaaattttccgagcctcttcctacttaaggaattgtattcactttgtttcccttgtttagattcctttttttctaacctagcttttatcatttttcagtttgcaacttaaagtctccctctctgacttcccaggtttctcaattcacctcaatatatgcattccacatgttggtgttgtaattgtacctttgtttgctaagtgatttgattacagtccattttacctaccataagaggattgcatcagtgttaccattgtttgttcagcacctagtttggtagatgtttgtttctccataaatgctcacctaaaagaatattttgcctgttagaatgagctgtattgaggtaactatgcagggtgggagcacagttaatttttgtttttagaaattttacacaataggaaaataaaaggaagagatggagtgcaggtgttctaaaaatagggaaatattttaggaggctatattaatagcccaagatcctgcctggactgaagatactgaagaaggcacagcagttgggttatagatgagaaagtgcaactgagagatacttagattaatgtagtgattgtttctgactggctgggctggacccaaggtaagagaggcctcatgagcaaatgatcaacactataagttctaatgagttgtagaactttctctacaactgattagagcttatagtgccaataagaagatagcgatgaagcattttatggtgaattctcagttacattttccaaaggctgaactttagttgtttagcatggagaagtttagaagaataatagagataagtactacatggtgctcaaagagagaagtggactgatgaaacaaatttgacagtcattggtacaagttgcagataaagttatgaatgtggctgggaacacatagagactggctttggctcaaccacaggaataatcttagaaggagaatgaaagaatttgagccaaagaaaattaaaaagaaatggctacatgggtagaaataaaacagcaagaaatttgggaataaaaaccaagcgaagtgagagacattcaaggagagactggtgaatcaagatgaggactaaataaaatattgcttataatatttggtgatcagaatttctttttaggattatcaagtctgttgttattggagctagacaggcagctataaagcctgttgtaaagtgcatgggacagaaaagaatcagaagttatagcacagactacttttaaaatatttttttgagttgtaaagtgcatgggacagaaaagaatcagaagttatagcacagactacttttaaaatatttttttcttataaagaagaaagaactatatggtggtaaccagataagaaagcacgtggaaacgggtgatttcttctcgtgaaatttaatgaaaccaaaaattttacccttaaaatacagcatttactctatttcatgcaagtcactaagaattctccctgaccttgccataagaaggaaggggcaactgtaggtactactgctaaggatcagcagggacaatctcactcatacccacaggacacaagaaatcttacgagctaaacagaattgactgaaagtcaagtgcaatgttaaaaaatcccagaaagtcataaggcattctgcaaagtcattaaactgaaaggataaagaaagcagtgatacagtcagaaatatccccccaaagcaagagacttgacagttagaaagggtcctttctacacaaaaataactagagtagagtcattaatggcctatttttattttctgtcctaatatatgaagaacggctagtttgcaaaggaagaataaataccctagtgataaaaaaaaaaaaattacaaagtatggaattagagaaacctgggtctgaccttccagttgtgtggttaagggtatgaatttagataaggcatgaaatgtttcttaactcggttttttttgttactttattaaatgggcaataatggctactcttaagactgtagagaggactaagacaataaatccaaagtttttggcatgtaacacatgcctaagagataataaagttattcttgatagagtcctagattggaagtagtgagatgggttcataaaattgacccttggtttttgaaactaaaaatagttttccatttccaaaaaatatatattgtgtaaatatcactagtaaaatgtataacaacattttttcccctgaggcaaagttaaggcaaaagataatttcagagccttaaatatctcttgcctagagctccttcttcatccattcctcaacaactatagcgagatctgtcctctgtgtctaaaatgttcataactagtaattgtgaaactagtggcccaaagcaaatgaagaataactgccttgatatatgtatatgcacgacaatgaacacagcaaatgctgagaaagaaagaatggattggaacagagaaaaataaatcctcctgagaactacatcttcttatttagaactcctgtccttacttcacatgtgcagaaccagctcaaagtctggatgtaagccagccatgacccttactctgctgtgaatatcattccccccaacagtagtctcagactcttcatttctccatgtggaaaatgttgccaagtcacacaatgcctagtatacagcactaaagtcatttttttaaaaaacttttaagttcaagggtgaaagtgcaggtttgttatgtaggtaaacttctgtcatgggggtttgttgtacagatgacttcattgcccagatattaaacctagtacacattagttaattttcctgatcccctcccctctcccaccctaccctctctgaaaggccccagtgtgtgttgttcctctctatccgtccatgtgttctcatcatttagctcccacagtttatctaaagatgtgtgcttataaatcttccttctcccttctacttctggcaaataaaacattctttttgttcatctgcagaaagaaacagagtcctccttctctctctctctcttttttttttttttttgagaaggagtttcacttttgttgctcaggctggcgtgcagtggtgcaatcttggctcactgcaatctctgcctcccaggttcaagtgattctcctgcctcagcctcccaagtagctgggattacaggtgtgcacctccatgcctggctaattttttttatttacagtagagacaggtttcaccatgttgggcaggctggtctttgattcacatatcaaggcatgttacaaaactatttatgcagaaatggcacacgtgagctactggcatgtaacctgaatcctaaattggttgggagaaatagaaattgtgtaccatagaatcaaagacttttaccttgccattcacagtgtgtcccttttcatgtagatgacattatttactattcattgtctcaaacacatttccgtgtataagtgagaaagtcctagtgcttatttgtcataaggtaagggaagatgcttcatgggacaaaagaaatctgacaaagcagcaagatttttaaattttctattgtggtaggagttttactgattatcactaaaatagggaatgaagtgggttttgggaaatcagttccatttacatttattccacaaaaaaagatttatatctatatgccactctttctttgtgtatgctaaggcgtatgaaaggaagaaaatcctctgtgatttgcattaagaacagtaaaaaacaatattgaaggacttcatcataaccagtaggagaacctggtcaaattaagcacatttgtgattcccagaacattctgaagagaaatacttgagtcattcatttggttctaagtacacctgacagaattgcatctgggcatcttctcaggggaatctcctctccttaagtgcccttgagtaagatctctctgcagttaagtgcctgacattattaagaatcttaattttgtactgccttcttgtatgtgcggcataagatttaggcaaaagtaacactgcctctttcaaagtcaatttgaaacacacatatatgaagaattttttaaaaagtcaataactattgtcattcagtaaaatcctcaaaagaaatgtaataataccaagtccttcacccacttcattttgatttgaatttatcagaaaaagctctgaaattaatatctaaccatatagtcaagctgtgccaaatgattgtagattaaccagtgaaaatctattcacattttgttcagtagtgtgagagatacagcagccaaaatctacaggatttgtgtttggttttttgtttgttttttgagacagagtctccgtcttttgcccaggctggagtgcagtgatatgatctcagctcactgcaacctctgccttccgggttcaagtgatgctcctgcctcagactcctgagaatttgggattacaggcgtgcatcaccatgcccagctaatttttgtatttttactggaggcggcttttcaccacgttggccagtctggtcttgaactcctgacctcaagtgatgcccccgccttggcctcccaaagtgctgggattacaagtgtgagtcactgagcctggccagcatttttatatacctgcaaaagacactttgaaataacaaataagttgtaatgacacagttgatagaaaatggaaaatgtatacttccaatgtggagtaaaatagcaaaacatgctcgtaaaagcactaaataaataagaaatattaatgaaaaatatctaactgtaaatttcttgaagaaaatacttaaagtacagttttagggattgaacctaaacttcaagtttaaatgttccataatatttaaatttatttacaatataaatttataaaacaaaatagatattcagcgtggaaattcagaaaggaaacacatatacaaagttactggtgttactaataagtgcacgtggtttgcaactgattgctcttatgcaaacactcacacgagcacatatgaggtcccctaggagtaatagaccagtctctggcatctgggcagatggtgcttatattgctggcaggtgatgaagctgagggaagacacttatcatcttaaatcccagagaccaacactttcaacttaaaaatgaaaatgtcccaattataaatccccaaggtggaaaaggctgcaacaggaaagcattctaaaccatgcctttgtgttgtattgcagtcaagaggaaataaggagttcccagcaactgaaagtttttctttcatgcctctcatatttcttggcatcaccataactgtggccatttaatcaagattccctttaaactggtgaatgctagcagaatgtctcaagagagctgatttccttcactttcaagttcattgtgaccacgaatgcattaacctgggctgcctacatttcttcctgtgctgtcacataagatatactccacataaaaataaagaacatcgaccttgaaagaggaaaaaaaaaagaaagaaagaaagaaaaaactacatttagcaacccagactagaatctaagctctgtcaaagtgatttcttattccattttactgaagcagtgccaagctttatcacttatgagttcatgtcttacagctgaggcaacccacttgaattggtaagttgcttaaagtatacacgcgctgttcatgttgtcactgtgatttaaaatgagagaggagttctgcaggtggaatacaactgaaatagagagaggaaatggaaactagaaacattaaaccatgcgtaattaatggttctttgtcttgctggtcctctggaactctttttatgagtgttatgcagatgccctatagcaggaagggcagtgctgtcatttgaatagggttggttgttctccaccaaagtgcattttgaaatttgattcccagcatgtaggtgttgggaggtggggtctagttgggaggtgtttgggttgtgggggtggatccctgatggatggcttggtgctgtgatcctagtagtgagttcccactctcacaagactggattacttcccttgggaatggatttgttcctgtgagagtggattgtaatagagccagtgtgcccctcaggtttccctctcttcacatgagttcatttcccctttggccttcaccatgttgtgacacagcacgaaagcccttgcaagaaaccaggggtatggccttgaacttctcagcctgcagaaccatgagctaaattaatctctattctttactaattacccagtcaaaggtattcctttagagcaacacaaaacagacagagagagagaggcaggatgcttagtgctgagggtccgactttgtatcatcctacatttttcgttcacattggcatcacaaatagaaatggagaaaataagtatgattgctgcagctaaatctgacaaactgtcacctacctacaccatttctacaccatgtaatctcacataacgtccacaaatgtcctgtgcctattagcattttaaagggctttgtggccattatactctcgctttggagctagggatgtttcattatcctcaattaaaactctctcagaagcaagattggcaagcatttatttatatattttccttagaggcaacatgggaggcatggattctgtaaaggaggcagggtgctgttctgtgctgcatcaagaggcgatgctggtttggaataactctcctaatgtgaagctatccccattaaaacataaaccataattgtggaaagcaatttgctcagtagcagagaactaacagggtttcttattgtgattcaataacaagggagcatggagatgcaatgctgaaaatgctccccaaactcttttaattttcttgaagtgtaattttcttctgtgaaaccaatgtgaaaagctgaaatcatttctattatactcagaagcaagatgtatagacatttcctgtaaattaacattttccaacttcagtaaacttaaacactcttccatttgtctgtttcaaaatgtggattaataaaaacttgaaaccatgacactgccgataaacagtgaaagcaaatccacagctaggtcacaagttgatgtacttaaatttctaatcagttttgtcatgctttatacagctgcttctctttcactaacaattgattacagttcaataatgattatataccaacatgagaggttgataaatattaataatattttaaaaatcaataacattattaagagaatccttcctatagaatatggtcaaaatcaataatagcatataaatatatcagatgctgagatattgcatactgtatgctactaaagtcaaaatcaatagtaacaatcaggagatctattattttattacttatacttaacataagtagatattcgatctgtacaattctatttcttttattaggcataacatggatcaaggaaacgaaaggagccataaatggttctaataaatttataaaaacatttatttgttaaaaatttgcagctagcccatttctttttatagcattatccactagtgaaggacaagaaatagaaatatctttttaaaaaaaattcctatttttaatcatagtgctcaatagtggcacatgcaatggcttgagatctgtggtgcatccaggggataacagatgcctcagaagcattaccacatcttccccccgcctatccccagccccgtgggctgcattttgttgtgactcctgtgtgcttttctaagacgtgtttgcttcacagctggtgaatggacactttccatcacttcacctcttggcaacagatgcctctcagttaggcacagatgctgagtgtccacccatccctaacattagccttgcgttctggactaattgggccaacagagttgcaattaagatttgaataattagataacggacatgattacttttgtaattaatcctcatactgagtcatcatgatcatgtctggggtgatgaccactggcttatacctaattcaaatagaggtagtgagtattaaaagcaaagcattagcaaaaatactccctcacttctcctctagaaaaaataaatatgacactacatatagacacacaattttcatttttcaagtacattttacagtgatctgttggatgatgagaactcatttcaatttaattcatgcctccatctgtctgtctgtctatctatctatctatctatctatctatctatctatctatctatcctctatccatctttttttcccaaagacttccactttggcttctgcactgttttggaactgtgacctatattttaaaatgagtgttttctttcctttttcaaaaatttaccatatcataaaaacaaatacatagaaacaaactgaagttgacccctctcccttctcttgtctacaaaaaagccacagatgttagaatttcttatggtttggctgtgagttcctcctcttatctctactctttccaaatactgtccatatctgtgactcctagaatgtcatctggtaggagtgtggtgcgaaaagacatctaaagccaacagtgcctagcagacctgccagagctcttgtctctgcagaaccctctcagaagcctgttgacttcaattaatcttctcaatgaaaggatcaatcagctccgtaaatcagggtctcagactcatccctgactacacactcccacaactggcgcatgccaatctgttgccaaatgaagttcacttttctctttaaatgttactcaactcccaccactatgtatttcgctcccttgcctcaatgtgggagtatcgtgatatctttctgaagtaatgtaatagttttcctttcctattcctgtcccattccaaacttccttctaaattggcacagtcttctctgtatgactgtgttccttcatctctgcattttagctgctgtagcttctctcaatcctaggaataaaccaacatcccaagtgttactacatggacgcttccctttgcctagaacagtctttcttccctcttcatctagtaaactgcacatcctcagatctctggccatcaattttcccaagaggtgtttcttgtccctctagaccaagccaagcccttcctttacactctcttaaagcctccttctcatttcactcttagcgctttcctcactttgtagttatatgagcttttttgttaatcatttcagctcatagatacactggatcgacccagtttctgacacacaagagactctacactcttaaattaatgaatgataaatggtgtcatattgaaaatgggttaaactgtgtgattcagcaactaaggataaaaaggtttcagaagtaattactcaatatttatttataagttgtctatatacaccaatggtctttttatttttattttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccaccaatggtctttaaagaacagattctttcatatatgtgttcatgtatgccaaaattaatactcatgttttttgtttgtctgtttgtttgagacagaggcttggtctgtctcccaggctggagtgcagtggcctgatcttggctcacagcaacctctgcctccaggattcaagtgattctcctgactcagactccccagtagctaggattataggagggccaccatgcccagctaatttttgtttttttggtagagacaaggcttcaccatgttggccaggatggtctcaaactcctggcctcaagtgatctgcctgcctcggcttcccaaagtgctaggattacaggcatgagtcaccatgcctggcagtcaaatattaatatgtgactgacacaatacaggtctttgaagatatacacataattaatatgtagtctgggcctgcaaggaacttataatctctcaggtaatacaaatctgtaaagacgaaattaggagccatgacaaactaataaaataatgagttaacgaggctggtggctggaaatgagagagcgttttctggtgaatgtaatgtcaggtttgggtttcaaagagagtaggaattagccagacaagttacacagatgtagaagaataagaaggagaagagcagacacatttaaggccctatggacagcatggataaaagtcacagaggtccacaagcaccattaggggtgtgtgtgtgtacatttgtgcacacaggcttatgcatgtgcctacaaattattcacagtgactgaaaagaaaagaatggtgagaggtaaggaggggtgggataagctggggggatgtcagagtagacctcttatcccagaatagactggggctcactttgtagataacagagagccatggagatttcatgtaggtaagtgataaggttatatttgtatttgaaacagaacacagctggggaggctacacttgaaagggaagagactggaggccagaatattgaagaggaggctgagtccaggcaagaatttgctatacttgcctgcataggcaagagtgaaggcctgtacttaaaagaggtgcagtaggtatgcagacatggctatatagttaaggaagtcggaaaaaaactgagatttgtgatactggaatggagtgtggaaaaaaaaatcatagtttagtaagacactcaggttacaaacatacatgctggagaaaactgcaattttaacaaatgtattttagcttctctgactcatgaatctgagccctacatatgtctttttgtttgtttttgtttgtttgtttgtttttgaatactaaatgttttgaacaccaatttggagggctataaagtttaatgtgaactaaagatatcataacttctcaaattcaggcttaatgtttctaggagtaaacatgttcagaattctaaccaagagcataaggaaatgtaatgacataactttgttaaaactagatttcgatgtcgtgttttttgaagctatgaatgttagatgatggggaaactcccaggtcttttctgctttacataacatgtaagtatttttgtctctttttgctggttactttcctaggcattgaggagtacaggtgaattcatatattacctctggggtaggttttcactttgtgctgaatgtcaacctgttccttgaatgggcataattcagaaaaaaagctaatttgtgtgttattatcagaaattatagttcattttttattctggctgttgtcttctttgaaacttttttctttgtaggtatacaaatttggataagcagccggatgtatcaggcaaattcttggggagatccatgtttgcacaattgttgatgtagttgttttatagaagaaaaacccacgagggttgctgagtcatcagactccactgtactctttcactgcagtagagaatatagtaagaacttggtttggctcagtacaacatactagctcagtgatagcctacgcaaggtattatttaagacttactaatacaattgaatttatgtaggattatcttcctttaattttcctattaagaataacttagggactgcaagggagaaaggaatgttttattgaaataagtggacattatcatagccaatacttacaaatgttagaatttggaaatgaaaatgaggcttctatgttcaaaacccaggatggagtctagggctttgtctctgacacctcattggagatgagtcctgtcctctgtgctagaagatctatttcagtgcagtcctggtaggaaaagaaagctggcccctagccaatggtaaataggggttaacagagatggaacattcaggtaccaggcttgtgagctagagaggtgacacactgcttacttaatggtgtcttatgtaacctacctcccccactattctttctttacttttctttttctttcttttttttttttttgttttgttttttttgttttttgtttttgagaccgagtctcactctgtctcccaggctagagttcagtggcacaatttcaggtcactgcaagctctgcctcctgggttcaagcgattctcctgcctcagcctcctgagtagctgggattacaagcgtccgcccccatgcccgcctaatttttgtatttttagtagagacagggtttcaccatgttggcaaggctggtctcgaactcttgatctcaagagatccgcccagctcagcctcctaaaatgctgggattacaggtgtgaggcaccgtgactggcctccccactattatttctttactttatgaaaaaaacttgccacttggtctgtcagtgcagtgtggtcttaatgaaaaggacaggttcaagttgtaagtaaaaaagtaataaaaggcaatatgttattctttccctgtagctacaattttgtgagcaatggggaccacgggcataggacagtttcacccagaggagctgtgatctcccaagagacatcagcagttgtggtcttgcctggcagatggcaggaggtcagagagggaaacacaagactttttttctaagagtataagcgagcaccttgggagtttcacaaatagccaggagagaaatcaaatgactcaggggcagcaatcaaggcagtgatcctgagctatcataaaggtgtcagttgatgaaaataggacctgatgatattatcccaagcctagaaatatgggttgccataggttcttgataaaagttagttttctgtcctctaggtagacagaggctttttaaacttgaaattattagggagatttgagaccaaggtcgtagctagaatcagtgacagggcaatgtcagtgaaatattgggacttgggctatccagttgctgaaataataataacctcctcagcagtagtgtgcttgctgtaagccaggtgcttcactaagcacatttattatagtatctcattatataactacctgttaatattgtctgtgttatgctatgaaaggaaatcagagcattaaagagtgacaaaaattgtctaaagctacataggtagtaagtggtagactcagattgaaatgtcaatgtgttgaattgtaaatgccattcttataaccattatgcctttccaattctactttacaaacttggatgtgctggtaacactgttaaggttggaaaagccaaaggaaaaacaattattatttttcctttgaaaaattgttatttgtcattcattaagatgggtgctttctcctactttacctcatttaattctcaatacaatgaataagaaaatataaaatgtgtatttataccttttaaacacacagaagcaaaggattctccaactctcactctattgccaccaaatttatttcttatggggatttctctttctctacaatcctctgcaaaagagagcatgttttgccattttctctcctttatttcttgttcctaaatttagctcaatatgagggaataaaagcctggtgtgaaaaactcttttttcctaggtggcatctctcctccctctctttctttctctctttcattttctcagtttcaacctattagtagcaataattttttaaaagagtcatatatacatattaatcacagaatttaacctagatgtttacatagatttaaataagaacgttctacacgtcttcatttctctatcctatattacagaagttttggtagaaatagtgtgtgtatattacagtgtgtatgtatgtgggtgtgtgtgcatatgtgtgtatatctctgtctattctatctgcatgtaattttttttttttttttttgacagagtcttgctctgtcgccaggcttgagtgcagtggcatgatctcggctcactgcaacttccgaatcccgggtttaggcgattctcttgcctcagtctcctgcgtggctgggaatacaggcacgcactaccccatccagctaatgtttgtatatttagtggagatggggtttcaccatgttggccaggatggtctcgatctctcgacctcatgatctgcccacctcggcctcccaaagtgctgggattacaggcatgagccactgtgcctggcctgtatgtaatcttttattcattttacagagatcattagaattttctctcctgctttctcatgcactccattccaggtgacatcctataaacaagccacatatacagtgagaaactgcctacgctgagttgacctcaagtaggtagaaggctttacacagcttcaaaagtccctcatttgctctcatcaaaaaaggatatctgcaaggggactagagacatttattctaacatgtgcatcaggactcaaacaacttctgaggtgtcctcaggcacccggagggctctattgtcctacttctccttgttgcctgtgttctcctttcaatctcagcctaaagttcttgtggctttgggacatcactgtagctccttgttgggtattctctccctttaattatttcatgcgatagatcttgcttcttttccccaaggaaagggattcagagtgggtcagtcgaatttcttaatcctcaatcagacaaaaaagtagatcatgaaaaataattgatgggtgttaggcttaatatctgggtgatgaaacaatctgtacagcaaactctcatgatacaagtttacctacataaacctgcacttctacccctgaacttaaaataagagttaaaaaatagtttatgataagattttcattaataagaaactgtttgttgcatttctaacacaggggccttcaatacctcaacttaaagaatggaaagaatagccgggtgcagcggctcatgcctgtaatcccagcactttgggaggccaaagggggaggatcatgaggtcaggagatcgagtccatcctggctaacacagtgaaaccctgtctctactaaaaatacaaaaaaaaaattagctgggcgtggtggcaggtgcctgtagtcccagctacttgggaggctgaggcaggagaatggtgtgaacccgggaggcgagcttgcagtgagccaagagtccgccactgcactccagcctgggcaacagagcgagacaccgtctcaaaataaataaataaatacataaataaacaaaaaagaatggaaagaatattggcaaggtagattttgccagagagtatcagtgagatgcttttaaagagaagcagctttaagcagcattgtttcttttctgattagtcagctcttctgttttattctaaattagctttcattgctttttgtgaagatcagttattggtaaggactccttattgcattttcctaatctgaaactatgatgttattatcacttgttcctaaaatacatctataccataaaaagtttggggcaattactttatttctggctcaatgtctcccaagatgatctcaaacacaaaatcattactgttaatatttataaagtctctcaaaaagtatgaatttttctaatttataaatttgtatgcttcttgcagaaaatccttaaacctttcttatttttttcttttcttatgtatgagtgtgaaatcaatttgaaagttataaaaggctttacatggtgctcttcacttgcaaattggtgggacaacattcattatgataaaaataacagtaaaataagtatgattttattcacaacaatattattcttaatcatatttaaaagaataaaaagataatttacttataattacaacaaagttcttagcaaaccatgcagaataacttttttcattactaaaatatcatagtgtgcgtctgggtgaatgtctctatgtaattaccatctgtgtcagggtgttcatttctagcacttcagtagtctctcttttgtacttctgtcagtcaccccaaaaacgtactgatagtgttggctaaatgaataatgcaataacacttttattctacttgcattttatgtaataactaataatgttaaaaaaatgcttcagatttattttacacaccaaataagcatatcgtataaatatgttacatacatgatagttatgttatctgacaatgttagaaacaggcatttctgacactcttcaatattttcatttttatgtaggaatcgtaacaaatgcctaaggaacttaatgtctacaaaactatttctgctgtttaaaagatacctagcaactggaatgttaaatttgctctatttgtataagtagttatgctgttgtcagattgagatgagtaactccaggacctatgaaaactctactttctattcctacatgacttcaacaattctgctctatctagtaagtgatttatgcacaaaactcaaggcaggtatttgaatgcatcttacactttcattggtaatggctttatgtggacaaaaatgctatcaattctgaattttcctttcggaatgcaaaacctatgaaacatttcaataaatataacacaagcagaatcaccctctttaccaatcctcaagattttgaaatgtttaacaaacccgacattttttatttttatttatttatttatttatttagtaaaaaaagcagataggaaaattcggcctattttttgtacttagtatgggtcactagagagatagagagagtgaatggtctttcaataacctcaaactacaatgtgttcaaaaggggaaattggagaggcacatgaacttgaattctgataatagagaaagtgccagagcacccagctctgcacctgcgagtacagaattcttaaaacaaggaaatgcttactcagattcctccaaatatggaacaaaccacttggggaagcaacacattttaactttactggttcttttcaaaataagatcaccaaacttcttgaataggacactaatacaatagacacacaaacaaaaccaaagacaacgaagagactctatgttgatacatgtgtggctacttagtcatgagggttagataactcaggagtctgtaaaaactagactagaaaagaccaggagaggcgtgagggtgggagatggctggtagcttcctaagttcatatgttgtttaagaccaagggtaatgtaaacactatcacacaacaagctttaactttgttaaaagaatcagtgtgaagcattcatcgctttaactaaatttttgtgttaactgttttcattccccgctgcttacctctgggctgagttcctcttttcatgcctgcagatcagagcataattggacctgctctttttccctaaaatattctcaagaacaaaatggcttagcatcccatagagaaaaacattcctgatgtttaattatacttctcagtagatgtagaattgtgggatattaaacctgtttactttttgtttgacaagagatatgtctctattatttttctattatgttcccccttggacactagtcacaacatttttctttgcattctttttctctctgcctttcagatgtttgcctttaggggcactgacaaaaaacattttatttggtggatctgcattagaaatcacttcttttcctgacaagctatttaaaatgtcacttgtgccttgtgaaggcttttagaaaaatacagagacctggacccagatgacccaaactgtgtttctgcaaggattgcaatttccttttgaggattatggttccagggaagattgcttctaaatatctgtgagagaaatactttccagaattattgctgttgtttactctatattgatttttagagtattttacctcacttcatataaaggacaaataataaaatatcatttaattattgtaatattaaatataacagtgtaattatttctcaaacacaagagatcaaagtgtatctcttcaggatgtgctttttgactactgattatcaagtacaacatagccaatttcagttgtttgttctaccaattacacttctctgaagatcaaaaagccggagaataggaattagtgtagctcccctatactaaatatcatccagttatgaaatacaaagctataagagtggtgcttttgaagaaaattgacgtgtgagttaaaatatgcatgttcattgatcacaaatggatgagaaatgtcacccagttattacatagaaaagagctgattgaaaataggtgacctttaccaaacgtgtgtgaacaatttccactgttcattaaagtacaagatatctacatcatccataaggtggatatgatgttggaaatgcattaaacagatttcagtggttactaccatgataagtgttttgaactaatctaattgttactatactttgtgttctctgacatttcatcaaggggacgtagggaagcaaaattcttttcagaatgtcatgaatttaattgcccaagtagaaggaagaagcattggcttatgaataaataactatatttttaatttgaagaagatcactaactattctttttacaaagcatttgggcacataagtgcctgtcactgggaatatagtagtgaatgacacaggcatagaacctgccatcaaagagtttgaagtgtggcattattcaatgatgtaatgagttctgtgattggattataagggacatagagtgtgctatggaaactgatagaagaaacatttgcactccacttgtaggggccaaaaaacacttgtatgaaatgtatcttgagttctgaaggacaatagatctagtcagacaaaaagtcaacttactgtgacagacagcaaacatgaaatctcagacataggaaccaaatgatagcaaccatggctgggtcatagactgcttgagattaggaaaaagcagatatgatgcagcatccaaacctcacattgaaatggatgcagccatattcaccatataaagatgtggaatcaacctaagtttccatatcttaagatatccaagatacggaatcaatccatcacaaaatgactggataaagaaatgtggtgtatatacaaaacggaatactattcacacataaacaagaattaaatcatgtcttttgtggcaacatggatagaactggaggccattatcttacgtgaaataactcagaaacagacaaataccgcatgttctcacttataagtaggcactaaataatgtgtacaaatgaacatagattatgaaatgatacacactgaagactcagagcttgggggatggaaaagtgtgagggaggataaataacttaatgggtacaatgtatattatttgagtgatggatacactaaaatgccagacttcaccctatgcaatatatattgcatataacaaaattgtacttgtaccccttaaatatatacaaaaaaatgggtgtccagtgggggttttaattatgtctttaaaaagcagggaaactacaagagaagccttaacatgggggtaatagggcaagcttgtattcagagatatcaattttctgtcagtatatggcattatcttgtgtagaaaaggaatatggtaacgcggccataaggcaagtgacagatgaaggtgataagaactgtggggaaacaatgatggaaagccaggggagagaaagttagaaggcaggattgaaaggaccacatgttaattggatctgtgggaagtcagaagtgggaaggcaaagatgtttgctggattcctaacttgacacattgggtggattagagtgccacttactgagacggtaaagagagaagacatagaaaaggttttgaggcgagattagggaatgcactgatatctccctccctctgcccctccctccctctcttttcctccctccctccctactttccttccttccttccttcctcccttccttccttccttccttccttccttccttctttcaacatatagttactacctctgtgacagacactgatctaggtgatgagcctgcagcagtaaacaaagcaaggttctcatcttcacagagcttacagtcccattggagcaaccatcagcaggtaagacacagtaaatttgagatgaacaataaggagaaagagatagggtgggtgatattttaggtagaatggtaagagaaaactgaaaaattagtttcagctaatattagcgacaacaagctctgcacaaaagggtcagagtttttgccagagttaacccttagtgttctatctctgaaataaaaagctcagaagttctccttctaagaatgtcagtggtgttaaatttaaatagctcagtttgactttgattatccagcaagagtagaggcaaaaaagtggccttttttgttaggtcgcagtcaggaggtgggaggatgtgaacacttgtccacgtcagtactagcagatatggccatccatattcttcacttttcctgaactctgaaactgaaatacattcattcatctaatcctgcaatacagaacccctgaaaatcacctatggatttataactttgccaaatttatgctcattcaactttatttggttcaaagctctacacgtgaactttcatatattcttggcacagcatttaggtaagtgactttctctcccttcaactccactaaaacttattttctcctatagtatacatatttttgtttttcatgtgtctttttaaattttttaaaatttattttttaattgacacataataattgtgcataattatgggaaagagtgtgatgtttcaacataggtatacgatgtgtaataatcaagttagggcaattagcatatccatcatttcagaaatttatcatttgtttgtggtgagagcattcaaaattttctcttgtagctattttgaaatatatgttatattaactatagtcaccatgctgtgcaatggaatactagaacttatttctcctatctaactgtaactttgaccaatttctttctatacatctttttccctccccccgccacagcctctgctaacctctaatctactctctacttctatgggatcatctttttcagataccgcatttgagtgcaatcatgaggtatttgtcattctgtgtctggcttatttcacttaacatactgtcctccaggctcatccaagttgctacaaattacagaatctcattctattttatggctgaatagtattctactgtgtatatataccacattttccttgtccactcatctgctgatggacacttaggttgatgccatatcttggctgttgtacatagtgctgcaataaatatgggagtgcagacatctctttgacatactgatgttatttcctttggatacagacccagcaatggcattttgggatcatatggtagttctatttttaatattttgagaaaccttcctactcttgcctataatgactgtactagtttacattctcaccaacagcaatatgaattcccttttctccacatccttgccagcacttgttactttttgcttttttgataatagccattctaactgaggtgagatgatatctcactgtgtttgtaatttacattaccctgaagattagtgatgttgagcattttttcatgttcctgttggccattgtatgtcccccttttgagaaattctattcggattgtgggataagaactcaaacacacaggtttagaagcaaaaatagataaatgggattacatcaaaataaaaagattattcatagcaaaggaaacaatccacagcgcaaagagacaacttacagaatgggagaacatatctataaactatgcatctgacaaggggttaatatccagaatctataaggaactcaaacaactcaatcaaatagaaacatagaattcacgtgtttttgttttgttttgtttgtttttttttttttgttttttgtttttttgagacggagtctccctctgtcgcccaggctggcgtgcagtggtgcgatctcagctccgcctcggggttcacgccattctcctgcctcagcctcccgagtagctgggactacaggcacccgtcaccacgcccggttagttttttgtatttttagtagagacgggggtttcaccgtgttagccaggatggtcttgatctcctgacctcatgatccgcccgcctcggcctcccgaagtgctgggattacaggcgtgagccaccgcgcccagcccaattcacatgtatttttttaagtagctgataacatgtatttctatttgaagtagtaaaaaatacaatgtaaaattcagactagagcagcaataaatctagcttgcccttctgaaaattctttaatgagttctcattattcctgggttaaagttcgcacctcttacacaggcatcaatgaagctgctcttttttacacattcaccactccattgtcatgttctatcaaactaatgtggtgctggagggtgtcaggaatgcacccaacatatctctgtgctttagcacatagggtgatttccattaggagctaatggtctctcttttcctgtctgtctaaattcaagctattctttaatttacagataagggaattcctcttggcctctctgtttaagtcaggagctattttttgtgcattgacagcagtctgtacatatgttccatgatggcagaccacaagcattgtgactactcgttctttagttcccctctcccaccatcaggctgagcatattatgcataggaactaggccttgtcaacatgtatccctagcatctagcacagcacctaacacttaagaggtacacaatagttactgagtaaattcaatggacaaatgtcaatgaacaaatatggttgaatcttacacattaagattttataatgtgttaaaacgttaacaacaaaagcaaaagcaattgcctcaattctgatacaacagccacagaaattaatttggaatattcactcaatcttggtcaacaatattttctgaggataaactctgtaacagacactatcttaggtactgagttgcagctttgaataaaagaaacaaaaagcctgccttcatagagctcacattctaataatggggagaggggagaaaaacaataatcaaataaatttaaaagaatatggttgataagattttaaacattacagaagaaaataatagagaagagtaataggaaattataggggcaggtttgtaatttttaatttatattatcacaatgatggtaatataaattatccaaaatttatatctatattaatgaaatatatttccctctattgtttatagattttagcaataagaaagaaatatggcagttgagattagaaagggagaaaagtttaaataaagaagagagatgaaatcaatatccttgcaattcagttttgggagagaagaaagttgaactgacaaataagaaagtcttaaggctacattgctagaataaagagaactgagatgttaccagagaagtcagcattttctgataagttttgaacttcagtatggagttatcttgggcaatgctatatacaaaaacttctagatattgggaagggagactggagaagcaatgaacaccctgtccctcttaattgcaaggaattaaatatgtcagcgatacttacctaaatattttgctttctaagacatccaactattctatgtccaaaatggttatgtagaaatcaacaatagattaaatatacacacaaaattttatattatatattaaatataatatacatatttctcaattttgacctggttcagaatttttcatcaccttcctgagatgggaaaagcttctcaagaaggttgatcaacatctgattcaggtgagctaggcagtgagtctcatcctgtgaaacgtcctccagtagacactagtccacccatggcagccatggggcagagtagggggcagtggtgatatgagagcagcatttctcatcaccagtagcatcaacctctctggcaggttgtcagaaatgcagaatcttgagccacactctaaaacctctaaaaaagatccccagataacttgcgtgcctgttcttaaggtttgagagttgctggtctacagcagcagtgtccaactggggctacataatagagttacctgggaaatttttttttaaatcccaataattaggccacattcttatatattcgtttttgtcagaatcaactgtatatgtctcaaactgtggttcctggtttcttttctacagctgaaagaaatctaccaaagttttgacctactaaacccactaaggtttgacttgtgaaatcagcactccaggaatgagacccaggaatctacttctttatttaagtcacatagcagttgattcctatatgtaccaaaatataaggtgtggcttggaggatgaaaaataatggattccactgcaaaaaaaaaaaaaaaaaaaaaaagagtttctctatgtttattatttgaatcaatatgcaaagtatgcaatggaatacttttgcatatatacactggtagttgataactttgtcaaaatttataattagaggttttaaataccatagaaaaatatggatgaattagtgagtgtgaggaaataaaaatactgagtctctccagagacagacatttagatagttatcttcaagagatttaaaaatattctaccacggtccggcgtattggctcacacctgtaatcccagcactttgggaggcggaggtggatggatcacgaggtcaggagatccagaccatcctggctaacatggtgaaaccctgtctctactaaaaatacaaaaaaaaaaaattagccggtcatggtggcaggcgcctgtagtcccagctactcgggaggctaaggcaggagaatggcgtgaacctgggaggcagagcttgcagtgagctgagattgcgccactgcactccagcctgggcgacagagcaagactgtctcaaaaaaaaaaaaaagaaaaaaaaaagaaaaaaaaattctaccaaatattcattatgctgataataaaaaaatcatgcaagatgaatgtttctcttctaaataagcagtcagcaaactttttctgtgaaagacaaaatagccaatatttttagctttgcaggctctacaatctttttctgttctactattcaactctggctttgtggcttgcaatcagccattgacaagatggaaatgtatagctgtggctgtattccaaccaaactctatttacaaaaacaaatcacgggctatttttctggcccctgtaataccaagttagattgttgactaccagtggtcaaatggaacttctttttcaagacttgttcaattcctttcaatgtacgtaagaaagagtcaaagtaaagaattcagttgctaatttagtcctcatgacaaatagaatggtttctctaaaatggctcctaagttacattcttttaagaaacatccacttcatctgtgtaaatccaacaggacccccaaaaatagtatgccccaaaattcaaaatgtacttatataaacacagtgttatgaaattgttcctggaagttttgcaagatccacgtgttcattgttgctaaggagaaaaaagatctctaatttttgctactttacaggtaaggtgacagctaataataaggttccctatttataataacaactatcattttctgaggacctgagcaattgtggatatatcaattccctcctttatttctcagaacactacaataggataggtactgtgattggctcaattttcaataacatataaacaaagtttagacaccttaactgacttgtccaaggccacagagctagaaaatgccctcagctggatttgaaccaggtggttgaacctagaacacgtacagccactaaacattactgccctatccattgtctaccagaactatgaacatgtaagatactgagttagttgtaatattttcatttgtaagggaaatagatgtgctcaatttgaatggattaacaggactaaaactacagagaaaaatgtgaatgtgaaaaatggggaagtctcaccactgcatggtatgcctggaatacgatacgggatatcaacccaggataacacagtacttcctctgagaagcactcttttcttcttgtgcttagctattagggtaatttagaaaatgtatctgttcttactgacctaaggcaattaacctcttttctttcttttctactggcctcattactgcagcttattcatgatttccacagactgtcctttttacgtttctcaacttcttttcctggccactaactgctgaggctccacatggcatttcaaatttaagataaccaagtcaaatatttgttatttcacacagaacatttttattggcatggttctcctggaaggccacatggtggtcattggccagtctagagagggctgtcttagaccttggcacattcatttctcatcaaatctactgcggccagtagagcctagacacatggttatattttcttggtggaaacacctatgcattgtgaactgttaccattacaagctcttctacaatattgtcctttatagatcatattcattcttttggaatagtaatacaggaggtaatgtgtacatatactttgtgttttctgttattcttatacacaattaggataagccaaccgttttccaacaacctagagaattgaaagtacgctggttggttgttggagattatacacatatatgccttgatcatatttgtagtcattgtggaacctgttatttacagtatctggtacaatgtcatctctttccagatttgggaacatgttggaacacaataaattatcatattttataaccatacaacctaacttctagttaccatcttagcacatccttggatatgacagctaatcatattaaattttccaggtcacctctaatcttataacatccctcccttcttgtcacaggattagatcaaatattaattgaaaaatattaccacaatatcaacatgattagctacactaaacctctgtggacatatgggaaagtttatgtaaagtcagcatagcaaataggctgctgaatatgtaagtctgttttttctgaagtctacttccaacattcaattccaacagttagtttctctaccttttctaatattgtgaatatctttcactattaacgtgagttccccttaacttccttttaatcgcatttcaatacaattaacactgaatttatacctctacattttattttattttatcctgagagtgtgtcaacctctcttggaaagatgtatatgttacaaatactaaatttcagtagagactttgcttacagtagagtgttttttctgtcagtagtaatcagaattagctggaagcaaagacttgcacactaacctctttcagaaactaaaagaacaaagtacatgctggtttccaatactggtggtgatggaatttacaaaatcacttattttgtgtaaacaagagttcacctgttctgaaggtaatatgattactctgtactatcttaaaaatagtcttacaatattcatgagtatcatgtcaagggctggaaacagtcaccatatatgaggtaacaaaaaggtatagtatagagtgtatgagttttaaacacagccagatctgaatttgagttataggttcattactgtgtgcccttggcccagttacatatgctctctcagattccagctttccttctggaaaatgagggcaaataacatccatgttaacatttcaactttcatatgtttttatatttatcatttattcatatataaaaagtttataactcagctatctgagttgaggaagcatgtgagctagattagatactgcctatctctagtgtcttttattgaacatattacttattgaggagcaagttatagaagaacttgaagcaagttttgcaaagttttaaaagattattttatttaaattttgagacttcctactctaagtgaggttatcctatgagatgttttcccatcttacagaagaaataaactaccctcaatcaaatgaaaaatggaattcaatatagattaaggaggcagatgctaagtaaaataaactgttactaattttcagttgaacccaagattttctttatcctcttatcagtatattgcaaattcagacaactatgacaatggtaaaactcctttaagcaattgcatttttaattttttaaattaaatttgtattttaagttcaggggtacgtatggttgtttgttatataagtaaacatgtgtattggggatttgttgttttttgaatgagaactacaattccctcaatttttaaacatagatatttcattagagagtaaacgcaaccttcaatggacgtactctggtcagacacttcagtggtcaatacatccaacaaaaaagttcattgggtctgatgccaccatcaattctgaagttggcacaaggatagagatgttttcagcgacatgcaagttcgctagtagcaagtgtgtgtccctgtttggttaatgttgcctctttctgtttatcaagttgcttaaaaaaaaaaaaataagaagccaaagacccagggacagccactgtagtcaacacattcttctctcaattatctttaattctattgagaaatcatctccccagggaaaagagatagaagtctcagaacaagagaagtagataaaagtcttcaggttttagctacaaacatactggtagccaagtacacatcagcctttgggaaccttgaaaatagtttactcctctggaagaagcactaacatcgacatcagcctgaaaagctctccagagaatttcagaatgatagccaattattagaaagtgttctgacatctttataaaatgtcccatctcaagagatccatagaagaaaagggaagtcagcacttcaggaaatacgagtgctcactctgaaaagcacacttgagataccattataaatctttatacaaaagcagctagatatttacattttgctttaacaatagaaattaattgttaaaaatcaacctgtttcagtattatacgtgatattttaaataatgtttatttcattatttgaaaacttttatgtcatacaatatcaaggtaagtgattgctattcttcagtatttagcctgcagactgatagatcacataattatagtgatataattatttaattactcttaattacataaaaatttatcataatatggagtaaaacaatcaggctatatttacatgcgcttagtaaggtagaaaagaaaaagttcaggtaattaaactttggaaaaaagttgcttacaatacctttctagatatttttaacaagcttacaagaaaatgggtaaaaaagaattaatatggaatggtttaatctgaattacctggataattgccctaaatgatataggaaatgtaagcttcacttcaattcattatatcttaataataaaaatgaaataaaacataaaaaagatttttttacaaacacgtaatctcttattgaagaattctttcaaaaacaagcattttagaaagcacttaattttcctttgctttctttttttattcatgtcataaaagaaatccacttctgttgaataagtactataaattatatgaatggtacaataagtcttctagtttcatttttcttaatacttgcatcagaaactataacatttaagttttaagttccaaatggatactattaaaatattcagggatttagtcctaaatccttaaaccaaaagggagctcaggaatattgctaatgtagaaagctgcacaaaatctcaactcgcatttgcaaattttctttccatctgatttaactttgaagttttcagactcagattttactatatgacatcaacaaatcacttcaatcaaaaccaatttaccttggcaatgcacaaccctccaaatagattattaaaaaggtaaaatgagaaattaactatcttttcatgttcccttttattttctctggatacaaggcagaatgaatgtatttcagaagaaattgccctgagatatcattatctccaacgccgttttcactccaggaaacttgcttataaattaagcttttcctgacacagtcacttgctgcagtgcagaatgtcagtttagtcagttagaactttcaatgcagaaattcagtgccatgcagtcacccggataaagcagcacttaccttaattgaaattttctctgtgaacgaggtgagaaatccgtcaaatcaaccgtgaatggggtggggagatcgaagttttcaatcaacaccctccaagtagctgcatcctgtgctccttttccctgttatgttgagctcctcactgtctaaggagagaaaaacatcagctgaaatcctccgaggttcccagtgagtaaatgaggactaagcgatgtttctgaacgggagattctccgtgagcgtgctccgtttggaggctccctaacactcttggcaggtccctggagccaggcgttaatcattgacctgattagcaagaacgctccgggtgcgcaggcaacacacgccgagggttggtgggtctcccgggaactggaaaaggcaccaaggccacttgggaatcttgtcttttccagcctaatggatgaactacaactatgattatgatttgcaaggagattagctgccgtgctagccatcgcaggacttaaacaaatgtgctttctcctgctgtttttcaaggtgccttcgtgtaagatattaggtacagtgaagcaattaatagactgatagagctgatttgtaagacaagcttaaagctgaaaaatgtttaaagcgatgtgatcaaagagatagctgcacttgtctctgccgctcgcctgctacatacttcaacctttgtcgaactaaaatgaatttaaaggtttattacagccctccagagtgcaactctctgaatttataaaaaggaagtattcatactaaataagcatatttggcagattgctacagacacaagcactcaaaccacggcatgaacacagccttgcttgtgtagttttccaaacggcattttcaattagcattacacttgcaaaaaatgtttgcattgtacccttaaccagagtaatgtaggagaatacagcactacacctaaccgaatcatctctttgattatctgttgaaatactgatttcctaaaacaaaaacaagcaagcatatgagaggatcgaaaatatctaacaactttttaaacgtagctatgtgccgttaccaacctgctggtccccatccgtcatccgctctttctgccactgaccaccttctcagcacttcctcatcaagttcctagttccctgaagagatctaactctctggaaaaggtcacataactgaatgccaaagccccaaatggttaatttttgacagctctcacttttgcaggataaaattatgcaaataacataaaaagaacagatgaaaaaagtaatttgcatgtcttgagggtgagaaaattctcattgccagagagaaagctgacgactgtcctctcacaatgatcctgagtgatatgttcagcacttttgtttttttccagtgggtctcacttgggacatatggcatttctttgatgtgtgtgtgcgtgtgtgtgtgggtgcgtgtgcttgcgtgtgtgtgtgagaaagagagagaggaagagcgagaagctatatttacattgtgatatttatatatatcttagaaaaccctcaaatttcagtaggcgaatgcactaagtataaataatagagaatccgtttgccttatacattcccaaatatatttttaaagtatctcattaaaatacaagctcttggtgaaactttttggacaaagtaaaacttcagggtaactgaattgctgttactaaggcaggtactcatcctactctgaaaacggagacggccctgcagaagccccaggagatggggctgtagcctcccatgcagaggtctcttgctccctcagctggtggagggtgacagccgaatgtgaagaaacccagtcaaccacttcaggagagggagaacaatttttgctgctgtaaagcaggaaacccattatccaattttagattggcatgagagtgttatagtagaaaagaggctgcttacatcgaagtaaatgcaccttgagcataaattgtaaaaataagaaaatgtaactgctaatttctcctgagagggttccaactagtctttaacacaatacttgtaaataacagtgggatagattccagggctctaatgtgtagttggtcatgcaattaaagcactccgtttctcgtattggtctaagtcccattctgaggatcttaaatcgtgaactatttttaaaacttattaaaacgttaagacagggcttattttcctgaaccctgccagccaacccacaatcatcatcaccaactaaaacaggtgcacacgaaactttgtgccatagtagatgggttctatctggaaactccaactccatgagactgccctgatgacatttccaaataaccagcctttctgttctcataaaatccagaggtctttcaaaaccctgaatggtttctatagagagtatgatgactcttcagtagtttttttaacctatgttggaacactaattgattttatgtgaaagtacacacatgaagaacaaagcaaaataagaccattttgttggaggtgtgaggggagaccgtagtcacatgaaaataacaggtactgtctattacatgcttgctatgtagtaagtgactggcatgcacttcagctatagctatccatgaaccccttagtccaattctattaagcagacattataatattttattttttaattaattaagttagggctctgagaagttaagcaaatttaccaatgttgcgtagtcagtacagaagaaacccaccactaaaagtcaggttactgtaactataaaattagcaaatatttggaaattcccaaatgttaaaactgatcaaaacccttacttccaacagaatgggaacattttctagattttatgattaacaaaaatcattttcacatctttaaaaaccattttataactgataaactattgtaacagttctgctattaaaagttatgtatgatttagcagaaaaaaaattcacaaaaaaaactttaggctaaaaaatagattccatccagagcttccaaatatataattccattagcacaaatgactcaatttcaaatttttaaaaatcccttctgcaattcatttgctctcccactcaaatataataattattgcttttttaaaacaagaaaatagctccactctaagtaaacgaatatctcaagaacagccataaaaatatattagaccaaaattatgatgatttttactaacctagttctccaagtggcataatgtaatagcaaagctcaaatgtactagggagctaaagtttatctctgatttgttcatgctttatctacaggtttcttaaaagtcacatgaatcctatcatttcatatggctctttgaaattctcagacacatccataactttacagagaagcattgtgaccacactctttcaagaagtttaatgaaataaatgatgataacgcaaactaatgcaacatttaaactttgccaagaacttattctctcatttgattcttatgggaatcttgtgaaataggttaccataagtatttttctcatatgttagtgatgaggaataaaaagagcaagtgattgtcctttggtgtttgatagtggaaaacctaatgtcttcctttttacgtaagtcctattgctccccactatgtcgaacaaatatgtttatctgagtcatcttgttgtcaaaaaggatcttaagtggctatataaacagaagtcagtctttcttcatttacttaggtttgttccaaacagtgtaaattgtgattgtgatttattgaagaaaaaattactctgagctgacagggaacttgtgatttatgtatactggaatagcaacccttagatttcctacagacttttcctgatcttggctattattatttaaattggggatatatgaagatatttcccaaatattagtcttatgattcttacacaaatagaatcttgcttctgtataccaatgtagattcagctattacctccctaccactgtttgtgatggtttatcagaacagaccttgaaaaattactgttaattattttaaatggatctataaatacatatacataaacaagccacctaactaataacaaattgatcttgcagcagcagcatcaagctaatactatcacacagaggtttgctgaatgctaacagattctcatgtattatacatatttctgcttatgtctaaatcatggaggctgaatgactaaactcaccagccttcaagagaaatttttatttttgattccggtttcacgcacatatactcatgagtttaagataagatgaaattttagaaaaaaaagaaagctaaactggatatcagaaaacttagactatagtcaaaattctagcagtgagtagttttctaaccgaagccatttaaaaagcttctatttaataatttcattggaaaatttgaggaaattaaactatattatctctaggatttcagtcagttatgaaaatgcatctatttgcctaataatttgtgatgttctttctacctaattcagaaataatcaagcaattaagaaggaattattgtctgcaaatacatgttttctcccttctcacacccttccatgccccaaacaacttattttatactataaataacattatagcaaggatgtgttgatttcatagttcgagtaattaaaaaatcagccagaaattattgatgtgaaattgtaaatggagtagattaaaaaattgctaaggtcaggaatattctttaaatgttttaaaataattataacacgtttctttaaaaggtcatggttattttattgcaactagaatggatgttagccatcctctctattgtcctgatcagtaaaattaatgtaaaggtaacttaattaaaatgattgagaattatcttaaaattggagagcatacttaaagaatggacacataatattaacatattttgtgtttttaaaagcacatttccaatttagtagacaattattttaaaataacaaaaaagcagagtgcataattaaaagaaaagaaatggcttttgtagacataattgctttgcattttagacctttcttgttagctctgatttattctattttgtatctttgaggtatgactatgaagttcaagtaaaattagataaataatatgtaaaactttaagaatattaaactcactttctattgaattcactaaaagatactaaaaattagtaatgactagagttatacatataaaacccaaacaaaacacatttttagcaatgattttaaaatgccattaaacaaatggacatataaaataatattaatgaataatattgctcaatagaaaaaaaatgtttatttccttactgagtagataggtttacccttttggagagtcagaaaagcagtggtagggtagagtggaatgtggaaagatctgcaagcactaatgggacaactagtatcaaatgaatttcctgttcactaaaaaattttagatgatgaaaattctgacttagattttcttattaattcataactatttaactatatatttaattatttaacaagttatttctaccactaaatacctattagaatagttaaaatcaaaaagaaaaaaaactctcattacgtcaagtgtcaacaatgatgtgaaaaacctataaccctaaaacactgttcatgggaatataaaaggatgcaatcactctaaaatacattgtggtagttttttaaaaagttaaacgtatgcctatcgtgtgatgcagccatctcgctctgaagtattcactccaaagaaaaaaaagcatatttccattcaaacaactagacacaaatgactgattagtcacaatggctccaaactggggaaaaaaaagtccgtcaacaggtgagtgaataaactgtggtacactcatagaatggaatacttcttggtaattaaaagtaggcaactactagtacacttaacaactggaccacaaaatgattatgctgatataaaacaagccagaaacaaatacattactaatatataattacatttctgtagaattaaaaaatatggaaatttatctgtaatgacagaaaacaggtaactggttggaggtgaatgaagttggaatgagaaattgcagaggtcacaagaaaacccttgggacaatggaaatattcagtgtcttgattatgatggtggcttcacaggtgtatatatgtgtcaaaacccatctaatttgcaagttaaatatgtgcagtttactgtatataaattatacctcaataaagttgcacaaaaccctcacatcttcctcatttcttctttaataaaacagaatcacaattaaatgattaataacagattatgtccataataacaatctatatgcctttaattctgatttctattttctaaagaaaccgcatcgaagatggaataaaatcacctactttatatttctaaccgtttcttaaattgtatacagcatttcccattcaatcatattttaagacaactttaaacttaatgtcctagtatctatccagataatagttcagtaaaattttatatagggaaataaggtgccatttcaaatcaaacaatgatggctgtgaaatgcttaattaccttttgacatacatatatcattgtccatttgttcttagcttctccataatgtgtatggaaatattactctagcctatcttcagcatctatgacaccgcaggtgacaataaattacgagaaattatggggctttctcaacctctaaatgcatttgacaggcatgaagatgaaaataccttctataacatcataaagatcatattgttacagagtggctctaaacggatcttcctcttattatttacttatttacgaaatcaaactttttctttggatttcatggtgactctattaacctctgaataccatatttcattctcctctcagttatactgactgtaatacccagtttcctctcatgtcaacttgctctttttcactctcagcaaaagtcaataatttgctgccacatcataaggaataggtgactgctatctgccttgctgactttatttcccttattaaaataatttaaactctctgcagtaatacagagttttaacatatatcagactgttggtgagcagtctgaaataacacctttactaccttctgtacatcaaatatatagatttcagtttttgtagtaatggtaaaataatggtaaaaatatcagagatttgggtagttcactgcctaggattgcaatgacacaccagcaaagagcaattatgaatccttgggctcgttgcttcacatttgcttgagttttctcagatgaaaaaaggtgataaaatagtatgaaatgaattagtgcagatggagtagtaagattaaatgagttagtagatacacactaagaagataactcacaaatgagctaccagctataattataccagctataatttttagttaaaatgaacaacatataaactatgtatacccccaaataaaactttgtttaaattgtaatgattatgtccaattggatgcaggcttaatgtatatcaccattgtctacatcatgaatccgtaaggatgtttctactaaaaaggtaaaaaatgataccatatgtttttagaaggaatgttaaaaatataataacaaagtgctgatggacatatacagtgctatatctcaggagagcaacattgacatttgtaatacaatggcaagtgtttgtacatgcgtatgtgtgtgtgcatgtacataaattgcataaattgggtgattctacagatgttattgagaaaatattgtgcattgcatcattatttataatagtgagatactgaaaacactaatgcattttattgattagacataaatatgaaagtcccataaatgaatgcatctatcatgttttagaaatatatttttgacatataaattttcacattatttttataaaaaagtagattacatcccaacataagcctgtttatatatacatttttaaaggaagattattcatcatgagaaactaaatttttttttcttgattggcattgttattttggtggttgagtggtcatttcttccttgtttataagaagtgtaagcttgagaaagggataatttttctttaatttatctcttctaattccaatgcttttctgctttgtatatatgtttatatatacaaaggaagaggaggataaaatttagatagctacataaaattgaggtttaaatattgtgaattaaaaagatacctgacttcattcaaggtgcatactgattctctcacagatgaatttcaaatgtcattggtggttgcatgaacagaaatagtgcagtaccaatgccttagggttgactagtgacacgagctatatactcattcccacttcatcctttctatcaaaatgggtacaaaccaagaaaactgattccaatcccagagagaaacaggtcatctactgtgtagagttatggctctgagaagataccttcatcaaatacacacacacacacacagacacacacagacacacacacatatacatattttactactgggcaaagtgcctcccatgcttttgaatgatctgttttttactgttcgatgtatttagagggtctttttattaaagggattgaatctggcattcacgctgggctttgtagtagaaatagacaaaaggattattttattttgtttagcttttaatctgcttattcaaaactttattacaaaatttcaaatacgaaaactagaggaaacagtattaatagacacatatgttcttgtcacccaacttcatcatttagctattcttggccaatgtggttcgtctgtattctctcactttgtccactgaccttcccttagataattttgaagcaggtcctagacattatattattctatctgtaaatgtgtcagtgttgtataaatgataaagataaaaactgatttctttcttcttttttgaaatgtatccacaatatctttatcacatggtgttttattttgctttgactctaagtgacttaatggcactcaccttgagaatttagtcttgtagaatctgctagatttatgaacttgggctgctttcatgctcccgctagtaatataaaatgttgatattattttattgcagaattcacaaggaggttagctggccaataacatcttaaattgattccagcagctgctacccccatcccccatgtcctattgatagtggtcaaaaacaacatctaaagatatattatttattataaagctttaataattgatatgtcactcatttgatcaaaagaaacttcaatagtccccagttgcttattggataaaaatgtaaatttgttgtatataattcaaaattctccttgatctgcctgtaaagtgatttcctacaatttcaaagatgaaagctggtctttttactttaattgttatcagaatataatttttcagtgtctcagtttttatttctgaagcttgcctgacttcttcccaaactccaatatgtgtttaagtacaaggacctatactatttgatggctcttacaatgcttaatgtaagtactggatataaaatagtcacttagtaaatattagctgagcaaatggtataatgccctattgaacaaagtattggctttctataaataacaggtgtttatctgcttcatcattttactattctgtttaaaagcagcacagaaaaaactctttggggaattagatttccagatgcttctgctctgcttaggaatatgaaaagctatcacaatttaccacaccggaactattttcatttagtaaagttctctccaaggagctacaaaccaaggaccatttatctttatctcatggaattatttttcttctctaaagaccacgaattaggttcttgatttctggcagaaaacactagtcagtttgaggtgcctttttatgttgccatattttataatgacaagccaacttttcaatttaattaatgcttttcaatctcactgaatttgtactctttttcacttaaagaatgagttatttttttcttttctaaaattgtcattttattttttatatattctaaactcttatggacatgaaaatatcaaaatcatatattattaataaacatttcttgacaaaattaatatttcataatttatatcttcatttataattaaagcatacaatttattatattaatgacaggacaaacatactttcagttggttgtaggatgatggattgtggtaaaactaagttgctatactctacttttactagctttaattaagaaaaaaattagataattaagaaactcactctaaagcaagatgagttagtaataatttaaatgcataaaaattccaataagaacaagagtaacccttttgtaactaatctgaagtagttctaattattcaagaattattacagtgcaaacttttgtttcatttccaatacttatatttaatatgtttttttttctgatgaacttgaattgcttttaaaggagcaacttgagagaaaaattcaagctgttctgaattgaaggtttacatatcattattaagtggacgtcttagctaagggtctctataaagactgccctcagaatcttttagttcagtgtattttagaagagttagggaaataggctgcttcaaagcaacacatgtgttaaagttctgatgttttggggattaatccttaatgctaagcaggtctgcagtttggtagcaagcatgaatgactcatggacgcaaatgagtcctgaagctgactgaagtcaaggtgtctgtcaagttgctctataatgagagctggcataatctcttgcgcatatagaagacatcaagaaaaaacaggttgatcacagtctaagaaaaagatgtgtttgatttagtctaaaagggtcagccttattaggaatttttgctggtttggttcacagatgatgcaagcctaggaaggggctgcaccattaagtcagtgacctaatcgatgatgggaacattcagtaaaaagattttatggttaagttttacattagacatccccactgttgctgttatgcaagtgagatttacaaaatgcatacaggacttgaggcattcttatgacaggagatctgttctaatctagagtaggattggcccacctaagcctccatgcagttgctcctcagcgttctcagaatattggggagcagattaagtcagaagaaggcagcatcattagtgtaggagaggactgtgaaaagctgctgtacctatgaaagctgggccgcgagacagtatcctggtgataaacaacatggtgcccaacgaatagagcatggtcagggttgagtattatcagggcaattgagccacaaagaaggttaatcccataagaaagacattctagaagaaaccaggcattatcagaaaatgtatcactgtcactgagcaatagaggcagatttccagaagagaggcaggtaggaaataattgggaacacagggatcctgccaacagctactcagcagagcctcaattcttgcacacaagtgagtaattgaaagttttctaggtagagtaaccttaattatcttagggcaactttccgtaaattaagtgttaggaagtgccttatctggaacagaaaaccagcaactcttctagatcctgctctttgaagtcaaaccctacaggcactctgattccataacatgttctttttatactgttatgtacttttcaaagagattttgcacacattatttcctttgagaatggaagtagtacttaaggtgagcaaaatcatattatgtccattttactgacaaattgaggctaacataaattatgatatgaacaaacacaaattctgacctcaggcagaaaagaatcaggtgcatcctgcatgaggtcacttggataataattttaaaaacgataaactgatcccccattgttctgttcttttgttgtagatgttgacaaactttagttttaaagggcaaggtgaaaatgttttagaatttgaggcaaaaaaggcagaattgaggatactatgtaggtacgtatgtagtttttaaaaatgtagccattgaaatatgtaacatctttctttgtgagtcatataaaaacaggcagatagtcatatttgacctatgggccacaatttatcaactctgaactatagcagtactgacttgagtcagttgtcggcaatatcaatttaatttaacagtgattagttgaatagtacatctcttttcctcaattaagttgcattttgtgtataaaaaacttacacgagttttgatttacacataaaaattattataacaaacttaaaatattttattcataaaataacatattatatattaaaaaaagtataaaatattttcccaaaagtgtatctctaaactttatatacattaatgtgtttatttcagttaaaaacctgtcaaatgcaaaccctttcaaaaagaactttctcatgactcacagtaaaattgatttatatttatttttttctccatagctaaaatttgtgggttgaaataatgccataatatatctcatagcttttccaaaaatcgaccaaagccactcagatagctgaaatctttaccataacgattcggttgcaccctctgtctgtgacattcccagacaatgatgactttgtgacaattttattgactatattttcttagaatgatgtagaaaggatgctaacgttataaatatacaatagcatagctcattaacatgtgttttcctcagaaagaattggacctaaatatgtaagctttggaaaaatgttttgtattcagatataaagggagataagtcattttgtgcttcccagttttccaggctttcatagtctccctggataaatgatgaattgaagacaatgtcagcaattattgctaatacaactgaaatgacattaaaaatcacaaaaaatggttagaactttgccacaagctttgaatattttttattttgaaaattttaagacaatcctactgtttttcagagaaacgtttattgatgaaacatttttgtagataaatggataaccttttctttctcctcttatttttactcttctaaattacctagagaaaagaaagtgtctatttggcatgctttggttatgatatgtgaattgcagtgatcttgggaaggcttgaatttagggtccatgtgaaaaacaacagattcaccttaagaatcaggccaaccataaaagttgggcctttttctctgggcaatcccagttaaggcacctatacactcacttgattaaagatttaagaaaactttctggaaaattcccaaagggaaagtgaatcatttataatgttaacattaaatgcacagtggttggcctctaacaataacaacaacaacaacagcagcaacaacaaaaactaaacatctggggatcaggagtataacatgaaacagaatatggaataacaacatcagacatagaatattcatgaccttcagtttggaaaaaagaagctagacgccccctttagctactttcccacagtcttcccttttcttttttttaacatttatgtagaagttcaagagttttcacaactgagtagagcagcatgaaatacaagtgtaaagatatactctgcaagggcggacctctctattctcggtatcctgtctgcgtttgtgggaggcagaatcctaagatgatcccaatgaccctcccccttggatgacagcaaaggaatttttgcagatgtaattaaggttatggttgatcataaatagggagattatcctggtagtcctaatttaatttaatgcaccctataaaaacagtgttttctctagttgggggcagatgagcaagtcaaagatttgaaacaagaggggatgccactggcttaaatatggatggtggggggaagaaccagaaagtaacctggtactatctgagagagactccaagctgacagcaagcaggagaatgtggacctctgagatcttataaccctagaagcttaattctgctgataacctgaataagcttggaagctgattcttcactagagctctgacttcaatattttgatagctcaatcaaagagaaatgtcagataacaaatgggtgtcccattatgccacagagtttgtagtaacgtgttacacagcttaaggaaatgaacaccgtgtccactgtaagacatttgagtttctccagcatgcagaacacattttctttcttgttgtatcacaaatgtttagcatagtatccagcacataatatataaatgtatattggttaattatgtgaatgcaggggatgccacaaagggccttaatctctgtgctttcacggcttagaactggcctctttcttcactttttgttatatgttgcctcaatataatggaatatgttgtctcagtataaacaagaggggatgccacttgaacaaagagtaagatagagtactcccagtttttaagataatattcatagatgatgtttcagcaataccacgtgtattcttattccattttaatttttggcgtgggaaaaattgtacaagttaacacgtctggattcatcaggactagggaaattatgataatatagaaagacttcctaattgcatgacactggatcacggaggaactagacagacacagaatggagttgtccagaagtctgggtgctcttcaatttgtattaatccccatctggtaagtgttctaccataatgaaggagacaaaatatatataacgaaggaagtggaagggggtcactagatactcagagatcccaagggtattgaatcagataaatcagttttcacagataaataaagtcccacataagttgtcttttaagatagaaacatgtcaataattactcaattttgaacacttggcaaataatttggccaataatttgtttgattttttcagggctttccccagtatttcttaaggttgattaattcacaaattacttatagtgggaactttgaagagctgctacacttgaaaccttagctagtataatttagatcccttgagaaaattatcttgcatgagaaacagggcatctcagtgcaacagaccttctctacaattatttataatatattctctttcatatgttcaaaacactgggaaacttcaaagatattaaaacaaaacctgtggaaagtgtgtgattctctagtcctccagttgcctgcattcacttcccaaccttaacacttcagtggccataatggcgccaggaggctgtgtctgaaacaagaatcccttcctcatttggaaacagagtaattccaatgtggcgacatggcacacttggaaatgttttcgtatgtaatgtgaatgctttcggattgtcttagatcaggatggagctcacgttcatcacaattccacacctgtcactttttccataggcagtgcagatttagacagtgctgggatttactcaagtttcagctttgctatttaataactgcaaacttgggataagtgatttcacttctccaaatgtaagttttaaaatttgtaaaatgaggatatatcagtaactacatttagaatatttatgaagacaaaatgagctaatttcagtaaggcattcaagatcgtactattaacacttagttattaataatggtaccgattatttactaatattattaataatatagctttactaattagcaatattattataaaacatagatgcaaatacaaaatatttgaaaaagacattggccaaatataacaccgtagcagcatatggtatgttcatatgccacctaccacaaatttcagaccatggtgtgtgtataagtgttacttttcccctgctatttaataagactatgaagctttgcataatttttttgtaactatgttaacatttagtagtggataaaatatgtttctaatgaaaaacttcagattacccctctgtatataaatgttttccttttcagttctgacaaaaatatgtaaatagataaagaactcatgttttataaaagaatactataaatcatttacttttctgacatctgatagtcaagaaaggaattcagcttgataccaagtagtatgtatttttctcatgagactgaggaattctgttctgctctcattaatgaaaacacgagcatgattctaattagcctgaatgtgccctggaaaagcataaatcccttaatcagatatgagagaggaaggctggtcaccacctctaaatgccaaatttattatgttctaaaaaaaatttattctttcttctaattaaaattatagcctccataatgaacataacataattaaagataaaataaattaatcaaagaagcactttttgtttcactacattaaaaacctattctaatagttatattaataaacctgctcttacatctcctcggaaggtgttgttaataattacaggtactataattgttcaagtgagtagatatcctcccttcaagtgactatatctccaaccaaagccactaaaatactttgaagaatttcacactgtcaaattcttagtagcaattatcccaacatgcactcccagtaaatttacaaatcctttttctttttttttttttagtatattccactgtcagtgtgaggaaatttctcctttttagtaatggtacttaagcttgctaccaaaatcatttatattatgatgcctttcattatcattcttttggagtagagatggatacttatacccattcttctatttaatcatcttaatatcacttctaaaatcaagtacatatgcaatttactttattttttctgccttttacaaaaaaaaaatgactagacattaagaataacataggatttggggccttgttactccagcctgggcgacagagcaagactccgtctcaaaaaaaaaaaaaaaaagattttgagccttgctggcataatgctgaaaaggcacaaaagtaaattcaaatcatggaaattagatgaatgcttcaggtagattgccaatcattcggttatttggtaaaagattatgtattgtaatgatgtttatgacatcaggaaagtaacttccccttaacctgtaaactttcgagtacttttctccaaatgattctaggccatcattttttgattctttaggaactttgatttacctcaaatttcatgcccacatctcaaatgcgtgtccttgtagggtataccatgttccatctgcagtttctcctgcactccggatactctgtatttaatgtgctttgagtcaataatcccagagtcttgaagccagagtaggtgaccttttctaattgatacacacacacacacacacacagggtagacacttacacattactttatgtaataaagtacttgttactttttttatctttccaggtgacactgtgaagattattaaatcagtgaaaaatgacgtctattaataaatagtgagagtaggactacgctgctataaagaaatactgatttaggaaaattgatttgagacaattatttggcaatttaaaaatgtaaaaatacatagttcaacagcatataggtgttttgtatgaaaagctcaatttgttagtaagtgtatgcaaacaaccctacatctgcccactccccaacatattcaccaaaaaaagaaaaattgaaaggagacaaactactactttttattccgcacgttttaaggacaaaaggaaaattactgacaagctgggaaaggaagcttatttatgactactttccagtaccacacaatacataatatcattatttttctggtatccttagtgttacataagaactgggtagattgccctgttcatattctcaccactgccattcacaacaaaatgtcttcatgtcaaacgagtctttgttttgtttgcaatttattgtcaaaaaaagagatgtcataattttttttttttttttttgacagagtctctctctgttgcccaggctggagtgcagtggcatgatcttgactcacggcaacctccacctcccggtttaagcgattctcctgccccagcctcccgagtagttgggactacaggtgcacgccaccatgcccagctaatttttgtatttttaatagagacggggtttcactgtgttggccagaatggtgtcgacctcttgacctcatgatctgcctgccttgacctcccaaagtgctgggattacagttgtgagccaccttgcccagcccataattctttaatctccaagatgatgcatggaggaagaagttacaaagcatttgcccatctcctctacttcctccaccctattgtaagaaaagggtataattctaacttattatgtttatcaggcctacgaatgatgaagatgaaggaatagcagatagtaagtcacactaacatggtcacattagggtgttattttaccgttttcaaatcacaatgccatattcttgtgacttaaattgcaatgtgcacagaatatggagaaataggactatattcttatgccaatgattctgatgacactggcaattgtattaaaaaatagaacctattttatgacaatcatgaaactttaatcttcagttcctctttacattctattttaatgtgtatttgtgttatatcagtatgcaacagagttatctaaaatttaacaataaagagaaaaattcccagtttacaatagggattataacttataaattagacaaaggattttgaattaaaccacatatattggctcaaatttattcccacctctgtggagtgagatattattaagcacagattacagagaatttatgaagaataactatggttttcttaattattttaatgattatttccttctttctaatttaatgggtattcaacacactgttcattaggggattttatgtttaatactactaataaaattaaatgaaaaagatatatggtaccattaaagtagcaagtaaaaaaaatgctagtgccaaaataactctttatttagtaggtaccaagagatacaaatgaaaatcatatttcatgaggtaactcttctattgaaaactattaaactatgaggcatatttatctcttcctccctgtagaggtataaacacaaagcatgtttctaaatcataaattatactcttcatgggatattaaaaatgacctccaaataaacagaacacaaaaactgcaagaattccaaagctttaccatatatgaaaacaaaacttttatctcaactgctcaaattgcaatgataaaatcaaccatcattatgaatgaattatctatataaaaatctaagtaattactaaataaaatcttatttcatagaaagttatgtatgaaatgcaataaagaatttacattgtgcatgaagaaacagacacatttcttggagaagaaagagcataaacaagaatacaactattttcgaagatattttatacattgcctaaaatattaatgaaggtttttttatagtagccacttaaatataatctataagcattagtcatttacattcttaaggatcacagaaatatgctgttttatcacatttcatatataagtttctattaaataactaaaaggaaaatttactattttattttctatttgttattcgtgtgcttagtttgtatttaatcttaataaatatataaaaacaattttcttggatttggaaacaatagaaaacccctcctaaaaattttaaacgttttcctaagaacgatatgtaacaatatgatttttttaaaagctgttttgaagtatttcttagatgagcttgaaagtaattttgagttgtaaaaccatgtgagtattatgccttctaaaaataatgttaaaataaaaattttcagaactaagtgataaaaagtatttagtacatttactttaaatgattgtatttcttactaataactgcataattaacacagaatcattgcatctagcaacgatctttgggatgacatcaatggtgtcaaaagagtagttattaagaaaatatcacaaatctttaattctgactgttcaatgaaatgatttggtattgaaatatggtactagacaagattattttaatttccagaagattctaacacactgaaaaaaaatacttcatcatcatagttgagaagaaagcttctctctctttctctctgtgtctaacttttagcacttataagcagtttttaataatgatgaaatttaactttcaaaactttttcttttattcattctctctaagaaatgtactctttgtcccaagttgctaaagttttctcctgttctcatttaaatatatatatatttatatatatattttttctttattatatattttctatatatattttttctctctcattggattgcttttgtgcctttgtagagaatcgaataaccatataattgtcggtctatgtctgggcttggtgtgctagtcttttgatatatttgtatgtcttcactcaaacactatactgtcttgattattatagctttacctttactattactttgctattttaaaagattacttttaatgattttaaaggttattatcaacattctaaagcctttggatttccacacacatttgcaaatccacttgtcaattcataaacgtaattctgctggaactataatcagaattgcgttgatctatagatcaatttagtaagaatggacatattaacaatattgagtttttccaaaataaactgatcatagatacatagacaagcaaaaaaaatatatatatatagttaaatttctactataagtagtatccgtataattctgtatgtgactattttatatgagatttaggtaccatggaggatggctaaaaggaaatcttgctcatgtaaaaggccctgaatgtttcaaacaaagtctaacttattggtttgctcctttgtccagtaaactggaagcatcatctcaagctcacagtttactaataaaaatgtcatcagtaagtcaatgttactgcttctttactgtttgatataaaaataaaacaatattaatgtgagtgatcaaacaccaaatgtcatttcttcagagtcagaatggtgttttatagagagattctcctaaggtacagtatttttgaacaacaggaacagcagcattttatcagtgctatggctatatttttgatagtgaatgatataaagttggacaaaggaaactagataaggcctataaattccaagacaacacacagaaatgtgacttgtattttacagaagtttagttggcactaaattggttgacacttttatgtcccatagtcacagtttgcccaccttgacgtgccacccaagtgacaggattccactaatagaaataatgatcaatgcatagtcccaatagtgcaatttattattaacttattattatgatcaatttgaattagtttatataaaacaaagggcttatgtgtacattttcaaagtctgacatggaaaaattatgaaggaagtaaaaaatactatgacagttttgaattttcctctttttaaaaaaataaatctataggctttcaaactcatttgtctgcaaatatctttttaaatatcactttttgaatatctagttaaataatgcttacaacatagtaaacataaaaatgaaacaataaaacaaaacatacagagggagttatacctatactgcctgatatggtttggctgtgtccccacccaaatctcaacctgaattgagctcccagaattcccacgtgttgtgggaaggacctggaaaggggggcgtaattgaatcatgggggccagtctttcctgtggtactctcatgactgtgaacaagtctcacaagatctgatggttgtatcagggatttctgcttttgtttctttcttattttctcctactgctgccatgtcaaaagtgcctttcacctcccactatgattctgaggcctccccagccatgtggacctgtaagtccaattaaacatctttttcttctcagtcttgggtatgtggggttttttttgttttgcttttttttttttcagcagcatgaaaatgcactaatacactgccttagagctatatctatccatatatctattttctatgtatatatctttatatgtgaatgtgcatatatatatttatgtatgtatgtgtgtgtagatatttatctgtctatccatctctccatttacgtttatctatattttgcttttctaagaaattcactaaactcagatgcccataaaacacacaaatgtcaatataaaacagaaaatcataaattaaaaatacaaacaacttagaatacaataatttccttccatttgaaagacagatggacttttttttttactaaacaaatgtttgtacaaaccaacaaagtcccacaattcaattaaaaacctgatacaagaattatacagttagttcatggtgtgtgagtgaggcacatccaaaatagcttacaagcatatgaaataatgtttgactatcgtaaagaaataatatcttattatttacacatacttgaattttatatcatcatcttgtttatatgctgtgtgatttgatttcacttgtctcctgacacttgaaacctcacttataaattgtgaaggacaaataaatgtaagcatgtatactaggtcgaaatatatcagtacaatgtggaatatcatgtgataatatatacagtacacagaaacagattgataacatcagttaaaaaaacaaattatacggccagacaccgtggctcacgtctctattacagcactttgggaggccaaggctgggggatcactagaggtcaggaattcaagaccatcctggccaacatggtgaaaccctgtctctaccaaaactataaaaaattaggcaggcgtggtgtgggcacctgtagtcccagatattcgggaggctgagcaggaagaatcgcttgaacttgggagatggaagttgtagtgagctgaaattgtgccactgcactccagcctgggtgacagagagagactgtttcaaaaaaaaaaaaatcagaaaaccaaaacaaaacaaattatcttatataatattccttcagataaacttctctagtaaacattaattttgatattatctttcttattttagaatactacactagactaaataacagcaggtctaaagaacatatggaaataatataaaagagtagcagaaagaaaaataaggaaaagttcatacagtcctgcctcacttaacactagggatatgttctgagaacttcatcgttaggcaatttcttcattgggtgaacatcacagtgtgcaccacagaaacctagacggtgtagcatactacacacctgggctatatggtgtactctattgcttctaggttacagacacgagcagcatattgctgtacagaataatgtaggcaattgtaacacaatgacaagtatttgtgtatccaaacatatctaaatacaaaaaggtaccgtaaaaatgcagtagaaaagattaaaaatggcatacctgtctgcggcacttattatgactggggcttgtagaactgaaatttgccctgtgtgagtagtgtgtgagcagcgaatgaatatgaaggcctaggccattacacatggacttcataaacaacgtacatttaggctatactaaatgtatactaaatattcttcttctttaaccttagcttactgtaacatttttactttataaactttttcattttttgaactgtttgactcttttgcaataacacttagcttaaaacacaaacacatacagctgtacaagaatattttatgtccttattctattatctttttctatttttcaagtttttcattttattttaaacttttgaaactttttattaagaactaaaacacaaggccaggcacggtggctcacacctgtaatcccggcactttgggaggccgaggtgggcagatcacttaaggtcaggagtttaagaccagcctggccaacatggtgaaactccatctctactaaaaatacaaaaaacacacacaaaaaattagctggacattctagcgcaggcctgtattcccaactacttgggaggctgaggcaggagaattgcttgaacccgcgaggcagaggttgcagtgagcgagatggtgccactgcacgccactctgggctatggagtgagactctgtctcaaaaataaaacaaaacaaaaagaactgagacacaaacattaacctaaaccttcaccagatcaggataatcaatttcaccacctttcacctccacatcttggtccactggaaggtcttcaggggcagtaatatgcatggagccattgtctcctataataacaaaaccttcttctggaatacctcctgaaggccctgcttgaggctgttttatggctctttttttttaataatagaaggaatacatgctaaaataacaataaaaagtatagtatagtaaatatataaaccagtagcatagtcatttattatccttattaagtattacgtactgtatataattgtacgtgcaacacttttataggactggcatcacagttagtttgtttacaccagcagcaccgcaaacaggtgagtcatgtgcacactacaacattcgaatttttcagttccattatgattttgtgggaccactgatgtcgatgtggtctgtcattaactgcaatgttgttatgtggtgcatgacagtattgcctttgaggaaaattctggctatctgatttttcaagtaatctgcccaaactattcctcattttcacttaagtttgtgttttggtctgagtgtttgtgtacccccaaattcatacgttaaaatcctaatcctcaaggtgatggcctttacaggttgggcctttgggaggtaattaaatcatgagggcagacaaatgtgatgtgtccttattacaaaggctccagaggactgccttaccattcctccttgtaaggacatggaaagagagtgccatctatgagaaatgggcccttattagactgaatttgccagtgcccagcctccagaactaggagaaataaaggtttgttgtttataagttatccagtttatggtacttttgttatagcatcttgagctgactaagacagtttgtcttgtgaaaatttaagagagaaacaacttatgaaacattgtatccatgaggtgcatataaattttagacagaaatcactctggaacagaagatgaggaagccatatgctgagcgtaccacttcatagcaccacgaggccttgttaatatacatacattttttaatggattctaatgtattttcctccatatgatggcaaatggtctataaaattgttcttcttaattcttgtatttgtagtgtagacacagctaaaattacctccaagttatggctaatataatttctaagcgattgaccttctcttctcactggcacgttttgtatatttgaatctaattgaactaaacataacagaaaattcaggcatggagccagcatctttcttgattgaccctgttctgaatgccaactcctgaaggagcttcaagaacagaccaaccctccaggcagtgtttaaaatagattctgctcctaagcagcacagcacagctatacacctgctataacggagaagagcttctccaagatgttacatgtgtttaacagtaggcaaacattgccatttatcacctctatggcatttcctggtggggcttgtgtaatacactgagttttcttggaggaaccagctggagtattggtcaatctatcttttttcagtgcttgataagaattcaaatggataattcaaatggataagaactcaaatggataatgaacaatcttgtagttttacctaccatttttacaattatcactgtaaagaaagtctataagattgcctttgagctctgaaaggaagcctgtaatctaaagcaagtaaagttgtggaagaccttactatgagagcaagtctaaaaatggggcagatcatggaaagaaaagaaaaagcaatggaatgattttttccttgtcagtgctgaggtcaggcaggtaataaaaactgttttatccaacatgtgttgagaatacttttgcaaatgttaaagtcaacatggctataacaagcccaagttctccaggaggaatgcatgcatttaaaatggaatcaaaatttatagagtacaataataagagccctcttacttacattttcatttaatcacatgtatatggccatcttgtccattttgaggttgggctttagggaaagctccaaataatgagtaggcttaagtatcaaataatgtccaaccttttagactttaaagaagattctgaatacatttcttctcagtataactacatattaaatctagacgttagggaaagaaacacatttttctcctgggatctctttagagagtatcattcagtgaaatgttaaatgacatataagaatttctagtaataaatatgatggttttgtctcagcctggttataagaaagatgcacattaattatgaaaattagtaaagctgttgacccttccttgggctgatgactgcatagttctgaaatgcatctctatccctagaaaggaaaggaatgcttacttctatagcttactctctgtttcagaagcattgagatttcctctggaaactccagggaaatttccccagaaattctaattgactgaaattgagcataagcctattcaagaaccaatggttctccaggaaatataattactgtgagacaaattaatttgagagatatgtattgataagcatccactgaggcatggagccctgtggggaagcaaagattattcaataacatcagaattctgttaaaaaaaaaagggagacttgatgctaagcagtatcttcacacgtctgctacactaagatttaaatgttaaaatacatgaaaattaaaattatgattgaaagattcactgcattttaggagaaaaatacatagtgagatgtaacactaaatagaggataggtggatagattagacaaatagatggatagagagacattttatggctctcatggttatagggaattgtcgtttaacggtgttgaggaaattaaactgtaaaagaaacatactatttcaggtggcaacagtgaagtgccagcatgattatacttccaaattactatatcaagtagtgaactaatctattattagagggtgttgagctagttggtataagataaacagagtaacagaaaagaataacacttttttcctttttattaacctttttatttcctttttgctttaacggaaaactaaggattaatgtgagtaaatatgaaggtagctccctctacaatattttctgcagcatatcaaaacatctttcccggtacttcttcttataatcactatattctcttccttagtataaaatattgtagcatgtgcctaagaatttgttacaaattacttcccctcattttatagatagttatatgtgcatttcaagataattcattttctcatagaaattcagacatcattttgaaatctcttagctccagagttagcagtatccattctttttgcaatacttagatgcttatgaaaatgataaatgctaatacttatatagttatttgtaaaactgagatattgatcatcttcattcttctatttagacaactgaattatgactgtttcgaccaatactgctttcatatcacaaagtgaacatgaaaaagataatgtagtgtaactactctcatgtccttatgttttaatatgagtacaaatgaaatactaaaggtcaccaggcatgcgagaaaggaggtaattctaaacctgaaagccataaactaacaaacacacaaaaaagtttccacaagattgctgaagaatgtaagcaaaatttgaatcatttttgggaagaggacgggcaaaagaatactttgaaagtaattttatttacttatttagagacagaatctcgttccttcgcctaggctggactgcaatggtgcgatctcggctcactgcaacctctgcctcccagcttcaactgattctccagcctcagcttcctgagtagctgggattacaggcgcctgccaccatgccgggctaatttttgtatttttagtagagatagggtttcaccatgttgaccaggctggtctcaaactcctaacctcaggtgatccgccctcctcagcctcccaaagtgctgggattacaggcgtgagccaccgccgcacctggccggatagtaattatttttaacaatttgagagcagttatttttcacaaagaaaagttataattaacatagaagaaaaagcagaagacagaggagaaaagtaaagtacagaggaagaggagaagggcaaggaaggaggaggaggagaagagaaagaatggaggagaggaacagctagagaatggaaacagaacacaatagaatacacagaacagataagcattttgatgtggtaaggacgcatattgcttcaagtgtttaaaaaatgcacacataaagtaaaatctatttcttattataggctgtgatcacaatatttagaaaacttctgttctaaaaggttgataatatgtatttattataaatactatttattttttaatatttatgacatataaatacactttttttcccacaaaggccataacgtattttcaaaaccaaactctaatttactatttaataaaataaccttactatactttatcagaacttcaaattcagatatatgactacgttaaacttccgtcaatattgtctacatacagaattaatagctaaactaaaacttgtgaccaaaacagttctatgaagatatggtgtcaatcaaacatgtttaaattgtttttttattcttgaattagattacacaaatatttctcagattttttatagtctatagtttgtaattattatttttaaaaagaaaaaatagtgtttttgaagtgtattttacgtaattcttatattttctgtactatttcatacagtttgttaagctaaaactaaatcttagtggaagaataaagacctacttgaaattccttggtataggaacaattacaagatctactatcaaaacaaataactccagcttcctgaccatgatggctatgagtactaattaaaatattattgataaatatatacacatatactttataaattgtttgaattaattccaaccaaatttattttatttaaattataataagaacaaataatagaatttttgcttaaggtgtgaaattaatttcttgaagtaatatctggaatttccccatttgtttttgaaggtcattataaatttgcataatatttaaatcatatatggaaaggtttgactataattactactatcatttatggagacagatatggtaataaggtcttcagccaatatttctttatttgttaaaacaattattctaaactgttaataatctataaaagtaacaacactgaccttcattctacgttttatttgtattcacttgaactaactcagaagtcatacctccagtcagaaagtgaatattttcttatatttgcactaaatattaatcaggaaaaatgagttaaagagcatatagtgggtgctcaaatatgaataataataacatttttcaagcttttactaagatatttaccactggatgtttaaaccattttgcctaattatacctggattctcagatacagatatgaatgcgtttgttaattttaaaatgacacttctatatttttcgtttttttcatttgagaccattctattaattataactcctcattttagctaggagcaggaataataaatttcagataccttgcattctgatcatttaacttaacatagccttgccaaaagaacagaaaatgatgtccatattctaatctcccatctctaaatccacttttccatagtctgtactggaatgttaggaccagaaatcactggtggacctcaatttttgactcctttcccagctggctttctagcagaagattggaagcactggggggcttaggatggtggtaaaagaggataatagaatgtctttttaatttttcttctagcagaggcattatcctttgaaagcgataggtggctctggcctcccgctcctcttggatccatcagtactagccttaagctattgtgccctctcaaagactcaagccacatccaagcaatactccttccagagatggctgattactaactctgcaggaccattcaactgagctactagatttgataaagtcaacttcttttctctccagttttgtttcgtgttgtagatgctttccgcttcaggtattggtctgatttattccccatccccgcttttttttaatgtttagtacttataatcctctatattacatgacctctgttgatagatctacttgtctttgttaaacttgtatttcctgactgggccttgactgaagctttccaaaatcctcccctttcaaagattaattgttgaactttctaaacagtatactcataagagtattttgaattaggtggactgatatggaaccatgaatagctaagaaatgaaaatgtaagtttagtgaatgtcctagttatcataaagtttttagagctatttacataatgaatatttcaatggaaaaaaaatccagtttgttgaagaaaagttactcaacaagtaacagaatattatgtaaatggcgttacccacatttgctaacctaactaaacaaataaatgttaagaataagggaagagattaagagtaaatataatttttgatatttattttatcataagttaggtgcatgtgaaagagaaatcaaacttaaggaaaaggagggatatgggaaaaagaaaagaaaggggaaaggtagagagagaaaaaagacacagaagaaaggaaataaacaaaaaaaggtatgcggaaacttgaagactagattattttagaaaacccaatgtaatttcatagtggaaatagaatcacctgcaaatagcaaattagatgctttggaaactattaatctcacatttaacatcagatgatatttttgacaaatggtaaagtgcatgaggatgaagcatagtacggtaataaaatgcaagtttgattaacatttttttgaggaacgaaatcctgacactcacaatgtgtaatcttggaaaaattatttaatgcctcagagtctcagtgtcctaacctgtacaatagaagatagtcattctcagcttccaatatttaagttcatacaagaacgaacacatatttatcaagaaccagtcacatgtgagcagcaaaacctattattatatttcaaaaatgacttctaaattttaattattttaaaagggataaattaaattgggatcttaaagagtcttgtgttagtcactttgacatcaacaaattgagttccttttctgtactattcactttccaaggatctaggaataaagcagagatcaaaaaaggcaaaaaaaaatgcatccctaatctcatgaaacatatactttagtgggaagagacaattaatatgtatatacaatatctgatggtgctaacaaaccatagaaaataatctatagcaggccaggtgcagtggctcacgcctgtaatcccaacactttgggaggccaaggtgggtggatcacctgagttcaggagttcgagcccagtctgactaacatggtgaaaccctttctctcataaaaatacaaaaattagcctagctgggtgtggtggtgtgcacctgtagtcccagctactagggaggatgaggcacaataatcgcttgaacccaggaggcggaggttgcagtgagccaggattgcaccacttcactccagggtggatgacagaacaagactctgcctcaaaaaaaaaaaaaaaaaaaaaaaaaaaaaaaaaaaaaaagaagaagaagaagaagaagaagaaagagagaaagagagagtaagtaagagaaagaaaggaaagacagagagagaaaggaaggagggagggaaggaagggagggagggaggggagagagaaagagagaggaaagaaagaaagagaaggaaagaaggaaagaaaagaaaaagaaagagaaagagagagagaaagaaaaagaaagaaagaaaagaaagaaagaaagaaagaaagaaagaaagaaagaaagaaagaaagaaagaaagaaagaaaaattcaaagtaggagtggggagctagagagagaggaagagagaggttgtgtgctaatttatttagggtgctcaggaaactccctctataggtaatatttgagtatagacccagcagaagtgagggacaaactacgcaggtatctagaaaagagcattcctggaggagggaagagtcagtgaagggaccttgaagcagggcccgctgatatggtggaggcgcagcagccagggcactgcggcagagcacgcacgaggggaggtgctaggaaaagatgcctgaaacccagcaggagcaatttctatgtagggccttattgattatagtttggatttgaaattttatttttagagagctaaaaagccattcgagtgtttgaaaagacgaagggggatgtgctgtggtttaaaatcgggctactgaaaaattatgaacatttaggatctagaataaaagctggatggctttgggagaacatttttcaaataaaagatgaagatggctttgagcagcatcaacctgcaggtgttataaaatttggattccaggtctatttttgaggaagtctatagaacctcaggatggaacaacaggaggaggaacaataggaacttcaacactatgaaatgaaatttgcaaaattataacatttaaaaatataatcttggtattgatttgatagtaagcgatagatgctaaatatagcagagatagggtggaatcaaagatacaaatgatagggcacagtttgtacaaggacgagagtttaaaaaaattaataccttgaatgtaagaactacagacttaaatatatatgtgatatacataaatctgtagttcatatatatatatgatatacatatatcatatatatttaaatctgtagttcatacatatatatataatctgagattggaggaagtctttcattttggggaaaatccagtgagatctattccaagcctcagttacacatatgcattaacaagtgcaagtgcatatgtgtgtggactttagataaatagtagctccacaccagagaaattgcccagctttattaccctcttattcatataatttaaattcattgtttttgaataagaatggtagaaagatttatgacctagaacactcatgatgaatatgcaacttccctctggtgccagagagggagatcaatggaataactatgtaacaagtggtggcattataatagtggtattggttgaactagaaggtttatcctgatgttccttttcacatacaaattctacactaaccatttagattactaactaacttacaacaaaattatacagtggatattttatattttgaataagcattacatttttgaaatccaattgactaggtctgtcattttaattcagtgttaattaatttaagtaaaaatggctgttaatgacaatctgtgtaaggcactggagaaaacacatttatcaggaagacatagtaccagtcttagtaattttacattctaaagtactgtattcaatgtttcacgtaaagataatatcaagctctaatattaggtcatctggataacatataagtcacaaaaatttcaaatatcttagaaccaaaaatttcttagaaactaattatttctaacatgtaggctttgaaatttcagctttattctactgacttaagtttcacatttctgaagaaaatgataatacatttaaaatgcagtataattttagtccccaggcattattacacaaacaaaatgcttaaatcattttggctcaatcttgaaaaagaaaacaaagaaattctaaagattcaacatttagttcttatttaaatcaagttctacattttggctaattacgtaattccttagcaagtgattctcaacagggcttcacaaaatgtaagacttttcacaaaatgtaaaacttttacaacacattctctcaataaggacctatgatggcaggttttcaaatgaaagtatttcaagatgtagttacttttatctagttgttagaattttttttaaggtataagactgtatttgggtcaacttatctattcttaagcctttagatactcatgaatgagtcaaattttcaattaacaaagttggcattgtttgaagaaacaaaaggataacgtttcatattctaaagcatttaataaagttattaagctctataacttcataatatcaatcacctcacttatgtaaatacaaattctggactaaaattgtgttttaagatatgttttggattactcacacttaggtacctaaaacttaaacattttaatcctaaacggacctttgatatcagtttagaagatgcctaggaaagcaattaggcccagaaagtgtacatgacttatttaaaaacatttactggctagtgtcagaaacatcacatacacttattagggttagcaaatatccagtaaatacacagttacttccccttctcttctcatgcaatcattaattcagcgttgctccaacgtcaatgaagcctagtaaagcttcatcatgcttcacgtcagactacactgagctaccacatttacatgggattaaagaaaactatttggggctggacccagtggctcatgcctataatcccagcactttgggaaactgaggtgggtggatcacgaggtcaggagttcgagaccagcctaggcaatatggtaaaaaaccatctctactaaaaatacaaaaattaactgggcatggtggcgcgtgcctgtagtcccagctgcaggagaggctgaggcaggagaatcgcttgaacctgggagacagaggctgcagtgagctgagatcacatcactgcactccagcctgggcgacagagtgagactccgtcaaaaaaaaagaaaagaaaagaaaagtatttggtaactttgagttatagcttttctccatattcataagtactgtgacataaaaaattctatatgtcttttagtgtctagtgcactattttattatagaaatgaatagttataaggagcaaaagtcacatgtaaacatatccagttctaaacaaatgcacagaggtatgtggccagacatatgctcaaaccttaaacaaacaaatcttccatgggtccataaaaaattcaatatatttacaagaagtcccaaaagcttaaacttaggatcctaccttttgtaaggcaggccgttttattatcaagaatatctcggccaggtacagtggctcacgcctgtaatccaagcactttgggaggccgaggtttgtggatcacctgaggttaggagttcgaaaccagcctggccaacatggtggtaaaatcccgtctctactaataatacaaaaattagctgggcgtggtagtgcatgcctgtaatcccagctacttgggaggctgaagcaggagaattgcttaacccaggaggcggaggttgcagtgagcccagattgcaccattgcgctatagcctggatgacaagaatttaaactccatctcaaaataataataataatagtaataataataacaaatcacattttcccattttggattatttttaattattaatattttacactataagtatcaagagattctcaggagtattttcagaatccttgaacaatttcaggggatatttcaaatcaaagaaaaaataatgtgtctgcaacatctgtactcctttcttgtcttacacaaagggtatttgtgcataaatacatgctaaaaatatgtttacttgattgagtggacatgatcactctggataccacactttggactaatccaatgaatgaaatacaaaatgaaaataaaaagagaaatgtaagatacaggaacagaatccttattttgaaatcacagtttcgttgtatttgctgataaaacctatccaatagtatcaataggttctttcacattctccaagtttcatagctgtacattaactgtggctaaatttaaaattattgtagactccagatttggaattgtactctctcacttatcatataagtaactaaaccatattctaaaatataatattttctttaatcatttatattacaaataaatataaaaatattcagaacaaaaatgtcatgttatacacaaatctaacctctactcgacaatttatacaatatatacaattctactccacaatttattttttctttcttctaccttttaccgttctgtaaatacagtataaaataaaaatttgggatttatatgtaatgataaatctatatgctctttgcaatttttctgtgaataccccccaaaatactatactataatacaaatgtgattacacaccaatatcccttttaatgagaaaaaaatgacaaaagtatcactggaccatagtgtcaattaattttaaattcatagaacagctgtgaatgttagagccatagggttcttccctggacccctgtgaattatctgtcaaggttaaaggaagcataacaatttgctacaggtatacccagagggtatgaactcataggaaagagaggaaagcagaatggtcatgaaagactgttattggagacagctgcgtggcgggaggcgataaggtagtagaagtggagtcggagtagagataatgaaagcaatgacagaaaagacagctgtgtagagattaggtttacaaagcaagatctgtatccataactaaaatctgtgagaagaacattttgacacatcaaagagcctcaaggagctggtttacttttaatacaatttgaaagtgacaataaaatgctggcacagtgccgcagctacttcataggtgtctgacataatatgattacaattcagaatggaatcatcaaccgactctatttctccagaggataaaaaacacaaacatagcagggctaaccatgcttctgttgttatgatcgtctcatgtttaaaatttggaaattactgttcgttactaaggtcgactttttctggaaaggtaatggagaaatctctctctgtcatttttatgttcatcttttgttgtattgcatattttaattgcaatggattatacctacagattattcactcatttttgtgttaatcaaacatgtgtaacatttgatgtaaaggtacaagaaagaatggaattccattgtaaacagggatttatgagaagccagttaggaaaaagtgtcacaaacaaattgagccttaaacaaagtccgtcatccaattaaaaaaaaaatgtaggctggtggggaagtattgcagaaaaaactgaacagaatttttaaagacttgggatctggaaaagcatggtgtctatgagaaagtgcagagagtttaatttgagctaagtatgcactggagagtgccagattaggctaaatattaaaaaagaaaagaatatatatatatatagtctactgctgtgcaaggaaaaaaacccacatactagtggcttaaaagaacaagaaaaatttcttgtcatgaatctacaaatctgcaatttgggcatggcagggacaacttgtctctgctccattcagcattagcactcagaaccgtctaaaagttccaaacctcacaggttaggtagctgattctggctggcggctgggacctcagctggggctgtgatcagaatccctacaggtggatgctgcgttctaatcgtggatatcgccttttctaacccagccttagaagtcacgcagcatcaatttcgccacatgctatttgttagatgtgggtcactaaatccaatctatattcttggaagtgaaattagacctcatctctcagtgtataaatgccaacaatatgttgtaaataaaagcatgtaggaaataatattttggcctaacatctttgaaaaataaaatttcatacaattgctttggttcttcactaaggatggtaaatgtatcacgtggtttcccgacgtgaggcgtgatcagacatgtgtcttagagagctctttctggcagcttggggagaactaataagagagggcttgcccttaatggaaaggagagcacttaaaaagccattgcagaatgtagcaataacagcctggattatgacagtgaatataggaaaaagtccagtagaaatgtattttcagcaaagaagaaatgacctataaagataaatgttccagaaaggtagactaaaataaggagtgaaacatcatgaaatttgcaaacaattttagcatgtgttaaatactgaaggggaaagccagattgaaataatttccaaggctgatgaaatttaagaatgcaaacccagaagatagtgactcaagggatagggaagattggatgactgatagctaaaggtggcagataaaaagctcatggtgtatttatttttgtcttatttctttgtttaaaatggattcagttgagagttcagtggatgagactggagtcacattggaagggcaagactgcagagaatgcaggggaaggatcagctgatggacagtcttctactgacactgatggacaggtggtaaggccatacacaggttcagataaagtataggtgtgagaggggcatgttttgttgaagtagagaatctactcaagaatgttgctcaaattattgaatttgtaaaaacaccagtgtacactggaattaatctgaatcttgagaaataaagtggacacacaggaaatttttcttatctcttatctcttgctaatggtgttactaaagccgtatgaaaatggattcattacttaacttctctgtgcctcacttcccttatctgtaaagcagggatgataaaaatagggatgctgtgtattaaaatgacttaatttgtggaaaacagtgagattgatgccttgcacatggtacaaccatatgatcactagtcaatcttattaaatagaagaaaataattatatccagtcctaagtgctctgaacacagaaaaagaaagtgttggctattggaattcctctacaatagaatgattaaagctgtgtcatctctaccctttgggaaagtattacttacacgaaaaattttgtaaagaagctgaacattgtccaagtagcagaaaaaaatatagatgtattttcttgtgattaagatattttaaaaatacccccatactatataatggtgaacacatgggtattttttaaacctttccagatacaactgtagcttaaaattacacattttctttaacattatagaggaattactgttcatattttttcttccaaatggtatctaaatacattgaattggtgatatctatgatcagctcctctctatttaaataagtttatgcataaacaattttcttggttctcaattgctgtataatgtcatcaacttaagcacaactgttcaggaacaaaatgaaacaaaaaaagagataaatactacagaagggattactataatagtactgttgataatctagtgttagatgtatcccaacttcaaaaaaaagttagaataaaaaaatagaatgggacacatataataatgcaacaacatttttgttaatgtataatcagtacaattatctgtagtgtttgtgacatcattatggatgccagttatgttccaaacttaaaaaaaaaacagctaagtaagagattagaggttggattcgaacacttgctttgtggaataaaaatttctgttcagattttttgttctttattttcctcttcccaaatttttatggcatcgttaaccatccaaataattaaactgatgcctaaagtttatactttatattactttacctctcacagcctatatccaaatcaccaaagctttaaaactcttcactttctaaacctttctcaaattgcaccaaagtgcaccagaaccatcagtacctcttcaagattactgcaacagcgtgatatataccattattcctcctctccagggtcctttatgtttgctattctttctcagtggaattatctttcctgccttttttccccatgtaaatcttccgatctatgaagccttagcttaatttcttctatgtccaggaattttttttttctcacctccctggctggtgtaactcctattacatgctctactgaaaacatgtatccttttttagaaacatgttatcagatgtgtaatttaatattgttggtgtcattactgattaataagtacttcccacagtagaataaaatttcactaagagcaactccatttgttatctcttgtgagtgttagatattgacatcaatatttatgtctagcatcgtatccaaagcacctagcaccatgttgaccatacaggaaatctttatttattatctgttgaattaaatgaattaatttatgattcaggataatacaatatgcaatataatatactaatgtgagaatatttcatttttgtatttataaagtaattatgacattttaataataatacatatttagaacattatttgatgttcaaggtacagcatgacttttaaaagtgactatttttccttcagctgtatcatgatttagctttagcttataaataaataactttataactgttaataaataagtaaaactggtgcatcatttacctatttaggatgcttatgctaaaattaggaaatttaaaacaatgatactcaaaaattaacagatgtagcttattgaaattactgtcatttaaaataaagtacttgtctgaataatctgataaataacatgccttaaataatttacatattttctgttccttttttcagaggcttattttcatattttattcatatagtccctacaaacatactttttaactctgatttccgaagtattgattctaacttcttgcctttctcaacattctctttcaatctagctcctaaattttagaggtccaaatactctcttcctcttccccttttccctcttctcctccacctctcctcctcctctcataacccttaatcttcctcctttgcctcttcctactcctcctctttttcttcctctttcttttgtattcttatactatgctctcttgatgaatggaagtggtgcttactaaataatgaggcacacaaatgtgaacagattgttattttaaagtagtttaaagttcatcgaatggagcgagtatgcctgaaatgtgtattgtgcatttacagatatttcagtgtctttcacaaatatcgataaattaggatcacagtcagaaattggtaatggagataattgtctttgaaagaaatttgagctggaaaatgaactcaagaagtttgagttctcttttcaagagagtcaaatcactgtttttaggcctgctagagcattttgttgtccctttgctctttaatgtaacctgatagtgctgaaacttttaggtatatacatgaataactaggtttagataaacctggaagaaaactaccttaattccaagaattggattaaatgaaggtacagaataaaaaatttctttgaattcttcttttgaaatttggtaactcaaaatattaagtgggggataagaaatagtaaaggtatttaaaaagttatctttatactaataccactactctgaaccactagtaagcatattaatgagtatagtttctcatgaactttgaattacttaggacaaacacatcagaagatgaccaagaaaaacatcaacaattccactagatttgagttttagatcttcttatttcttttgtaccttatttcaaagtgtactctgagattgccattctacaatgcaatgaaatataactaatgggtatcaggtttaatacctgagtgatgaaatcatctgttcaacaaaccccaatgacaaaagtttacctatgtaacaaacctgcacttgtacgtctgaacttaaaataaaagttaaaaaaaatcagtatgggtatatataattatacatatttataaagtacaagtgatttttttaattttaattttttaaatgtttgtgggtacatagtaggtgtattatatttatggggtagatgagatattttgatacaaacataccatgtgtaatgattaaattaggacaactggggtatccatcacctcaagcgtttatcatttatttgtgttaggaacattcccatttcaatcttttagttattttgaaatatactgtaaataattggtaactgtagttcccctattatgctaccaaacactggatctaattccatctaactgtatttttgtacccattaattctttcctctttatctgcaccctttccactacttttccagcctcaggtaaccatcattctactctgcatcttcatgagttcaatttttttgttagctcccacatataagtgagaacatgtgatatttatatttttctgtttgctatttcttgaaggaagccttattcattagctaggtctaaagggaaagtgggaagtgacctttttaattgtgaagacaaatactttaacctctgaagtatttgtgatttttttttttgagtgatgtatgagtttctatttttcaccataaggctcaagagaattaagatcatgatctcatgaaaagtattattttttacatacaaatacctataattattaattatagatagcatttaactttttaaaatatgtatgctaaaaacattcatattaaaaatacaatactatattttttgttacatcattagccatgtggctcttatttcagaagtaaaaattatatacagattggaagactattcaacataaaataaaagttgaccaaataacataaagattactagaaaaatatttatgtctcaaggtcagtatttaagtttgttacatttttattacattttatttaatttaaaacatttttaaaagttaaattcataggtagtggatgacatatttaatttaataaatggcattcttgctttatatatatgaatatataatgaaactacatgcaatacaaataactgatctagaacaaggaaaaaataaaatactaaaattaagttttttaaaaaaatgatatctaggaagaagctggttatactgatataacatcagtataactgttagaatggttaaatgtcagaatggctgttattcatctttgttaaagaaaaagtaaataggtaaccgagttgtttcttgcatttcattacctgaaatgaatttaacctttattctattttgcagtatactaggcactgtgtaacgacctctaaatgcatacagcatccagtcttcaaaccatcttatattatcactattgtattattgcatcaacatatatatgaggaaactgagatgcatatttgctaaacagttttccaaagtctcatattaagataggcaagtaaattggaagaagtgtaaaatattttttctattcaacatgactttattgtttggtagaaacagatcactttaaccattgcaaagtgtaaaatattactatcgtacatccatgtgccacataacagtgttctggtcaatgacagcatgtacaatggtggtcccataagattataaaggagataaaaatttatatcacctagtgacactgtagccaccttaacatcacaatgcaatgcattactcacgtctgtggtgacgctggtgcaaacaaacctactgcactgtcagttctataaaagtatagcacatgcaattatgtacagcacataataattgatcatgataagcaactgtataactggtttatatatttactatactatactttctattattattttagagtgtactccttgtacttatttttctttaagttaactataaaacagtgtcaggcaggacattcagaaagtattacagaagaagtcattgttatcatagatgccagctccatgactattactagccttaaagaccttccagtgggacaagatttggtggtggaagataatgatattgataatcttgaccctgtgcacgccaaggctaatgtgtgtgtttgtgccttagtttttaacaaaaacagtttagaaagtaaaaacataaaaataaaaataaaaagtggacccagcaatcccattactagggaatatacccaaaggatacaaatcattctgttttaaagacacatgcaagtgtatgttcacaatagcaaagacatggaatcaatctaaatgaccatcaatgatagaatacaaagaaaatgtgctacatatacatcatgaaatactacacagccataaaaaaagaatgagataatgtcctttgtagggacatggttggaactagaggctgttatccttagaaaactaacacagggacagaaatgcaaatgccacatgttctcacttataagtaggagctaaatgatgagaatacatggacacatagagaagaacaatccacactggggcctttcagaaagtgcagagtaagaggaggcagagaaccaggtaaaataactgttgggtactaagcctaatacctgggtgacaacataatctgcacaacaaactccatgaaaaaagttcacctatgtaacaaacctgcacttgtatccctgaacttaaaataaaagttaaaatataagttaaaaatttaaaaaaattaaaaatcgagaaaagcttatataataaggatattaagaaagaaaatatttttgtacatctgtacaatgtgtttgtttttttaacccatttatgcctgaggttgcaatttttattttttatttttatttatttatttatttatttatttatttattttgagacagagtctcgctctattgcccagcctagcgtgcagtggcgcgatctcggtttactgcaacctctgcctcctgggttcaagcaattctcctccctcagcctccggattagctgggactacaggccactgtcaccatgcctggctaattttttgtatttttagtagagatggggtttcactatgttagccagcatggtcttgatctgagctcctgatttgcctgcctcagcctcccaaagtgctgggattacaggcgtgagccacgacacctgactgcaaattttttttgtgtgtgaaaaatcagaccttgtcaatgaccttgaacagtaggatataaataactcccacaagcttagcgttccaatagtggaagactaggcataaatgggttaatctaagtgtcacaaaagagtgaaaaagttaaaaaataaaacactttataaagtaaaaatgttacagtaagttaaggttaatttattattaagtaaagaaaaatattctttataaatttagtgtagtgtaagtgtacaatatttataaacattgtttataattacattagctgaggacgtaaagttttttttgcttttattttttgttttttaccatcttgtgaaaggtttctgaaactcgataataaaaatcagttggcgtaaattattcttttgggtcacatttttagaatgaaaaacaaagaatgtatccttagtactggttcttaaacagcccataaaaacccattggcctgaagcttgtctcaggcccgtgcccatcctatagttttgaaagacaaaaggctggtagagacagtcttcagcagtttcaatggcttcaacgatgctctgtggagttcagagagtctgagtgccttaactcccgagctatgatcccaagcacagggctagcctggcctctgtatctccccaccaccaacctcttaaaagaataagataacagcatatctatagtaaaaccatctctgcatagaaactgttcaaatgctctgttttcataaaatgttaaaagttaaaaaaaaaaaaagtcctaggccttcacattcactcaccactcattcactgacttactcagaacagctttcagttctgcaggctccatggatgataggtgtcccttacaggtgtatcactttttaccttttataccatatatttactgtatcttctctatgtttagatatttttagatacacaaatatttaccagttgtctacagtattcagtaagtaacatgctgtacagatttggagactaggagcaataggctataccacgtagcctaggtgtgtaggaggctatgccacctaggtttgcgttaagtacactctgcaatattcacacagcaagaatatcacctaatgatgcatttcttagaacgtctcctggaattaagtgattcatgattgtattgtaacatcatttctattattacagataaacacatcacagatctagtcagtgccattgcatttatttaattagaatgatagtttttttctacacacaaatgtaaaattttaatgtgtttatttggatattttataccaacagcataaattgcagtgagtactggacttgtctcactgaacaatatataaactcaaatattggcccataataaattgacaatgaaaacaaaagcaaatgtcattcacccagatagtatgagaagtacttatctaattaattttgatcctcaatggtctaaaacataatttttaagttaaatatatgaacgttccacatagccaagttatttttattataatttataaccatcagtaaaaaattggggatttaaaaaaacatatattattgtaggttctagaatttgtatgcagtacgctaggcctaattcacggaattatattactcttgtttgaatacttctggtataaaccatcatagcttctcagctctgaaacatttcaaataagatagtaaaaatgtcagtagccatcgttctaattatgaataatttatctaccacaaaggaccactggatataacaatattatcaattttaagttttaatttgttgtccaatgaaactatactattttcatgggctgaaactgagaataatgaaactaccagtgctttgcataaatatacataaaatatttgctttgttattctgttattctttcatataatttcttgatctggaggtaatttaagatatgcaaaggactttttttttttactagcaccaatatatttttaaagatatttgccttggagaacaaactactcaagtataattaattcagcctttgctgaggtaaactttgaagctgaccgaattgagaatcctgagatcaaaattctggcaaataaataataaaacatatacagagattactagtagaagaccctaaaggtgagcagtgctataatttaccatactgaagaaaaagggcaaaagcgtaattaaaaacatgtaattggaaatatctccttaaaaagtgagcatgtgtgtctattaaatccagaaatgatactatcaaataccaactctggtggtgtaagaaaataaaaatgaattatcctttacaattggatcatataggtcttacttttcctttctaataaccagaacacaatgtcttataattccatgctaatttactgtttgaaatatgaagattttgaacaaataacatctatcctctcttttaaattcttgtgtgtgtgtttgtgcacccatgtgcacatgcacatgtatcatctctaatttgagaatgtgggttgaaccaatgaaaatgcaatattattcaacattattttatttattctgtgaaattgataattttgtgtattatggttcaaccacactgccttgttagtatatattctatagtccaaattaataaagtaacttcagtgaacttggtcaacaccaactgctcagacgagaataattttttctacaatccacagccatttatcttttctatgttttaaatgattttttagcaagttgcattctgagaagagatacatggaataaacaaacaaaaagcaagatacctaaattttcctcgttctctttagtagtgttggtggaactacttaaaaatgtaattcttaccagcacagagttagttttaaattttcggagattagatttaaacaagataggtaccaattgtcaccttcacagaacaattctaacatcataaaagatacaaatgatcaattagatcagtgccttaacgcttcagacaagatttagtgtttgctttaagacgttgacatattttacaacatttggtaaaaatcaaattgtctttttataagtgggaatgacttgaaaaacccaacagctttgactcatagaattatattcttaagtagataactggcttatttctgttccgataatagtaacacaataaacacagagagcccatttcagttatacatattatcataaaggcataaacaattacatttatatcctagaagacaatatgtgtatatatacatactacctaagactatatatatatgtgtgtgtgtgtgtgtgtgtgtatatacacataatcaagggacattaaaacaagtactttattgtgctaaaagctatgggacttcaatggaaatttgcatcaatctaatatgccacattctacagaaatttttttttgcaatagacacatacaaaatattacatattactcgttcacaaatttatacagtttattgatatgatttgccttaaaaataaatatagcaaagattgcttattttctgagttatcttatatttattattcattgatttatttcccatcaccatttctctattttcagctttccccacccttttggtcattttactttcaagatgtactagttgttaatagttggtatacctgtacctgttccttaacaaaagcatgaccagatcacagatattgctacagttgaagtaatatcagcattttcataataaaaactgctctttggaggtttataataatgcaactgtaaaagttcatactgggctcatcttgtcatataaggtcacagtctgaagtaaatttgttttgccaattttcatacaaattaatgtagccactactctaagtaacgcaaatataaatcaaacactggagaaaagtattcccccaaaataataaacatcatttggctgatacttattttcaagatatttagttgtttttaaatttgcatgtgtcccacacgggtgtcaagaggatagctctaggagagaaagaaagccaaaaaaaaaaaaaaaatacatggcttttctccaagaaaataacactaacatatgtgagcatataataaatagccttcatggcaggtggcttaccctcaaacaacaaacccaatctcagttttttacatagacaactatgtaaactatgtcaaggccctatttagagaaagaaactgtcatgttacaactttctgaaaccatttaaaaaatacgatacaaatctcagaaatgtttcagtcattttatgtaatattgaaattaccaaagagtagtaacttacttaatatcattgcatggttttataataatggcaatgtaatgcatacactatttctttttttttttatactttaagttttagggtacatgtgcacattgtgcaggttagttacatatgtatacatgtgctgtactggtgcactgcacccactaactcgtcatctagcattaggtatatctcccaatgctatccctcccccctccccccaccccacaacagtccccagagtgtgatattccccttcctgtgtccatgtgatctcattgttcaattcccacctatgagtgagaatatgaggtgtttggttttttgttcttgagatagtttactgagaatgatgatttccaatttcatccatgtccctacaaaggacgtgaactcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctgtttctccacgtcctctccagcacctgttgtttcctgactttttaatgattgccattctaactggtgtgagatggtatctcatagtgggatctaattaaaataaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaagtgcatacactatttctatagatatacttccaaatgtaaatacacaatcaaatagaagtgaatttatatgattattggatccagaaattaaggctttgggaaagaaaaagcttgagtgtttcatctcaagattcttcctgctaatatcattcagagcctgtaaggcaactattttgaatccacactaatgattttgttaacgcaataacagaaaaaataaaaataaagaaagaaaggaaaagagtagggtaaaggatagaaaaggattccattgcaacagtgttaatatcattctggagaatgcaggagaagccattcatatagaaagctattataaagtatttaatgttaggaatgtattagtaagtaaaagtcaggcaccataatatatggtaaaagtcaaataaaatctcatcaacttaaaaacatcctggccattttgtaactcaattccatttttggggggtgtatgcatctatgtttttattagaaatgcaatgatacaatttttaatttcacctgatgaccttcttatcttaaaacttcatagtgtttatatagtacaatgatgataaaaatcataatcataataactgaaacaaacagggaacttaccatgtgttttaaatatgtttatttcaccttcacaataactttgaagttaagtgttattatgaactctactttatacacaagaggaaactttgagttagcaaatttaagtaattggcaaaaggtgtcatgattacccaatagtaaacctagggttcaaactcaggcaacatatcaatataatgtgttcttcacaactatgctagatatttatcattttaatttgccatttgctaatttctttttttaaaacatacttccctaccattagaaaaaaatggctatttcccatcatttttttaaagaaccacattgctctgaaaatctatatgtatgtatttatttactctattatatatttatttaaatatatatttactgtttttatattatttccttgggattggtgcctggaagtaatattgctgagacaaaaatatatgaacttactttacatatatttgattgtggttttttttactgaatacaactattaatctgtatccttgtcaacataaactcagatatgtgtgggtaaacacacatacacaaacccatgaatatgtgatttaatagctgtaaaatggaacttcattcctttgaaaaatcatttgtaaagttaaacattttttaaatgtttgaataaatttatgttctcacttttttcctaatgtctctccatggttttattcattctatattatttttagtagagttaatgacagcaaaattatatcttaaacagagatatcaggtaaagaagtataaaagtgttcaatacatacaagttgaagtcagaaatttaatttggcttgacttttatgaaccaaggtgtgtgagtaattatcagaggttgttgtgaggagatatgattgggaatggccatgacagctggatcacaaaagtcttcatcatttgccagcagctttgaacctttgaagagcctgacaacaaatcacacctcactggccctattagagacacaattacagctaatatattgaatgggtgaatttgcaatacaagggtttgtttccttgatttcagaaagaaatgtcttcttctctaactgtaactttcctggtagtgcttgtgtgaggcaagaagtgtgagctggcacaggcctgctgggaatccaatctgtgtgtgcaatgtgttataggcctgtcaccccaaattgtttatggcgagacattctttgacgtatagacatttgtcaaggtcatgctgttgtaaatgaccctcagtttgagaactgagaacattcttttcacaataacttttctctaaataagtttttgttagcatgaagtttcttagctacttgagaaaacagccaccagatttcaaggacaacaaattaaatcagacatgagctctagccagagaacagcagaggtatgagaatcagtcttggacaaaatgctacgttcaaattataaatggggtacccattatgtataacatcaatcagcaggaggttagaatgcttaggaaaattatttgtggaaaaaaattggaaatagcagaaacatgtactacttttaagcagaaattatagtgactgattataacacgaacactttcccttgtcaattagtttcaatatcaggaactctggaaaatctgtaacagtcagctaaggtacaattttgttatattttaacaagctagttactatagtcttaacttcaggaatacttaactactaggcttgttactataattcagctttctgtttaaagagaaaggttctgctctctcgtatgtagttttcttactttggaagagaattgatattaaaaattggcctcatttatgtggctctattgttttaacaataatcaatatattcattgaagtgtatttattttagaagtcatcagttgtagataagaaggcacagtttctgtttccaggaacagaatttgtattttataacacaaattgggggaaaatagtactgaagtagaaattaactcaagtggtgccactctcctctgagcaatatcctccactcaaaagaagtgcttcccattcttaaggagtcctaagataatataagagggaagatataaacatgtataaagcaatatgaacaggtataaatcaaataaaatacattcaaacacagatgattggtacacttaaagattgaagaggactgaaatagagccactcaaaaattcttttagtctctgggctgacttaatttttgaagcgagtaaataatagatcagatattaacatattattacatctcccattaaatatgtgtgatgcctaactgccaaaagctttgttgattatttatttatttatttatttatttatttatttatttatttatttatttttctgaagcagagtttcgctcttgtcgcttaagctggaatgcaatggcacaatctcggctcactacaacctccgcctcccaggttcaagcaattcttctgcctcagcctcccaagtagctgggacaacaggcactcaccaccacgaccggctaatttttgtatttttagtagagacggggtttcaccatgttggcctggcttgtcttgaactgacctcaggtaatctgcccacctcggcctcccaaagtactgggattacaggtgtgagccaccatgcctggcaagctttgttgattttttaattaaaccataatctctattgttttttatctggaagaggatatttttctgatatttcatagattcaactatagatggcaggatattggaagcagtatcagacattttactatatgattaaattcactttaataatcacaatattagcattttttcttgtatatcaccactatatacatccatttttagggtaggaaatatgtaaaagtcctgtgactcagcttttctctgggcattgaagatgtacctttatgttatgttagaaatgaacatatatttggattagagagtacagattaatcagtacataaggagtattttatgctactgattaatatattctcaacagcagagaaatgcacttgatgcaattcagaaaaaagtaaaagattcttttacatgctaaattgtttcaattcactacattttcatttactctggggaataaaaaggaaaatctttaattatctgaatgagccactacattttttcttttgtcaaatgcaatttgaatttctgggaattatattttagagtgtttctgatacacacagagtaaaccatctctacactgtcctgcattttcctttctaagctacacaattaaaaacaaaaccctttccaattgtgtacatttttgaagcttctcaacaaattatgaggcatttatactttggaaatgttaatcaatttaactcccttcccatcactttccctagtgtattcaaagctcttttgctttacagttatcttagggctattaatgcatgattatcgtatgtgtatttgcaaagaaaaaataaaaatattggataagcaatagaagggaaaaatccattgttcttggagaatctacttgaataattatgttctattgatcaactgttatgagtaacgtgttttaattcctcagagttccagattctatattgagccattggtcaaattctctatcgagcattttaaaatccaacatgataggataaacatttatgattagtgaattggttatttggtttacgtgattatgaaatcacagtgctttattctagattgatatagacaaccttatttcatgtccctgaataggattacataatatctcattgcagacattttgtggtgactattaaattgtcttaaaaaattgctgagggacctcagctgtattcaaaggtatgtacttctggaaagtccatgaactgattcaagttacaatgtatttgtatcatgctccagaaaaaaattctgatggatgttgaccaattctagtggtctctatttactgctctaactagtgactataacagatagacggctgggggtcttctgtataaggttgtgttgcctttgaaagaaggtagtaagaagtgaaggcttttccctctcaaacattaccagatccaacttgataatggcatcaaactatcaaggaggacaaaacaaagaaaaatacagaaaatagagctgaagcctggacgtagactacctggcttcttttgcatgtgacaaaacaagactccttacttcacttttaagttatattttatttttcttataattttaagcatcccaacccttatacataaaacctttgcttacataagatcaattcagcattttacaggaccatgcagggaagtggaacaatcttcaatcactcctttggaataattaaaatatacatggcaggctgagaatggggagcgtgtgtgaggtatcaggggaggtgaaggaacgtgtgtttgcataataaacaagacctctagtaatagtcacttagaatgaagccatgtattactttgaatacaagttttctctcccctctcattcttgctctcactctctttcatacacacaaacacatatgaatatatatgtgtgtatatatatgtacataaatttatatataccctcttggacatatatgatacattacattttacaaggaaaacatatgcctggggaatagtgtaaaatattgaatcctggaaatacttgaaatagcagttttaactctggttaataaaccaaaagaaaaagagaatgcccaactctatttaaaacagaattgtatctttatagtcagaaaacttttataaacttagtcaaaattataaagtgacatattaattaaattgaagaggatgaaacttgacatatacttctgattttaatttttgtaaaaaaaaactctacaatttattataagatgttaaggtttaggcaatgtccatagctaacatagtttgatgattcaaaccctacactgtgtattccttttatttttataattatttatcttgtattatctgcagaaaatacagtgtagtatgatttggcaaggagaaacatctgcctggtaaaattagctaggtttttatttcagaaagaatcatagcttttaattattgagcacctcctatataacagtatttttaattattgagcaactcgtatgcatcatactttacattaggctaggtgtgatctcctaataaaagttctatgaggagtgagtaaatgcacataaatgtgtattagaaagattggttaatatagtggttaagatcatcagccctgaagcatcctgactggactcaattctcgccctcccattagatgctttatgaacctggacaaatttgctcatctctctttgtacaagcatcctcatctgtgaaatagaagtcatgataatatcttctatgcaagctttctgagagtatggaggaattattaataataaatgtgcttaaacacttcttgacaaagaatatgtgttcaatagtattttgttttaatcaatattattaccacttggctaaaaataaaataacattttgtgaaaacacaaaattagtacatggaaccattcttttgtgtaattcagtttcttctattcttcaaatgtctagtccaaaatccattgttatcagtagctatatctcccccacttcttcttatcctctattcacgtttttatgctatgaacaattacccccatattaatgtcattttattcatgtgttgtataatctacttaacctggttgtttgcaccctgaatagcatttctttctccatatatagactctttctatataagcatgttgattttaacttctgtttcatgtaattttcttaaattagccatattagagcaatttacaccatgtccaaactaatgtaaaactagtgatgaacaacataatggaagcattaactgaatatcttcttagattggagcaaggcagccagttagttgatgatacaggaaactccagataagagtccccatccttcacctgaaatgactttctgcttacagaatattatgagagcaattatacatctctgtatggcatgaataatttatacttttatattaagtcaaaagtaaaaaggtaccgaatatgttccatgaaaatagtttaaaaatacagacatttgtaccacatacatgtcttgcacaagcttggggcccattttagctttcatttgaaaacaaatcatcattattagaacacaggtatttcctggagggatacttcaaattataaaatcgtgattcattctacctattttgatatggataattacatacatattaatgtattttaaagtagctttttcatgctatgtcatcagactcactatttaaataaagacatcttgtaaattaaagctatctttgggaagagctgggagtatggagttctgcttattgttataaatgtcttcttatttcactttttctgtatcccactttactcattacagcctgacactctcaagatgaaaattattgcataagtaaatcacttctccattgtattcacatctattgctattactaaaactaatactaacttgaagtatagtttatgccctgataccataggttttaaaaatattttattttggctggacacagtggctcacggctgtaattccagccctttgggaggctgaggtgggcggatcatgaggtctggagatcgagaccatcctggataacatggtgaaaccccatctctactaaaaatacaaaaaattagccaggcatggcggcacatgcctgtagcctcagctacttgggaggctgaggcaggagaattgcttgaactcaggaggcagaggttgcagtgagctgagatggcactgttgcacttctgcctaggcggcagggtgagacaccgtctcaaaaaaaaaaatatatatatatatatgtatacacacacacacacatctatatatataattttatttcaattttatttatttatttatgtattttgagacagagttttgctcttgttgaccaggatggagtgcattagtgcaatctcggctcactgcatcctccaccttctggtttcaagcgattctcctgcttcagcctccaaagtagctgggattacaggtgcctgctactacgaagcccagctaattttttgtgtatttagtacagatagggtttcaccatgttggccaggctagtcttgaactcctgacctcgtgatctacctgcctcggcctccaaaatgctgggattacagatgtgagccaccacgcccggccctttacttttgttcttttggctctataataagcatattctttatacttggaaaaaatatttttatataccttttttaataagcagaatttatctgtgggtttctctgtgcatgtgatgctatttgatagcattttacccacagtaaaacttctttcaatattggagtcaattctctcaaaccttgctgctgctttatcaacttagtttataaatttaatattctcaacattttctgtcatctcaacattgttcaaagcatcttcaccaggagtagattctagctcaagaaatcagtttatttgctcatccgttggaagcaattcctatttattaaagctttatcacaagattgcagcaattcagtcacattttcaggccccacttctaatgttggctctcttgcaattgtcatcacgtctgcagttactttctccatggaagtattgaatccctcaaaatcgtccatgaggttgggaattgacatcttccacactgctgttaatgttgatattttgacctacttccaaaaaacacaaatgttcttaagagcatcttgcttggaaaatcttttgcacaagtttttatattactttgttgagatccaacaaaggaatcactatctatgaaactatagccttatgtgagatatttcttaaataataagactttgaagtcgagaatactctttggtctttgggctacagaatggatgctgtcttagcagacatgaaaataacattaatctattgctacatttccatcagagttcttgagtgaccaggtacattgtcaatgagcagtaatattttgaaataaatcttttttttttctgagcagtgggtctcaacagtgagtctaaaatattaggtgaactgtgttataaacaatcatgctatcactcagattttgttgttccatttagggcacaggcagagtagatttagcataattcttaagaaccctagaatttttggaatggtaaatgagtgttggtttcaacttatcaccagctgcattaggctctaagagagacagcctgtccttcgaactttgaagccaagcattgacttctatgtagttaaaaaagttgtagatgggatcttcctccagtagtaggctgttttgtttacactgaaaatatattgtttagtgtaaccaccttcatcaatgatcttagctagatcttctggataacttgctgcagctttgatatcagcacttgctgcttcaccttgcattttatgttatggagatgacttattccttaaacctcatgaaccaacctctgttagattccaacttttctgcagcttcctaacctctcacagaactgaagagcattagggtcttgctctggattaggtattcatccaagggaatgttgtggctggttttatcttcttttcagaccactcaaacttcctccctatcagcagtaaagctgtttcactttattttcattcatgtattcactgaagtagatcttttaatatgctttaaggaaattttcttttgaattcacaatttagaaaactgatgcagggccctaggtttcaactatttcaactttcaacaggcctttctcattaagcttaaccatttctagcttttcatttaaggtgtgagatgtggtagtcttcctttcacttgaacatttagaggttattgtagggttattaattggcctcatttcaatatttttgtgtatcaggtaatagggttgctcaaggaaaaggagtgagatagaaacagctgattggtggagcagtcagaatgatgcacaacattgatctaaatgtgacaccttatatgggtgctgtgttcgtctgtttttatgctgctatgaagaaatactcaagactgggtaatttacaaaggaaagaagtttaattgactcacaattctggatggctggggaggcctcatgaaacttacaatcatggcagaaggggaagcaaatgcttccttcttcacatgttggcaagagagagaagtgccagcaagggaaatgccagatgcttataaaaccatcaactcttgtgtgactcactcactatcatgagaacagcatgacagaaccacctccatgatctaaccatctcccacgaggtccctcccccaacatgtggggattacaattggattgcaattctggatgagatttgggtggggacacagagtcagaccataacaggtgcacttcatggcaccacaaaacaattacaatagtagcaacaaaaatcactgatcacagattaccatcaacagatataataataatgaagacattaaaagtaatttttgaattaccaaaatatgacacagagatatacaatgagcccatgatgttggaaatatggtgctgataggcctgctcaatgcaaggttgccacaaacgttcaatttgtaaataatgcagtatctgcaaagtacaataaagcaaagcaccataaaatgaagtatccctgtaataacagttacacacttataattctggaattctatgtatataatctcattgattaattaattcttatattagcttggtgcaaattgcaattacttttgcaccaagctaataacaatgatatagtttgcattgtttctgtatgattgatgagaactctcagcgtcttttccgtgcatttcctacctgaagaagaaaaagttgcaatgatagaagtaatcttttacttccacttctcagactgagctggtaaagttatcaaaatgtgttgctttgctttgattttggtgggattattcctatctcactccttttctttgagtgaggtgggaatactgcttggtctgtttcctcttccttattgcgcctactcatgcatctttcttccactcaaaagcaaaacttaaaacgtgcaaaaacagaaatctatagagaagcattctatcttttctcatttaagttgacatattacagcattcaagtagcataatataatcatgagcatttatcaaaaaaatctaccttggacctttttaaagtatatgtgaattcttttgaatttatatccaccactatgaatacaataatgaaaatataatattacctaatctttattaagaatgtgtaacaccaggcactgtgttatgcacattatatatattattgtgattgttccttgcataaaatcaatcaaacaataatacctaaaaattattcagttataatattctaagtattgtgccaggtataagccatatgttttttgtcaaagtaaatatttagggataaggatatgggattttacatgccaagaatcgaggaaaattcatttgaatatttctaagacaattgtaaaaatacaaacaataacaaaataaatgttagttttaataattcaatttcactgaaaattttaatctaattaaacatagatttagcacatatcctcttttattgtttagcactatctctaaaattaatttataagatttagttgacataaatgatgactgaagtcttggcacagtttcattttagactttagaattggacaatcaattttttaaatggatataattttatcaaatatattaaccacaaacatgaatttatgtgtgtatcattttgactcttttgaagttactattttcagtaactcaggcacatacacattcttatctacatattcatgatatatcatattatatgccaatatatatataatatgcacacaaaaatctatgtgaatatatatgatgaactataaacccagtgcagtaagagtctttattttagagataaaataggggtaagcctttattgtcttactgtcttaaaatgaatttaactgatacattgaaataaaattagaagtaatattttaaaagttatatgcatcttattttcatttattgagctaaatctgaaatgattttcatttcttgagttaaatttcgggtgtcttttgaaaataagatttactaataacagatagccaacctttcacagtgcactgtatgagttccaatatgaaggaataccttaagaatcttttaacttagtaaatgagtaaaattcaacattatgaaaagtgcaccagcttctgagttccaatatgaggtggtagctcttaggcaaacaagaaaaggacacagagaggggaacatcacacactgaggcctgtcaggaggtcaggggcaagggagggagagcattaggacagacatctaattcatgcagggcttaaaacctagatgatgggttgatgggtgcagcaaaccaccatggcacatgtatacctatgtaccaaacctgcacgttctgcacatgtatcataaaacttaaagtacaataataaaaaaaaggaagaaaggatgatctgggacatgaaagttgaaaaaaaaagaaaaatttgttattccttgaataacattacattttaaaaacagtaaacctaagaatctactcacatttaattttttagtgaactcaatcatgttatgaaaatgaaacgggtgcttttcttaggtgtaaacagtaaagctgtactttacttagcggtaaagagaagaggtatatttaaaattagttttgagtcatggtagttgaatattggggtctatattagaagactataatcagtgtcaggagatttcaaataaggcttaaaaaatatttctaaaataagaagcttaaatcattttttatcccttaatatcaataattaagaagtttgcccaaactcatttatgttgtagagtaactgaaaagtattggttaaaatcattttcaatgtgtgacttccatcaaagtcatagaaaactatacatatcagattcctggggcagtagatgaaggcaagagagttaatagaaactgtttgaagacactgaaatgcaatctgaaggtagaaaaaacctctacgactagttctttgcccaattggtgatttaattggtgacagagtagtgtcctgcatagcaaatattttaaagttaccctatttctgatgaaatatggagaactattaaagggtttttttttcagatctttactatgacaactattgttggaattgcataaaaagtttaaaccaaatcaatttcttttattcattattttcataatttagattgaggttggaatgtataattcaattatatagttaattgatgccatgtagacatggattaaccaagctttaagtgttctgagattgaattatttcaaaaagtattcattgtactttctgactggaatttgaattattcccttcagccagtaaagtataagcagtatcttcggacaacaacagggcattaaagaaagagttctgaggatggccaataaaagaaatctcattatctttaatctgaatatgaatcaaactttaaagtgtggaaaaataaatacaaatcagttaataaaacatccataagatacgtgtttcaagctcaatatgtcttgtactagtattatatgttatgtaatacatgagttgccgtaaatgaatactgatgtcaaaatcagcaatagcatgtctacttttaaaaactcatccccttgatgaaagatttataacttgaaatgtaccatgtatgtgatgtgaaagaatggttcactcatgttgagcagaaataatcattcactttgcaaatgaacgttaacacttgaaaaataatagttatgtttatttaataattatgaagtactaggactattttaagcactattttattttattttatttcattttatttttttgagatggtgtctcattctgtggcccaggctggagcgcagtggcgcgatctcagctcactgcaacctccgccttctgggttcaagccatgctcctgcctcagcctcccgagtagctgggattacaggtacatgatatcacacccagataattaagcactttatttcaataatgtatttaaatctcacaataaacctatggagtaggttacaaatagtatgctcattttatagatgagaaaatggaggcaagcaagattaagtcacttgccaagtgactaattcagtaagctaagttaatgatttagctaagtgatgcagccagaattttaacttaagaagtcagttgtcagagtttataatcttactcaagaccctatgctctgtcatccttaacattttgtgccgcctgtggcagtagcaaagtagccccaataactacaaattagataataaactttgaagcctgcttcccaaccacagccatcacgtcttgccagatagctctgccaaggttggctctgcttccctatagcaactggtatttctctgccacgaatgctctcaatggcagacaaactggctccagctcagctagtgtctctgctgtcaccaaccactcggggctaatacaagacacttcatcaacctcttctagagtggacttgggccctgaggaccctggcttgtttggtagaaatctttcatcactgaacatgatctgagaaggtagggtggctaggacaggtcactctgcccagagatatcttctctgagacccatagtgctactctatcttggctggtgctttttgtgacagacgtatgttctgattaaaaaaaaacaacaggccaggcatggtggctcacacctgtaatcccaacattttgggaggccaaagaagggggatcacctgaggttgggagttccagaccagcctgaccaacatggagaaaccctatctctaccaaaaatacaaaaaatcagccaggcgtgatggtgggtgcctgtaatcccagctactcaggaggctgaggcaggagaattgcttgaacccgggaggtggagattgcagtgggccgagattgcgccattgcactccagcctgggcaacaagagcgaaactctgtctcaaacaacaacaacaaacaacaaacaaacaaacgaaacaatcaactaagcttgctgcaatgtgggaagccctctcttatcctggacataagtgagcagcatgcaagtatagagctggatatgaaaacttagaggaatgaccttgtggaaaaaggctgatctttcttgtaagggttggcatgtggcagactgaacaccatattctggaaacagggacattcgacttatacctgaatgagaagaaaggcttttattgatttaactgccaaatgggaaatgatgaaacactacaatatttcttaataagagaagatgttttacatattgtagctaaaaacaaaataaattatcatagaaatcagtaatgcaaaaatccaagttgcttcttatttaattgaataaagcatagtcataaggccaacgaaaatgctggtgtgacatttaagatctgaggtttgttgattttgccaacattttacattctcttgaagatttgttggctctaccacctggcctaagtactgagcctctgtcagccaaaaggatgggaaaatgaatcaaataaatgagacaacatagacagtgttcaaatgagtatctaactctccctccttgtgaaatgctgagttacacaaatgacaagatacaaatcacctaaatctgctgaaagaggaataggagagtgtaaggcattttagaattttcccagccctcccttttttttttaactcagattttgacacttgaaggatacattaatgttatctaaatatccgcttatgtagaatatataaatgctttcttaaccgtgatatacatattaattattacccaatgatctctaaattctttctagctttgattttaatatacacaattctagatggattatgtcacatttagtctaccctctaggtatgcaattttctgtcctacttctgaagaataaataattttgctttccacagagcagaggggaaggtagctatggaggtcattttttaaagagaccaaaataaatgaaaatagctacaaaataaatcttcaaatatcattcaaatctctttggatgaattcacaaggtctttgaataaattctcaaggatattaaacagtaaaagttacagagaaatatatctaaataacttccacttcaatgttcccaatgtctgttatttaaaatagcaggcaaaacatacatatataaatgtaacatatattatatccataattatagataaatatttactcattttccatacatatcattatttttctatactgaaacattcatatgcttttaccactcaaaaattttggcatcctaactaaagcctagaaacatcttcaaagtagtatcaattgaataagaagtataactagagtttattgaaggttttaggatccacagctattatgaatagcttcatatattacttttggtagtctttacataccaagttagtaacaattaatgctgtgataaaattatttgtggtcatttctgatgtcataaaaatgtagttagaaaattactgttttttatatacatattgattatactttaagttttagggtacatgtgcacaacgtgcaggtttgttacatatgtatacatgtgccatgttggtgtgctgcacccattaactcgtcatttacattaggtatatctcctaatgttatccctcctcccctccccccaccgcacaacaggtcctggtgtgtgatgttccctttcctgtgtccaagtgttctcattgctcaattcccacctacgagtgagaacatgcgctgtttgggtttttgtccttgcaatagtttgctgagaatgatggcttccagcttcgtccatgtccctacgaaggacatgaactcatcattttttatggctgcatagtattccatggtgtatatgtgtcacattttcttaatccagtctatcattgttggacatttgggttggttccaagtctttgctattgtgagtagtgccgcaataaacatacgagtgcatgtgtctttatagcagcatgatttatattcctttgggtatatacccggtaatgggatggctgggtcaaatggtatttctagttttagatccctgaggaatcgccacactatcttccacaatggttgaactagtttacagtcccaccaacagtgtaaaagtgttcctatttctccacatcctctccagcacctgttgtttcctgactttttaatgattgccattctaactggtgtgagatgatatctcattgtggttttgatttgcatttctctgatgtccagtaatgatgagcatttttttatgtgtctgttggctgcataaatgtcttcttttcagaagtgtctattcatatcctttgcccactttttgatggggttgtttgttttttccttgcaaatttgtttgagcccacaagagaaagcagaaaagatctaaaattgacaccctaacatcacaattaaaagaactagagaagcaagagcaaacacattcaaaagctagcagaaggcaagaaataactaagatcagagcagaactgaaggagatagagacacgaaaaacccttcaaaaaatcaatgaatccaggagctggttttttgaaaagatcaacaaaattgatagacctctagcaagcctaataaagaagaaaagagagaagaatcaaacagacgcaataaaaaataataaaggggatatcaccaccgatcccacaggaatacaaactaccatcagggaatactataaacacctctatgcaaataaactagaaaatctaggagaaattgataaattcctcgacacatacaccctcccaagactaaaccaggaagaagttgaatctctgaatagaccaataacaggctctgaaattgaggcaataattaatagcttaccaatcaaaaaaagtccaggaccagatggattcacagctgaattctacgagaggtacaaggaggagctggtaccattccttctgagactattccaatcaatagaaaaagagcgaatcctccctaactcattttatgaggccagtatcatccagataccaaagcctggcagagacacaacaaaaaaagagaattttagaccaatatccctgtggaatatcaatgcaaaaatcctcaataaaatactggcaaaccgaatccagcagcccatcaaaaagcttatccactatgatcaagtgggcttcatccctgggatgcaagtctggttcaatatacacaaatcaataaacataacccagcatataaacagaaccaaagacaaaaagcacatgattatttcaatagatgcagaaaaggcctttggcaaaattaaacagcccttcatgctaaaaactctcaataaattaggtattggtgggacgttatctcaaaataataagagctatttatgacaaacccacagccaatatcatactgaatgggcaacacctggaagaattctctttgaaaaccggcacaggaaaagaatgtcctctctcaccactcctattaaacaaggtattgggagttctagccagggcaatcaggcaagataaataaataaagggtattcaaataggaagagaggaagtcaaattgtctctatttgcagatgacatggttttatgcttagaaaaccccattgtctcagcccaaaatctccttaagctgataagcaacttcaacagtctcaggatataaaatcaacgtgcaaaaatcacaagcatttctatacacaaataatagacaaacaaagagccaaatcatgagtgaactcccatttacaattgctacaaagagaataaaatacaaaggaatacatcttacaagggatgtgaaggacctcttcaaagagaactagaaaccactgctcaaggaaatcagagaggacacaaacaactagaataacattccatgctcatggatagaaaaaatcaatattgtgaaaatggccatactgcccaaaggaatttatagattcaatgctattcctgtgaagctatcattgactttcttcacagaattataaaaaaactagttttaatttcataggaaaccaaaaacgagcccgcatagcaaagacaatcctcagcaaaaagaacaaagctggaggcatcatgctacctgacttcaaactatactacaaagctacagtaaccaaaactgcatgatactggtaccaaaactgcatgatactggtaccaaaacagatatgtagaccaatggaacagaacagaggcctcacaaataacaccatgcatctacaaccatctgatctttgacaaacttgacaaaaacaagcaatggggaaaggattctttaataaatggtgttgggaaaactgactagccatatgcagaaaaatgaaactggacccctttcttaaaccttataaaaatattaactcaagatggattacagacttaaacatacgacctaaaaatcataacaaccctagcagaaaacctaggcaataccattcaggatatagacattggcaaagacttcacgactaaaacaccaaaagcaatggcaataaaagccaaaattgataaatgggatccaattaaactaaagagcttctgcacagcaaaagaaactatcatctgagtaaacaggcaacctacagaatgggagaaaatttttgcaatctatccacctgacaaagggctaatatccagaatctacaaggaacttaaatttacaagcaaagaacaaacaaccccatcaaaaagagggcaaagtatatgaacagacacttctcaaaagaagacatttatgaggccaacaaacatatgaaaaaaagctcatcatcactgatcattagagaaattcaaatcacaaccacaatgagatacagtctcacaccagttagaatgatgatcattaaaagtcaggaacaacagatgctggagaggatgtgggtaaacaggaacatttttacactgttggtgggagtataaattagttcaactgttgtggaagacagggtggtgattcctaaaggacctacaactagaaatgccacttgacccagcaatcccattactgagtgtatacccaaaggattataaatcattctactataaagacacaagcacacgtatgtttattggggcactgttcacaatagcaaagacttggaaccaacccaactgcccatcaacgatagactggattaagaaaatgttacacatatacaccatggaatactatgcagccataaaacaaatggatgagttcatttcctttgcagggacatggatgaatatttgtcacacagaatatttgtccatcttctagaaatgtttgataataatgtaacatggaaaatgaaaaacaaataattcctggaggaacatctgtgagatatatatatagatatatatatatatatatatatatatatatatatacacacacacacacacacacacacatatacacacatatatatatagcatttacatatatatacacacacagcatttatgtatatatcacatatatcacatttatatgtatcacatttatatatagtgaaaaaatattatatatgtgatatatacatatgtgccacacaaataaatactatttagacttaacaaatgaggaaatatattcagttgcaacaacatggatgaattttgaaggcattttgataactgacataagaacagaaaggcaaatactgattttcacttatatgtggaatctgaaaaatcaaactcataggagtagagggtagaattgtggttgctgggagctgaaggaaggcaaggaggaaagagaaatttttgttaaaaggtaaaaagtttcagctagacagaaggaataatagatccagagatctattgtatagtatggtgatgataaatgataatattgtactgtatacttgaaaattctgacaatagatctttaatgtttttaccacaggagaaagaaaacataactctgcaaggcgatggatatcttaattagcttgatttaatcatttcacaatgtatgtgtatattaaaacatcacattttgtaccaccaataccttcaattttaatagattttgggaaaattatataaatggaattgttggtgatgcacacataaatcataatcaggtttacagacatttcaatatccattattcaaaataaaagcagctgtcaatttttaaaataaacttagttactgactacattttttattggtaatcaaactgatgttcatgctgatgttgagtgcaaaaaaagatttttcaaataaaaacctcgatgtgacagagtataaaaatattctctctttgccccatcaaacagattttgatagaactttgaagaactgcagaatttatcttttaaaaagatgatacgagaaaaaagtagtaatgagcatgaaaaaccttatgtatttattaactgctgtataaaatactaccacaaaacttaggctatcacagcaatatacattaattatctcagtttctttaggtcagaggtctaggcacaaattaattaggtcctctctcaaggctacagtcaggatgttatccaggtctgtggtctcatctgaagactgaggatggagtatttctaagatcacatgctttttggcacaattcagcttcttgagaaatactggtgcaagggtaccagtttctacctgctgttagctgaaggacaccatcaatttcctgccatgtgggctcttacagcatggcagcttgcttcatcaaagcatgaaagcaaactaggaaatagagtctgttagcatgtgcaagttacacttaacctattcatggaaattacattccaaaagttttgtcatattctgttgtttagaaacaagtctacaccatcccatactcacaggaagaggattcaacaagtgtctgaataccagaaagtggggattattgagagacaatttagagccaccctgccacaacttagccacattgtatttaaggatttgcttcaataatgagaaacaaaaatgaaagaagggatttttaaaaaatgaaaaaagaccaggaaaagggaaagaagccagggaagaataggaagatgagatgaaagaataaaggcaaaagagaaaaaaagggaagaagaaatgaaaaaaaaaaaagcattgagcaaagtacaattaagtgtgtgtaaagaatataaaatgaaacatcacatttttaaagtctattattgaggctaaaataacatgcattgagaaagaagttatttatcttacaaattcatggaataaaacaatcaaaaaattaattagtctttactcaaagtgggatagggagtgaggactatttttaagtgggtaagaatttctctacttaatggtgaagaaagatgtatattttctacccatcacttcattatttaaaacattttaaaataaattgtttttccttaaaataaatcttgagtcatggttaaagacgtaacaactttctccaagacataaaaaataagttaagatttgtgaaccgtgcatatttgctcttagttcccagctaaatttcagaattttatgtatatgagtgtctagacatggatagacatggatatttatcatattttaactacatggttctctgtaaataattgattgattcagcatttaaaaatgctatgctgagcctcatttccttatgtaaaagtgtgaaaaatcaataattatttcatagtatcatgagaattaaaaataaacttggttagaactttgctgaacactcaggtggtatccactaaataactgctgaatgaaagaattcgtgttatatggcattatacaaaccctatatctaactaagttagagtaaaaatctggttttagaaattttagtcttcatatctaagtcaactttcagttctgaaagatatcattttgctctaacttgttttattttcttttattatatgctggaaactttggaaagtgtattaaaaaatggttagttccttcatttattcaaaaagtatttactgagagccccgtgtatcaggcattcttacttctgaggatgaggcactaaagaaagtgaactccctgcttcatggaaatggcattcatttacatgtagaggcatgtataagataaatgcatatatatctttcttgaaattatttttataatttatctttataattatttttatcaattattccatataattcataagtggtcttacacggtattgacaatataaatactcttagtttgagttttaatatactttgatagtaacttatttcttattgcctcagagatttgttacagcatttcatctcatgcattatttcccaatttctgcagattcaaaatgtcttatatgtagtattctggcagaaacaatgcagacagaaattgaatcaaaaatataattctcataaaggcaagtcacacaaagcataaagagaataaatgtcatgctagcaatttttgcaataattttctctcttcaattaatcagacactcaattggctcgaaaaaatatatatcatctaggacaagtcatccatcttggttggcacctaaagtagatgggccatcctttactttatagcacttcaactacataaacctaaaagataaaatgaaattctagacacacaaggttaaaggacagcagagtcgggtttcatcttctgcaatattgttaaatggtcaaggtgaggaacaaaagtaatatccatttttttgtgtgtgaaatacaacacaatgtgaaccagaatgtcaagaatgatgaatatcacagaaatcctctcatacagaaaggagtttatctgcacagcattttcagcaaataaatcacagtttcattctttctttccttttttttttttttaacttcacttagaccaagcagtgagtcaataacttgcagtcagggttaactcaaaaatttagactgatatagccacttatttgactgaatatggtcatttttaataaaaaaagacattttgtatcatgttaagcaaaatcattgtttatatatgtgttgaatttggtaatactgagacatttatgaagtaatgcagtttgtactggatgctttgccttcctgtctctgagttacaaagtccctatatgcatctttagacattaaagataggaaatataccactgtttccataaccaggtggggtatccagggagaatcggaaagttgaacaaatgttccaatggaggaggccttgaactgggcattgagattatcattcgagtcactatgtaaatacagatcacagaaacaaatgaagctggttgaccgtaagagaatagagaagtagaggacagacagcaacatacataagacacaacaaactttgttatggttatgctgctaatgctttgtaagaagagtctccttttgccatttacgtctgattgttttggtttcttttacctacagagaggaatgcgaaataatattagcttttattaaattccactaggtaacttgatactatatttgttaaggtagctcagaaagaagtttaaatttgataatataaatgtcaatttatattaccaaatataaattttatagtacagttaaaaatataaaattaatttaataaaatgtataacaggctgggcgcggtggctcacgcctgtaatcccagcactttgggaggccgaggcgggcggatcacaaggtcaggagatcgagaccatcttggctaacacggtgaaaccccgtctctactaaaaatacaaaaaattagccggcgcggtggcgggcgcctgtagtcccagctattcgggaggctgaggcaggagaatggcgtgaacctgggaggcggagcttgcagtgagccgagattgcgccactgcaatcctgcctgggctaaaaagcgggactccgtctcaaaaaaaaaaaaaaaaaaatgtataacaatatttcatataaagcacaaaataaaatatataatataaaaatcaattagatgtaatataaattgaagtttcagatttcttttaatggaatattctgaaaaagactgttatcaagatgatgcttactaacaggtttctagagaagggtgtccatttccttttctaagatatggctattccgtatgtgcaagctctgtagtttagcacacatttgaattgtttatggaacattccacccagtcaatcaaataaatcctgaatggtgcacagagcattatgtgtaagatctacttaattatgaccctctgctgcccttaaatataatgtcatattttaaagtctaggatgagaccaccttcttggattccatgattaaaatgtctaattgttaggtcagagccagacccattctctggctctttcagaagatatggaaatatgtctccttacatcttctatctgaaccttacttatcttcacttgaagatagagaacatgagcaaaaatatacacttattggagtaacaaaagctatctggggtaaatatgaccaatttatgtaatttatatttaaatatgaatgtacatctaaaacatgaatgttaatagcattacatatctatatacatgcgtatacagtttgccagatgctgcttcaaaacattgtcatcataccttgtttgcagaaacataatgtttatgtttctacatatgtgtgtgtatgtacctatatgtgtgcatgtccgtatctgatctattttctattttatctttattattaaagttagcaatgacagatctatatttttggaagacagaagaagaataagttagtgactaatctatgtgagctgccttttagtgcagaattcgtgtctctgagtaagttgctgagatgtatagacaagaggtatatgctgagatttaaagtctgggatgtacagtggtggaccaaattgtctacattgctagtccttagaagacagtagtcattttttcctgaaagaaattaaacaagtatgtaaacataatgtctggtattaatagactttgaatttaaaatttctttaactgaagaaaatataataacaacttaaatctaaattcatagcgtgcagagtgggtagagagaaatagtgttaatactgaggaaatataaaaatgaaaactgtattcttagttatgaagaaggctaaggcgaaaggattgcttgagcacagaagtttgaaaccagcctggcctacatagcaagactccatctataaaacaaaaaggaataaaatgtaatataaataagctaagagacttgtatcataaagcagacataacccctggaaagcaattccagaggataaaggaataaagaaagggaaaaacaaacaacagaagcattttctttgagccttgagatttaaagtgcttatcaagtcccagagaggattgatgaaaaatgacaaacaagtcgtaataccctgatacaaatctttaattcaaaatagataaaatcttataatctttagaatagaaaaaaattccaaaaaagtaaagaaatactgccaatcctggaaattctcatctacaaactggaaattgaagggcaactgaataaaattaatggattatggagagaagtcatctgttcatcaagaatgccatatacagccaattgttataattctagtttaacataaaaggaagatagcataaaatgtgaaaagtcaaagctgtatcttccatgaatattgtctttggacaatactagaataaaaccaggaatcttcagcaatagtccttccacagaaacatcaatttgaacaactatctacaaaaaagaatactttccaaagagataagaaatccaagtgggagatcacagtacctggttgtagcacaataatgaaaaatatgcattgaagaaggaaggtaggaagaatattcttagattacctgcatcactctctcctgaccccaggcagcacagcacaagagagaaacggtcttcttgggggaaagagagggaagtgatcaaaggactttgcctttgaaaactcagcactgagcacattatcatgccccatattctagtccagtacctgaggaatgaatcactagacatgtcctggagccaggcaagaccacagagtcccaggcttcaggtatgcatggaggattcaatcataagcccacatcagtgttaggccagcttcagggaatttgagcccttgacagcactcagtggcaggcagtgagcgctacaatgagccccaggtatctggagcatcccagtgccacaactgctacattgagccctgggcttttgaaaacaccatgctggccagccacgtctatcgtagggtgcttttgtaccccagtgccatgcctgctacaaagctttctcagtcaaagccagtctgcaaagattaaaataaatacttactaattcaaatgtgcagacatctacacattaccataaagttaatgatcaatcaggaaaagatggtattatcaaatggacaaaatgaggggtcagtgactgaccccaaaacatcgagatggattgattgactttctcacaaaaaaaattgaaaattattctaaggacactcagcaaagttcaaaaaaatacaggagagccattcaatggaatgaggaaaatgataaatgaccaaaacgagatatttaatagagggattagaatgacaaaggaacaaaaaatcaaagagatgtcctgaagtgaaaaatataatgaatgaaaccaaaaatgcaatagcggatcaacagcagaattgttcaaacaggagagagaatctgtgaacccaaaaacagattatttgaaaatagtcagagaagaacaaagaaaaaggagtgaaaatgagtcaagaaagtttatagaatttatgggacagcaccaaaagagcaaatgattgagtcataggggtcattaaaactgatactatagaaatacaaaggatcatgagagattgttatgaacaattagacacaaactaattggaaaaataacttaatacatgcaacctaccaagactgagttatgaagaaacagaaattcttaacaggccaataatgagtaaggaaactaaagcggtaataaaaagtcccccatccaagaaaagcccaggagttgatgtcttcaacgatgacttctattaaacatttaaagaagatctaataccagttcttctcaatctcttccgaaaaattgaagaggagagaacaaattgaacagtatattttacaaataatttatgatgatcacgtgggatttattccagggatgcgaggatgattcggcatacataaatcaatagatgtgatacatcaaattaatagaactaagaacaaaagccatatgattatttcaataggagcagaaaaagcatttgacaaaattcaacatcctttcattataaaaacactcagcaaattagatataaaataaatgtgtctcaacataataaagactgtatatgacaaacccacagctaatatcatactcaacctaaaagtgtcttctctgagatataaaaaatgaaaagaatgccaactcttgccatttctattcattatagtacactggaggtccttaccagagcaattatgcaagagaaagaaataaaatgcatccaaattacaaaggaagaagttaaatcatgtctgtttgttgatgacataattttatatgtagaaaactaaagactccactaaagtgctgttagaattagtatttccgtaaagttgcagaatataaaatcaacagataaaaatcagtaatgtttgtatgcacaaattgcaaacaacctgaaaaagaaagcaagaaaccaatcctatttacactagctataaaaacatgaaataattgaatttaataaaggaggtaaaagatctctacactgaaaactacaaaacactgattaaatagactgaagaagacataaatgcatgaaataacaaatgtcttgtgttcatggattggattaattaatattgtttaaatgcctgtactctccaaagtgatctacaaatttaatgcaattcctattaaaataccaatgatattcttcacagaaagagaaaagatcatcctaaaatttgtatgaaatcataaaagaccccaaatagctgaagaaattttaagcaaaaagaacaaagctagaggcattataccacctgacttcaaaataaactacaaagctactgttgtaaacaaaacagcatggtactggcataaaaagagactcaaaaactaatggaaaataacagagagctcagaaataagtccatgcatttacagccaactgattttcaacaaagaagccaataatacactatggggacaatctctcaataaatgattctggcagcactagatatctgcatttagaagaatgaaattaaacccttatctcatactgtatgcaaaagccaactcaacagggattaaagaattaattacaagacctaaaactatgaaaccactagaagaaaatatagggggtaacctctatgacaatgacattgatctgggcaacacttttttttggttgttgctttttggggtttttggtttttgttttttttttttttttttgcttatggctccaagaaaagcaaaaatagacaaatgggattacataaaacttaaaagcttctgcacagcaaaggaaacaatcaacagagtaaaggacaatctagagaattggacaaagtatctgcaaattacacatctgataaagagttgaaatccaaaacaaatgaggaactgaactcaatagcacaaacaaaacaaaacaaacaaacaaaacaaattgccccaattcaaaattggacaaaggacctgaaagatgcttctcaaacacacacacacacacacacaaacacaaatgaccaataggtaaataaaacttgcttaacaccattaatcatcaggagacatcatacctgttactgtggctattatcaaaaagacaaaaaattacaagtgttgctgaggatgtagaaaaacaagaatcctaatgcactgttggtgggaatgtaaattagtacagacactatggaaaacagtatgaagtttcctcaatgttggaaacagcgagttccttttcaaaggttctgcttgtcctctatttgcaaagcctaacttccttgcctccttgcccctaattatggtaaacaagcttccagccattcccaatctgtaattcacatctgttcccaacttgtaacccacatccattcccaatctgtaacccacatccattcccaatctgtagtccacatccattcccaatctgtaacacacatctgttctcaatctctaaaaacccacgtctgttccttatttggcacccttagttctgaaactgctcttcctgctgctgtagcccctacccctgctccatttgaagtaggcaattgggatcagcttagattgtgcggtctgaccccagccaacggggaccggacacagtagcagggactgactgaattagggataaaaacccctaccctcctttgtttggtgtgctcttgcagtgaccagaagaatgagcagcacccttctgcagaagtaaatttgccttgctgagaaatccttcatttgagtgctcattttctttgagactctgagctcttatttccaacacttaaaaaaaattaaaactagaactaccataggattatgcaatcccactattaggtatatatccaaagaaaataaaatcattatgtcaaagagatttctgcactctcatttttattgaagcattattcacattagccaagatatgaaataaatctaagtgtccatcaatggatgaatgaataaagaaaatgtggtacacatatacatatacacacacacacacacatacaacaaaatactattcagccataaaaaagaaaagaattctgtcatttgtgatgacatggatgaacctggaggccattattttaagtgcaataagccaggcacagaaaggcaaatactgcatgatatcatttacatatctaaaaacataattgatctcacagaagtagagagtaggatggtggctaccagaggctacggtggttgggggttaaggtggtgttggcgaaaggatacaaaatctcagttacatagaaaaaataagctcaagagatctgagtagaatttagaatatattgtattcttgagaaacgctaagagagcagatgtaaagtgttctcagcacaaaaacaataactatgtgaggtaatgcatatgttaactacatatgttaattagtcattccacaatgtatatgctcttcaggacagtatattgtacatgacaaatacatataattttgtcagtttagaaaaacagaaaaaaaactaaaaaattaaattgaaaaataaaaatagatgtgagatagagatagaaaagaatataaaaatagatctatcagcaaacacatgatagagcaaggactgatgatgattgagggaagagtgttccctgtgagcaaggatatgcaaatctcccaaaggctgaggaatctaagaggctgaagaaaggggatgataaatccagtttcttagaataaaacatttaacagagacttaagaacagaagccctgtgttgggggccactattcccaaactgttaccccccagacacagggcctatatccataaagaaagtgtatatgtgcttcagaaggaatgtgtagtacaattgaagtatccctcagggaaaggcatgaatgcttaagggcaggatttaaggtaagtacatgctcttacacaaggaactttagataaattcgaaatcttagaggtattcctggaactggggttaatctgaagtcaacatagcagactagcatccaagatggagttgctttagcctccacagagaagattaggcaagtaaattgtcattaggtgaggaagccacaagcacaagttactttttatatagtgaacaaaatggccgtaaggttctcctcagtttgactaaaccttagacaggtttcttcccgactataggtccatggcctctcgtttcttatgtttgccttagaaaatttgcaactatttatctgcttctttgagctattaatcttctcttagcctcttgccagctttacatggcaggaacaactttcccaagaacctgggagaatccctatgaaatgtaatcatcaagaacgacagggcctctgtctcccagtttctgtgagtgggtaagagcctaacttcaataagcaccaatcagcaacagagatggcctaatcaccttgaccaacctccccactaatgtcctctagtacttttccattagctcctcctgttgcttaaaaaccctctcaccttttgtttcagcaaagttgacgtcactgcctactgcctcttccctattgcaatagtcttgagaaaagtcttccttgcctgtttacttcatctggtgcaactttaatttcttttcttttttttaatgagtaatatattgctagagaagaagcttaaattatgaaaaaccatgataatagaattcactgcacttctgatttagaatattcaagttaaaatccacaattttcttatttcaaactttagaattgataaatttaagtgtttgccattgcacacaatactacagtaaaatgggcatcaatttgaatctaaattgctataacattttttggaaaaaagcctacagtatatattaaaattacaaattcacactctttgatctagaaaaaccacacttagtaatacaacctacagaaataaaagcaccaatgcctgggggaatatgaacaaatatttttagtatagtgttattttaatggaagtaattagtccatttaatggcaagagtttgaacaaatatgtgttacatctacacatcatggaaattcagaagcctttgaaaattacttaaatgtttattatactgacaataactaaacactaatgactaatctggagatatgaactaaacattaagaaaaataaggtactgagtagtataggctatatgaaatttactaaagttatacgacaagaatctctatctatgttcctgcagaggtatagagaatgaatactagcaagccaatactggatttttcaggaatttggaaataagagaaacattagaaaggacaagtaacagttgcatatttataataaaaatcgcatcatttctataggtattgtgtacacatataattttattactttaaaatatgataaaacatttctaatgaaaatccaattttgctgacattgactaattgtgtgtgagatcatttaatggacactaactttatgatacctataggagaaaaataatgcttaaagggaaaaaaatatacaacactggtatatctttataaaaatgtattagaaaaattataatatatatttattgttcagtaacatcagccaatgaacaaattaattgttgattttagcagtaggaaaatgtcaaactaataacttataagactacagggcacatgaactaatttgctaatctaccttagagaacctatgttagaggaaataaagaaaatcagagacctattccaaaacgtattcctcgaactatatctactaattatatgctaatatatgtctctagttaataaagaaggatgtaagggtatcactgggaatggtattttgtattaactttctctgttaatcatgaatattaaagtaaatatttataaatgcaatgattttcaatttgtgacggatacttagagagaagctttattttgtaatttactgctatctcccataattaagatctaaatgtaaaagtcagtattgaacttactaaataggaaatatttctaaacaaacaattgagtgggtattaatttttcttaatttgtcttctgtattttcaaatatacatgctatctaatttaaagaaattgagttttattaattgagaaaataaaattgtgctaatctgcttcaagcgtgaagctggctctggtttcagagcttacaaatgatttcagtaaaacctttctaagcaataaagttttgctgctttgctcaataaacaattaaatattgaagacaatgcagtacagcttcactcctatgtatagcaccattaaagcatgaacacagaagggaaaaatatctttaggaaagcatacaagatgacaatactcctttttgaaaagaaaacagttatcacacatatttcttttattcttttctttctttcttttttaattgttgttgttatcgttgttgttgttgttgttggtttttggacggagttttgctcttgttgcccaggctggagtgcaatggctgcatctctgctcactgcaatctccacttcccgggttcaagcgattctcttgcctcagcctcctgagtagctggggttacaggcatgggctaccatgcccggctaattttgtatttttaatggacacggggtttctccatgttgttcaggctggtctcaaactcccgacctcaggtgatgtgcccacctcggcctcccaaagtgctgggataacaggcataagccaccgcgcccggctttcacatatatttctattttagaaatgtgtatttctaactgagtcaaatggctccattactgtgtattatgtgtatttctaactgagtcaaatggctctgttgctttaaattatgcaaaggcttaaaaagaagatatgtatctatgctgatatctgattagagtagaatcagaattcattactttacatgcatttatttcacactccttgataggaactattttacaatgacatatatggcaagaaatactttccttgtatcttcaagctgcttctaaatctaatttacaacatgcgattgtatttgtattcctaattaatcttcaattatgaagtacattcaatgggattaaaatatttttcaaatattgttttaggttgctgggctgatgctgaagaaggggaaagattttaaactgtgtataacagactgttgattttaagtcaaatcatttaatacctgtgcaattgttattgcttatctttaaattctgaactccatcttttattccaatggaaggtgttgatgtatacattttcagaaatttaaatataaatttacatacttaatgaatgagaattagtattttgaaattttacttccagtaacttcattatttcttttagatattaacttaatttaatttttatatttcaagacttatatttataaatgccagctattgcttttaatagcatttagtgtttgttaatgggaaattcaaataagtttaactcttccatctagtccttaacatacctcattttgtgctgatgcctaatggagaaaaataaataatatatatgatacaatttaatatatatattatatatatttctcacttttagttttcacttagcactgggtgtttatacacacatacactcatatacatatatacgcattgtatatgcatatattcatgtgtatgtgtgtatatatatatagcacttatttaaatggtaagaaagaatatgagtgtgtatgtatatataaccaactggtggtatgtttaaacacacacacacatattctttcttaccctttaaataaatcctattcatttaagttctatacatgtttctatgtatatatctaagcaaacctctaatttgcttttatatattattgtataatattccataaaatgtggctttctactttctactctctttcaatgatggattctgtagcagaagctttgaatgaactctaaagccatttttatccctaatatcaatctaaactacatagtgtacatacagcttttttacatagataaaactaatatcttctcaagaactgagcctcctgtaagcattcactattctcattcacaccaccagttggttatattagtgatgacagagagatgtaaatacctcctagctgccaagatacttgctatggaatgaaacaaaacaggaagaaattgataaagtgaaaataatatcaataagtctttaaatatccaaagatttcattcatgtttctctaatagatcaatgcacactcttcggcatatcaacaaagaagtatttgttttccacttcctcttgactccatataatttactttttggaaatgcaaattaataactcattactcattcatcattcatccatgaattcagcaacaaaaaatattatgttctactataatctagacactgtttttagaggtagggatatagcagttaataaaatggaaaccttaatcaggctggtcaggaaaagactcattttagaatgtgagatttaaacaatgacttaaagaaggtgagaaacggaaccatacctatatctgagaaaagagcatttaggaaaataaagaggaagtgcaaacctcaggagagggaacatgactgataggttagccgtaaagtaaggaacccaatgtagttagagaagttggtaagggagagatggggtggggttggagagagagagatagcaggagtggaatgggttacctagggccatgtagtgccctggaaagacctttcctttgtctctgaataaaagatggggagtcaatgaatgctttgtggcaaagaagaggaaagatcaagtagaaatgttttggagtactcaagctacttgcagacacatttgtaaaaattataaaattatactgcaaaataagttagtaaattattatttaaatcattatgcaagaagtagcatggtgtagtgcaaagaatttctttgaaagagcttgaaaatgtggaatttttgccatgtctgattaatgatctctatgagcctgaataaggcaaagaatctctttggtcttagctttctattggctgtgagagattgccaggtgtgatttcccaggtctaaatttctgtaactttatgctctggatcaactccttatgccttattccagctgttagataaataaatcagtagttgtattttacttaattagtcaatttgtcttttgttgtttgaaagacatttttatttccttcattcttatttttcttgatattaggttaaaaaatgatttagtgataaaagagagtatagtaatatttttagaagttcctgtcattttttcttcctattcttctgcagagtcaaacacttttaccgaaattaattcccaagcaaattaactaaagcatatagtaggcttttactcaagtgcatagatacaaaggatgacaatagattgagaggttataatttcacattttaaaatgaatatgtatttatttaagctagggtagactgaaatcaagttagaacagtagtaggagtgaataagaactgaaagaaatgacatttggatggaaatggagttactccatacaaaaatagcattgtctaaaaggcacatctatttgcattaaagatgtggacagccagaagccacaaagtaaaagtgtgggtgccactgggtctgtggtatgcacttcggctttgtaaaagctacagctatgacaacaacatttattaggaatccaccatatgtatgcactggttcctctcctctgtgtaaaacttctaactggttcttcttgatatatttttaaaaagactgtctaatattagcccaggaaagcggatgtttcttccatctgaagttccaaattatatttccccttaaatctataccttacaaaggtcaaaatcttgaactattctgagaattccctaccaggttattacagctgtcactttcaaataactgattaccagccctgccatactccagttttcaattgaaaaacgtgaatgacaacaattttgaagccgtacatttttaacgttttgcaccaaagctcaactctcaatataacatatttcagcataatgctgtgaaatgttatgaaacatttctcaaatgtatgaatgcagccattaggaaactgatttttggatttagtgtgtgtaatgttgtttccatacagaatccataacggtcacatacaaaactcattcatttcctaaataggtttggtgttgttctgatgtacagagctaaaatagaaaaccaatagcatttgtaactttatcagatttctctcaaaggttaaaactattttcccaaggtatataatattaagctaaatacgaatgcattcaattaaacaatatttagtacattttctatgacccaagtataaaatggattaatattttgcataacaataagagtatttttgacattgctaaccttgatcataaaataatacagttcatttcattcataatagcagtgaaggtattaaaaattgtgtggattttatatactttgtcctttattttagagactaagttcggcaatgtatttttattgaacaagattttctatcaaggaatatttaaattctacccaggcgtatttaaaagctgttgagcagatgctggaatagggtggctattatgatatgtaaaatattgcccttgttcccaagacactttctaccaaaaaaaatattttattcattcattcaccaaatagttgtcaggggcacactatccacctggcacaggtcacaaggccaatcccaaactaatatagctcacagagatgacaaggataagaaacatttactgtcatcaaatatgtagtatggatgcataaagaaaaatgactaaagcaccacatgagtaaagtgtcatttttgaatcatcagaaaataaaaacttgcattctacaaaagagccaagtaaacttcagccacaacaaaatatactgcaaaatttcagtgaaacatagagattttgactcccaattttataataatggaaatttagtaaccacctaaaacaaacatttttcatcccctttttattttttaatttttttttcaagacagggttttgctctgtcattcaggctggagtgcagcggcttgatcttggctcactgcaacctccatcccacgggttcaagagatcctcccacttcagcctcccaagtagctggaaccacaggaacatgccaccatgcccagcttatttatttatttatttattcattcattcatttatttatttattgtatttttggtagagacagagtctcaccatgttgcccaggctgctctcaaactcctgagctcaagcaatctgcccacttcagcctcccaaattgctaggattacaggtgtgaaccactgctcccagcccatctactttataaaaacatataggtacatatatatatatggagagagagagagagagagagagtgagtgagagagagtctcaaaaattaaatacataaaatacaaaaacaattatatttttagttttatatattacacataaatattgtgatcaatttataaaaagaaaactcatttcagacataaggtcaataaaataaaaatggattcagagaaagaaaaacaagtaagaaagaaatgaacaaaactagtacatccgctctacatacacacacacagacacatgcatgtacataggcaaattagtgcttgtgtcaagaaataacaatgcaaatattcaaatcagagactgtataaattgcatttgtatgatctggtaacctcatgtatatataagtgtgataaaatttcattaaaaattattccaggaggcttatttcataacactaggagagtgtgcaattaatggagattgagtagatatttttccaggaagtgggtattgaattccgccttggataggttgaatttaaaccgcttgcaggaaatccagatgaagatgtcaataaagcatcttcaaagtagggaatgcaattctcaattttggatcatctaaaaagatttgaatgatctacatagatattcaagtcattggaacatataaaattctaaaaaatgagaatagcttaggaaaagagtaacaaagttatcagtgtacaggtctctgaaaacatatgtatctagagaaaaaagaaggcaaaataagagtaattttggaaaaagagtaaaatgaactattgtttattgtttgaaagagaataattctttaaaaataagaaatcatcatgaatgttaagtgcactaggaacgtaaaactgattaaagaccacatacacacacacatgatttctgagttaagagactgttggctaacttaaaaatatcatgttaaccattagagtgaaagctaaactggatgataaatgttgaaatatgaatgtggttgaataactaagaagtgtatactgctttggctaatatctgttttaaaaaggaagaagaaagaggaagagagctagaggcaaaaaaaatgtgggtgcaaatattttaagaaacagcattttaaattacaaacatgaagatagtatatctgattaaatgtcaaattgttatgacagtaagacatctcattgagaaaggagcactttaaatatatgaaaggacgtgttttaaaagactcttcagaagaatttaaagaagaaaaagtgtacttagtctttgtcaatacaatgacaaatgtatgatttttttcagcataaaaagtccattcaataaaaacatgtcacattagtttattgtttaggtttaaattaaatagcttttattaatattattttgattacatcattaaacaacaaacaaaacacttgaaagtgtttatattatcaatgcaacaatttgctttaaaactttgaaaattataatacacaagctgccaataaaatatttttctaactggggagtgagggctatagaattaatggaaaaaaagtgatttgaaatgtatcataaagattcatttttaattattgatatcacaatttctacattttagtcagcagtaacaaaaaaggccaatgttagttcatttaagcaatgaaataaactaatatcctcattatccaaatactcatagaatcatggataatttgaagagatttctgccactgaagccagttcatgaccgattatcttacaaatttataacatttttgagctagacaatatgtcaactatgttcaactatattatttgagaattcaaagtagagagcagtaggctaccctatcaaagtctcagagaaaattgtgaactttgttaagtcacctgcttgtatgatagctcagagatcattccaccgcaccatggtgataccataagattcagaaactaatatattttaggatcatattaatcattaatacattctatattttccaaaatgaattatactaaacattttataacaaccccaaaagtattcaaaccacccacccttctaggagtaaatattttagtcataaatgagaattatttaataaaagttttctgtcaggtcacatattactcagcatgttgataagctaatttttaaaataatttagaagtatcctagataaggcagctacgtaatttaatatgtaaaccaggacagtttggagagttaacgagatgccgtaaataattgtgtagaaaccaaggcataaaccaagacgcatggtcaccttggctacaggttacactcatttgactatttttgcctgtttcactagatatgagacaacatagaattaagctctttctatgaaagaaagggggtgtgtgtgcacgtacttatgttggctttctcatttggttattagtaggaaatgcctttcttgctatgcactctcaactccaacttcaaagtcatacatgtatatattattttcttggcacaaatccaatctattaactaatgaaatgtgaaatcaaaaaggcacaaacgagctaaattggaagcagcaaagtccgatgatggcattcagcattcaaatgcctatataggagacatgaaggtaaagaaacaaactttcttgtatcttttcctgtgtttataaatgataggatgtgaataatcactaactgttttcatttagatgtgcaagttacccttgggcatcaattataacctgaggacataagcaacagctaaaacctgacaaatgtgtgtgtagaaagtccatgaaaacataatcactgtcccatcaaagaaggaacaaagatatcataaccaggcaattgggacaccttgtcagttatgcataaattggttaatcaagaaaatagcttgacataagggatgccacatcctgaaaaggctgctaaggggacagaatcttgacttcaatttggacttgtctgctgtaaaccttcgaaaatactagaaggccccaaggtgtgtggcagagtcaattcataaatattcaaatgccaagcaataaaataattgctaaaaatactctcatgccataaacaatttttttaagtttttaaacagaataatttttttaaaagcctctaaaatatatctataacataaacatataaaaggtactttggatttgttgtttttaaaagtccccaaatacaaatttcctctaattctttattcctgagtcatagtcctgattatccttccatctgcaggagataatcatctagttcatctactgttccctccaatacagtatgctccaactgaatacattgctttttaacactgtcctctttgctgtttcctcttttgataacaaagcctcaattcaggtacttcggcattattatcacaggttggagtctcaaaagcagatgctaagatagtgtctgtgtatattttttttaaaaagaaactactctcatctgttaaaagaagagaaagaaacaagattgggcagcaggactggttgaagtgccacgctggctccatgaagccacagacaaagttctggagatagaatgacccatcttcagatggtccttggccaccttaaagtgcctgggccattgtatctcctctatgatcagtcactgaatgcaggccgccctagggaagggcataaccttgggagacctgtgagccctaagtgaactcacagctgcactgtgagttccgctggcctcactgggggcagcaagtcctctgaggatccatcactggattcaccacattctgcatctcactcccatattcaagcattcactcactaggtccagtaaatgttgaccgtaaatgttttctatctgttacttcccttacagctttgctgcgactaccttgatcctggctgtcctttcttctttcttagtatttctgtccaccttcttgcccactttcacactaaggcaccctgaatgatcttctttcataaacttcttaaattacatagcaccttctccctgcctcctagataagattcatgctgacattgaccaacctctttaaacacctgctcatctacaaactgaccaattgaactgttataattctctccctgtgccatgctctttaatgtctttatacttttgttcaggctctttcttctgatacaaatgttttcttttgcccccctctactacaagaacccttctgctcaccagttgcaatttatactgttctttgaatcagcaacattgaaagcaaaagcctcagcacatggccgtttgtatctttattcatcggagtgtaacaaaggaatgcacaattctagtgaagtgcctggtacacagagacacagagaatatgctttgccttgtggtataaggaaaaaaaataatgagagagagaaaaagaaagagagagggagggaagggagagagagagagagagattacagagacagagatagaactaagatatggacagatacacaatcagctagttaaaaatgacatattttagtcacagaggtttttaaacaacccacttgctaaaaagaaattctgtgtaacatcaagaaatttactttacttttctgagtttttttaacctaatatgcaaaatgtagctaatgatacattacagaaattaaatgaggatgcttacagtttctagcacacactttgtgctcaataaatatgattattacagctctgggttctggggtcaaatgaatgagatttctgtctcattcatatctacaagcaagataagtaacctgtttttaaagtttttagaaaagtttgcatgaaaatcaagtacatcagtgctgcttaagatacttataaatattaggaataaaatggagagaataaaaattagatgtaccatgcctctacattaaagatcttacagttttaaaatcatagctgttttataaaaattaggtgggaaaatatcattccttaatgtaaagtttctgtgagtgttttattaagctgctatttttatctaaacatatacttagttatatgctgatatgaaaattatttctgagtagaactaagtggcttttagagtggatctagcatccctgattatagctctatggggtaaagctgattcaaaacaattttctgcagcgaatttgagtcctgaatgtggaaactctcacagctcacctcagatgactttaatgagattttcagcctctatgaaaggattataactctaccccactttgactgctcccaaagagcatggctctgaattccaatggccatacagaagagctgtattcctggcattttccagagagtaaaatcttcagtcaatgtcagccaaaatttactaaaagaattatgatactaaatgatttgcaaggacacagtacatgccgtctttaaaattgtttttactaagttgtgattgtgtggtgatgccttcaaccttacataacttgttgttgattctctgtaaaggccagtggagtaggagacacaatgtgtatgggtgctttgagcaaagggattttcaactatttcttctttgatgcatcccaagcacacagtatcatgcctgacaaatcctaggttgaataaatatttgttagatatatgactccacgttattacactgtcctcatcaggagaccatttgacataaataattctaattttataccaagaaatattgtgtttttcctaaacaattagttgatttatatattgaggccatttaagattatgatgaaaaagagtcttcttgcatattaatttttaaaatcttggtgacaaactgctatcccaaccctagtaactaatatgggtcattttggcactcagtgtccacttaattaacagctgtactttgtagtaacattataatcattttaatttctatatatttttgctgctttcttttagtttttttttttttttttttttttttgagacagagtctcactctgtcgcccaggctggagtgcagtggcgcgatctcggctcactgcaggctctgcctcctgggttcacgccattctcctgcctcagcctcccaagtagctgggactacaggcgcccgccaccacgcccggctaattttttgtatttttagtagaaacggggtttcaccacgttagccaggatggtcttgatctcctgacctcgtgatctgcccacctcggcctcccaaagtgctaggattacaggcgtgagccccccgcgcctggcctagattctttttaagtcatatgagattctagaaaagcagagagaaagagatgttttctaaattactattctagagttaaacaggatgtattataattttaatgggtgttttccatgaagagtattacagtaaattgtgtaggatcacagacatttccctaaggatcattaatctgtcattatccgattgccatctgcattccactgctaacagaaggatggctcaattattttgaccatgtatgactgggatgctgttacctttattaaccattagttgtattatttttattaaaaaagatatcctcaagaatgagcatgagatttatttgtaggtaatccaattgttctgaaattaaattaggttgatagttgtacaacccaataagtacactaaaaaccatttaattgtatatgtaaatgtacaaattatgtaaattgaattttgaactcctccttggattctaagagataattcaggataatctccctatttgcagatccttaacttgatcacatcgacaaagcaatattccatgtatcattcacaggtttcaggaactaggacatggacaccatgggaaggatattattcagcctacaacaatgcccacaagggcaaatacacaaacacacacacacacacacacacacacacacacacacatacacacagagagagagagagaggagagagagagagaaagagagagagagaggagagagaggagagagagagaggagagagagagaaagagagagagagaggagagagaggagagagagagagagagaaagcgagagagagatgacttcctatatgagagaaaagcagagaaagagaaagacgctcaattatgcaacaagacagaaccatacaaaaatgggagagtttgcaagccacttatgaatcaaggtatacagtattgtaccataattcacaaataaatacaaaggttaactcagctaatatattgaggctggcataagaaaagctagttctggtaacaaaaatattccaaaaatattccttcttctctaaggttgttgtgtaaacctatcagattagtaaagaacagaagaatatgtatgtttctaaatgtttcaaggattaatagaacaataacaaaaagaaagtgtacgtgtttaagaatcacagaaccacataaagaaaaagtgaaaagagaacaaaacaggtaaaatagtggatgaaaagtatggatatattgactaaagtaaaaaattgagtaagctaccagaggttaatcatgagcctcaaactatttttattgtataaattaatgatgtagaacatgatgtctcgatatacatatatataggaaagtgattactacaataaaaccaattaacatttccctcatctcacagtcaactgtgtgtgtgtatgtgcgtgtgtgtgctaagaccacctaaaatgtattctcttagctaatttccattacaccatacaatatcattaactatagtcctcatgttgtacattaggtatctatatgtattcatcctccataattataatgctgagtttattatattttaaggttagtcaccagggaagtctcattccaaatgagtttcctgaggtccaaaaagtaccttgattgatagtttctgccagtcaatattcttccaaaataaaccccttcagtaagatgtttaatttgggaagggggaactaaaccaaaattgtatcttaaatcctctggctcccaaattctgccgttaataaataaacaattatcaagtttaaaaaaaaaaacatggacacggtggggggcatcacacactgggggctgttggggggtggggggctgcgggagggatagaattaggagaaatacctaatgtagatgacaggtcgatgggtgcagcaagccaccatggcacatgtatacttatgtagcaaatctgtatgttctgcacatgtaccccggaacttaaagtataataaaaaacaacaataacaacaacaacaacaggccaagcgcggtggttcacgcctgtattccctgcactttgggaggctgaggtgggtggttcacctgacgtcaggagtttgagaccagcctggccaacatggtgaaaccccatctctactaaaaatacaaaaaattagccagacatgatggcagacacctgtaatcccagatactcaggaggctgaggaaggagaatcgctggaacccagggaggcagaggttgcagtgagtggagatcgcaccactgcactccagcctgggtgacagagtgagactctgtctcaaaaaaaaaaaaatggcaatggcaaaaatataataaaccattataattatataggggctcatctcaccaaaactcttatatctaatttgattccaccacagttttacactttcccttttagcattttcaaattctcttgtattgcatgtaagaccatccaatagcatctacccaaaagaaaaagccaattggtcttgttatccacatgaccaccttgagagcacattgcagcttagagagcacatggtattgtgttacttatggcatcaataacaatgtctaactcacacaaggtttaatcttagtcatcttttatcatcatggatgttccctgggctctttctaatctgatcatattgaaatgtgctgtcctgatattttatgaactagggcaaagtcacccttactcaccatccgaagtctcagatggtccttcttacccagtaataaaaatgaaaattattttccttggcaactcaggcagtattctggttaattatgtggatgtaattcttagattatttgcatattttatagctggtaatacctttactttactgccagctctttaacatactattttatatttactttatgttattttgtcacattttaagaacttactcaattcatctgaaattctttctgttacaaatgtggatctaaagggaagaggtaactttcacgcaagtagagagtttatttgagccaagcttaaggattgcaactgaagagcatagattcaagttgccctaaatatatattctgattaggagcaattacaagtaggattttaaagaagaagaagaggtagtttctaagttctttgccatgaatttacattaaaataacataaattattgattggctatacatttttatttgtatcagaaagctaaggaacataaagataatgagtaaggcagctattcaggaacaaaatacctttaaacaattgtgggccgggcgcggtggctcacacctgtaatcccaccactttcggaggcctaggagggtggatcagaggtgaggagttagagaccagcctgaccaacatggtgaaacctcatctctactaaaaatataacaattagcctgacgtggtggcacatgcttgtaatcccagctactcaggaggctgagggcaggataatcgcttgaacctgggaggcagaagttttagtgagctgagatcacgccattgcactccagtctgggtgacagagagagactccatctcaaaaaaaaaaaaaaaaaaaaaattgcctctgggcatgggtacatggttgtggtgtggtggtctagggaagttcgtgactgaagtctgatacttatgtctctctgggcctgataaattttgcatacctcacacagctcagactgctctaagctatttttctcttctcgcaaggcagattctacatacatttaaagaacatgtttacatttttaaattaatttttacaatatttataagtggtaactatatatcaaaatatgatgtgtccccaaaactattatgatcatgcagtgccagcttataaaatggaagctaaaaataataaatacacatataattgaattagttatcttttgaaatatttctaaaatggcttccacactacgctcgatttagaagtagatatacaaaccctgaccaaaaaagggtctcattcagaatacattacttgcaaaaagattatacattacgattaacaaaaatatactagataaaatgagttttcagtagatatgttataaaattgaatataaacatattgagtacatattttgcaagatgttaccatcaggagaaaccaaagaaagcatccatggaatcttctattatttctcacaacttaatgtgactttacaattatctcaaaatgaaagcattagttaaaatgttagataactctcgaaaaatgataattaaaaagtaaatatacccttttggctttcttttaaaattttctaaatgtattcattcattattcatttgttcatatagttttttatttgttttcttgtcacttaattacttatcaatttcaaaagatattttgtgatatatttcacttactgtactttattgctgcaaatattccaaactgataataataaggaacttagatagtctcttatctgtacataagttagacagttaaaaagttaaaagaaaaaagttgctatttgtttctttgtaaatcagtagctttctgttccctaccaaacactaatccatctttttttcattaatatatttgacaaatatttattaagcagctatctgcagattcctgctgttccaagcattgagaattctggtgaaaatatagtttcttctctttacatcagatgtatggacatgaattggagagttccacacataaacaagtagaaaaatataacaagaatatattttcaaatgcctcagagatggcttctactttccccttcaagcttttcccctttgtgtattccatctcttaggacaatgtttaacagcacgcttgttattgtgggattgaaagttctctgttttggggagttgtgaagtgcacgttatcagcatcctaggccactacatcccatccactacttgccagtagcattcacttctcaggtggtgaaaacaaaacagtttgcagacattactccccttggtggagaagggtagaattgtggttgtatatcactgccctaaagacttctgaagtttttgccccaagggattcacataaatgccccaaggacctcagagtgggtattaaacttttttatcaagatgataaattctgaaggtagactttgagaagagagaaagtgccatgtttttctaaatttttagactaaagtcaaatgaggaaaaaaaaggcataaaataaagtcaaagaagggatatgaaactttaaaatacttctgactctaattctgaggagatgaatgccttctggagattttttgagtagaagactaatattatatgaatttagggtgaccaacttattctggtttgcctgggactttcccagtctttgttctaaaagtctcatttcttgtgaaagctcttagcttaagtaaaccagggttattgatcacactatataaattttattttaaaatgattaatctgtggataaagaaaatgtgatatatatacacagtggaacactaggcagccattaaaaggaacaaaacaatatcttttgcagcaactgggatggaactggtggccattatgctaagtggagtaacacagaagtggaaaaccaaaaaccgtatgttctcacttagaaacggaaggaagttatgagtatgcaaaggcatgcagagcgatataatgaattttggagactcagaagggaggggcccagggataaaaatctacgcattaggtacaatgcacaccactccagtgacaggtacactataatctcagattttaccaatatataatttgcccatgtaacaaaaaaccacttgtaccccaaaagctattgaaataaaaaaaagaaaaaagctcactctgtttaagaatgtatggtagggctagggttgacggcagaaagtggaaagtattagaagacaatggtaataatctatttaagagatgacggtggcttttccaggtgatgttctgttccatttggggcatatggagcttgagatgtgtgttatatattcgacttgaagtgtcaatcgacattctgtacaaatctgaagctaaggaacccggatgtaactttgggagtagtcagggtttttaaaaaccatgatgtttaggttgaattgagtaccgtcaaattcatacatcaaagtctcaaccaccagtacctcagaatgtaagtatatttggagataagctctttgaagaggtaattcagttaaaaatggggcttttagggtggagccctaatccagtatgggtgatgtccttattagaagcggaagagacattcgggttgcacgcacacagagaaaaaagccatgcttggacacagcaggaaggcaaccaacttctcagaagaaactgaacctgctgccgtcttgatttgggttcccaaaactgtgagaaaatacatttctgttattgaagtcactgaagctgtgttgtgttattatggaagttctaaaatgtgaatatacatggttttagatggtatgccacgtaaggtgagctcgtaaatgcaggacgctgagtgaagggcgctacacaaggtaaaggctgggaagaagaaccaacgtttgtcagaaggattgtaaagttacaagctgatgcaatgcaatagaaatcccgaaaacatacaaaccaaaaaaggaatgaggaaagatcataaagataagaggaattcaaggtcattagggttagaataggttattatttttttttaatgtaagaagaaagataatatttttaaaacatgtttgagtcctcaagtggataaaagcagaaaagcagaggtccctgggttggtcttttttttttttttttttttttttttttttgagatggagtatccctctgtcacccaggctggagtgcagtggcgcgatctaggctcactgcaagctccgcctcccaggttcatgccattctcctgcctcctgcctcagtagccaggactacaggcgcctgccaccgtgcctgcctggcttttttttttttttttttttttttagtagagacggggtttcaccgtgttagccgggatggtctcgatctcctgaccttgtgatctgcccgcctcggcctcgcaaagtgctgggattactggcgtgagccaccgcgcccggcctgggctgtttgttcttttacacaagagaaaagatcatttatccttttttcacagtaaacaacaacaacagcaaaaaccctggagtccatgcagatagcttactagattttgtgacgatgagtttatttttatatgaaggtgtctattcatttctataaataagaaacgagaggaagaaggttgatggagcttatatagattggaagtgaagaaacatagtattacctctgagagttggaaagtgaacttattaagaaaatgtaggagaatgaaaagtcctatgtgtgcttgtgaggcatttactcataaaattaagatgagattcatcagaaaggtgaaggtctagaaaagacatatgtattaaaatgatggattagaaatgtagactggattctatcctagctacaaaaaaaatgtattttttagagttttagggaaagtttgggacaataatttttgggctttagggggacaacttggaaatatattatggatgaaggtttcaagatggaagaggaacaggagagtaataaaagatggcttttagattttgtgattgaggaattagtggctgcattgccagacacctttcgcaaactctgtgaaggaggttttgaaatggaaattaggagtttcattttttttttaattcttttgcagactgctaatacctgtcttactctataatgtcagggtttaaataggaacaagatcagccagctaacgggaacgtttcttagcctctcttctaagtaggaataaaaaagtaacagagtcctgacaagagaatgtgacaggggctgcctctagatcttgttcttaaagaattgggttcctcagatgggcaggtgaatacctaccagtgcatgagccagaaacgaatgacatgaattaaggatgccaaaactattaaactatctccaatacatactaatctaagactaaaaaaaagagaatgctaagagtttttttttttttggttttgtattatgctattaaatagctcataaactcattgataaaagctttagatacagagaacaacccatttccaaataagtccccccaccaacacacatgcacacatcacaaaatatgttaaaaataaaaagtttgtagaagactgcctttgcattcttcatattctactagttatcacacaatcactcagttccatataatgccaatattattttattttgttcccttaggcccaaataatgcttaccttgcattcacagagaattttactgtaaaattaaaatattgtctgattcctcaaaaacaaccaaatacatgatgtgattgatttttattagttacttttgaaaccaggggtctaatctgtaaatatacctcatgttttgagattccaaaattgtatctatacccataataccctatgattctaaccctaattgtttaatgtttatgttgttatttttacataataaaaacaaaataataaagaaggatacagttcatcatctcgatatgtaaaaggtctataatgaggttatttaatactataatgatatatatttatattcaagtaggaaaaaagacatgtcagatgaacagttccagaaactaggaatgggttacataatttattatttttccctctgctctaggatgtgtgttttggctttactctaagatcatggtatcataacatttcatgtgtccagatatcaggaggaatattgctactctactagatgagaaatgtaccactttaaagacattagtggactatttcactagatagattaactattaaaagtaagcctagcctgtaatcctagcactttgggagaccgaggtgggcagatcacccgagctcaggagttcgagaccagcctggccaacacggtgaaaccccgtctctactaaaaatacagaaattattcaggtgtactggcgggcgcctgtaatcctagctactcgggaggctgacacaggagaatggcttgaacctgggaggcggagattgcagtgggccaagattgcaccattgtaatccagcctaggctacagagtgagtctctgtctcaaaaaaaaaataaaaaaattaagcctaaaatattttattacagatattatttgtaccttctaattgaaagaaaacatattcacaaatatatattatgcacatataaacactcatatatatacatatataacatgtatacataaatttacacacacatatgtatttaaagagattataagacaaccaaccatgaatacagagaaagacaaagtgatagaatgtcatatactagtagtttttgttaatttgattgtaaactgaatacgcagttcctgtaactgtggttgttttcacttaaaaggggtataaaatgacaagttctatatacatattttaaaaaatacctacttttacctgcaagtgaaattcaaagcataatatccaattgcacaataaatacttcttgctcatgtcataaatggcactaataatagcatttataataaaaattagtaatgcaataatttgtcttgatgccaagtgacatgaagttaaattttgtttttaagcaaagagagtacttaaggcaactgtgaattggcatcagtgtgttgacagacagcaagattcacttgcaatctgtatttttggcctaaaactacaattcagtgtttagataataagtcccataatcatccaggcaactaaggcaaataatacattttctgaacctgtcctcacaagtttttctttcttccatcttaatttacaaattcctgaacacttaatggggaagaatcatttgagttgctttgaggaaatgaaagaactgaaatagcctttattttgaaaacaatcagtagagtaacttcgatgtgccaagtggagtgtcaaatcaaatcactttagaaagcggtcctcatgtgtttaagtttcattagccagtgggaagaaatgaattcttgttactatctacagctttgttgctggtatattagaatctacagagacatcacatggcaccaataaacctggccaatttgccttttttgggctgcctctgatatcatcagctcctgactttttgcttcctgcaaagattagcatgttaccttgatgatatactattcaggaacatatgtgcactgttgcaatcaaactgtcagctcggaatcaaagttcatttccctcatgtgaaatgtgcagggggaggctccttttccctatatgagtatcatttatcaaagttccatttgaagattgcatggcctcaaaagtattataattttgttccccaaagaatgctcacaaaagtttaatgcatctggaattgaggcaatccaagtaacaggaatcaagctgtacctgaagccattgccttctcagccctcaggcactaaggggagattttcttccaggggccctgtggtgccagccttgcaatttgcctttagaaagagtctctttcaatttgtcctcttcatccaaacatgacatgcttgtatatgtacatgtgcatgtgtgtgaacatatttgtcaaatgttgagactattttaatcatttacatattgtgatcatcaggcttgtgtaacccgatcattaaaatatgcctgtctggtaggggaaaaaaaaacagttaatggctttgctcatctaatgtatgtgtcaatgtctctgttttgggacaaaaaaatgatttaaaatgttaaagggcctggaaaaaagcataagattgtttatggcaatcttatgtaatatgactttacataaccttagttttcaagggcaagctgaaatttcatatcacagccaatctgtgttatgtgacaacaaccaccacagaaaaatcagagctacttagatttttagatttaaagcaaatcaagaaatattttagagatgttaattcagcactgtgagttagagaaaggataagtaatatagatgggtgctccagttatatgaattagaacagaaatagaatcattggcgatactctaataacaggagagaagaatagagtgcagcagaagcaaagggttaacttgaaagctgggatgtcaacctttcttattccctttttagaaagaaaatgacagaactcagcaaatacttcaagaccaacatcctatgtgggaagaaaaggaataaaaggcaacgcagtttacacagatgctagcagcacagtacggaaatttagggtttgtctatgtggaaaggcaaacttctttgcttctaagaatatagtttctctctcacagggccccattactcagcagcatagtaactgacagtacaatgataaaaagtaagaattagataaaatcaggaggttcatcatgcaaatggaaatcaatagaaacattatattgtgattagactaataacatatttttcaaacatatgggcaaattatatttataaattctttagtaacatttttctttcatatttgtttattacaggggtatatgaactagatgaaaaaatatcaccctttccattgggatcatttcagggttcctttagagtgagtgatggaagtgggaagagggagggggagtgagagaaagaagaaaaggggaaggaagaggagggagagaggaagagagagagaggagaaggaagaataaaaggaagagaaacagaggaagaggaagaaggataaaaaggggaagagacgggagcaggagaagggagatggagactaactgacacttgcatctattgagcagtagggggatatctgggagaccacattctcaagccttgagcctgaaactaatgaaactcttccagaactaaacccacttaggtcctcccttattctgacacagaatgagggtttgagatttgttccccatcaccagtttttgacttgtgtcctgagaaggtggaaaaatcagaaaactagagagtaggacaaacagaattagccaatgcctgagaaggaagcagaaaacaaaatgttaaaagtgaaggaattaagtataggtgacttgatgtttcacataggggagagtttaaaattaatatgtcttattgaactaattaaaagttgttaccacaactcaaagtcactctgattttcttgggtgataaaattgtaaatggattatttgattcatgcaggagaattttttgatatataaattcattatttgaaaatttgaatggcttttctctatttcatgtcacattgataaagcatgttataaaataaaggtctcagatttttatttttcaagtaaaataaaaatatgtaggatatttttcaagcagagcatgcatgcatatgtggaatacaaataaacaagtgaacaagcaaaatcccaggaattaaaccaacatttatttactgactatagatgtctttagtatttaacttcatatcagaaagagacttgagattaaacatttcacatgagatcgtttgcttttctctcagtatgatttagcctaggctaaattgtacagtgatgactatcaaatccaacattctctgaggctcttaaaaaacaaaggtttagtttttacttatagtacttatttgtcactatcttcactgtgagctccaggctagtggaaagggagctctatctaaatcatcagttttctataattcctgaagtgggggtcagaacatattttgaataataacaatgcagtgtatcacagttcaactatattatgagagggcaaggtaattattccaaatagtcctatgttgctctatgataacttgcacaaaataaacagtgaataggcattttttgactaaaggttcagatcaaaataattatcattctgtgaaactttcgttttagtaaaagggttgcacaactgataggggacaggaaggaaattattgtttttcaaaaaaataaatttaataccaaaggctataaatcatgctgctataaagacacatgcacacgttgtttattgcggcatttttcacaatagcaaagacttggaaccaacccaaatgtccaacaatgatagactggattaagaaaatgtggcacatatacaccatggaatactatgcagccataaaaaatgatgagttcacgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcacggcacatgtatacatatgtaactaacctgcacaatgtgcacatgtaccctaaaacttaaagtataataaaaaaaataaattaaaaaaaagaaaggcatcactatacttttgcatttttacatttaagtagctttttttagactatagatggaattaaaatttttatttttatgtacttattttgtaatatcttagtgcagaccttttattcagatacccctccaactccagaatagcaagcagcaacgtattattaaagaaattattggttaagtccagaatataaattacttattattatgattaggagagaggtaatttatgagagtaaaatttcagaccaaaatctgtgtctctaatcttgatagaacaattgactatttttacaataagcaaattcgatatctatttcataaatagcaaattcgttatctatttcataaatagcaaataaatggacaacctcagaatatcattttaatgagtgcgactttcctgactgtaaccacacattcagtattcactgaagcttcctgtgtaggatgagagtcaggaaaacttaaaaagcacttaaaaaccatagcagacaatggaaagtataaaggccatttaggtttcagaaagagaagcataacaatatgccttcaaaagattctcaaaaggcaccagcttaggattccgctcatggagttaaggccaagcattaaaaagtaaatgtatcagaagcagcagaaaagtcatccctttaagaaaatctgaaggtttcataaatatatttcagctttatttaaaaaaaaaaaacatggtaatctgctttgatttaatgttattcacaagagcaagaaaaaattctcttgtgaaggttaggactccagaaatactttatatcattattttctctgctcatttggcttcagtgccaaatacccagtagaaactcaataaatttaaattgatgatgatgatgacgatgatgatcatgatgataactgctctgagacactcatacacatacacggaggttgaaaaatcagttattaggtccatgtgcactttaactttgaatctgtctttctaaataatttgaaatcagatttattttcttttgtgtctgctatattttgatgagaagtgaagaaattgcaggcacagactttttattgatgaagaatttatttattaggctcattcactgggcaggtgagtgagctatcttttttgatctcgcccactgaattctggggcaatgagcccttgtacaactgcaaactcaattacagcctgaattaatattttacacattaaatttcataagttatacttggttgaacagagtaactgaattaaaatatgatttataattaaatccttatcaatcaccctaaaagtgcaaccaatctgtatatttggctcccagttctcatttaaaattgtgaaatgacttgtcaggtaataagagtaatcagttttaggcaagagaaaattgcttgctgtaatacagtcccatttgtaattgatcagcaatggcacaatgatttatcattcatgagatgtataccacatcagaaagcttaacttacacagtgaagcattcagtctcaaatgtgaaaatattttacaaccgggacaggtctatactctgtatgtttcatgttttctacctcttagaaaatttgactggattgacttcctgttatatataattcatagtattacaattaaaatttatattagataaaaacatatgtgcagctttattgttgctcttataaaaatactttcaaaccattaataatgtgaaatgtgtcaacactggctacattggagaaggattacttttatacatttactttttattaacagaaaaatgcagttaattttatctatttgtctctgactatgaaatactcatgagttatcagaatttctaatagaagattatatattttatgtttattggcataaattgtttaatatcacacatggaaaataatgacgtaaaggctcaaatttgaaatgggcttctatatgaagaatcaagaaacatatcgccacatgactagtgctctgtaagtacaaggcccagggaagacagaaaatgagagaatggtgaaacatgattaagagaaggagacagagagttgtatcacaataaacacaagactgagtgttggtacattttcaggttttttgtttgctttgctttaagttatagaaagaagagggagaaggaacatgttatacatcacaagctagagttatatcctagagcactggtttaggtttagtgaaattacttgtgctcttgaatccttcatttcttcatctgtaaatctgaataatagtaattgacttgcccaaaagtcttgaggcccatcaaaatagtaaatgtgaaagaaattatcttaataatttagctccattggaacatgttattattgtaactttatatattaaatgttttttgtttgttaagttttgcataggcatacaacacatttatttcttcagcacaatgaacaaaattcacaatgattagatgacttcagtgatgacaagtcttgcaatgatgatattataacaaagcaattttatttaaactgtaggtcataaagattcaatggggcaatttttactaaaattactagtaaataggaagttaggaatgatttcagttaatcttttcattttaaggttatggaatttttatcttattggtaaatcagcacatatatttatgtataaatcattatcattttttattcatgagaaaaagctacctagctttatatatctatatgtaatagttaaaatatccttgtttttactactttatttaggaggtgaccgtgttaaccctcttaagttagattgcaacatatagaattctgtaagtcagattttgaaaagttactaagttatcatggttgtagattaccttactgagtgtatctcaagttctaaaatttaaaaaagagtacatatgagaaaactttaaactttttattacaataaataaccaaatattttattattttataaaatatatttagatattttatctgaccacttaactataggaagcagaaaaatgtatgtatttataattattttcagtttaatgtggcttcaaaaataaataaaagaatttatacctgatcacaattattgcagtggcctcttctgtctgatacgttctttaagaatagaacacagtaagtttctttattctaaatctgaaactgaggtttccatcacgctaatttgtaatcaaatataatagttcacaggaaaattagaggtcagtttatattaaacagcataaacccaagctggctaacttaataaagcatgatgggatgatcattatctaagtggggggctgacttaaaataccctatacctatagaatgccattcattaaaaattgactcaagatttatacctgtaggtaataattcaatatcagtggaaatcagggcatgtgcctcagcagcagaaattaacctgcaagaaaatggtcgtgttttggtgctgggtgggagacttttctctaataaagatctgcgagtataacatttggtgaaatccccaaattgttcttttacttatatacaaatgatgttaaaatataaatcataacaaaaacaagcttcctttgattacactaaaatctatattcattttatgtgatataatgaatacaagttatagtactaaacctcagagcaaaaagccagaaaatatattaaaaagctcgctcttagaggaaaagtctaatcagatactacttagaaatctcaatgacgaaggctttaccatgttgatttcaaataataccacatgaaaaaaagtatgttgtattccgaaagtaaatatatttatgtgttatatcacattaactatacaaaacaaatggaaggatctaaatttacagtatcagagatccacagtttagaaagtagaacttcattcaccactctgaatcatttctttgtgtaagtaatgtaaaaacaaaggtaataacggccaggcgcggtggctcacacctgtaatcccagcactttgggaggccgaggcgggcgcatcacaaggtcaggagatcgagaccatcctggctaacgcggtgaaaccccgtctctactaaaaatacaaaaaaaatctactaaaaatacaaaaaattagccgggcgtggtagcggtcatctgtagtcccagctgctcgggaggctgaggcgggagaatggtgtgaacccgggaggcggagcttgcagtgagctgagatcacgccactgcactccagcctgggcgacagagggagactccgtctcagaacaacaacaacaacaacaacaaaaggtaatcacaagtaataaagctaatcaaaataaattcattggattaatgagtgaaaaagtcatagtgcatttgatcctaaaaggaaatgggcataaataaatctaattataagaggtcaatatcatatatgtcactgtgaaatattgtattattcaagatactaagtgcagttaagaatagcttttcccccgttctcacctaatgtcagtatttggaaacaaagcaaaacaaaattcattctctcaatcaaggatttatctatttcagcaggactgtaatttcccagttggctattttttttttttctttctttttttgagacggattctccctctgtcgcccaggctggagtgcagtggcgcgatctcggctcactgcaggctccgccccccggggttcacgccattctcctgcctcagcctcccgagtagctgggactacaggcacccgcaaccacgccgggctagttttttgtatttttagtagagacggggtttcaccgtgttagtcgggatggtcttgatctcctgacctcgtgatccgaccgcctcggcctcccaaagtgctgggattacaggcgtgagccaccgcgcccggcctccaggttggctttacatctcatgaaactacaaagaacaacagcgttaacattctagacatctaacaacacatcacatcaaatatatgctcaaaagtatcctagacacacaggaatgtagaacaagaaatagacattaggaagaaatgtttcctttcacttgtgaaaaattgtacctataaaatcctgtcaaattctgtgtctatacttgacagtgaaaatgtactgtatatcaaaccattttcactgataatgatcatatgaatgtggcaaggtttaatacttcaaaatatccaaaaggcagtgttgtatatgttgtgtttcacttattccagctatatatatattgtatgaaagcctgattgtgaaaatatttttatctatgctagacagcaaaagcatttaggcaaattatattgctcaagaaatcttacaatctttttcattttctaattagtagagaaaaaataataaatttgggggatttttttttattcagtggccatttcgtttcatagtgcttatttctcatttgtttggaaggacatagttcttttaaagggcacgagggtgcagaaaaacttttttctgcttgacgagacatttaatacaatacaaatgtctaattggtgtcacacaaggtcaggtggctttgtccccacactcgaggactcctgggaaatgaaaggtcaacatgtaatgtcttcagacttaccaagaaagaattttatttcttccccaaagacacaaagtcatttttattataaaaaaataaacaaaaatgtcatcaattaaaatggtaatttttttcataaattgtcagtattttattattttgtattaaaatggcagcttaccatgagagccactgaccgggagataaaatttgtgcctctgtgtgtgtgtgtgtgtgtgtgtgtgtgtgtgtgtgtgtgtgcatctgtgtgcactaaactgaaagtgttttaattatgacaattgcattttggcatcaatttacataaaataaacttgatgccttctgcatatcttaagcttcatccacgtaaaataatttattcttttggagggtcatagagcgctagtcctggacaaaaagaaataaatagacattattacttttacctcttactactccattacctcccaagttctaaaaacctgtaactctcttttctgtcttcttcttttatcttaagtcatctcctgataaaataccctggaccacttccctctctctaggttacatgacatgctttaaatttttaaaaatcttcgcttaaacaaaattaccttgtcctttgatctccccatgagaggtcttagtagtaagttctaatttgataaatagattccaaaaatatgcttatgtaataaatgtaaatgtatcatagtagtttattatgttagctggctgtatatccattcaaaaacagatatatgtattggaatgataaagcgtgagtgtgtaatctaagaatattagtcacagtggcttaattaatattgtttggaaatggaggttggaggcaaggattaggcagaaaaaagagaaaaaacttcactagagcttctatctataaatcctcctgggccaccaaatgtagaggctcacacaccctgtgtactttataaacttctatttgaaactaaatgattgtcttgatcttactaaatcagttttttaaaaaaatatatgtttaggattttaattctactactgttcatacatagttactagttattgtcaaattgcttcatttagcacttatgatttatgctttaaaatattatttgtttaagatatatcagacatataaaggaggtgcttaggttgaaatttgtttatttgttcaccacattcattaagagatacttcatggatttacagtatgtgtcgttccagagagccatacatctagttattaattattggggaaactttagtctgtgatcctctgctaaaaataaaatggaatattgatatgtggcaacaacttctaacatttcttcaggcggtatttttaaacactaggtgagagttactaagaatcagaaaagtggttgaatagcatagaagcagattggagagccatttgtgccataaaacaacaggatttggtgtctctaaagatgtaagaaggagagaaatagaaaaattgatgaaggctttgaatagctacatctggcaataaaagaaagtgaaaaaatataacaagagagtaataggttgtggtgagggaaacaaagaagctgttgaagtagatttgagatcagatctgtcatgggcttttaagaaatctatagtcaggtgttgagatgtaggacttttttgcatagggcatttcccaaggaagttggaagaataagaagccacaaagtattggaaaggaattttgagcccactaaaatttaaattccacagcaggatggtagtaaaaaacagaacaaacttagaataaatcctagaaaggcaaaataaacaagacaagagaagagagaatttaaagaaagaaggatctcaacactgagtaattaatatattacaggctcagtgaattaacattcaattaagaatgatgaaattgaccctgataaacagtgctatggcatggtcaaatgatatcataaaaattaatgctagaacatggttaaatagaatgtaggttaaaggcaaaacaaactaaaacaaaacattttacctgagagcaaatgtcagacttaaataggattcacagagaagctgaaaaattttaataccagcaatagagaaacctcctttaaaaagctggattgagaaggaaacaagaaagtaaaaagctacaatgcttcttgagtcacacaattattcaatctccgaccaccctgagtgccactgtttgtttctaaccactagaatatggcagggtgggtggagcaagatggaagaatagaagcttacatcatttgttcccgctgccactagaacaccaaattttaacaaccatctgcacacagaaaagcagaatcatcagaaccaaaaatcaggtgagcaatcatagtaccttgttttagcttcatatattaaaagagtcattgaaaagagtaagacagacagttaagactcactgatgccatgcctctctcatcccccagcagcggccctgatacatagagaatctgtgcactttagagagagagactttgtattgaactcagcagtgccctatcacaacagaataaatccatgttgtgctcagccagcgcccacacatggagggagcatttttgaccagccctagccagagaggattcatccattttatcagtgggaacttgaggttcttggcaggccctgccactgtggactgaagtgttctgggctcctaggtaaacttgaaagccagtctaggacacaaggactgcaattcctaggcaactccaagtgctaggctgggcttagagccagtggactagggtggcatgtgacctatggagacaccagctgtggggctaaaggagtgcttgcattatgcttcttccaacctcaggcacttcagcttgcatcaaagagactgactccttctttctgcttaaggagaggagaatgaagggtaaagaggactttgttttgcatcatggataccagctcagccacagtaggatagggcaccaggcagagtaatgaggctaccattccagtttgtagctccaggatgacattcctagacacagcctgtgtcaaaagggaccccactaccttgaaaggaaggatccagtactggcaggatattacctgctgactaaagaacccttgggccctgaataaccagcagcaatacctaggggatatgccatggtccttgggctatgagatgcactggcttcagaggtgacccagaacattcccagctgtggaggatatggtgaaagactccctatattaaagaaaagcaggggccaagcgtggtggctcacacttgtaatcccagcactttgggaggtcgaggtgagtggatcacgaggtcaagagatcaagacaatcctggctaacatggtgaaatcctgtctctaataaaaatacaaaaattagctaggcatggtggtgcacatctgcagtcccagctactcgggaggctgaggcaggagaattgcttgaaccctggaggtggaggtagcagtgagccgagatcaggccactgcactccagcctgacaacagagcgagactccaaaaaaaaaaaaaaaaaaaaagcagacggaaaagtaaagggaactttgtcttccactctaggtatcagcttgactactgtggagtagagcaataagcaggccctagaagtccttgagtccaggcataggctcctggacagcatttctggacataccatgggccaaaggtgagcacactgccctaaagtgtgagtcccaggctgggcagcatgcaccacaagctgatggaacggcctttgggcttcaggtgaacatcagcggtagcctagcagaactccccatgggttgttgttggtggtggccacaaggagaggctcctctgcctgtggaaaggggaaaaaataacaagactggctttgcattgtggtttgagtgccagattagccccagtaaaatagaatatcagataaattgctaagttgctttctttttactttaattcctggctgccagatagcatggctggatatccctgggtcctgggggagcttgccattctaaaggaaagggccttaggcaaggcatagtgctgtgctagattcagggctgactcagcagtctcagtggtggtagccacacgtgtgctcgcatcaccacatctccagtgccaggtggttcagcacagaaagagagactccatatctttaagagcaaggaagataaaagaattagagtctctgcctggtaatccatggaatgcttctagattatatctaagaccaccaaggtggtacctctacaagtctacaaaaaccacatcattattggactttgagcctaagtctctttgaatacctggaaagccttcctaaggaggacaggcacaaataagcccaggatgtaaagaccagatattgatgaacatctacaagcatcaacactatccagtaaaacatgacctcaccaaatgaactaaataaggcatcagagaccaaatactggagaaacagagatatataacatttcaaacacagaattcacaatagctgttttgatgaaactcaaataaattcaagataacacagagaagtaattcagaattccattagatacatttaacaaacatgttgaaataaccaaaaaaaaatcaaacagaaattctgaagttcaaaaatgcaagtgacacgctgaagaatgaattggagtattttaacagcagaactgatcaagaagaaataattagtgagcttggagacaggctatttgaaaatacactatcagaggagacaaagaaagaataaaaaaatgaagcttgcctacaggatctataaaataacttcaaaagggcaaatctaagaattactgaccttaaaaaggagatagagaaaaagacagggttagaaagtttattcaaaagataataacggagaactttccaaacctagagaaagataccaatatcaaagcacaaaaaggttacagaacacccagcagatgtaccctaaataaggctacctcaaggcatttaataatcaattcccaaaggccagagatgaagaaaatatcctaaagtcagcaaaagaaaaaaaataacataaaatggagctccagtacacctaggcagcagactttttagtgaaaaccctacaggccaggagaaagtggcatgacatatttaaagtgcagaagaaataatacttttaccctagaatagtatgttcagcaaaaatattcttcaaagattaaaaagcaattggaacaaaagcctaaattgagaagtgaaatttaattaaactgaagagcttctgcacagcaaaaagaactaacatcagagtgaacaagccacctacagaatgggagaatatttttgcaatctacccatctgataaaggtctaatatccataatctacacggaacttaaacatatttaaaagaataaaacaaacaaccccatcaaaaagtgggcaaaggatatggacagggacttcgcaaaagaagacatttatgcagccaaaaaacatatgaaaaaaagctcaacatcaatgatcattaaagaaattcaaatcaaaaccatgatgagataccatctcataccactcagaatggcgattattaaaaaatcaagaaacaatagatgctggtgaggatgtggagaaataggaacgcttttacactgttggtgggagtgtaaattagttcaaccattgtggaagacagtttggtgattcctcaaggatctagaaccagaaatatcatttgacccagcaatctcatgactggctatatacccaaaggattataaatcattctactataaagacacatgcacacatatgtttattgcagcactatttacaataacaaatacatggaacccacccaaatgctcttcaatgataggctggataaagaaaatgtggtacacatacaccatggaatactatgcagccatgaaaaggaatgtgataatgtcctttgcagggacatggataaagctggaagccatcatcctcagcaaactaacacagaaacagaaaccaaaaaccgcatgttttcactcataagttggagttgaataatgataacacatggacacaacgagggtaacaacacacactggggcctctcggggggtagggggcaatgggagggagagcattaggacaaagagctaatgcaagtgaggcttaaaacctagatgatgggttgacaggtgcagcaaactatcatgacacacatgtaactatgtaacaaacctgcacattctgcatgtgtatcctggaacttaaagtaaaattgtttaaaaaagtctcccagaaaagaaaagcccaggatccgatggcttcactgctaaattctaccaaacatctaaaaaagaactagtaatacttctactctaactgttgtgaaaaatagaggaggaggggacactatcaaatgcattctagaaggtcaatgttatactgatccccaaactagaaaaagacattcaagaaaacaaaactaaaggtcagtatttttaacgaatattgatacaaacattcttaacgatacactagcaaactgaattaaacaatacattaaaaagattatgcatcatgaataagttggatttatcccagggatgcaagaatggttcaacatacacaaataaatccatgtggtacatcatatcaacagaatgaagcacaaaaaccacatgataatttcaattgatgctgaaaaagaattaaagttcaacatcctgtaatgacaaaaaccctttaaaaattgagtatagaaggaacagacctcaacctaattaaagccatgtataacggaccacatgtagtatcacattgactgggtaagaattgaaagtctcttctcttagatccggaacatgacaaagatccccacagtcaccactgttatttactatagtactggaagtcttagctggagcaatcagacaagagaaagaaataaagggcatccaaattggaaaggaagaagtcaaattatctgtgttttaacagtaagcaatctaaaaaaaagaaatttaaaaagtaatcacacgtatgaaagccacaaataaaattaaatattaagttaatttgaaattaacttaatcaaagaagtggaatatctctagagtgaaaagtatacaatactgatgaaagaaattgaagagaatagaaaaaaaaaatgaaattccatgttcatggattggaagaaccaatattgttacaatgtccatactacccaaagcaatctacagattcaatgcaatccctatgaaaataccaatgacatccttcatagaaatagaaaaaacaatcctaaaacttatagggaaatacaaaagacccagagtaaccaaagcatcctgaacaaaaagaacacaactggaggaatcacgttacctgactttgtactacagagctatagtaatcaaaacagcatgatactggcataaaaccagacacatagactagagaaacagactagagaacccagaaataaatccacaaatctacagtgaactcattttcaacaaaggtgacaagaacatatattggggaaaacacagtctcttcaataaatggtgaggggaaaactggatatccatatgctgaagaaagaaactagacccttctctcaccatatacaaaaacaagtcaaaatgtattaaagacttaaatctaaggcctcaaactataaaaatactataagaaaacatgcagaaactctccacagcatttgtctggacaaaaatttcttgagtaataccccataacacaggcaaccaaagcaaaaattgacaaatggggttacatcaagttaaaaagcttctgcatagaaaaggaaaaaaatcaacaaagtgaagagacaacccacagaatgggagaaaaaatttcaaaactactcatctgacaagagattaataacgagaataaggagctcaaacaactctatgtgaaaaaaaaatctaattatctgattttttaaatgggtgatttggtttggctatgtgcccccacccaaatctcatcttgtagctcccataattcccacatgttgtgggagggaccccgtgggagatgattgaatcatgggggcaggtctttcccttgctgttcttgtgatagtgaatgggtctcatgagatctgatggttttaaaaatgggtgggtggatcatgaggtcaggagatcgagaccatcctggctaagattgtgaaacaccgtctctactaaaaatacaaagaattggccagacgtggtggcaggcaactgtagtcccagctactcaggagactgaggcaggagaatggcgtgaacctgggaggcagagcttgcagtgagctgaggtggcaacactgcactccaggctgggtgacagagtaagactccatctcaaaagaaaaaaaaaaacaaaaacaaaaacaagggggagtttccctgcacaatctctttttgcctgctgctatccatgtaaaacgtgacttgctccttcttgccttccaccatgtttgtgaggcctccccagccacatggaactgtgagtccaattaaactcctttcctttgtaaattgtccagtcttgggtatgtctttatcagcagtgtgaaaatggactaacacagtaaattgttaacagtagagtggggcaccactgaaagatacctgaaaatgtagaggcaagccactttggaactgggtaacaggcagaggttggaacagtttggagggctcagaagaagataggaaaatgtgggaaagtttggaacttcttagagacttactgaatggctttgaccaaaagcctgacagcaacatggacaataaggtccaagctgaggtggttgcagatggagatgaggaacttgttcggaactggagcaaaggtgactcttgttatgttttagcaaagagactggtggcattttgcccctgtcctagagatttgtgaaactttgaacttgagagagataatttaggatatctgactgatgaaattcctaagcagcaaatcattcaagaggtgacttgggtgctgtgagaatcattcagttttaaaagggaaacagagtataaaagttcagaaaattttcagccagacaatgtgatggaaaagaaaatcccattatctgaagagaaattcaagagggctgaagaaatttgcctaagtaaggaggagccaaatgttaatccccaagacaagggggaaaatatctccagggcatgttagaggtcttcacagcagtccctttcatcacagtcctggaggcctaggaagaaaaaaaggtttcatgggccaggcccagggtccttgtgctgtgtgcaatttagggacttggtgcctggcttcccaaccactccagctgtgatcaaaagtggccaaggtacagcttgggccatggcttcagagggtgcaagccacaagccttagcagtttccacatggtgttgagcctgccagtgcacacaagtcaagaattggggtttgggaacctctacctagatttcagaaattgtatggaatggcctagatgcccaggcagaagtttgctgcaggggtggggccctcatgaagaacctctgctagggcagtgtggaagggaaatgtgaggtcggagcccccacacagagtccctattggggcactgcccagtggagctatgagaagagagccacaaccctcaaaccccataatggtagatccattgacagcttgcaccatccacctggaaacactgcagatactcaatgccagctgtgaaagcagctgggagggaggctgtaccctgcaaagccacagggttggagctacccaagactatgggaacctacctcttgcataagtgtgacctgaatgggagacacagagtcaaaggagatcattttggagctttaagattgactgccctgctggcattcagacttgcatggggcctgtagcccctttgttttggccaatttcttccatttggaatggctgtatttacccaatgccagtaccccattgtatctaggaagtacctatcttgcttttgattttacaggctcataggcagaagggacacgccttgtctaggatgagactttggaatatggacttttgatttaatgctgaaatgagttgagactttgggggactattaggaaggcatgattggttttgaaatgtgaggacatttgggaggtgctggggtggaatgatatggtttggccctgtgtctccacccaaatctcatcttatagctcccgtaattcccacatgttgtgggaaggaccttgtgggggatgattgaatcatgggggtaagtgtttcccatgctggtctcatgatagtgaatgtgtctcatgagatcttatggtttcaaaaatgagagtttccctgcacaatctctatttgcctgctgctatccatgtaaaacgtgacttgctccttcttgccttccaccatgatggtgaggcctccccagccacatggaactgtaagtccaattaaacctttctcttttgcaaattgcccagtcttcatatgtctttagcagcaatgtgagaatggactaatacaatggacaaaatattggaatagacatttctcaaaagaacatatacaatttgcaaacaggtatatgaaaaggttcttgacttcactgattttaagagaaatgccagacaaaaccacaatgaaatatcatcttatcccacttaaaatggcttttatccagaagtcaggcaataacaaatgcttgtgagggtgtggaggaaaggaaacctttgtacactgttggtgggaatgtaagttagtacaaccactctgcagaactctttggagcttgtcaaaaaaataaaagtagagctaccatatgttctagaaatcccactgctgggtatatatccaaaagacagaaaattagtaactcaaagagatatctgtagtcccatgtttatagcatactgttccttatagctaagatttggaagaaacctaagtgtccatctacagatgaactgattaaaaaaatgtggtacttatacatgatggagtactattattcagccctaaaaaagaataagattatgccatttgcaacaacatggatagaactggaggtgattatattaggtgaaataagctggttacaaaaaggaaaatactgcatgtactcacttatttgtgggatctaaaaatcaaaacgattgaacccatggagaaagataatagaaggatgactaccagaggctgggaagggtactgagagggtggtgggaaactggagatggttaatgggtacaaaaaaaaaatagaagaataaataagacctaatatttgatagcacagtagggggactatagccaataataatttaattgtacatttaaaaataactaaaagtttttttgtaacatgaaggataaatgcttgagaggatgaatacccaattttccattatgggattattacgcattgcctccctgtaccagaatatctcatgtaccccataaatatgtacacatactatgtacccacaaaatttttaaaatttaaacctttaaacattttaaaaatttaaaaagaatgtggcaaagatgatggagtgtcatataagattctgatcttagcagaatggagatggaaattaacttgttggctttgaagaagtaagctcctatgttgtcagatggctgagtaggacaatgtggaagggaacaaatgggacctccaggagctaaaggtgactcccagctgacagccagcaaaaagaacagaggcttcagtcctattactgcaaagaactgaaagctgccaacaacctcatgaatttggaagaggacttagagttctataaagaacaaagtccagtgataccttcattgcaaccttatgactcctgagcagagaaatcagccaagctgcacccagactcctaacccattgaaaatgggacatgacaaatgtttgtttttttaagccagtaaatttgtagtaaacttctgcaccacggtagaaagtactgtctggaaagtaattttgtctgcatttttgccttagagactgcagtgctgagtgactaaacagacaaatcatgcccctgagctggatttcaaaccttaggttggacagttttttagtgttttaagtgttacttaaattctctacatcgtaatgactttattggtcaaggaggtaatatacttatatcatggggttgctgtagaggttaattcagttaagtgcttaaagcacagtaaatgttagctatacttataaatatttggttttgagggttctatttgtttcattttgttttaaagaaaattaattgaattaatttgtagactgaggagaagcaataaatgaagctaatgattcatgagagagatttttagggaacacaaccctagaggaaatcagatccagagaacactcagagtaaaggatgaggtaaataaatgtaactacaaaagggataatctagctttaatttattttattcatttttactagctttttgaagagtcaaaatatactccactgattttaatgaacaatattcacaagcctttagcaggtctttgaaaaacaggggaaaaggaatagatggccagtatcaggacattaataagcttttgtttttcatttaaaataaagagcagaaaagtgaaagacagatgttacatatatacatagaaaattgttttcttaataatgtgttgcatttccttaaaatttaaatttatgtcataattatgtattgctaatattttccatatatgtatgcatatgtgtatgtatgtatataagtacatttctattttactatctgttcaatggtttcattttaaacacttacaagacggaaagtcattaaattcaatttaatctggataatttttatgcttacatagtgtcttccattataaacgaattggagctatttgaacattttatataccttgagcattagcacttcagaaaaatgctttttccttgaaccttaaattatcaaatgtaggtttcttagctccatagggatacatttatagctattttcaaaaaattctgggctgggtgccgtggctcacgcctgtaaccccagcactttgggaggctgaggtgggcggatcacaaggtcaggagattgagaccatcctggctaacaaggtgaaaccccatctctactaaaaatacaaaaaaattagccagacgtggtggcgggtgcctgtagtcccagctactcgggaggctgaggcaggagaatggtgtgaacccaggagcagagtttgcagtgagccgagatcgcaccactgcactccagcctgggcaacagaaggagactccgtctcaaaaaaaaaaaaaaaatctgtttttcaaactctagtgattttgacaactagaaaatgttcttaaataatcttcatttatttggaattagtcactcatttcttttttattcattcacaaatatttaataaatgtataccattacaagctgttttgagaagctgttaaatattctatagacaataattctgttttaaatcttagtcttgtaaagttttctaaaatacttttactatcatggatggtaatagtaaatttctctgggaggttttccttctcagtttacaaaagtctgagtgtcttcatttcatttattcttcagaataacttggaatactgaagaaaaatacctacccttttcaaagaaaaggaattagtcaaaatctgctgtgttcttagtagtcacatctttggcatctgttatctttgtaatataaatgacagattttatgtaacattaagctttagttctaaattttcatgcagcatgtcatctggtttacagatctgaaaatattctagtaatctatgtggataattcttactatagtctatatactttttagagactcagctaatgtaaattctcctattttaagaactgcttaatttctcaattatcaggaatcctggtgtctctctgcctgttcatgaaaacaaacagatattcttttaacataaagaatggtcaggccaggtgcagtacctcataactgctgtataagtgaggtaggagaattctttgagtccaggagttaaagaccagcctgggcaacacagtgatacccctatctctacaaaaagaataaagaaagaatggctagacttaaaatacaggctatgtttgacttgagcagttacagaaaagatacacaggcatcctttagagctaccaaactaaaatataaggaatgccatttggacttctgacagaggggttgtgctgggcataaaaagatatgaaagacaagaaacatcatgattttgattatgacctaaataagccataatacacctttctaagggtagatgtcagctcactattccttcgtaggcagctgtctgtggctgcttcaggctgagctgtgatggagctgtatttactgcacagacatagtgaggatcctgagaaacttcaagtaggctagctatttcaggcagaagttgttttagtcatgcagctcttacccttcattatatcaaatattttgtataagatcatttcactgttaggcaaccgttaggcaatcatacatctctgcagaaccaagaaccaaaatccagggttcttgatgcaatcttggtgctttcattcctagaaatttttcttctacagagacagaggtactcttgatgaatttgcaagcaaaagatggagagagtgtcttagtcagtttgggctactataaaaaaaaaacataactggcagcgtaaacagtgaacttaacatttctcacggttcttgaggcagaaagtccaagatcagggtgtcagcaagtttcagatcttggtggggtccctcttgctgctgtgtcctcacatggccttcccttggtgcattcattgagagagaggtctcagctctcttcctctttttataagggcattaatcccattatgaggcctcacacacattactaatataaccttcaatatctcccaaaggtcccacttccgaataccatcacactggggataagggtttcaacacataaacttgaggagcacaaaagcattcagtccttagcagagagaaatgaggaaagtgttctcaatactgtatcaccagttaatcagaacagctgtataactctcagaaaccatagaatgtatctagagatttgaggagaattattaatacattatttctgtccaaatcttgtaggaacataagggcttgaacaagccccgcagtattcagcaaagtctattaccatttgtacttactgagaatttataaaatgtctatgtcccctggtatttccttccttccttcctcccttccttccctccctccctccctccctcctcccttccttcctccctccctccctccatccttccttcctttctctctttcttacttttttctttctttccttttctatttctttctctttcttatttttctttctttctctttctttcctttccttctttttctttctttcttcttttttctttccttccctctttctctctctccttccttccttatttccttccctccctcccttcctcccttcctcacttccttccttccctccctcccttctttctctttctttctctctttctctctctgtctctctttctgtctgtctgtctgtctgtctgtctgtcttgatggagtctcactctgttgcccaggctggattgcagtggcaggatcttagcttattgcaacctccgcctctcaggttaaagggattcttgtgtctctgcctcagcctcctgagtagctgggattacaggagccaaccatcatgcctggctaatttttgtatttttagtagagacggggtttcactatgttggccaggctggtttccaactcctgaccgcatgtgagctgcccgcctcagcctcccaaagtgctgggattacaggcctaagccacctcatctggcctcccctggtattttcaaagtagaacgtagactaacatgggaagtttccatatactcccaatcttccatccatcagaattttttaagtttacatcagacaaaaataaatcacagataaaacataaaccctacacacacacacacacacacacacacacagacacacacacagagagagagagagagagagagagagagagagagagagagaacacagactaaaagctgttcaaaggagaaaagaagttgcttttttcattctgttgttgttgtttgttttttgagacggagtctcgctctgtcactcaggctggagtgcagtggcgcgatcttggctcactgcaagctctgcctcccgggttcatgccattctcctgcctcagcctcccgagtagctgggactacaggctcccgccaccacgcccagctaatttttttgtattttttggagagatggggtttcactgtgttagccaggatggtctcaatctcctgacctcatgatctgcctgcctcagcctcccaaagtgctgggattacaggcgtgagaagttggttcttttgaaatttaatgtggaaagttgtcttccataggatttccatggtaattagaaatcctaaatattttttaagcacactgtggttatatttgacagtcacttgcaatatttcaggaatatccagcaacagcaaattctctcttagcacaactatctctttattaattgctcagtttaccctagcatatgttgtagatacattttcacttaaattcactgtgtttttgttttatttaggataacaagctgaaacttttcatactttctaaatgctcaaggcaatgctactttggcataggcaactataagaaatcacctaagaaacaccctgaagggcttgaaaaatggattatggttttctgcttacaggaaataaagttctaatatgttatgatggggaaaagagtctagaggaagccatccaatattaattgccctgtcataggcgaaaattgggccttaggtctttgatgtccaaaatagctgactcatatatttatagttaccatatacattttcaattattcttgtgagccttaaggaaatcatgtttgttttcttgttgcattatgtcacgaccatattttatatactttagaaaaaaagatagaaaactgattattgtttttgctttctaagctaaagtttaaaatttcatataccagggcttatttgaatgtggattaataataaaataataacaatatgaatgtgttgattgatttgaaaatccataagtaaattaatttgaccacttaacctatgataaaagataagtttcaatgtattttgggatttgaaagaagcatgagactcatatttcacctgtggcaacaaccacccacagctaacagctatgtagccatgatagctttgaactaccaagcatcattacagatgaaatcactatgattactgcttactagatatgtggacacaggcaaatagactaaattctctgactctaaagccttcatttaaaaaataattaaaaagcatgaaagcaatatgtattttccaggatcattttgtgtctggcaaatactatgtaagtgtacagatgcatcatcaacattactgacttttgtagatagttccagtagcaagcagctcacaaagtaatatggtacctcatctcataatagagaatgtgtgtatgtctgtgagtatcacccaaatttaacaatctcttcatctttttctcactaaggtagtcagaaagtcacttagaaaagttattgaaacccttttactaagatttttcccaaggtgagccatttctgtaattggcatacatttcaaaactgcccgtgttctgacgaactttgatttttgaaacttgccaatttcaaaataaaacacaatgtcttaaacttaacagcgcactgcaacattgatttgatgaggacggggtaaagaggcccatggtgttcctattctgacaattactcttttattaatgcgactcaaatcactttagattttttattttcttttggcttccacatcatgctgatgattcatgctgagattgcagtcaattatagcctggtgcctacagttcttttttacagaaaacactgttaaaatagtcttttccctgtcctgtaactgtcgagttggtccttttgaaatttaatgtgtaaagttctctttttttctcttgaagtgtataccttgttaaactgtatgcattgttctaaactaaataatttttctgaatcacaattctaaaatctaaaacaccagatttgtgtcagccacagattctttaacttatggtcagaacttgatgtaagttaccttttaacactaatcaatataaaaatgttaaatatatttattaacctattagtttggtgcaaaagtaattgcagtttttgccattactgatggctgtcatttcaatagctagttctatttgagtgttcttgctcaatcaattaaaatcatctaattgtattatcacaaattcatatgtcttcactttttaaaagaaaatattttaaaaatttgtcaaacgtttgttgaaatcaagatacgctatgtacaaccacagcagtttccaagtttgtctagtctactaattatgtcaaaaaggagaatgggtccgggcacagtggctcatgcctgtaatcccagcactttgagaggctgaggcaggcggatcgcctgaggtcaggagttcgagaccagcctggcaaacgtagtgaaatcctgtctttactaaaaatacaaaaaaattagctggctgtggtggcacacatctgtaattccagctactcgggaggctgaggcaagagaatcacttgaacccgggagggagaggttgcagtgagccgaagtcgcaccattgtactccatcctgggtgacagagaaagacttcatctcaaaaaaaaaaaaaaaaaaggagaatatggaactagttgtcatgattttcttctgaaaccaagattggcttcagtggttattgcatcgtatcttgaattcttataaataaaaaggtgtcattctagaaatttgcattaaattaccatcaattttaaatcttctttgttcacacaatccctcttatcccacttttgaaaaatcctatcattcatatttttagcattatttacataacgtatttacataattctttacataatttctgagattattttatccccagattactatcaattctacttccctaattggttcattgtggcccaaattgaaaacaaacaaatcacatcattgtcttcacagactttgagagaaaatatcaccttataaatgttatatgtcactttccacacagaaaaaaatgaatacaagtgatagattatataatagattctaggtttgagtactataaaaatatttcaacattaattaaaaatatgctgcacaagaaatgtcaatctgggagttggtacgtggcatgaaagttgaacatgaaacacggtactcactccagagacccttgacatttctcgatagttgaaagttgttcagaggttgattgcccactacgagctcttgctaaagggatctattcatgtatagtacaacctgctgggaaaggtcagtgcaaaagtcaaaacccttaaaactggggagttttgtatcttaatgatgctttgaaatgttactcactacaaagtggatcacctgtaggtaactggaaaagaagaaaagaaaaaaacctagaagtgttgaagtgaggagagctggacttgagttacccatctccatttaacaggtatcttattttgagtaatacagaaaaccaacttcagataaaatttcctcatgtatcaagtgagcttaatattgacgttggatatatttctaaaggataaaagtgattgttgctatataagccatgtttaaccactgcatcagtatttattgctgtgacagtgaatattgattgtcaacttgattggattgaaggatgcaaaatattgttcctgggtgtgtctgtgagtgtgttgccaaaggagattaacatttgagtcagtgaactgggagagggagacccatcctcaatctggatgggcaccatctaatcagctgacagtgtggctaggataaaagcaggcaaaagaacgtggaaggatctgactggctaagtctctggctttcatctttctcctgtgctggaggcttcctgcccttgagcatcggactccaaattcttcagcttttgggctcttagacctacaccagcggtttgtcaggggcttccagaccttcagccacagactgaagaccgcaccatcggcttccctacttttgaggttttgggatgccgcctggcttccttgctcctcagcctgcagatggcctattgtgggacttcaccttgtgattctttgagtcaatactccttaataaactcttcttcatgtatacatctatcctttaagttctgtccctctaaagaatcctgactaatacattgctattattgcttatttaaactccacaaattggttgaggcatatgatgattattattatttgtagcattagtagtattaccatcaggattcctattagtactagttgtagtgccagtagtattactgatactaaatcagaaaacctttgaaacatccagtgtgatgtagtctgcagtggaatcagaatctgtctaccccatgtggatttcaacattttacagtcattctcctgaggtggagattatgaacttggcctcagctattaactatattaacaagaggccatggggttaagcataatgcctgtggagatttttggctctcctccaggacggttcaccttccaacaaccagaaccaaagctcatgcccagagaacctcattgtgaagggcaaatctgaaagctgttattatggagaaggtcatttttgcagtgtagtctagtctggcactaacgttacaggcagcagcgaccaccacagccctgatagagtcaggatctgcacaatcccttctggctgcccatagcacaggcttctgacattttactgagataaccgttagagctttctttaagcctgagtgcttttgaagtagaaggaataaaatgacgaggttcactctgaacccttagtggtagcagagaggttattgtcagtttcctgaaatcgtgtatcctaagctccatttattttgaatgtcggaatttgttcagtctgctgaaccaacaaaatgcaatgctaatttgattagagtataaagagctttatttttatttaaattcagtccactagttaaagcttcaactcagaaatgtatttttaaagaaaactagatagtgttgtgaacagactggaaaaatcagatgattgttcatgtacatatacatggacacacacatatataatccacgatgagacagattttatacttgaaaaagcaagcatatttgaataaaacattactctgggacttgctggctctatcatcttgagtggtcagcttcaggtttctcatctgtaaactggtactaatggtatcagcctagcaggatactattatgaattgaattatttcaagtatttaaaagatatggatgggatgtccataatgctaggcactcattggtgacatagaattcagcataactagacaatgccgtgagccttccattccagtgatggcaatacagggagtgtagttagcaaagagcctggcatatagagcaggcattcaataaatgccagtgctgtgatctgaatgtttgtgtccccccaaaattcatatgttaaaatcctaaccaccaaggtggtggtattagcatggtattgggaggtgattaagtcataagagtagagtcctcatgaatgggatgagtgccctatagaggaatccacagagagctgccttgtcccttcaccatatgaggtcaccatgtgcaggcacagagaaggcatcacctataagaaaatgaggcctcaccagacaccaatctactgttgcctgatctggactttcagcactgtaagaaatacatttctgttgtttataagctgtctagtccatggcattttgttatagctgcccgaataaaccttgacagtcagtttccctcctctggactgaaccactgtgtggaagagtttgcaggataaaagcatgataatctcatgataatgatacaaagcagattatacctaaatttttatcaacctgaaattataatttctctttctccattcttatatgtcttatgcagatttcaattcctgtttacagcactcattcctttggtttcaaattttaaatttatttgtttctcagtggctataatacttactcataattttaatcccctctttcccaattcggaataacatcaatataatttcttaacctggcattcaaggtattttccaatacattcctgtattctttatgtcacacttccaaccaatcaatcaatcttaagattgtttgctcacccccaaatatgtttctcatttcttttatattttcacttgcatgtcagtgtttgaatccctgtctcactatagacttactttagctaatctttttttttgagacggagtctggctctgtcgcccaggctggagtgcagtggcgcaatctcggctcactgcaagctccgcctcccgggttcaggccattctcctgcctcagcctcctgagtagctgggactacaggcgcagctaatctttaaaaaatttgtcaaccagtagttcattgaaagattaaacaatagaataaataaatgattgtacacagttcaagcctgcaaaccttttgggagcaacagtgggcttattactttctgtaacatatgaggacatagagcgtacctgtaaacgtatacattgtaagttctctatttagttgaaataaattgagctatttgtacacattaactcagtttaaattaataattttagtaacgactaagaaaaaagagaaaagactaagctctatgattccagacatttgattaactagaattctgatttttctattcaacaaattatataaatcacaggagttacaatagaagacttaaacttattatgcagtgaaaatacttaatgatatatgttattcttaaatattatagaagctacaaggtttttttcagtttaaactcattgtatttatacatataattagttcattatttttattaaagcagatgtaaacttgaactacgcagtcagaataggattgtcaaatgtggtaggaagtaaatccatcaggaaaagttattgaaggaaaccagtaagtgttactcttttttaatgtttttattactttggatacaatgagatagtccagtggtacttttaaaattcaatatccaagtatctccatagggtttgttcaatgtacaactgactattatataacaggaccttatttactaaagaaaggtggagaattaattgtattgatttttatctgcaaaatattgcatggtagatattatcctacctttgtggatacaattatagataacatttcaaagttgtagtaatttgaaagtcataaggaagacaggtggacaagtggctaggtatatggtcagcatccttagtcaaaatgttttggattaatgttaaatctaatttattattatcgaataagcaacctaaagtttctttaggtgttatgtttataggcaaaggtgagggaaattgggatttcacatctagcagaggagtagagagttttcacaaagtagagtagtatgttctagagactaatacatgtagtttcaaaagaagctttggctaagttacatgtcaaacaagtttttaatataaagctgaagataatggaattcaggcggagtcaagccttatagagtaacatctttagcttcaacaatccactaacacactggtatatgatgtctaaggagctctaaaatctcagtggcagcaaaaccgtgcatattattgagtgccctatcatacaaagtcttcccaagattatactgagagtggattgaatgaagaaaatacagaataataataatgatagaaataaataagggcaggttttgggtacttcagattgacaaacaatggaagcaaataagaaagaagtaagtctggctgcattgaagtcatgctttgggcagtgatgcatgggacaagtgagccacaggtgatggccctgccaagccagccaactcaactgggctagctaagcaggcagagctgattcatataacaagcggaaaaacaatacaaattggtgctttattacaatgcctcaggcccattaattattatttggggatgagaggagttgagtaaaaaactatagtgtttcaaaatggtatgtcatctgtcactttgaaattaatttattaatgatttaacgagatgctattatagtttctaaaatgcagctcttcaagtttgcatattcgtgtctcaccaatttatactaattgaaaaaaatcatagttgcagaatttatcatgaaaatcaggatttgggcaatggctttttaagatatgcaaatcaaattatatttttcaatatttatcctatagaatttcactttggtcatttagtaacatatgccccatggaggcaagaacatttttcttgtccagctatttgacatgtgtaaatcacaaaaggtggtaaactattttcacaaatagcattttttcttactatcagcttcaatgactcatatagtagtaattgaagaaaaaaataatctggcaaacatttcacttttgaaagtaaagcagttaaatctttgaggaaacagaataaattttatctcactgtcatatcaaatttaatttttgatgccactatttactttccactttataaattaataacattttagaaatcaaaattattacaatatttaatatttaaagctctattaagtgtttggaatcatttgcttagacttgtttttttttttttaatttggaaacccagcagactttttccatctcttcattatccagctctcctttaagttctcagaaagctaaattattttatacttggtatctgctagcaataaaatcgaatccattcttgtctactagtgttttgttcctcaataatttgtgttactggttgcttatcctcttttcttttcatatccctgaccttttttttcttctgatctgttgcctagtgttaggagacacagtgataataaaaattgcgaaataaataaataaacaaaatacaataacaaaaacccctacaatgtagaagttgtcttctgacggcaaaataattacaaagaaaagaaaaagttgaaatctgacaggattagcctgctgacttgctgagtttatgagccctgtaaagaataccaatgagagaaaaaataggagagagagacaacgttataaattttacccgcagacttcttcacagtgctttgggaaataaaatcaagttctggataccattaatggttattgtcatgaaagagaaccagtttgccatctgcttctctgttcgagattaatagaaacactggaggtggagctctctttgaaatagttaagtgatctgcagaacaatgcgaaaccctctgacatatggacattatactggaactggcaaaaatatttatttagaaactgttgagttagtctatctagcataagaactagtaacacaatctactgatgattcagaatcaaaatactaagactagatcaaggtgtgctgtgattataataatgcaacataaagcagaagctcaaagtcacttctacaaagcacggaattcatgttatgtagaggcactgccaaagatgaataccaaacagatcctcacttatgctagttagagggctgggatgtgtgacatgattctggattaccatgacacaatttgtgaaaacaaacaaacaacaacaaaaagcactgttacagtcatcagtcttatatcatcattttctctccaacagtgtttatgtatttactaaagcaatatgatgcccattctagaaaaacaaaaccacataattgattttaaaattttgtgaaaatctgataaaatatggaagtttttaggaataaattaacctattcatggacacaaatattttctacataattacagagaatgactgaacccactaatatctgctcaaagaccctaaattaactactgctaagactcacctgcatgttccaacgttttcccacatttaacaattctaatttatgggaagaaatattaatacacgatcttataaaaatatattgtaaatagttgctaaatggaccacattaagaaataggctaaaatatgaaatatccaaatagtggaatttattccatctctaaaattgacatttttaattaaatagtttattattttaaatatatagatcacacaaacatactcacacaaacatataatcacaaactcaagtttcaaactgtggatactatgggtcctattatagtaaaaaaatacagacctatatgcaaaaagaaagtctcagaaaagtatactcgaaaagtttggtcattatttctgtatttggtcttttttcttcatctcaatttttgattttttttacactaaatgtgtaccaaagatacactaagatcaacctctcttagtgatgtgcgtttaaactacagatatttctgagaattgcaatgcatcaagtgtctgcaaccctggtacatggattgcatatgggttgccttaaaggagacagaattaacaggaataaacacaaatatgaatggcagaaaatgtgcagatgctgaaacatttatctcatgaccaaccacctatacaaaggagagaccagtaatgaagtcccttaggaagtgacaaaattcccatccaagtctcagaaagcactttcctctgaagtgaatcttatctgagagtggcctatgttcttgagttcagagttcagagaagttgctatcaaattatcgaaggcaaaaaggaatcacattggggaagcttctggaaagtaggtggggaataatggaaatgaatttgacaaaataagacaggaaataatttttcagtatataagcaccagagacctaggcagccaggaattcttaaaggactaaaggaaactttcctgcaatgcagtaaactgtcccctgacaaaaccacccccaacccgcaaccatcaaccatcgccatcaccaccagtggtggggaaataaagtttattgtcagtaggttcagggagctgccatttactacatctacatgtttgaacacccaaatagaagatacagattatttaagaagacacacataaattagaaactcctaatagcagggcagactgtctatttttggtcctgacactaagcaaagctgcttgagacgcctggatgccaacatttaagttgagtacagatatctaggtcatactggaggatctgctggggagaagggaataaagagtcaagtaatatttttccatgttccatagctctaactagcactagctccaaaggcagtgctctcaaatgaatttcattggggaaaaatatttttaagaggtaaaaagaaagaggtgaccacggttgcttattaaaggtatttcaaactcttttatatccccattatacttgaaaatcccaagtaaaacaaacaaggaaaggtcatatatatactggtttataattttcaaacagttgtcacttgcatttttcctttcatctttatgcaggtttaatcacatcaccatttcataatgagagaagctgaagcactagaaatttaaccgaattgactagggccatctgagttctaacagagctgggactcacaccttagccttctcaggataattgcctatattaaacccacaaagcatgctgtttatcatggccataaacccataaagagatgatttatagtggggcattcattttgaatatgattaatttcatttttataaatgattttggatgactttctcatctgggtatcataatgactgtcattactaaacaaatttgctcttcgaagtagaaataacgtgggtgatatcttccttttcatgactaatttactgccaagaggggattctgtcattatatagtaataatgttcctaaatcaatgtgctctagcaacactggaaatcagaatgtagcttacttttcatgaaccaaaattgtcaactaggaacagtcctgatgttctgaagttccaataaaagtaattaaagaacaataacattggctaagttgttgagtcctttttaaataagacttcaagtagtaagtactgctgaacacccagactatttttgaaggagagagatatatatatttccttaaaaaaaaaatatatatatatatatataaaactatcttacatgtcttttaaaatgaaaacatagcaatatcttttaaaaagaacctggctttcctatgtaaaagcacagtgggagaacttaaaaagctgtgctaaggaagagtgacctgctctcggatctcattcagatcatcactcagtatccaaacttgcataatcttgacattcttggcacctcatggggctcccggggtgatgtccatgggtgagaatgtgaactaaacaacaaacaaattcctgtacaaatacatacatacatactgaaacacacacatgcacaaatgtgtagtttaaaaggagtcaagttatttatgactaaacaataggggttgggaaacatataaaggcacagaaataatctttggagtgggttatcccaccatttaaaagaatggtccatttgcatatgccatcactggccttctgagaatgatgtgttaagtaagcaaatcatccattattcttttaatattaaggtaatgaaatataaaatagaagcagttagagcagtcagacgaactttgtcagcatgatcaaaatgcagaaacattcctgccataagactaaacaagagcctttttcaaaaatgcattcattttaagctctgtaacatcaaaatctgtttgtggtgtttattttaatttgaggggagaatagcaatattttccaaatatgaaagccccaaataacaacctatgaaaccatacagttttaaaaactttatttatatgacattataaattaggataagataattcatatcacatttagataacaatggttttattatgcagcttatctgaattcaaagccaaccatgttgtcatttgaaaatgtgttaatcattccatttacaatgagtatgtagcataaataaaagctgcattcacacagtccttgggatttaaatacaatatgcttaatcctcctatctcatgttctggagtacttcaggtgggcctccacaatttgtttattaattcccaaagtgattaatttttatggtacctcaaggttttgaattatcgcaataaatatatctgatgtatacatatggaagactgagtcttaaataatttgcatatgtcagtatattggttcaggtcatattgctaattagtgctgaaccatgattaactccaagtatatcttcaatcctttgataccagtatcttcaataccaatttcaatcctattttgattaagagatgtaggctcggatctcaaggaccaaatgattctcttggtaagatgaactgtgttcacatgtaactaaaaacaagattgcgtatgtgtcaactgatggtctgagaaaaaagtttgctatggagaaaaatactagtagcaaccaaaataatttttaaaagtacagcttcagtggagttatcttgcagttaatttttgaataattagaagactggttgaatggacattttctaaatatttatttatgtgtctctagctacacatattaattaggtgtagcaatttatctatctatctagctagatagagagatatagagacagccagatagagatattatttgtatttttctgccactaaaaaggagagaaattgatagtacaaatacttgtttctgacaaggcaaaagtgaacatggtggaaacagaaaagatcagcagaattacagaactgtccaggttggagattcccatgagagatgtgtgtattatttattcttgcagctactgtcaattatttctgatttctagtgtttacttatatgtctgtttctatccaggtagacagttgatgactattttcaaattgacatattgaaagagattgcttagattttgaggtagtctgctcacagaaaatccttatcagatgttaactcggtaccccaaatggaagataaaaattaatccataaaaaaaaccatcatgatttgtaaaaatgaaaataattccaattaacataaaaacgttatctacctaatgaaggaatggagaaaatgattgtcaacgtattaacatattagtctgtttttgtattttacaataaaaaagtgggcacttttgtattaatttaagtaaaacgcattggattgatataagaaagttctctattcccaagggggatatataagtcagtgagtagttaatatgcttaagtttattattaacagtacaaattgatcagatttttcccaaaaaaatgatcaatttttccctcaggtggagaatatacataaaggtgcacattacttgcatttcaatatgagacacagaaaagataaaatagacagaatggctagaagataaagttataaaagcagactttgtcctgataaaagttcttatttaaaaatgcatgattccttgtcaaaaatttttaaccttataaaaattcatgagcatttctgtttggtatttaatgtatatctcattaaaaatgagttttgaatatatgattaatattgttaactccagcacatcctctcctgctaaagtgcattgaaagtcctaaacaacattaaatagttttctctggtgatacatctactgctttcatcgatgacatttccttaaagaatactaatggcaggtcggccgtggtggctcaggcctgtaatcctaacactttgggaggccaaggcaggtggatcccttgaggtcaggagttcgagactagcctagccaacatgacaaaaccccatctctactaaaaatacaaaaattagttgggtgtggtggcagaaacctataatcccagatattcaggaggttgaggcaggagaataacttgaacccggaggcggaggttgcagtgagtgaagatcatcccactgcactccactccagcctggaagatagagcgagactctgtctcccagaaaaaaaaaagaaatgctaatagccaaaaaagcagcccccactttaaatgaatttgacaatggctgatgttttcagttctgttctgtgtttaacacttcactgacaatctggagtgacaggcatctggataatttagccacacaatatatataattgggcctaaaatttagtaaaaatgaacactgtcatatattcctttccaaatgtggcccagggcctattggtagaacgttattgaattcatcagaaattgtaaaaagcagaaagcattacagagaaagttcatgtagagcttaactaaatatgtgatttgtctcacccatggtgaccataagagtgatgacacaagattctcatatgctgctttgtcaagccaaaaaacacactgatggtagttcacattgattgattcactaaattctgttataattgttcacaaaattcctaactacaaagtagctgtttaattcatatcagaaaactattattcacaacaaaattttgatgtattatatttttacctagaagatattttaaaaaccagccactgcaaaaacatgccaaagtgtaaagaccatcaatgctaggaagaaactgcatcaactaatgagcaaaataaccagctaacatcataatgacaggatcaaattcaaacataacaatattaaccttaaatgtaaatgggctaaatgctccaattaaaagacacagactggcaaactggataaagagtcaagactcatcatagtgctgtattcaggaaacccatttcatgtgcagagacacacataggctcaaaataaagggatggaggaagatctaccaagcaaatggaaaacaaaaaaaggcaggggttgcaatcctagtctctgaaaaaacagattttaaaacaacaaagctcaaaagagacaaagaaggccattacataatggtaaagggatcaattcaacaagaagagctaactatcctaaatacatatgcacccaatacaggagcacccagattcaaaaagcaagtccttagagatctacaaagagacttagactcccacacaataataatgggagacttcaacaccccactgtcaacattagacagatcaacgagacagaaagttaatatggatatccaggaattgaactcggctctgcaccaagtggacctaatagacatctacagaactctccaccccaaatcaagagaataaacattcttctcagcaccacattgcacttattccaaaattgaccacacagttgaaagtaaagcactcctcagcaaatgtaaaagaatagaaattataacaaactgtctctcagaccacagtgcaatcaaactagaactcaggatttagaaattcactcaaaaccactcaactacatggaaactgaacaacctgctcctgaatgagtactgggtacgtaacgaaatgaaggcagtaataaagatgttctttgaaaccaacgagaacaaagatacaacataccagaatctatgggatacatttaaagcagtgtgtagagggaaatttatagcactaaatgcccacaaaagaaagcaggaaagatctaaaattgacaccctaacatcacaattaaaagaactagagaagcaagagcaaacacattcaaaagctagcagaaggcaagaaataactaagatcagagcagaactgaaggagatagagacacaaaaaaaccttcaaaaaatcaatgaatccaggagctggttttttgaaaggatcaacaaaattgatagaccactagcaagactaataaagaagaaaaaagagaagaatcaaatagatgcaataaaaaatgataaaggggatatcaccaccgatcccacagaaatacaaagtaccatcagagaatactataaacacctctacacaaataaactagaaaatctagaagaaatggataaattcctccacacatacaccctcccaagactaaaccaggaagaagttgaatctctgaatagacaaataacaggctctgaaattgaggcaataattaataacttaccaacaaaaatgtccaggaacagacggattcacagccaaattctaccaggggtacaaggaggagctggtaccattccttctgaaactattgcaatcaataggaaaagaggaaatcctccctaactcattttatgacgccagcatcatcctgataccaaagcctggcagagacacaacaaaaaaaagagaattttagaccaatatccctgatgaacattgatgcaaaaatcctcaataaaatactggcaaactgaatccagcagcatgtcaaaaagcttatccaccatgatcaagtgggcttcatccctgggatgcaaggctggttcaacatatgcaaatcaataaacgtaatccagcaaataaacagaaccaaagacaaaaaccacatgattatctcaatagatgcagaaaaggcctttgacaaaattaaacagcccttcatgctaaaaactctcagtaaattaggcattgatgggatgtatctcaaaataataagagctatttatgaaaaacccacagccagtatcatactgaatgggcaaaaactggaagcattcctttaaaaactggcaaaagacagggatgccctctctcaccactcctattcaacatagtgttggaagttctggccagggcaatcaggcaggagaaagaaataaaggatattcaattaggagaagaggaagtcaaattgtccctatttgcagatgacatgattgcatatctagaaaatcccatcttctcagcccaaaatctccttaggctgataagcaacttcagcaaagtctcaggatacaaaatcaatgtgcaaaaatcacaagcattcttatacactaataacagacaaacagagagccaaatcatgagtgaactcccattcacaattgcttcaaaaagaataaaaacctaggaatcccacttacaagggatgtgaaggacctcttcaaggagaactacaaatcactgctcaatgaaataaaagaggacacaaacaaatggaagaacattccatgctcatggataggaagaatcaatgtcgtgaaaatggccatactgcccaaggtaatttatagattcaatgccatccccatcaagctaccaatgactttcttcacagaattggaaaaaactactttaaagttcatatggagccaaaaaagagcccacattgccaagtcaatcctaagccaaaagaagaaaattggaggtatcatgctacctgacttcaaactatactacaaggctacagtaaccaaaacagcatggtactggtatgaaaacagagatatagaccaatggaacagaacagagacctcagaaataataccacacatctaccaccatctgatcttcgacaaacttgacaaaaacaagcaatggggaaagggttccctatttaataaatggtgctgggaaaactgactagccatatggagaaacctgaaactggatcccttccttacaccttatacaaaaattaattcaagatggattaaaaacttaaatgttagacctaaaaccataaaaaccctagaagaaaacctaagcaataccattcaggacacaggcatgggcaaggacttaatgtctaaaacaccaaaagcaaaggcaacaaaagccaaaagtgacaaatgtgatctaattaaactaaagaccttctgcacagcaaaagaaacaaccgtcagagtgaatagacaacctacagaatgggagaaaatttttgcaatctactcatctgacaaagggctaatatccagaatctacaaagaactcaaacaaatttacaagaaaaaaacaaacaaccccatcaaaaagtgggtgaaggatatgaacagacacttctcaaaagaagacatctatgcagccaacagacacatgaaaaaatgttcatcatcactggccatcagagaaatgcaaatcaaaaccacaatgagataccatctcacaccagttagaatggcgatcattaaaaagtcaggaaacatcaggtgctagagaggatgtggagaaataggaacacttttacactgttggtgggactgtaaactagtttaaccattgtggaagacagtgtggtgattcctcagggatctagaactagaaataccatttgacccagccatcccattactgagtatatacccaaaggattataaatcatgctgctataaagacacatgcacacatatgtttattgtggcactattcacaatagcaaagacttggaaccaacccaaatgtccatcaatgatagactggattaagaaaatgtggcacatatataccatggaatactatgcagccataaaaaaggatgagttcatgtcctttgtaggaacatggatgaaactggaaaccatcattctcagcaaactatcccaaggacaaaaacccaaacaccgcatgttctcactcataggtgggaactgaacaatgagaacacttggacacaggaaggggaacataacacactggggcctgttgtggggtggggggaggggggagggatagcattaggagatacacctaatgctaaatgacgagttaatgggtgcagcacaccaacatggcacatgtatatgtatgtaacaaacctgcgcattgtgcacatgtaccctagaacttataataataaaaaaacaaatttattatactacagaaataaatggagctctgtgtatattagacatatattttcaaataaaaaatttggagattgtaaaaagaaaaattggtaactaaagtaaaataattaagatgtaacacaactgaatctataaataaataatgataatgtcattacaaacttcttaaatttatcattatgcaaaacaaatgaagaaatgcatgtggtctttctcagcatatgtctttccaggtttatataacatttattaaacattttgatcttttaatggcagttaatccattgggaaacagaatacttagggaatgcaaacaaccattaaattatatgccaaccaggcttgttacattggcagagtatgatgaatatgcctatgatgcctattaaacggcatgaagaagatatttctgctcctccaaacaaccttttacacagctaatctctactgattgaaactgtcttcaaatatgtaaaatattgatatttaataagtttttctttcttttctccaatgatatatgtccttggaaagctgacagataacagtggtagagacccttgattacatttatatacaagtttgttgtttaaatattcctaaagtgaaacaagaatctcatagatccaaggcactaaaaaaatgcatctttgggaagtaaagacatgatgttgtgtcagacaaaatgcattgagtagaaatgggaggcaatgcctgcatcatcttcagttaaagcacataaaacctgatcatctgttcttagataaccagacagtaaactagaccaaaggaacagatttcttagtaacgtgatattctgccaacaatcacattggttttatttgatagttttcataaacatgggcttttatcctgtggccttataaaggctttgccttcatgcccctcccctcattctcctccctcactaggctgccatggggtctgtagtctgcagtaacgcaggtgttgaaagtggcaccaagagacacatctgtggtttccaatttaatacagtctagttttaaaagataagattgtatggctttgtgcaaaataaaaaaggtattgcatgacactggaaaaataaaatcatatcgttttgtcttgttttaaggatattatcaattataggcaagtgaggttgggaggaaaataaagaggggaagaagggaagtccatgtgcccttaataggagcgatgggaagaaaagacaatgctttcatgaacgatgtaaacaaacagattcaaatgttaactaaaaagatgcctaggtgaatcatatataatataaggagatctgatatagaatttaattgtgtgtatctcctggaaattaacttacttagtttatgacagatttgaaatgaaccttcagcagttggtgttcacaggggagcttttctatgtggtaatctgtggccggcaacagggagtcttacattggtagaaggtggttacaggtgagaaaaataagtgaaggagaatggggtggatcaaagtatggaacatttataacaatggtgtggaaaaaaatttgactcaggcatcttgctacctagaagactgctagtcactacctaataattgaatgaataaatgaatgctttcagaaagtgatataaatgaaaaatgcaccaatgttaccttagcatcaggctgtttctatgtaaataatttatgaattttatctgtgatcagatggctcctttctgaatgagacagaatttgaacatgtttatctggggctaaaggcatgctgaaagtagaagaaatcaggccaataacaaaattcaagcctttcaaaattgtgttgacactgacataaatgtaaagactcatcaaagaaagacagcaacaatagaagaagctgattttctccctaaatacacacataataagcaacattttaaagtaacatgtaggctaacagtggaacagattccctttcttcactctaagctcactcgactgcatgacataagtatttccttttatatcacactgagaatttcactttttattcagatttggtgcatttctctctctgctaatagacatgggcagtgactaaatttctaagggtatgggtgtacacaattttgatgatgtgaatcttgcttttgcttattaatggctgataacttgacatattagtacagctcaagtataagcagcttttcaaatacctacagaaaatgggtgtagttaataaatgctactgttctagtaaaatcatctcatctctagtttttcaataacgcacttggtttgtaatatttagaaaacaattttgacagagatattcactcaacagtattattaaatgacttctagatgcccagctcctggcatacacaagataaataagctatctatgtcatttgaaaagagcttgtagtccttaagaagataaattatatagataaataagcacatgataaataggtactaacacatttcataatgtgagcaaaatggaatgaaattctatggatgcttggagaaagttaactagctagattaattaaatctccttggagaaaagttttcttcttatagaaatgaagcatcactttgcttccagaattaactgatctgcaaaaactcaacaactctttgtagctattgttttgaacgacttccctcaccacaaaaaattcttcaacatcagtatcatgccagttaattttaatttgttgcagctaaatgaaaaacaaacaaaaaatattctaaactattgtattaattagaaaaaagaacagaggcagaggagcattaacagtttatttttcattcaagaaatatccagtgaatatttttcaattgagtgacatggaaaaattatactcagtctatttatctttttgttttgttttgtttttgagactgagtctagctttgtcacctaggctggagtacagtggtgcgatcttggctcactgcaacccctgcctctcaggttcaagtgattctcctgcctcagcctcctgagtagctggtattacaggcgcccgccaccatgcccagctaatttttgtatttttagtagagatgggttttcactgtgttgaccaggctggtgttgaactcctgacctcatgatccacctgtcttggcttcccaaagtgctgggattaaaagcgtgaaccatcacacccaccctcagtctatttatctagaaaatatttattctttcttttttttttaagtcatgtgagctagttccccaaataaatcccctttaatatacctatatattgctttatatatagataatatgtatagagatagataaatatataaacagactgataggcagaaatcctattggtttctctgaagaactctcttatataacatctttgtccttatcttgattacgtactgccaactgtgaaaggtccttctggagataaagtttagaaaaatttattctcctggaatttcacccataatgaatttgttttgattacattaacctctcgttttgagacttcagaaaatgaatcagttctgacttttgttcatactttttcataagttgacagatgcatagtagtttttgttactttattgtggaatggatggatgggaggatggataaatagtggaataaataaaattcaactgaatgttaatattgttgccatattactagcttcacagtttagatagagtatattcatttaatagcaaactactgttggagattatttgagtataactgaatggagtactaatcagccctgtactgagtataatcttggttctaattttatctctgccatttactggatgtgtcgctttgtgaaaagtgcttgactttcctaaccttcaattttgtctttaataaactgggaagaacaaagtccattatataagattgtggtttttaaaaaattattttcttttattcatgtttcactttgttcagaaagtatttgtgcaaaaaatatgttaaataactacttctagaaaataatcgaaggggaatgattaagttcttttggttacttgtatttttgtgttttttttaattctctttttaatctttagacagttgaaatcttattttatcctctgaaaggcatctccttctcctttctgcaccactttgctccagatacctagtgatctaatggaactcattctgtctatgtccttccttacagcaatttgggatggacatgaggaaattggagagttaaagtgttggtgggaaatggaaaccagcaacaaaggtcaagaagagaagctgggtcttagtgatgtctgcatgagatttttacaaatttgctgtctagaatgttatataatcccatataatcccccatttgtgtttccacaaacattttataaaatatatgttgttagttggttatagtttcagaattggatttgtgttatttggaataaaatttaccctaagtgctgagtctgatgtcatgacagataccttgtgacagcagagaacacccaatgacccttggtcatattttaggtttcaagtatttctgtacttaatgtacataagaagtttccttatgctttcacttcttggcttatggtgcatatttatgctttatatttttatgtacatatcaggtaaatatagaagcccattcctctctaatagtagagataacacctttgtctattttattacatatttgaaccctaataaatgcttgcaagattcatattatgaccaaaaaattcattaaattttgtcatctccatctgcatttgtgcctaccattgcattcgtataacaaaccatatccataaaaataaatattcctataaatgtgacaaattaacacatttttttcctgaaaataaataaactatatacattgaggtcaaccttttacttatttatgcattatcaccagaaatacgaagtaaattctaatcaagtatttataccactactacatgaataaaatttgaaatgtaacttctgcagtcttctatatctatagacatatgttaaggcaaattgttttagatatgtgaaatttaaactaaatatatattcattattaatcagcagttattatttaaacatttgagccgaaacttcatatatttaaatttaatttttttcagctatttatataatttgcagagctgaagttctaaaatagctctttgagatatttttattaatttgtattaatatttttattgattttaattaattttatgttattgtttttaaaacagggtcttgctctgttgtccagactggagtgcagtgatacaatcgaagctcactgcagcctcaacctaccaggctcatgtgatcctctcaagtcagtctcccaagttgctgggactacaaggagtctaccaccaagtctggctaattttttttttttttttttgcagagacagggtttcaccatgtttctcaggctggtttcaaactcctgggctcaagagatgctcctgcctcagtgtagtgtatggatatttaagtaataaccgctggttaataataaatatgtatttagttttaatttcacaattctaaaacaatttgccttaacatatatctatagtaatagaagcctgaagaagtaacatttcacttttttattcatttagtattgacataaatgcttgatgattataatctaccttcatatttctagtgacaatgcacaaataagtaagaggttgacctcaaaagtgccgggtcttagggtgtgagctaccatgctcaacctttattcctttttaaaaacatctttcgggtcaggcgtggtggctcacgcctgcactttgggaggccgaggtgggcagatcacttgaggtcaggagttcaagaccagcctggccaacatggtgaaaccccgtctctactaaaaatacaaaaattagctaggtgtattggtgcgcacctgtaatctcagctactcgggaggctgaggcaggagaatcgcttgaacccgggaggcggaggttgcaatgagctgagaatgcaccactgcactccagcctgggccacagagcaagactatctcaaaataaataaataaatgaatgaataaaaaataaaataaaataaaaacatcttttgaaatttgatgtcccttacacctgtgttaacaaatgtttaaaggcaaaacaatgtattttgcttcatacgctaaaagctgaagacaaggaaacatttttgcttaactttttaaagaaatattaaaattttttaatatgtaaacaggatttaatggaaaaatactttctaataactcagaaaaaaaatagactttctttaaagacactataaacacatttttccaccatttttttcctagaaaacaggcataaaagtgtcacccaaaagagaccaccatatttaattccctgaacaacaaggttcttaaaaaaatacatacaaagagaaaaaaatcaattcatgcctttaagatttcacattttaaagaagcagctttatttgacttcttaaatgcattttaaagtttatgtcatcaattctgctacacaaagtgagagcatcaatacctttgaaggactgaggagatgccaccattttactctaatctcagagtgctaatggtatcttttaagctcttcgaacacacaaaatctcaagcaatttgctaaatttgaagagtaaaatttacaggcaaataagaataattaggctgaatattttgtccctgtgtgctatttttaaacactcaaaatcattcatagtgactgtcagaatatgtgaaaaccctgtcttttagaaagaaaaatagtgaataaattaactgaaaatttgtgatcaatcacatttttccttaaaacatggtgtcagtttccatagccacagacacaataacagaaaaatcacctcaaaaattatttaggcaatatacatgttttatgtacttaaaaaaaattctcaagtatattgttcctggattgattaattcaatgattctatcatgtcatcagaagcttttcttttccctttgtcagcctcaatattttatctttggtcactcaaatagcaacattaagagctgaataaagtgtgcttatatattgcacatattcaagagaaattatttttagagatccctccactcctggaagatcatatttccttttttgcattgaaaagtgtgtcttgctttaacatattcccacttatcaaccaatcactgtcaagaaaagtagatcattaaaattggcttaggctatttaactttcactcccaagttgcttggactctgataactgtaagcaaagaagaaaggtgctcaatggagtaatgcctactgagtagacaaacaatggcatctgtcaattaaataaattcgtgagtaattttttgtgtgaataaattatttaaatcatgtatatattccttgaaaataatttataacacataggtgccttttagaaacgtattttatagaaccctccattatattccttgaactattttgctaacatctttgagtattttcctaacagaaaaatactttatattcataaatttaaaaactcaaaattgtagcacttattatatgcctagacatgtgttagtcaagattacagaatcaaaggagagatgaaataggaccaagttcagtaggaaaccttggtatgcttgagaaaaccgattaaaaacataaaataaccataaaccagtaggtcatacgtatgggaataactggaccaggagctagataacctgacctgttctgccttcaacagcaaaaaaatcatctggaaagaaaatgactggaaaaattctaggcgtagatgcaacaattaacaagcactctcaagattaactaagaactgtctcttgctgagaagcagtaggagcaaaaaacaaacaaatcaattactttttgtttggaagctatagtaaaggatcttgagaagagaggtataaaaagaatagcagtctgtaatatactaattggcaaataaatggaggtcaaacttggggatatacatcagagtataattaataataaggaagaaaaatatttgcaggttgacattttccctaaaagcttaattttaatttctggaaaatttagtaactgtaatttgtctaggtgccactttaagaacagaattcaaatatttgatgaactattgaactcagacatgttatgaaaatagttctgatttaaagtacaaagattgtcaaataaatgtacacacacattttatatgcttctacatataagtattaaaagctaaagcaaagaaaaattacattaatcttaacacatttctgtaatagtacagttgaatcataatttaaatacacaaagtgaaaaagaaagaattctatttttaaatttgaaaataaggccatcttacttctctgtaagtagagtgatacagtttgagatgttattttccaaaaagaaactgagtttacattggatcctccaagtattcctatcttttatattattattttttaaccaaccactcttatatatagttaacttgtctaaggctttgaacagggctttttattagtatgttagttaatcttaagcattagtctgttttaataagcatcttgtattatgtgaattaactagcttttaaaatcaattaagtatatagtacatatgtagaatattatgtaccaagcacctattgcaagacaaatcaaggtaccctcaaaggattgaaagaaagaaagattttggctagagcatggaaaatgaaggaagattttagaaaaattgagattaagaacatagatagaagccagtccatgaaagaaccttgtgggagatgataaggcttttgtcctttattctcaaaggtttggaaaacctttgggagattttaagttaggccaaaacatgatgatatttttattcttaacacaaagtttggattcagtttgaagaatgaaatgtggacaaatttagaactagttaagacaagaggctaatacacgtcactggtccaggtcactgaactaataatgctagcttagttcagagtggctggtgtactgatgaagaaaatgctaaccagttaagatttctagaggagggaaatccaacaaggctgaccagaagcagccagtgtatgcctcttgcttggagaggaactgaaatagcaagtagatattgacacattggatagatcatctaagagagagagcactgggactcaacagagaagggaagggaagcactgaaagcaaaggagagggaaccaggcagcctgcttggcagctgggagaagctcctggaggccaggaaagggtaagtgagggacccccgtgctccacattcctgcacagacttccacaaacctaatcacaggaaactcccttaatcctcatgggcctcaagacagagaactgcctacagattgtgcagaggtgtttgttgttccagaggggacactcatgctgagtcaccaggcttccaagccctgagcagctgcgacatgcaagggagttgagcccccgaaggactgccaaggagaaagagtggaggctgggtactttcacacatctcgaaaacaaacctcactgccaatgatgcttcgggctgttgtggcacccagacacagagaaactgtaagcccgtagctgccttcccacacttctcccactaagacatgccccgtccttccaggtggtgggcccacggctggcaccaatctgaaaacagatccccaaaggactttgtgccctgaaactgatacttctgctgctgcaggagtaagaggagaggccagaaacttccacatgctccaaggacaaatgccacttccacttccatgggctgctgtgggatggaggcaccagaaaaccaccagctccacagctgccccagtaagctactcctactgcaagcagccctgccatccctggaggcagatccctagggcagccaccactgcccccacctaagctttcttcaggaggcctggggaatactctgcccctatcatagtgagcacctgaatgcaccataacaagggcacctgaggacaagcccaccagccaagtcccattcccccaggatttgagcatgccatcaaggggcctggatatcctccagcccagtccacctctgctggccccaagccctcctcccagagtctgagatcaggacaaagtaacctgctgatccaacagttggcaccccctggcatgagccacctgtgtggactgacctgcccagcccattgcagccaccactagtgccagcatgaaccacttgggttccagtgggttgcccccacaactgctaataatatcacccacatcacaccatggccaaggggactgagaaacctctcacatgcccagctcactgctgccactaccagcatccaagcaagccatctggaggcccgagaattggctcacctaaacctgttaacacaaagccagcatacagtgttctggggctcaaggacaggcatgctcagaacactgctaccaccactggtgccaaagactggcctacatgacattctattccccagcaaaacttcaccacagtctccactcataaatgctccctgagcaagcaaggaaataacagatacaactgatgctgtttaccgccaaagaaatcatgtagagaccacactcctgcatgtacccaaagttaaagccaaagtgccctaccaaccaacaacatatatacatctttaggaaaacaatccttccctatgaaagcaaattcaaaaggttggaagaagtgactattacaacagatgtgcagacatcaatgtaaggtcacaggaaacatgaaaaaatcaaggaaatatgacatctcttcaggaacactgtaatgctccaataacagattcaaacaaaaaatgttcacaaaatcctgaataaataattcaaaatagtaagccaaataaggatacagcaacaaagaaaactaccggcccatatctctgatgaacacagatgcaaaaatcctcaacaaaatactagcaaactgaatccaacagcacatcaaaaagataatatgccatgacaaagtaggaattatactaggaatgccaaaatggttcacaatatacaaatcaataaatgtgatacttcacattaacagaacaaagggcaaaaaccgtatgatcacctcaatagatctagaaaaaaatggaaaaaaaatcaatatcccttcatgataaaaactctcaacaaaatagaagtagaagaaacatacctcaaaataataaagactggccataacaaacacacagctataattacattgaatggggaaaagctgaaagcctttcttttaagctctggaacaagataaagttgtccacttttaccattcctattcaatatgtactggaaatcctagccacagcaatcaggcaatagaaagatataaaagtcatccaaattggaaaagaagaagttgaattattcatccttgctggtgatataatcttacatctagaaaaacctaaaaactctaccacaaaacccctagttttgataaagaaattcagtaaagttgcagtgtacaaaatcaacataaaaaatcataagcatttctatacttcaataatgaactacctgggaaagaaatcaagaaggcaatatcattaacaataactataaaaaattaaaatagctaggaataaatttaacaaagggagtgaaagatttctacaaggaaaactacaaaacactaatgcaaaaaattgaagagaaaacaaacatggaaagacattgcatgctcatgaattgaaaaaaaaatagtattgttaaaatgataatcctgctcaaagcaatctacagattccatgcaatctctatcaaattatcaacatcatttttcacagaattaaaaaaaatcctaaaatttgtataaaactacaaaagacaccaaatagtcaaagcaatactgagcaaaatatatgaagctataggcatcacactacctgacaaaatatattataaagctataataatcaaaacagcttcacattggtataaaaacagaatgtagactaatggaacagaataaagagtccagaaatagatccaagtatttacgtccaactgatttttgacaaatatgccaagaacaattctgaggacaggaaatcctcttcaataaatggtattgggaattacccataagcagaagaatgaaaatggactcctatctctccccatacataaaattcaattcaatatatattgaagacttacacataagaactgaaactataaaattattagaaaaagaaatacaagaaaaatacttcaagacatcagtctagataaatattttatgactaagacctcaaaagcacagacaactaactgtaacacaaatagacatatggaactataagaaaccaaaaagcttctacacagcagagagaaacagaatgaagagacaacctgttaaaagggaggaaatatttgcaaactattcatctgacaaaggactaatatccagaatacatgaggaactcaaacaattcagcaataaaacagacacaaataattcaaaagtgggcaaagagcataaatagacatttcttaaaagaagacatacaaatggctgataagtatttgaaaaatggttcgacatcattaataatcagggaaatgcgactcaaaaccaaaatgatgtatcattttacaccagtaagaatggctattattgaaaagacaaaaaacaaacaaacaaacagaaaaaaaaacagatgctaacgaggctggggagaaaagggaactcatacacttagtggaatgtaaattactacagccactatggaaaacagtatggagatttctcaaaaaactaaaaataaaactactgtttgatccagcaatcctactactaggtttttatccaagggaaattaaatctgtataccaaggggacacctgcacttgcatgtttattgtggcattattcaccattgcaaaaaaacagaatcaaactaaatggatgaatggataaagaacatgtggttcatacacacaatggaatactattctgccataaaaatgaataaaatcatgtcattcgcagcagcatggatggaaccagaggtcattatgttaagtgagaaaagctaggcacagaaagagagacaccacatgttgtcactcacatgtgggagtcacaaacaatctcatggagacggagaatagaaagatagatgcaagatgctgtgaagggtttgtgtctgggagggaggataaagagagactgattattgggtgcaaacatacacttaaatacaaaaaaaaagcccaatattccatagcagagtagagtgactgtatttttcaacaatgtaatgtatatttcaaagtagctagaagagaggacttgaaatgtttctaacacaaagaaatgacatattctcattgtgatgatacattacataccctgacttgatcattacacattccattgtaatttttttgagacagggtctcactctgtcatccaggctggagtgcagtagctaatgcctcaacctcctaggctcaaaccgtcctcccacctcagccttatgaatagctgggactacaggcatgtgccactatggttgactaattttttttttttttttttttttagagatgagctctcattatattgcccaggccagtctcaaaatcctgggctcaagtgatcctgccacctcagcctcccaaagttctgggattacagacgtgagccgctgtacctagtcacattctattattgtaacaaatacatgtaccccataagtatgtaaaatagtttctaccaataataaataagtaaatgaaaaagtaaataaatataaatagttctgtttagcaggtaaacagaaattcaaatttgatttggctgaattattaaagacagggtattagtttataaattaccaccagaggcatcatgggaccttactgaaggcaacaagcagatctcaaggtacaacttcctaaatttttcctactggctgtctccatgctgaatcatagataggtgtatgatgtgcccccagagtgaacacgtgggtttccattttggctcatacagcaaccaataataccaatgacagattcttcagattcttttaatcctacagttcttccatccacaattgtatatgcaaaataaactggcttctcttgtgtagaaaaacttacatattacagtgtacgtattggttcaagaaaatagaatagccattgacagcaacagagtttataaaagtttggtagagtcactagctcaacaaggtcgccaatgacgcaggttctccataccctgtcatgaacagtgccagctttactctaaaatgagccttcctggtggaataggatggcttccagcacagtgagggccaagtgtgtcctcatttgcatccggcttgagagagagcaaggcgacaaccatacacaagttgtcatgagcctgactcttattgaacctgttgaactaagtgtttcaaaactgtatagcaaagatctgcaactcccctctctctgacattccttcctgggcatctggattccaatagtttattcctttaaacacctcactttctatgccagatttccagtttaattctgtcagtttttgctaacacttactaaagaaatgttttatctctcatttgacaaacaacacatgtatcatatctttttaaagctggagagagaagggctgaatggtaccctaaattcctaacagtaaaaactcactgatgcatcatttaatttagtgggcaaggtaatgacaaaggtgatttaatgcgtttggaaattcatactatgctacattgctaatatactaaaatgtaacagaaattttgtgaaagttaatttataaagctaatattatttcactcactaatggagaaatattgttttcaggttataacttttttaaggctagaataactgattatgaataataacgtgtttttttcctcttactacttatagtgcaataacattatttaattttacatgttaatatctttggtctttggtcctgaacccaaacataccagaatggacttataataggtacaggtaaatccactgtgtacaaatacagaatcagttgctattccagaagttactgaaattcaagacaaaatgtgttaatgtattagaatgcaataaactgaaggactttttcctcattcttaaaactcatatttttcttctgataaatatagatcacatatattactacaggctgccaaaaactatttcattgtaaatatttatgcagttttttttggtttggttaatgatgaatggcttgaaatgctaccattaactgaagaagcagtgtcataactcaagcatagtggacgtatataacaaaagtagttgtgataagtaaaatcatatagtttgtagagttggatgaaatataaacttttggttcagatgaatataaaagagtatgaattagggtgtaaatctccaaaaatgaccactaataaaacttctaaaaactaagagaacatcatttcaccaatgtttatacttgaacatttattgcatgcattttggtatttaattctattgagttgtgtctctttatatgagccaataatcttttctaaatttaaaaataaaatcaatagaaacataattttgaaaattgtgttatgctttttgagaattatacaatatttgatacaaaattacttgtattgggtttctacttcaagctaagaaaattgtctttagaaattgcatttattttcctaggtcataaagtataatgccttatatatgcctatggcttgatgaataatttctgcttaaagtaatttgaaaagctagtgaaatacaatgcagtgaatgttgtattccatccaatagagtcaactattgtttcataggtttgcctgtttttaatattatactggaactaaaacaactacttaacattataatagaaaatactatatagtaactgagaaacacaaatagttgtcccgatactagcaaaaaataagttatggagagttgcagaattgtagtaagaaacttaatacagtcctgggaaaatatataaactacttttctgcattttaagaaacaaaactgccaagatgttgcaagatataaatggtggaaagagatcatgttctagaacgaatagttttgtggtaaaattaaagttcagttactctgtgtactgggaagaaaggaaagtatgatatggtcagtagatggggaaatggcacgctttctatttatttatattaatacctagaaaacaaatgatagtgtccaaaatttccacatcacaagtacttaagttcctctggatcacccaagtcacgttccaagttacgtattggacaagaaataagcaggttgttcacacgattaaatgactcattaacttgggataatataaaataatgatatctgtgaaataagagaaagattactaaagccaatgttaaccaacctgtgcttaaggtgctaggtctttgatttatctcctgtgcaattctaattcttctggtcctaatttatttccttaacaatgaattagggataataaaaccctcccagagatgactgtgagagtctactggccaaatatgtttgaaaggtatagtaaattatgaagcttcactgcaactttttatttatctatttatttgtttatttatttgagattgagtctctttctgttgctttggccagagtgcaaaggtttcatcagttcactgcagcctcaaactgctgggctcacatgatccttctgcctcagccttccaagtaattagaattactggcatgctccatcatgcccagccaattttttattttttatttttgtagagacaaggtctctctattttacctaggctggtttcaaacccctggtttcaagcaatcctcctgccttggcctcccaaagtactagcattacaggcatgaaccaccatggctggtcctctcaaacattaaaaatgtgaatttaactctaatttcaatgctaaggcaatattggaaggtagtttaggcgtattctgaacaaagaaaaagaaaggagggtaaacttgtagagggtctgagatatagaagacttttgagttaatagacttcaaaagtggcaaaatcattacccttaagctacatttaaaaaattaatcaacctccactggggacttttcagcatatttcatactaattatttcttctgaaagccttcacataggcaaatttctttgtcccttttaaattatttattctcaaaggttcttttgttataactctctctgagagaaattcctccaaagaatggagtcaacacaaaatgccttttttaacatatgtgtaataggattttatctaatatagaattagatactattttcaacatatacttgtcacagtattttatgcttatcattttatgtaatataacaaatacaaaaaaaaaactactatgtactttcataatagaattaattattttgagtaggcatatatgttaaaaactacacgcattttcttaaaactaagtttattacaattactaaatctgtgtctatttttacaatatgtgaataatgatgtagctgcatcatgttaaattagtcatctcataccattttagcaattcctgtaattgttctgtgattttgaaaatgttttaataagaatgcacacataacataaagctcatttttatgtaaacagggtaattaatacagaaatctcaaactctctttactgtcaagatcaatatgcttataacataaaaatcctggcttactgccttgaacaacttagaaaacattaggcaattggctttcagcacaataaatatatgtatacaccatgtagatgagattcaagaaatattatactgtataagaagtgctggaggatatgacactgagttgcctatttttttctctctgtgataataaagaaaacaaattacgacaatgtttgaattaaaaaaggcaattaatcttagtataagagaataaaaattcttgtagttgatcacaattgcaatctattctatctttctcttggggaaacatgtcatttttatatatgctcatcaaactttaattggaataaaagtgtacttattgactctcctccctcagaatatttgaaaatattatacacatctccaaatacaaagctgtaattagttaaaaattatgcctttgatctgtaaacgtttcactttcaaaatctcaaaagtgtcaatattactatatttagaaaatatttttaaaatcatgtaaataggtagtgtttgttaatgaaacaaatataagtttacatttcattttattctatttcaatcttcgggttggtcatttaatggccttttccaatacgaacatttttgtttttctgggacattttatttatttatttttctttaatgctttattcctatgcgatttctccattttctattattgagtctcttactattcagatggtgggtgtcctgaataattgtccacctattttctttctgagtaaagtttggtcaaaattttaacaaaacctcttcctgtggagactataatactctatatcatggttcttagttttggatgcataatgaatttagggaactcaactttcagtgtgtaaatttttactttattctcttgcttttattttgaaaacttatccttaaatatatctggttttctctactaacagacaccaaaggaagttcgggaaaaaaaaacgaaactgccgtcttaagtctagattagggagggacattcatatgaaagcatgaagtcaagaggaaaatcaggaaatttaatggaaatatatatatatatttctatagagagagaagttccttataatatataacaatattcaaatttatataagttttgagattgagtccctttatgttgctttggccggagttcaggggtttcatcatttcactgcagtctcaatattataatacataatataatagaaatatgatataaaataatatatatttataatatatcacatatattataaacatgtttatatatttataatatatactattttattatatatttataatatatattattttattagatatttatatatttaaaatatataatattttatatattataaaatatgtaatatttttatagaatacatattatatatagtctatatatagaaatatatatttctatatgtctacatacatatagaaaaatatatacatatatttctcttgctatatatatagactttccttataagcccactgtcacttccctaccagaggcacccagtgtcacaagtccctgactgttaccgggccctgtagagatgcaccatgagtgttgcatcatgaggcttcctagctttcttcctgccatttcaagacttagatttctcagggccactggttatgtaatacttggcgtattcgcttttcatcttcaagattttattaatgatgtctcctctacgaattacttgctagctgggttgataacattaataaaacactttattggtttcttaggaggcagtgaaggccagtatgtgcatatacaacctgccatctttaaccggaagcatccctttatttgtaaatgtagtaaaaacggaatttagtattaattttatatttctaaaaagaaaaggattacttctaagtgttgagactgaatcgaccttggactaaatttcatgttatcattattattattattattattattttttgagacggagtttcactcttgttacccaggctgtagtgcaatggcgcaatctcagctcactgcaacctctgcctcccgggttcaaacaattctcctgcctcagccttctgagtagctgggatttctggagcgcgccgctacgcccagcacattttttgtgtttttagtaaagacgggatttcactatgttggccaggctggtcttaaactcccgacctcaggtgatccaccctcctcggcctcgcaaaggctgggattacaggcgtgagccactgcgcccagtctcgtattcaaatttcataactaaatcaatctaattgcaaatggtgtgttggcacttctgagatgaaaatgaataagagagttcctctcagaggaccagcattataattgaggatatttaataactactataaagtgactaggatattaggaagaattagggaaatatcattagaaatgagcacacgtaagtccaatgggctacatagaataagatatacacacaaaaatccaaaatgacttagaaaagtgtcaatcaaggtgaattttgtgaatgttagttcatttattgtggttaataaacatggggaaggtcctattgcagatgtcatttttgagagaacataagcaaaggcattggcaagacagcatgtgtgggtttcaggtcactgagaaggttcctttggttgaagtatagaacacacttggagaaaaggaaaaacgttgctggtagaaattctcattttgggagttcctttcttactgggcattgctggtctcatatattgtgcttagacaattaaaccttctaggccaaaataatctcccaattcatgtgtatatttctctaactggcataaatcaaccaaacaaaacataaaattccactagttactttggggaacttttcacgtgaacatgattgttcatctaagatgctaattataaccatagcagaaatcattcacatttggagatctctcccgctctcccccatttctccctcccttctctgggaggactgtgtaatgtatacaatctccctcttttggtaacttatttcagggatgaatatccaatggagttttaatcatataattagatggaattgccatgggtctgagttattgttatactagatgtaatatctccattgtgggtgttaaatgggttttgctagatttaagctttctctcaaacctggaatgtaaagaaaattagacttttatgataactattttatatctgtctgcagatagctttctcaattattttattatttttctcatttttctcttctaaggaaactttgctctgttactatatgcatactgtagtgcatctatctagcctagataaatattaaaaaatgtccataagaaaagaaaatgttggccgggcgcggtggctcacgcttgtaatcccagcactttgggaggccgaggcgggcggatcacgaggtcaggagattgagaccatcctggctaacacggtgaaaccccgtctctactaaaaatacaaaaaaaattagccgggcgtgatggtgggcgcctgtagtcccagctactcgggaggctgaggcaggagaatggcgtgaacccgggaggcggagcttgcagtgagccgagattgcaccactgcactcccgcctgggccacagagcgaaactccgtctcaaaaaaaaaaaaaaagaaaaagaaaaagaaaagaaaatgtcttttttatccattaccaaaactaattcagaaaaaaaggtttcaaggttgcttggcaatggcttatgttcctcagtaacaacagctagactattagagatcttggcatgaattcacaagtttttaaggcatttgatgtattagtatagatgtgtatgtatgttaaaatgagttcatgcaatagtcttgattaatatgcaactttttgaacaaattagagcgactaaattttaacttaaaaacaacttttttctttcttagcacaataaaaataatagtgcagtctttcagttaatacaagccttgggtccgatttctaatgattttaatattttaaattccctacatttgttctctagggtccatgtgttgtcattgtttctacaaattgtttatgatttgttacaaaataaaaattatgttaaactaaataaaattttaatcacaaatgacttatattaatgaatgtcttttagtagagtgaactcttatgaatccttggaatgctgcaaatcataaaaattaaatgtattgggttaagtggttaccttaacatcttcagtcaaatttaataccttaaacttatattaaactgtgattctttagatacttggatcatttcccagtaagaaaaatatatagatattggctacaaatatgattttaaatgcctttttttatttctacatacagattggttaaagcttaatatactgtgcagacacagatctttctaaatagttatccatatgattttcttcatttttccatctttgaccaacatggattcaatgttcccctaagcttgattaataagataggctgctttctaactccagatttttgacctcccttttcttaaagtatgtacctttcggaaaacttcctagaaaacttccaattgtataatctttctctgcttttttgagatgtaaatattttcacaacctcaacatttgacaatccatacacgtttttctcaaagatcaggagtcattcctttgaaatgtaatcattaaaagaaatgaggaccttatctttctgcctctataagacagtaggagcctagcatccatagcaccagttaacaaacccagacggcctgtatttttagtctgttcttgcactgctataaagaactacctgagactgggtaatttataaataaaagatgtttaattggctcataattccacaggctgtacaagaagcatgactggggaggcctcaggaaactttcaatcatggcagaaggggaagcaggcacatcttacatggccagagcaggagaaagggagagaaggtggaatggctacgcgcttttttttttttttttttttttttgagactgagtttcacttttgttgcccaggctgaattagcaatggcacaatctcggctgaccacaacctctgcctcccagtttcaagcaattgtcctgcctcagcctcctgagtagctgggattacaggcatgtggcaccatgcttggctaattttgtatttttagtagagatgaggtttcaccatgttggtgagactggtctcaaactcccgacctcaggtgacctgcctgccttggtctcaaaaagtgttaagattacaggcgtgagccactgcgcccggccggctatacacttttaaacaaccagatcttgtgagacctcacatggcaagaacagcaagggataaatccatccccatgatccagtcatctcccactaggcctctcctctaacagtggggattacaattcgacatgagatttggtcagagacacaaatccaagccataccattgcctaataacattaaccaaattctcccctaacttctttcagcacttttctactaagacatcctggtgcttaaaacctctctcacattttattttagtgcagttcattccaatcaacctccttatttcaatagtcttgaataaagtctttcttgcctgtttaattccatctagaacaattttacattgacattttctaaaaaatgacataaaatatatgcccataaaaaaaatctattattcttagtttcctgctatctagagttcttttattatcagggaaaaaaatcattatttaaatgtgataattcatatatatttttacagagtaactgaaatatgcatgaaagatgaatattttgtctattgttcattaagatgaaaaaccaataatataatgcatttattgtgttgtttaatatgatgataggttatattttaaggctaaaaataaaagtcttaattgaatattaaggttaatttaaaagtttaataaataaaattttaaaaaagcaaatttgagagcatactataatttttaaaaatttgagaaatgtgatttacttaatttataatatacacatattatttcaaaagaaatagtaaattatcttaaattgtgttgacaaacctgagtcaatacgaatagaatcatttgtaaagtaatatgattaagtcttgactacaaattataactcagatacttaatggaaattaaaattaaaatttgagcttcttttctacaaactgatgaagttatcctgtgcctagaaaatagaggatgctttttcttgccaaaatgtttataaactctttgaacttctaacatactattattttgagcaaaaatgcctttaaaaagttacatttttaaaaattgtaatgtacatttaaaaacattacaatttttaaaaaaaatttttaaatttaaaaaaatgtaatgtacattaaaaaagtaatgtgttattaatttttaaaaaataaattctctgtaactatatcttccctttagttgttacagcttgttgactccaaaaccctttcttgattttgtgttaataaaatttactcctggtgtcttttagaccaaacctgtccctatccacctttgttagagtggctttgactgaaaacaggtcactaaggttccttaatgactggtattgactttgtagcacaaaagcctattggctgctgtctacatacagaatatgtagaatatagaatattgaatatgtaggatagaagtcagttatctcagtaaagtggtacctgcctcagaatagcactggatttaagcaggaatttatttccacccatagttctcaggagggagaatgagagatgggagagatgaggataggagaattgagagttctttagatatcttaatgtttcaaagaccaaaagcagcctctgtttgagttcacatgcttgaaccactaaagggaaatttttaaatgcctatatctgctcccagagcttttttctttttatgttttataataggcatgaaaataagcagactgtatcatgctatatagttcagagaatatatgaactagagattgtcactaagactatcaggctcatcataagagaagtttatgaaattagacaagcagtgtttcaaatagggctgttgtagaaataatactgtccactggaggtagagtatatgatgcctaagaagactattatatttacattctgtagacttgtccattacattaaatatttctaagaaaacaaaaacatcgtgaaactaggcaatttgcttaatacttcctgaaaatattcttttgtgagtcctttggattggtggatgggatataggatatgttattaaactctcttggcttctgctttacaaatgaactacactacagtattagaatagacacaatagaaaagtcccctttcatgtataaagcaattataggtaatgggggcagaaaattaaattctattaatgtataataatatattaaagaaaagagttatgttgctttaagaagggacaaatagaggtcatatgaaaatttatttgaggataaaaataattaaaagccaacagcttaacacagttgcctgagatcataaagattaagaaaacatatttcatattaagacctaacaaggacattaaataagatcacaaaattcaaggcatgaaaaaaagacattttaatgtcttcattcattattttttgataacaacactttttaaatagatcccaatttgaagcatctcaacaaaatacaattttatgtcatattatgtacaatagttttatttacaaaatacacttaattctaaaaattattaaaatcacagcagctttaattctatactgtatatcatcacataaatgtgaaatgttttgggaaaggaatctaaatgttaacgtaaatgccttaaatataactcttctgataactcttaaatgcaatttgatcaatatttgggattatggaaagagtgttgaattgctatgaaaatctatagctgaacgtcttatattcagtttttgcaatgcttccaaaaacaggaaacaatgcaagcaaagtgccacagctggagtttaaacaaatgtccatcctttaaagtttttcaaagcattttaaacatcttttcttatggttcttgacagccgagggcaaacaaggttctttgtcaatttatgactaagccaatacctataaagatcctctgagattactgtaagctctaactaatgtccatttcctttatgctacatttgggcattcaagagtgatgtcttcctaggtggctatcagtctcccaggctcatttacctgaatacataaaatgaaaagtgatgagcttttggggtggacttaatatttggcacattaaaagctaatttattatagattaatatgaccttaacaataccaccttttcttcatttcattttacttttcaagtaagaataaaaagaccttatgggataaggacaagctgacttaaacagattatggattgtcaagtttcatatgtgtgtgtattttatatacacatatagtccctaagttgaaatccatgaatgatatggattctagaacatactaaagatgtaactttggcttgaagagtaagaagtctttattattttacttaggtaaaaaatacaatatttctttttcacgtaaaagtgaattttgcttaaaacatcaatgcaaaaacataaatgtgctctgatgagcaactaaaatttaggtgaggagaatacagacatacattttattttttaataaaaagacaattttttttttttttttgagacagagtctcactctgtcgccaggctggagtgcagtggcatggtctcagctcactgcaagctccgcctcccgggttcacgccattctcctgcctcagcctcccaagtagctgggactacaggcgcccaccaccacgcccggctaatttttctgtatttttagtagagagggggtttcactgtgttagccaggatggtctcgatctcctgacctcgtgatctgcccgcttcggtctcccaaagcgctgggattacaggcgtgagccaccgtgcctggccgacaattgatttttaaaaattacataaagccatattttataagatttgatgaaaatgtagtcagaatacacacacacacacacacacacatgcacgcacacgctaggtattggcatagattcacagatattctagcatccttgaagacaaacatcatctaggtattttctacatgtacctgaaaagatgctggcctagaagccactgaaaacctgtgaaaaactcttactcctggaggatgtgcttattatgagagtaggctaaggattcatttgccaagaacctcgaccttaacacttttgaacttgcaataatagacttcaccaaattaaagcccgtgtgagctgacactttttgtttaaataacaagtaactagaaaactatgtctacaatagtaatgtaacttacttcaaatgatcataatttttgtttgaaaatatatcaaaatcctttaagcttctttcatataaattttaaaggtttgaagtaaaattagtttatatctatacatatatacatataattattaatactttttttataagcatctcacttccaaaggaaatctttgtacatgtaatattacttttcaaattccaaaagccttgattacatggatggatggagagatagatagatagatagatagatagatagatagatagatagatagatgatagaatatttttaaaatatattttaactggtttaacaaaatcgcatctctaggtttagggaagcagctggtttgacaatggctgtattaatagtgggaaagacaaaattgtggtcacgaacacaaaagcaaacctaacttgcatgaaaaacatcacatgagactctatataaatcattgcagcacagcaatttttaatacataatcttaaacataagtatgtccaatgccggtgggaacataaaaatagcatctttaatagattgaccttaaaatccttgctcagatgttaatgtgaaaaaaaaatctctctagttactgatgagacagactggcattagatctgctttggttgggatgatgctacattctatgatagagtgaactatagggttgcagtgctaggattagagttgtgtccttctatggtagcactaggagcagagtgatgtcactcagcagaggatgatgctctaaggtggtgctgggaacagagcactgtgtctttctctgtgatagagttatatactacagagtgttgcagatgagaaggccttgtgttgccagggaggttttcacaatgaagtgacattccacatgagatctgaatggatacacatggaactctgggaaaagcattccaaagagtggaaagtgattgctcaaaactcaaaggcaagataaaatataaaagaaattaaataactccaaggaagttattgtcatctgttagtaatgcattcattcaacaaatatgtattgaatgccagccatttgaatgcagacatttcttttacaaaacaacaaaatttgggtttactagctttttttaatgttgaggccatatgcaactacttccctgaccattacttttccttttgccccacataaatcagaggagaatttctcttttttgcctagtcattttttatgccaatacgttaagtattttataaatatatgctaaatagtaaatatattacataaaatacattatcaatggaattagtgccctacctaaataactgatttttttttatgactgataaaatttttaaaaatgtcctgaggttttcctgtgcaggtcagaagtctgaataagcactcatttaaagattcatttatcttatcaatatcatggtcaatataaatcaatcaaataaaaccaataatatcaggaaacctaagaaagcagaaacttccatattttatagactttaaaactgagaacaaaattacttttcattaataatcaagctcttttttaaaaataaaaataatagcatggccactaaaacataaagaagttaaatcagagaacttgagatttaagcaagaggcagcaatgaaaggcaccaaagaggtaagggatggaaaagcttgggaagaatgtcagacgagaaaacttgttctttacttctcctgttttcatatagagggatatttattctggtaacacttcaggcttcctgtcctaccccttcctttggtatgacccaggggagtaagggagactcactaaataacgattcaggaataaacctggacatgaatgagtaagcttcctctgacttctcttctaatcacctgcctgacagacggtgccttctggtctgttgagaagtttgaagttgtgttggttaattttactctagtgtgactataaggaaatcacatattacacttacatcccatccaccaatctttcatcagtcattaataaagctaacacttgacccccacctgttcgttccctacttttgtttctcaactgcttctgtaccattagtaattttgtgactttgggcaaaacacaaatactcaccctgcctcaacgtattcatctgtaaaatgaagataagtttttgagggttaaattaatattattaacattcgtcagtgcttagccatatttggcacatggtaagcactattcaaatgtagttaaataagcattatttagttgttcctttacaactccaacagtgaggccagagaggtatccatgcttcatctcattcaagtcattattgaccaaagaaagacatgtgaaaattgtttaaagcacagcagaatgcattgtgaatcctggattgtaggaaagtacaaagcagagttaacgttggctgttgcagcagtctacagaagatgtgatgccgacatgagctagaacaacaattttacaaagatagatagagtatagtggagagattgcttgggaaaacctttctcacactgttctacagtttacaacacttattacaaacttctcaaccacccctagtcattaggaagagatttttcactgtagtcaggctactctctcggtcacctccaggcagcctattttttttctcacatagatacctcttatatggatcagattgaatgatattccccaacaatgtctctaatatgtcctaattaatggaaactgggaacgtcacttcttagggaaaacgtcttcacagaattaacaaagttaaaatcttaaaataaggagatcaccccggatgatttgagtgagtccaaaatccaatgacatgtccttccaagacaaaggtagagggaaatttgagacagacagaataagagaatacacaaaggagaaaaggagacaattttaccaaaaaaaggaaacgttagagtgaagtggccataagccaaggaagtcaggaacactaatgactaccagaaactttatatggcaaggtacagaatctctactaggtcacttaaggaaatatggccttgctgacacttcgatttaagacttccagcctctaacattgtgagagaatatatttatcttgttttaaccacccatttgtacaggctgtcacaggaagctaatgaagatattggcatctggaagtcaggttctgctacaacaaataccgaaaaaatagctacaacaaatactgaaaaaataccgaaaaatgtggctttgaaatttggtaacggttaaagactggaagaatttggagaagcacaatagaaaattcctgaattgtcttgaagagacttggtagaaatatgaatgtcaggttaattctgatgtgcacttagatggaattgagaaacatggtagagaaagtctctaatgccttggagaataaataaatttcatagattgaatgttggtgtaaatatgactgttaaatgcacaatggagaggattcagaagtatatatatttggaagccaagggaaagttaatccttgtagtggtcagaaacttggctgaattgtgtttccctctttggcgagatgtagaatttgtaagtgatgactttagctgaggaggtttccaaacaaaatgttaagagtgcagcctgttttttctttactgcttattgaaaactgtgagagaaaaaaataaattgaggaagtaactattaagcaaaaagcaaccagcatttgatgactcaagaggttctaagcctgtacaaattgcaaagaatactacaattagaaaattcactgttggaaacgtgtgctgttaagagaagtccaaagatattactggacaaccttctgccaaaggattacaaattaaaaatttacttttaaatctcattataatctgagaatagaaatggtattatccagaggaaaaaaaatctatggaggactctcgtctaatgatatgaatcactgtgattcacacaggagaaccactaggtttttgagactgttatagcagacatactgctagcttggaccaaaaggaacgtaagatgataatatgacagaaaattgcaggattttcaaaaatctacaggcaacaaacagaaatatagagctactcagctgtaaatgtgtgtgaaccttcaaggaaaaggaagaattactcaaaggcagaggctggtggagcaatgggtgtagaaactaaagcagatggaatctcatgcccacaggagtgagcctcaggccaagagaaaggagctgtgagttacaaaagattaattactctgagaccctgaaacctaatgggatttgtcttgttagatttcaaacttgcttgggactggtaaccttttcattgtttacaatttctgccttttggaatggggccatctatcttatgccaagcccaccattatatttttaaggcagataacttgttttctggtttcacaggttcataaatggagagaaattttgcctcaagatgaatcatatccaaagtctcatgcatatctaagttaaattatcaattttggcttctgggttaatgatatatagaggagattataaatttagagtttgtgctataatggatttagacttccaagtatgccgggataggttggctattgttgcatatagattcacataaattttcaggggctgaggttagactgtgataggactggatggtgactatcacaaagataatttcacatcttaaaccccagaacatgtaaatgctaacttatctgggaaaagaatctttgcagatggaattaaattaaggcttttcagatgaagatactagcctggattatctgagcaggatctaaatccaatagcaaatgtcattatatggcaaaggtagaggaatctttgagtcagacaaaagaggagaagacgtatggaagaggaggatgcagtatgaccatggaggcagagatcagagtgatgtgactgtaatccaaggaagccaagggttgtcaatggccaccagaagctacaataggcaagagaagcattttcccattcagcgtctggaggcattgaggccctgccaacacattgattttggacttctgccttttttagttgttagagaatgaattcattttgttttaaactaccaagtttttaataatgtgtttgggcagccacagaaaactcataccctttaatacaatcctctcacatttaacctgatattaggctctgtttctctaagtgtctgacataatacaactgagaagatttttacaaagttttgtatacaaaactgggaattaatttttttcttttggacatattaaatataagatatgtctaatatatctaagcagaaatgtcatgtaggcagtttgatatttgggtctgaagactagtggaaatgccagtcctggagaaataaatgtagggaacatcgccacgtagatgatatttagtgatatggagctgtatgaagtatcctgttaaaaatgttgtaaataaagaagagatgggtaaggcctgccctggaggacttctgcattttacatactctctgagaacattaagccagtgaagaaaaataagaagaaagagtcagtaaggatatgtggtttgtctgccagatagtgcctaactccctccccatctttaacctcattccttgcctcctgccttagccttcttcctcttttgtcctccaactgttcttggactcaatattacagaagttgattcatgatgattgaatccttgatttatatcaatgatgattgggctgcacattttataagattttttaagctgggatttttattactttttaaaaattcttttgaaatattacccaaagacagacctgtgtcaaaatataagaaccatgtaaatattatcaaaaataagcaattttttctgttcagtgtttctagtgtacaatgagaaaatgagggaacaccagatgccctggagaggtcagcatcagagggcactgaggactataaaaatctggctgaatcaaaatttctccagttactcctgtggagcaaaggagactttctgcctgatgcactagaagctaatgctatgacactgggtttttgagaaaagaaaagtgttctattacaagccaaccagtgagtccagctcaattctgtctccctgcactgactttaaggcaataattttattagaaaaggtttagggagtagattctgggattagcaggtgactgatagaagggaaggggaggtctggaaagtcctcgggcatgtacagttatctcttcatgctgcctgatggatcaaatgagcaaatttggaggtagttagtataaaacatgcagtgtaaattcaggcttcaatgtcagcaagcttgttctgcccaaactccaatgggtcatattggttccaactgatttcagccagtttttaaaatctcacagttggaggaagtttcagcatttcagcaagttggttcttttctaatctactatcctacaaactcaagattttctgttagtcattggtttctttaactctttggggcatggtttctctcctactgtctgtcgtacctcctaaaatatgcccaatagcttttttcttcttcagatcctgtttctttcttatctgccatttactctggatcaatatagcattaaaatactcattgcttttctctcttctcttttacgtatataaactttggtgtatcagagtctgctggtaacctctcaatactcaatattcatccctcttttctttaggtgggaatttggccacctcctaaaaagacaatatctccctgcctcccttgtaggtagatgaggctgttattaagatgtagccggtggaatgcaaaaattattatcacgtggcagattccacaaatattctctcaaataatcatggcaaagtctctttctcctttcaccctttcccaatggctggaatgcagacaatgccagccttcaaaatagacactagcaggagagcaacaagatgaaaaagaatgtctgtcccatgaacacactgagccaagccagtttataagcctacttaagaacatttaattgagaattgtgtatcttattttcagcacttttaattggaggtcattgcaatttacatttgaaactaattgcaattgattccaggttttttttttttttttcttttggaactgagttgcttcaagtaacagaacacgtatcattggcttaatggaagttgtccagcagcagatggcaaggattgacattacagactagaattttgtaaccttataatgcagtagcaaaatatggtaaatctttcctgttacctgcatatggcaaatcaggcactggtaaagtagtagaataagaagcagttataagatattgctacagtttaattgtatttctccaaaaatcgtaagttgaagccctaatccgtggtgcttcagactatgactatattttgacatatggtccttaaaggaggtaattaagttaaaatgaggttattatggttggccctaatccaatatgattgatgcccttataagtcaggaggaatttaggacatatgcagggggaaggctatttaaagacacagggagaagatggccatctaaaagccaagaacagagacctcagaagaaataaaccctgctgacaccttgatcttggaattctagcctccaggattttaataaaatgaagatatattgtgcattaactactcttgccaccattaggtaagtttataagaaagagagtaacttaacttgtagataaccacctgctgagagagatgaagagggatgcaacaattaagtcaaagaaggccttctctgaaagcagcacacacttattcactaacagcagaccagtaatatggcaaattgctgggttgaaaagccaaccactgctatacctcacagggaagcagctctaagcagtggttctcaatatggaagcttagcaggaggtaaggatatacctcaggtctttttccaggatttgtcattattagttctcagtgaaacaatggaagccccactgggtaaaatatataatttaagttgctacttcataccaacgccctcttttacaattacttctagctaggaataacacaaataagagagttgggtgtgaatgacacctaaaccacatagatctccagtctttaagacggagataataagatgattggcagtgttggaaggaaatcttccctggatttcttggtgatttgacatggtctggaccgcccaagcaatagacattgtcaaattataatgatagaacacgcatcctcttcttttcccccacaactacctcctctttgggttctaagggtggtagatatgaagtcttttgtctcctttttcaccagagacatctgttccttcttcaaaagatatgagagcctttctattatctgcatgattcaatgtttacattcttggttgtagaatttcttctcttccaccaacagaagatctttgtacattccaaaataaaagataagcaccttttataagtccagaagcatagatggttggctcctatgtaagctttaaaattcataattttggagtttctctactgtggtagagacccctctatgtgcagggtacgtttggctttccttacatagccctatgaaggactgaggtatgggcaaatagcaacatcactaaggtattctgtgagtcagtaaaaagaggttttttgttttgttttgtttgcttttggtgtgttcttgataatctctggtgtttctgctagtgtatttgtgtgtatgtgtgtatctattgaactatatttctatcttctatttatccaatctgtatgtatatacatatctatatctatttatcttactatataatctacccagtatctatctatctatctatctatctatctatctatctatctatctaatctaaacaagtagtgtaacattttcaactcttcacagttttacacctaagagatgtatatgtggcagcaaggatatgacacaaagcaaacatgtaagaattgtactaagtaatttttttgagaattgtattgaaaaaataaaaacaacaaaaacgtaatcaaataatatttcaaacctagcctgaaactcttcaaaacagtccataggccagcaaacctacatctatataagtatcattttaaagcttttcagcctcttaaaaggacatctgttccattgcctacttcacatgtggacagagcacataatggacaaaaataaaccttccagaaagaaggatccagaggccatagagaacaatgaaaaaggtaattcctgccagagagtaaatccagccactaacagatggtgtaacatgaattaactacactgccagcaaaaggaaccttcaatttcttcccagactaatgatggccttgtgtttcccgctcctcctttttctaaatgcaggttttgaaatgtgttacttattacctcagtacaattgtatggtaaatgtgttagggatatataacttgaattttaatttacagatgtaaagtaaatttttctacctacttgtataggagatattaaagctgactctgtgttttaacacaaccattataaccaacaaaatctcttaaaatataataatatttgagtgatatcactatgccagaacctcactggcctgaccagagaacaatgattcctgttttattaaataattatttgtgcacagaatcctggactcctcccttcctaaccagagagcttcttttcaatcttcattggcataactaagcatcagtaacatatacttcccccctttctagtggttagatatctctgatttgcattcttagtgaatcactgattttattctactggtgtatctctttgcctggcaggttaataagcctggtattcttttgtcattggatgttgttttttttattgtatgcttctttaaattactgaaggccattgtttacaaaggtcacagtacaacaaggacttacatcttgatctgataaagaggactgtatattatatagggatcttggagtttgagttgaatgaaataatagattagggctttagaatattttctcccctaagaatgagattaaatatatagaatagaaaaatgaatactgtgcttgcagagatttttttttaatgttttattttgctagaaagcaggtttcaccacgttgcccaggctgaaccttgaacccctgtgctcaagcgatccacccaccttgacctcccaaagtgctggaattacagatgtgaaccaccatgcctggcctgtgcttgggtactgaagttgcaaaacagatagacagattttggtagaaatctaatatattttatttgatatcattagatcatcatatattttgctgccaatgaaatgctttttagccccttttgccaggtatagctttgcaaaaaaaattatgaccactgggaagcgagtggaggtgcatgcagctctcaggaacattctataaatgttagttggcatgctacatttgtcctttcttatttgatctgctccttcctgatgactggaattaattagatggccatgttggattccccaacttggaagtgagttgactttgggaatgtaggctacgtaagatgattgatataaatgtaagacattttgtgcttcgtggagaagagcatcacattgtactcaacttctatacatttgaatatttccatataataaataaagttgtattttgtaaagccattattatatctgcattcttcgttattttagtcaatcctaatcataactgtttgccaatctaaactattaaattgataacctctcagacaactatttcaactttttctgattctttcggacaccattggaagttttttcctgcacaaaacatgtacgaaatagcacagccataattagaaatttacaggcacatctataaatatcaactgagatttaaaacttagaactcttcatgtcaatcacaacatccttcctcattctctaaaatttactgtacctactttttatttctatagggatctctacctaccaaaaagcaatcatctattactaatgtttatttacctaaattcttttagcatttatgttttataccatgtattttgttacttcttagcacaagtgaattatattataaagtggtttcataatattttgttacattcctttggtagttgtaaaaacatggcagcactcatctaaactagtaatagacacaaattctagattctatttattgaggtatattgcaggtcaaatactataatagttcatttaatttccaaactatcatacaagtagttcataataatgtatagagttgaatactgacctctttcaaattttaccacccagaatatgtgagggtgacattatttcagacaagaatgtctatagatctaattaaagcaaataccttgagctgagataatcctagactaggttgggcctaacatccaataagagtatctttgtaagagacagaagatgggaagacatacagagacacactgaggggaaggccatgtggagaaggaagaagagattggagttatgtttctaacaagccaaggaacatgagggttagctaagccaccagaagataagaaagaggcactgaacagactctctgagcctccaaagggaaccagtccggctaacacttcattttggccttctggccttcagaactttgagacaatacatttttgttgttttaaatcacccaatgtgtggccatttgttacgacagccccaggaaagcaatacagattttgttaccaggaagtaaggtgctgctgtaacaattaactgcaaatgcagaaggtgatttggatttgggtaatggacagaagttggtagaatgtggaggcacctcttgaagagatattggcagaaacatgaatattaagactattgtgatgagcctcagaaggaagtgaagaacactgtagagaatgcttctcacttcttaaagaacacatacttttttgaatagatgtcagtagaaagacaaacattaaagatctttctggtgatgtctccaaagaaaatgaagaacaagttattgtaaactgtaacaaaccagatccttgctagaaagtagcagatattttagctgaatcatgttctactatcaagtagaaagcaagacttgcaaggttaaacttgaatatataactgagaaagtttcaagtgaggtgttgagggtgaagtatggtttttccttgttccttatagtaaaatataaaagaaaagagataaactgaagatgaaacttctgtgtgagaaggaatcagcacttgatgatgtggaagattcttagcatatctacgttgcaaaggatggaagaattaggaatttcactgttggaagagcaaattctaaagagagggtcaaaggtatggctgaacaaacttttgttgaaaaaattaggtgtgtgattcatggatccagtcaaccatcttaggagaagccagaaatagaaatggagttatttcagaaatgcacaacctttttctaatggtgcagatcacttcatacatagtagacccacaatgtttttgaaaatgttatataagcataaacattggcagcttggattgaaagaaaaagacatgtgatggaaagaaggaagatgaacaatcttctgggatgtcaaaggaataaattttgctgataaaataactcagctgaaaatgtgccaacctttaaataaagaagaaataactactcaggtgctgaaggcagtgtagccactgccaagcatggaggagagaggcatggactgcattctcccagaaaggaccaaccctactggtaagtagatttcagatttacagtctctgaaactgtgagagaatgattttctgttgttttaagatacccagtgtgtgataattattatggcaatcctaggaaactgatatatagaatattcactttacatgtgggtgcaacaacccttgagaagtctaaataacatcatcatggtcacacaattattgggtaataaagtcagcttttgcaccaaaggagtctgctccagagaattaatcaatcaatgcaatatctcatgggacattttacttttttagaaagttcaaaatgtaattatggactgaagagacaatcaattgattcatttagtttgtggtcattcctatcaatgttctccagatacagaattttcaggcaaccacaatccttgcaggagctgtagcatgaatatgaccagtatacaaaccataatatttatgaccagaaccaaagtatcaccaatgaaagatcacagagcaacctcaatcataaatggtactaccttaatagaattaacatgaacacagccatgtgaagaccaagaagccggagactatgagtttgccattttcagctttatgaggttttcggtgctagtataaaataagaaactgagaaatgtgttgcagtagtaagacattgtatttcaggcttagatatctgcaactgcactgagtcaagcactagaggattacactaggtatattagtaacctcaccaagattttttaaaatgaccatcattacacaattaaattatacaattaaatacaatacagtaagatataatatttgactatattattttactatatgatgcatatatagtaataataccttcttgatgtgttaagttctagttggggaatgctaaaattgaacaaaattgaggatgaaggagcaattgtagtattcttcacaattataaaagcaattattatcagacatatttgtatgtaatatgcaatctgtgctagcaaacattaggaagctctaagtcaattgccttaaaaataatatatattttataaatttacacacacacacacacaatttttttttgaggtctggcaatctaaacccctcattttgaatagaggaaactcaaagcacaaactcacctatttagattaggataaagttttgcttagaataaaaattcctgattttctttcagctcttctttccaatatacagtctctatacatttggtatgttacaagctccagaattcactttagtgatacaaaaaataaacttggcttagtatttaacagtttattttatccttctcatcaagaagcctgcccttttttttgttgttttcttagctaacattcataaaagcaacatcaaagaaggatattaatgtgtagaaaaatgttcttacatacttgcctaaattatgtatttgattaaaactgctataacagccatggctttctaaccagtaaaatgaatctcatgcatcaaggtaatgactagacctttaacatgatatattgtaagctacaatacctgtagaaatgagtgaggaaagaataattacaaaggaagtatgtgtttgaggaaacaacttttgcaattagaggcctgcatttaaggaatgccagcgtttctgtgtttcccctggatattcttggtaactagcacagtgttgtaacaattttaagacattacaaattaacatatgtgaccatgagaatttatctatgaggaatatttttaaattaatgactcttcatggttttatatgtatattcaaaacataataatcaactgggcacagtggctcacgcctataattccagctctttgggaggccaaagcaggtggatcacctgaggtcaggagttcaagaccagcctggccaacatggcagaaccccatttctactataaatacaaaaattagccaggcgtggtggtgggcgcctgtaatcccagctactcgggagactgaggcaggaaaatggcttgaacctaggaggtggaggctgcagtgagccgagatggtgccacttcactccagtctgggtgaaagagtgaaactgtctttaaaaaaaataaaaaataaagaaaaaatcataacaatcaatttacttacaagttagaggcaatttattttctaaggccagcttatgtatctcaaattgttttgacctccacagtaacttgattctatagcactggacatcaaagctgaaaaatatgtaaagaaaatgctttaagaatatgcaagactctctgtattctgtgcatcattaattcagccttcccagaatatttggttgacacatctctatgaaactttgaaatctctcacatattataattcataaccaaagaagatttctctaaacaaaattctatcaggccaaagatagtaactctctggaaaaaataaaaaagcccacatcctaatcagcattgcctaagaaagagaaaatggtaggcagaatgagaaataaaatggtttaaacaataaatttagttccaatcattcaacgtgacttaatggtgacagaatggagtcaactgcattaaacaaacagacctggtagctcataagtttctaaatacaagagcaaagccagcactgtaatgacatttcttgttacagtcgtccctcaggatctgtggcagacttggttccaggacctcctacagataccaagattcacagatgttcaagttcctaatataaaatggcatagtatttgcatatagcctacacacatcttcccatatactttaaatcatctctagattacttataatgcataatagaatgcaaattctatgtaaatagtagttatactggattatttaggaaataatggcaagtaaaaatgtttgtacatattcattacggatgcaattttttaaagcatatattcagtctatgattaaatatattcaattcaatactggttgaatccataggtacagaatccacagatacagaggatagattgtatttatattgtagttacagattataaaatgctttcataaacatactcgctttttaactttaatcattacaacaaccttcctaggttggcaagtcgaggactctttttgacattattgaaatgaaaacaacttttagggaaggagggactcaattaatagttagctgaactgcaatgacgagagtcatcactcaatactaggtatcgtcaatcctgtaatctcttcactaccctaacttgcagtcattgacatgataatgcagcctgcatgatattaaaggtaaaccaattaattgtattcctcagctacagtttacaggaatatatttgagagggttataatgtttgtgatttttgaatctggaaatttgttttaagctgataccgtctctcaaaatatgactctttccaccagataaaaaatatattattctttccaccagaaagaagaaaagatattattttccctaaagggtaatagatttttgaaaagccaattacatgcaaaaacaatgatccaaattaacatatttagagaatattctgaacaaagcttctaagattagagagactgatagtagctaagcatgtggtaatacagataaatttcattatctgtttattgaatgtggatttttcagattgttcaaaaaaagctctttgaaaagtacacttaaagggaacaatatggggaacaatatgcatcacagttgaaagaatccaaacttgtaattaactaataccaagtatatgagtataagccttgagaaaataaagcaacatatttatacaaattcataatgaaagaagaaacagcaaatatgaaagaatataaatcagatcaaatacattattttatttatacttggctatggtcacttacttaattctaagtaatgagaaattgaatactttggcttcaattctgttctttttttagtgtttgtcactagaaaaaaaattcaatctgaatctctaagtaaaattgtacatcaatgtacacattatatccagcagcctattcatatttcccttgaaggtgccattgacatctcaaactcaaaaattatcatttaagttaattattcaccctgtctctcacaaatgtcttctcctatgattgcatattttaatgagaggcactactataattcatccaatttcctaaactccagttctttgtggcaccctttgatttcttctcctcccatattagtcatagccaagatattaccaaatcccatcttcaatgttctcaatagtttaaaatccacttcattttctccaccaaattattatgtcagttaataccattacgatatcctgtttaagttactaatcttccccaactctaagttttctattactctctaattatttctgcactctaccgtaaaagatgatttttttttgaatcccaagttgatcatagcactgcctaattaaatcctttttatctttccccatggctctctgcatgagcccgatgtacttcaagcttacctgtcatcatctttcaccagctacctgcataatgagtttaggaggagttaaactgtttgcacactacacctaagcagtgcaaaaaccactagtttgctcaaggactttgggaatatattttcatttataattctcatctcttctcttctgtcactttacttacactcaaacaattacctgtcctttcttcggtaaaccttcattttctctgcctagattagactccatgtctgattagactacctgttcaattataccttcatacaggatgcttttttacgtttcctcacaaattactgtactgtgtagaaatagcctatcgccttctctatctctcaacaggactgtgagttttgggatggtacatagtaagtttttcacagtcactacattctcaaaatcttcccatttcagtcagtttatttttagttttcataaagttttgagtgtaaagcctcattaatcactggcatcaacagtcatatggactaggtggactatctttaacaatgaagcacatttcagcaaaacctatagcaaaatgatgtgttttccacttttatctctgtttataaaagctgtggctaaacaagatagattcttaaagtcaagaaatcatagatagagtttcagagacaattgcttttaggggtgggggttattgaaatcaatgtgtctgacaatataatgagggataacctgacacaaaaggatcctaaataagtgtcctcggtctctgtcctttttttcaaaatagttgaaccaacgtaagtcacctatccaatgtgcatgtttttcttagtcaaactcagttttaagacattcttcaaaatatctggcaaccttacgaccaggagcaacagaagcaatctggaaacttcaactcactgccaagtaacattgaagaattcaaaatggatattatatcatctatttatatatgcatattattatatatactatatatacattatatgtaattgtaaattacatatatagtacacatgcattatattaatatattaattgcatatgcattatgtgtgcacatgtaaatgttcatgaatgtattgctgcccacatcactaaattagactcaatatcactgaagtcaaaacacctggaaaaaaatagattccaccacattttaaagacctaaaataataaaatcaattatactactaaatcaattcttctatcttcattttattttcccccatgatggtggacaattttgtttccaatgaataattaagtgaattttttgcagtagataattaatgctttctgaatatttcctatcagtattctacaataaggcatactgacttacctatcaccataagtattaaaccatatgctgtaggctagaatatttatattagtatcttaataaaaacttccagaaaattatctacatatacagcaaaatgcatccttagggatcccctgcaaatatttaaaggtatcttttgtgcaaggaaaataagatagtaaaagtctcatatgtaagtttttaaagagttagagtatactcttagcactctcgtcttgatattaaaggcttccaaaagagccaagcctctttgacatttaaaattgtatttttcttctccttctagagaaactgcttacatatggtttcacttgtatttttaagtcttcttatctgaggtatacacttgtagcacagcatgtttctaaggtctgagtgcatatacaaagagtgtctataaattaaaaatataataaaataaaaagagaaagataccccatatttcaattattcttatttcttatttctccaattcaaaaccaattgaaaactagcttattttccaagtttaggatatcactaattatttggtttggaataccatattatattgatttgaaaaaaatacagcataactctagagtcataatacttttctctttcttgtgacaaaaatccatgttaacaaccaatggtgagggtctttcttctgcttaaataatgttttaagtttcttctatattataattgaggactaagctattgattctactcaatgtttcttctacaaaattaatataatttcagtggtgtgatgagatactgaaatacagcaaagaagcttaattgttttggagaaaaggataggctaaagccttcttaccactcctaccccatgactagtggtcagcctgagcatggtgttaataagggttttgaggctgagagtggtagttctggggaagggtgtctggatcaattagtgttatttatttacagctcgaagataaatgcttagattacctggtacatggtggcattataaaagtgcggatgatgatttctactttataaacatgatgataatacaaattattttttattacaatttttctcactagtttaattaaaacagattttgatttgattgtgaatagtaaaaatgacaggataaaaagcctgcatgttactttgttggggctcagagaacaatacctcaaaatgaaagccacagaagcaaaagtttatctctgaccttctcctgccctcctgtctctcagttccattctcccccaaggataggcacagaaacaaaaatccttcttccccaaggtaggtcataaaaaccagaatccgttttccccagagccaaccataaaacctaaaaatattactctaacattccctctgcctttctgtgtaaaaactggccataaaaaattatctgacctatcttgtttgactgtaggtcataagacttccattccagagaaggtcctgccccagactcgcagggaagaaatgtcactgagagaggccaagaagaatctgcacagagaggttttgctgggtttccccactcacagcattagatcatatcctttctgtccaatcatacttctacatggctatctatattttgttgatcctaagtataaaaatagaccatttcccctgtatatttgggtctttgttctgaaggctctcatttatacatattaaataaatttgcatgttttttctctaattaatctgccttttgcaagttgatttttcagcaaaccttcagagggccaattcctcttggccccttcaatttcaataaagaacataatgctagacatgaagaagattattctttaaaaaaacatgtttgggatacagaagagattttgtatgttaaattttatgcaaacaaactctgagatagaagagacattctaaaagaggagagatagcagctgacccaatgaaggctgggggaaggagtggcaaagaaatctgtgtttccagttggccaagattatgagaacaatgaaatagatttttaaaaatggaaataaaagtgagtctaggatatggaaaagatggaatttagaggaaaaagaacataattttggggataattgtactctacaaaaaggaatgttgacacctctgattgtaaagtatgtagagataaattggtcaggtatatacaaagatatataatggaaataaaggcaagaaataaaatagaaaaggaaaaatcaaaataatgagtttatttcacctataaaaatccatttataaattaaaaacatatgaaatgtattacatagtataaaactgcatattaataaattctatataccaatggaaaactataatccagggactgtatagtattgctaattattacaatacatcaagcagataggaatcatcattttaattttatggatgataaactgaggttccctgaagtcatttacttaaatagtatgattagtaaatggtaggaaagaggtttcacaccttaatctttctgacagtccatgagatctgcagatcttcatggtaaacttcaccatgtgatttttaagcataaataaaccttcataaagatatttcagtcagcataattcgagctcaaaagattaaagctatttcactatatttcaacattatatttccccagaggacaatttaagaaaaatacataagctgtagtaatcaaaccaacgaaattgattgaattatattattgaagagtgtatttattttttcactcacatagttttgacccagcatttttgctgatatattttagaaatctagacaagacagctttaattgatgttacactttaataaaagagccctggttcttacatagcttcccggaaaataatcattttagaggataggtttgtgtgaatttttatgaatacttcagagactacctcatcaatttctctgttggcttgatgactaaatttgattaactggataaagatttaattctgttttctcagttgtaatgttttggttttcttctctaaaggcattcctcgtattcagtttgtaaatgaaaatagaatatacaagttaatgtgcaatgtgcttttaaagcacaattgtttctaattaaaaaatttattcctacaccatcataggtagacagacagaaatttcacagagagacatctgtcaaattttgatcatctttccaagaaaatagcagtattcatgccatcactgtcttcctgcctttataatgcataacaatcagctagcttccaccattctaattccagtagaggtaaaaacatattgctgggttttaagacgaatgccaatcatcatattcacatgatattactataaaaacatacattactcagcctgtgtccatctgctataagtcaactgaattagatttcaaagttctattgcaattcagaaatgtttcatgtctttcggtttattttataggaccacacaccgttaactattacagttaatcattattagaatgtcattctgaatagggctatagcacacaaaaatggtgaataaaaacccacctccataagctaaacactttttctttatcaaaacagttatttgtgattttattgtttataaatatctttgtcatttacaggttttctctgttttatatgactttaatcacaatcataagaaagattgtgtatatgtcatatacattattgaggaggaaactgtggcagagttaagtgaagaaaaagtcatataatataaaaagctgcttaatattgaggtgagacggccatgggcacacttaggctatactataactctgtataaacaagcatccatgtttcaatcttttctttgaggaaataatgtacctttttatgccaaaggacatttcctccacctgtgctttatacctctattctttcctctgcagggattctgctccatctgtaattcatagtctattgtatttttaatgtttccctttttctgcctgcttccatcaaaatattaaaatagttgatgttcatccatcatcagaataatcctccttccagcctatgttactatggaatcagctatcattgtctttcattgacatctttctctttcattcacaataactcttgtagaaagttaaatatgtcattgcttttgctattattcaatattccattcaatattttatgtgcttaactttgtttactactcctgtccagttcccacactgagaaaagtttgaggatagagatagagaggtagagatacagatttgagaatcatcaaaatttaaacgatttttgcagctatgtgagggaaagaccatctcccagggaaaatgtatggcatgaaaagtccaaaggggaaaagtagtaagctcaaaatgcattagaatttaagaacaaggcaaagatgttggataaacatggctagaagatttataagaaaactaggacagagtgctaaggagaatagtgagagatcagaataacaacaagaaagagtggacaaaagccgaaaatgccacaaaactgttaagtaattttgactataccaacatgaaagttatgagtgactatttttacagaggtatctgtggaaggataggggtcgaagtaaaattatattgctttgaaaagtgaataaacgggcagtgaggatgcagacataatattttcatagttatatttcaacaaatctggctgtgctgaaaagctgcagaaaaatagctatggcatatgggcttaaggcaaaattgtgttttaaaataatagcatttctttacattagcatagcatatagacacacatacatatagaaagtttattcacattactttatcagctttctgctattttatttactttttttcccgatttttcaatttgttaatttttctcagagtttttaataacttaatgtcactattttggagaaaataattcaaattgaatctaagttttcttttcttcacacataatattgaatgccctttctctctctctttatacatcacttatgttttatactttttgcttttcaaaaacttttaaataaaaattttcttcaggctgattattaattacatttagtcctcaaattcaaacaaaataatttttaatcagataatttatgtttataatttgtgtgagtacataactgaacatatttcacatttataattgtatgttttgttccaaactgaaaatatttgagctaattccataggcaagaatacctagaattaaaactcaatggaggtctgcaaacataactctacataatcaaaagaaatatttttaaaaaatgaatgtacatgaattcaatttgtccatttgattctgcacttatttggttatcagaaagatgcaaaatgatatttagacatatgatgttaacctctatcaattactgttttaatgataggaggacttcccttattcaaactcttgcaatattttgacattgttgtttgaataaagattaaccagttcaatatgtcaaagtaaaatttttccttccactaaagattttgcattatatgtgccatatttctatacaataattgatagacaataatagaatctttcaaaagcaaagaggtattggtagcttaaattcttagtggggtagggttgaaatgtaaggttctcatagaaattaatttttccttgtactcatgaaaaatttctaattgttaacattatttcaggtaatttatatatttaaaatgaaaacctttgctatggtaattttattgaattactgattcagtaaatgaaaagcacattgcatattattagttatagtttcaaccataattattatattttaattattaaatttctaaaataaaatgaaatgcagttttggacttactttttctaatgataaaaattttaatagaaacaaaaaagtgaaaaaaagctttagaagactattttaaaataatttgagttaattaaatatgtttttaatacaactaataacattatgtagggttacaaaagtcaaatgaaggctgcttatttagtaacaaatatatccctttagtagacaaaacttagatgactcatttctattactaaaatatgtatcagctcacatatagggtggatacacatctccattgcaaatataatctcttaaacttttagactttgcagattagcatgaaagcaatactaaaataaaatggccaaatgttgaaaatgtttagatatttgtattcattctataagtagctcaggtagtatttttaaagtgcctaaaaataagtaataaagaaataataaaggggaaaattgacacaatgtttttttttgaaaattgacacatatgggaagtaattcccattataattttaaaacttaatttttaaaaagaacaagctgtccacagtattagagaataactcaatattgctttatggtaaatctgcaaaaatggccacacattcttcccccttttgtgtccatactcacctctgtgaaactttgctttccattatgattgtgggtccagtcatgtgacttgccttgttcaatgagatgtcaatgaaaatgacagtaacaaaggcttgaaaagttcttacatagtgtgatttgtcctctttcttgctgttttgggattcctatgaatactattcactgaagaagcccaggctggcttgttgaaaaatgaaaaacaaatggcccaggtactttcattaggaacagggctgccctgctgagaggcagcgggccccagaaaaatgagtgaacccacttgagtctgagagcaatcaaagtaccaacaaagaattaaaagatacacaaatgttatattatgtatcacaagttttactgatacaaaaattggttctaggagtggggtgctactattaaaaatatcctaaaacatttggcattggattcaggatcaggttttggttggcaatacaaaagagtctaggaaattgtcagcaaagacttgatactatcccaaacaaaacaataaaaaaaaaaattgaactacgaaagcagagagtaaactgctaaagtagatttgctaaatggtgacccagattatatagttgtggaaaaaatggtaaaaactgttccctgttttaaattgaaatataaaacaagtgtaatgtacttgtaggtcttttttttttttttttttttttttttttttttgagacggagtctcgctctgtggcccaggcgggagtgcagtggcgcaatctcggctcactacaagctccgcctcccaggttcacgccattctcctgcctcagcctcccgagtagctgggactacaggcgcccgccaccacgcccggctaatttttttgtatttttagtagagacggggtttcaccgtgttagccaggatggtctcgatctcctgacctcgtgatccgcccgcctcggcctcccaaagtgctgggattacaagcgtgagccaccgcgcccggcctgtaggtcttgataaggtgatttttctggaatatgataaaaagtgccagtggacatctatatactacgtatggtaatgctcagaaagagaaggatgagttattggcgtgcattggaaatttaaactcattctcaatccccatttttcaaaccagaaaggaagtacaaatgacctcaggttaaagatcaaatcaaaagtgtagctgcaatacacttggttgagacctttgaaagattttgtcagtgagtggtataacctcccagctagaaaaagaaaggaatacataaaaaaaataagattagtattacactagcctggccacccaaagtagaaagaagcttaccttaaaaggaattgtaagtgtggtttttaggtcatagcaaggacccaaataagaaatttgcaatgtttttaagggaattgtcctgccatctgaaattgaaagagactaagtttaacaccaagacaggactgtacggttttaactttctatcttttgtagtcagaattagaaagctcttcagctacaaatttaagatattttttaatgaaaatgatcctttcaaagattatagccatgggctaaagataattatggactacatttgatgttcttaaacatattagtctcaagacttctttgttctcatatatattatttaggctccagagagcttttcattcttttgattcttttatctctcttatttaccaattagatattaaaactgtgaattgaaaatgtttatttaaaacaataataaacctactaactgatatcattttgcattttaagaaaaaataaacataataatttgagtagagaaagtagcattgttttacattttcaggtgctatggtttcaatgggtccactaaagttcaagtatctgaagcttaatgtccaatgcaacagggttgagagttaggaccttcaagaggtgattaggttatgagggtcgtgcctttctgaatgcattgatgcaattactgggggactggataagttcaggagtgagttgctgataaaaggatgatttcagcctcatccagcctctttccttttctttctttctttcatgcctactctttcacatttccgcctttcactatgggatgacgtagcaagaaggccctcgccagatatgagttccttcatcctggacttccccaattctggaactataagaaatgcatcttcattcttacaaatatctagtctcaagtattttgttatagtggcaccaaacaaagtaggacagcaagtctttttttatgatagaataaatagaataaatctgaattctcatgcattcttctgcattctatcagttgtgatatgttgctgtggttgaaatatataaagaaaatatggcctctgataaatatatagaataaaaatggaagtgtattttcataacctttttacattattttggatattcttatctaataatagctcaaaacttgaaaagtcacggactcttaaaatccataccattaccttgcagtttgaatagatctgttgctattcatggttttgggataccatacatgggttacctggaaatgcgggtaatttatttgtgtaccctttttaaaaactttatttaattttattttaagttcttaatagggatagctttgaatctataaattactttgggcagtatggccattttcacaatattgattctcctacccatgagactggaatgtttttccatttgtgtcctctctgatttccttgagaggtggtttgtagttctccttgaagaggtcctttacatcccttgtaagttatattcctaggtattttagtctctttgtagcaattgtgaatgggagttcactcacgatttggctctttgtttgtctattattggtgtataagaatgcttgtgatttttgcacattgattttgtatcctgagactttgctgaagttacttatcagcttaaggagatttggggctgagatggtggagttttctaaatatacaatcatgtcatctgcaaacagacacaatttgacttcctctcttcctatttgaatacctttatttctttctcttgcctgattgccctggccagaacttccaatattctgttgaataggagtggtgagagagggtatccttgtcttgtgccggttttcaaagggaatgcttccaatttttgcccattcagtatgatatggctgtgggtttgtcataaataactcttattggcccggcacggtagctcgcgcctgtaatcccagcattttgggaggccaaagcgggaggttcacttgaggtcaggaattcgagaccagcctggccaacatggtgaaaactcgtctctattgaaactacaaaaactagcccggcatggtggcaggctcctgtaatcccagctactcaagaggctgaggcaggagaattgcttgaacctgggaggcggaggttgcattgagctgagatcacaccactgcactccagcctgggctacaagagtgagactcaaaaaacaaaaataaataaataaataaatataaatagcttttcttattttgagatatgttccatcagtacctagtttattgagagtttttagcatgaaggggtgttgaagtttgtcgaaggtcttttctgcatctattgagataatcatgtggtttttgtattggttctgcttatgtgatggattacatttattgatttgtgtatgttgaaccgggcttgcattccagggatgaagctgacttgattgtggtggataagctttttgatgtgctgctggatttaaattctgggatacatgggcaggacgtgcaagtttgttacaccggtaaacacgggtgtgctttggtggtttgctgcatctatcaacccatcacctagacattaagccccacatgcattagctatttgtcttgatgatctcccttcccctgcaccccctgacaggccccagtgtgtgttgttcccctccctgtgtccatgtgttctcattgttaagctcccacctataagtgggaacatgtggtattaggttttctgttcctgtgttagtttgctgagggtaatggcttctacctccttccatgtccctgccaaggtcatgatcttgttcctatggctgcatagtattccatggtgtatatgtaccacattttctttatccagtctatcattgatgggcttttggattgaatccatgcctttgttattgtaaatagcgctgcagtgaacatacatgtgcttgtgtctttataatagaatgatttatattgctttgggtatatagccagtgatgggattgctgagttaaatggtatttccagctgtaggtatttgaggaattgccatactgttttccacaatggttgcactaatttacatttccaccaaaactgtaaaagcattcctatttctccacagcctcaccagcatctgctgtttcttgactttttagtaatcaccattctgtctggcatgagatggtatggcattgtggttctgatttgcatttctctgatgatcagtgatgttgaactttttctcatgtttgttggccacataaatgtcttcttttgataaatgtctgttcttgtcctttgcccatattttaatggggtttttttttgtttgtttgtttgttttggtgtgtgtgtgtgttgtaaatttgtttaagttacttgtagattctggatatcaaacctttgtcagatggatacatttcaaaattttctcctattctgtaggttgtctgttcactctgatgctattttcttttgctgtgtagaagctctttagtttaattatatcccattggtcaatttttgcttttgttgcaattgcttttgacgttttcttcatgaaatctttgcccatgtctatgtcctgaatggtatggcctagattttcttctagggtatttatagttttgggttttacatttaagtctttaatccatttttagttaatttttgtataaggagtaaagaaggggtccagtttcaattttcttcgtatggctatccagtttgcccagcaccattattaaatagagaatcctttccccattgtttgtttttgtcagatttgtcaaagactggatgattatagatgtgtggtcttattccttagatctctatactattccattggtctatgtgtctgtttttgtaccagcaccatgctgttttggttactcttgccttatagtatagtttgaagtttgttagtgtgatgcttccagccttttctttttccttaagattgtctcggctatacaggctgattttttgaataaaattcaaaatacttttaaactattaattttaaagtagttttttataagtctgtgaagaatgtcaatggtagtttaatgggaatatcattgaatctataaattactttcagcagtatggtcatctttatgatattgattgtttctatctgtgagcatagaatgtttttccatttgtttgtgtcctctctgatttccttgagcagtggtttgtagttcttgaagaggtccttcacatcccttgttagctgtattcataggtattttattctttttgtagcaattgtgaatgagagttcattcatgatttggctctctgcttgtctattgttgatgtaaaggaatgcttgtaattttttcacattaattttgaattctgagactttgctgaaaagttgtttatcagcttaagaagcttttgggctgagatggtcgggttttctagatataggatcatgtaatctgcaaacagagacagtttgacttcctctcttcctatctgaataccttttatttctttttaaaatttttttattatactttaagttctgggatacatgtgcagaacctgcagttttgttacacaggtatacacgtgccatggtggtttgctgcacccatcaatctgtcatctacattaggtatttctcctaatgctagccctcccctaacctgcactccctgacaggccccagtatgtgatgttcccttccctgtgtccatgtgttctcattgttcaactcccacctatgaatgagaacatgcggtgtttggttttctgttcttttgttatttcgctgagaatgatagtttccagcttcatccatatccctgcaaaggacatgaactcatccttttttatggctgcatagtattccatggtgtatatgtgccatcttttatttatccagtctatcactgacaggcagttggattggttccaagtctttgctattgtgaacagtgctgcaataaacatacgtgtacatgtgtctttatagcaaaatgttttaaagtcctttgggtatatgtcctgtaatgggattgctgggccaaatggtatttctggttctagatccttgaggaatcaccacactgtcttccacaatggttgaactagtttacagtcccaccgacagtgtaaaagcattcctgtttccccacatcctctccagcatctgttgtttactgactttttaatgatcaccattctaactggtgtgagaaggtatctcattttggttttgacttgcatttctctaatgaccagtgatgatgagctttttttcatatgttggttggctgcataaatgtcttcttttgagaagtgtctgtttacatcctttgcccaatttttgatggggttgaatactctttatttctctttgaattctctttctttctttctcttgcctgatggccatggccagagcttctaatactacggtgaataggagtggtgagagagggcattttgtcttatgccagttttcaaggggaatgcttccagcttttgcctattcagtatgatattacctgtgggtttaaatagtaagagtcataaatgactcttactattttgaggtaggttccattaatacctagtttaatgagagtctttcacctgaagggatgttgaattttatagaaggcttcttctgcatctattgagataattatgcagtttttttctttagttctgtttatattatgaatcgcatttattaatttgcatatgttgaaccaggcttgcatacttgatcatggtggataatctttctgatgtgctgttgaattcggtttgccagtatttttttgaagatatttgcattgatgttcatcagaaggattggcctaaggtttcctttttttgttgtaaatgatgacacattgcatgatacgatatcaacaaataacacttgtataatattaccatggatctaataaaaagatttttttatatattgagaacctggcaagcttgtgatggtgggaaaaatttgtcttaaattcaaatatgtgccaaaagctcaaattttgtcattggctacaaatacagtcatttgtccttcttgaagttacagatgggcattcattttcaataaattatccatgaaatacctcagtctgaattgtcataggttgtcagttatccatttgagtaaaaaactagattccaggaagaaaatctgctgtaattcggattggaactccattatatatattatttttcttgatagaagtgttacacttcaatatgtagcaaatgttctttatgcataattcccatttcatgacagagtatattaaatcattgaatactgttattgactatagtcacccaattgtgctatcaaatactagagggttgaaatttaataattgtgtgatttcaacaaggacaaagtaaaactggttttcttcccttttgtgtgtgtgttggtgaagaatacccttggtggaggttatctccatcacaatttgtgctaattttacacaccattgtttttcaatcatcagtacaaatgtaaacacagtaaaaaaaaaaaaaaaaagcaaataataccctagcgaacttatgaagatagcttttatttgggcccccttaaaaggacctatggcataccagctatgcaaatactacttctgagaatctgagaaccactcctgagatgtgcagaaaccaagagacttggagccactctgagagatcagaactgggatccagtctagaaaaactcgtgctccagagtaggtaatcctggcaatatttcccctggggatttcagaataactaggaacaagtcactttgtgtttcttaccatcctgacactttttgaatgtgggataggtctattgtagaaaagctattcttgtctcacaattgtgtacttagtgtttgtacgcatgtagggaaagagagacagttacttgatcaaaaacaacagaattcaaaaagccaagtgaaatatcatagagattatgagatcccaaacttcaagcctgatgctgtgattggatgccactttttgtggtagtgaaagggatgactggccgggcgcagcggctcaagcgtgtaatcccagcactttgggagtccgcggcgggtggatcacgaggtcaggagatggagaccatcctggctaacacggtgaaaccccgtctctactaaaaatacaaaaaattagccgggcgtgttggcgggcgcctgtagtcccggctacttgggtggctgaggcaggagaatggcgtgaacctgggaggcggagcttgcagtgagccgagatcccgccactgcactccagcctgggcgacagagcgagactctgtctcaaaaaaaaaaaaaaaaaaaaaaaaagaaaagaaaagaaaaagaaagaaaaaaaaaagagggtgactgcattatgcttgaggtatccacgaaaatttatttattaaatatttaaatttaaatttaaatgtccagagcaccagatgtggtaggctgtacaattcaccacaaattcttcctccttgtgtgcctacatcttcttaccatgtatctgtgaatgggatcttactctgtctctgggcttgtgcctatcccttaatttggccaagggattaacaacaaataggatataatcagaggatgtaaaagcacttgcagagtacggcgtttctttcttgttgcttttcagaactttgtgaaagacaacatgtgaaaaactccagggtaatacactggaggtgagagctatatggcccagttacccctgctgatcgagctcaaaggcagccagcctcaactgagtggtaactggccacagaaacctatgtaagaccaactgccaccagaaagtctatgcaactgagcccaccgaacttaccagccttcagaatcatgaattccataaatatttgtttttaaccatttaattgtgcaggctttgttattcaaccagagttaaccgatacacatggtatgttccctcttcacggactcttcagtgttccttacaaataattgtattattctttgctcatgagattccttcgttttgaattccctatgccttgctctaccttatatagtcttactcgtttaatctcctacagtattcttttatatctgttctttatatcttatttaatggaatatctatattgattgatttgcttataaccataacatagccacaaataataaaatcttagaaataaagaataaataagacttttaatcagatatgacataaaaatgaactgtttaaaactcattttgaatataaaatatgccaaacaaaaatatagttatatcaagaaaattaaatttaaaataggtatttcttccatacatgatatatctgcacattgcttttttactggatagaggctagagaatttttacatttatatatatatatatagagagagagagagagagagagagaatttttacatatgaaatgatatatatgtaaaattatatatatgtgtgtgtgtatatatatatatatataaatatatatatatatatacttctttccttttaaataaatgcataggattccatgatattggcctcataattcatttttactaacaatagctaggctatttccaggtttgttattcttatggttttgtgagtgtggtagtttacattttattttgtttactttatctggttttcttttgccttaataatagtgtgtcaacgagtgtactgtgtacttatttattttttaccctgtcgtactgaaatgcatcaatgggagatctggcagttcctgtagcacagcgtcattatatgaaggcggtgtgctaaaaatagtttgaactattttgtattcaaacataaattacacttataatatgaaatatgatatgagtagcaaccgatgacaatatagttcgtcagttttctttgaagaaatatatacactttaatacattacatagctcacatatctaaaatgtattagttaagattgtaccttgtattttttcacatgaagaatgatctttactttcttaatttatattacttatatataaaaatcaaaataaaaattatttattgtttcattaagtttatttaaaggtaagaatattctcatttagcaattacataaaatcaaattacctggtacagacacgcacagaggtgcacaccactaagtatgctgtagaagttcagacacaggttcacatgttcctggatcgtcaacacaaacattctagaaaatctcatttccacacatttgcataccatgccatccagtgctattgtttgggaggctgaggtgagcggatcacaaggtcaaggaatcgagaccaccctggccaacatgatgaaaccccgtatctactaaaaatacaaaaattagctgggtgtggtggcgggcgcctgtagttccagctactcaggaggctgacgcaggagaattgcttgaacctgggaggcagagtttgcagtgagccgagatcgcaccactgcactccagcctggtgacacagggagaatccatctcaaaaaaaagaaaaaaaaaaaaaaaaggatacataaaagctactatctttttcaggtgtcttatttaattttgttccacaactgttccaatctattttattttttatattgttgtgttttattttatttttatattgttttattttattttttatattgttgtgtttgtttgttatcaaagaataaaatgaatttccataaactacacataaatataatattgtattatgcctatggtcaatttatagttcttttctatttataactaccttaatatttgacttcccatgagacaaaatctactggagtaaataaaacacaaaatgataggcaagaaccccccgaatattctagttgccttcaaaaaaggtaagtcaaatatttaactaaatatttagtttgtggataaatatactggagttatttagtgtagctattataggcatacagatggatttatttaatttgctggcaatacaaataaacctaaatataattttaatatatcaatcagtttgaacaattatctcctataattaaaagtgaacttttttctcacattgtagttagttatatcaccacagtcatctttcacttgtattattatacatggtagagaaaatgggacttttaggaaagccacactgtaagactttgatgttttacctgatgcatttcctacctaaacaaactaattctgatatttcacagaacaaaatgttttctttttctcattcttcccaccatgacctcaacatctctctctctctaaccccttcgtctaccctctatctctttttctcttccacacccctctcccatttatcttttctcttcccctctttccttcaccacttttctctcccctgtgataactttttgcctcctcttctttcctcttttagagatggatatctggataagtgggtgaagattaagtcactatcaattatttgtacaaaccctatacttttagagaataaagggaatactttttttttgagatggagtcttgctctgtcacccaggctggagtgcagtggcatgatctcagctcactgcaacctccgcctcctgggttcaagctattctcctgactcagcctctcaagtagctgggactacaggcacgcaccaccacgcccggctaatttttatatttttagtagagacggggtttcaccacgttggccaggctggtcttgatctcttgaccttgtaatccacccaccacagcctcccaaattgctgggattacaggcatgagccactgcatctgaccaaaaggaatactttttatctgaactagaccacttagccatagaactaaaacgatttaatacagagctgtgttctatttgctttcctttttctttgtctttactctatttctatagtaagttcctgcaagacatccagtagatacattgacttttatttggtgaataaatttaagggacttcaagagttaaggccttttctagttcatggtctgatatccctagaatgtggttaaaaaaggttgctagatatcaatccatcacactcacattacaataagcaggaatggaggagagaaggcggagaaaatgagaacaagcacaagttgtatcatgtctattttatcgaaggttcccaagctgtataggacacatctgctttctttccattgtttagaagtaggcactcctagcttcacccaaaaaaaagtcattttgtgaaatatcatttttattctgggaaagaacatgcagagctaaaagttgaaggttctattactataaaagaaaagaagaacacatatcgagggactactagtaggttctactatagtgtttacttaactggacccagttattctttattttatagccttaaaatttcagtggttacattgaagagcaagctccatgtataacagctttctttgagcccaattctgaaaggaaatattctataaaactccatagatagatatatagatgacagatagatagaaatacacacatatgtatatatatatacacacacacacacacacacacacaatctatgtgcatatatttgtgagcatatgtatatatagatatcatatatccatttttatctatagcggaaactctcaatctccattaaaagtctatattttatcctttcttttacatggagtatgaacattaatgttatactggaatatacacatgataaatggtttattgcagtgtttccaaaattttatagaggaatacacatatatatatatgtgtgtgtgtgtgtgatatgtatgtgtgtgtatgtgtttatagagaaagagatgttgaaactatcaaatttatgtgctttaccttaaaattatttatagccaagaaactgatgtgactagatcaacgacagtgatataaatacacgacagatagatgtagataggtttcctgttagtttgatttttgtcctttactatgtgcttagccctgggtccaacaccagaggcattgcaatcggagcagatgaagaaactgaggaagagaaaagtggaaagcaggtctaacacagtcagttgtctggcccagtcgtcaatctaccttgagtgtatagcaggttgcttctctcttctagcatatccacacaccagccttcataaaaatcctctatgaaactgggagaacagcctgcctttagggatatgttgatgattcccgatgacctcaaatcaaagtcatatgatcctcaaggctttaaaaagctcaggccaaccttataccattgttttcacatcacatttttactgaaactcaactaagaagaaattgtcctctcactattcctcatgtaaaatatatttattataatttctgaagcttctgattcaccttttggttagcctcaaatttcccgtcagttaatatcccacttttattctattttattttattttattttattttattttattttattttattttctaagacaggccttgttttgttgaccaggctggagtacagtggtgcgatcatgactcatgcagcccccaccctcctgggctcactggatcctcccacctcagcctcctgagtagatgggactacagtcatgcacaaccacttctggctacttttgtttttttgcattttttttagagacacttttttgccatgttgcccaggttgttcttgaattcctggattcaggtgatctgcccacttgggcctcccaaagtgctggtattacaggtgtgagccactgtgcctggctatctcaacttcttttaaaactctgctttatactcaacctcaagggaaaaatttcttttaaaaataatattttagctattactagttatgcacatctttctatgacccttcttgtttccttatttctgccatcagcaccatcctatcatttccatggtagcactgtatatatgcatagtgttgtattatcacttaataaaccctccataaactaaacatgaatttattaggtaaatttaataaaaagttgtctgtagagattactcattttttgaaatagtgatgtttaatgctaagttattcctatcacagtctgttggcttctgtcatcttgacaacatctacacaaagctctcctgacaaatttggaagttgctaggttgttagtatgtgtgacactgaaacaattggttttgtataattaattggcctattcaaagtcatagcatctttgaatgagagaagaagaatacacaattaatgttgatggccatataattagatatgaaagctgaaagagattaatataaactcagtgtgacaatacctccataattatcccagggtaatctattggttacagatggtaactaccatttgcatgatcaagactatttttccattttccttttatataccccctaagatacttttactacttgagaaaataccttaaatacttacaatcctaatggggagtgattttctgctaaatcaatttgttagaagtaatctcccactgacttagtgtactctttgcatgctccagaaactttagcaattggaggtgttcaaattagtagtgctttccagagataatggggatcatgtgaacctcatgggatcacttgaacctcacggtacacatcagagagataaaagaatttttggtgattcatctctcagttaaagagaagaaggaaactggtggctacatagtacccataaaacagagtaaaaaaaaaatcacatataaatatttggtttttggtaaatttgtttgaaaaattagcagaattgaaatagaaaataggaaattgtgataaaaatacaaggaaaaaattttaaactctaactttatttacttagcatgtttcacaatttcttctcaattctttttttcctccctgagtgctgcagttattgaaaatcagctgcaagagtacatccgcatctcctcctgtattccctggcatatgctaactctgagtaggtatactgcaacaaattgttactaggcaattgggaatttctacctggaataagtggctattatacaatagaaatattggccaatgaaattgcttactcttgtatataatggaacagccagtgatgatttgttttggtccttcttatcagccaagcagctaaaattagaaactactttttttttttcttagcaagtagctcatttccaatctcttgcaggttaaagattctttagcagtttctttgtagtaagttgctgattttacttcaagtaagctagagtgaatcttaaaatatttaccaggcatatgacaaggtagtctatttatatgaacaagtgtgaacatgttattagtaaggttactatgcttatattcctgcagtagccttaaaagcatggttaatttggtatatttctcctttatccattgagttacggattacaaaaatagctcagttgttttcaattgcgtcatccaagttaaatgggaaatgtgtatttcattatgattctcaattgactagcagaacaatgtataggcacacagcaatcaaatatattaagccactcaaatcacatatggtcgtactccccatactaacattttagtcaacaatggatccatataaaatgacagtcctatacgtttatgatggggctgaaaaattcctattgttctagtggcaacgtagccatcataacatttcagcacaaagcactactcatgtatttgtggcgatgctggtgtaaacaaacctactctactgcgaatggtataaaagtaacagcacatacaattatgtagagtacagaatactggataataaacaaccttgccactggcttatgtatttactatactattctttttacaagtattttagagtggactccttctacttattaaaaaattagtttacacaacgtcaggcaggtcattcaggacatattccacaagaaggcattgttatcataagagatgacaactcaatgcatgtaagtgcccctgggacaagatgtggaggtgaaagacagtgatgttgatgatgctgacctggtgaaggcctaggccaatgtgtgtgtgtttgtgtctttatttttaacataaatagtttaaaaagtaaaaagaaacagaaaaagcttatagaataaggacataaagaaaatatttttgtgcagctgcacaacatgtttgtgttttaatctaagtattatgaaagagagtagaaaagttaaaaaataaattttataaagtaaagaaggtacagtaagcttacatcaatttattgtttaagaacaaaaatataactttggtgttcatcaagtttacagtagtatacagtaatgccctaggcgttcaaattcactcaccctaggcgttcaaactcatggtgagtgaatggtgactctgactcacccagagcaactgccagttttgcaagttgcatttacaataagtgcggtattgaagtgtactattttttatattttatattgtatttttactgtactttttatgattagataggattagatacataaataccatggtgttatacttacctccagtattcaatacagtaatatgctgtataggtttacagcctaggagcaataggctataccatatagcctaggtgtgtagtaggctataccagctaagtttgtatgagtaaactctgatcttcacaaaacgatgaaattgcctaaagatgcatctctcagaacgtatctctgtctttaagcaatgtatgattgtatatctattgaactgttttattatttatgttggtatttgtttactacttttcaataggcagatattttaaagtgatagtggaaaaactatgctgtatatatttgagactatgtatacacatatacacatatgtttatgtctgtgtgtgtgtgcgtgtgtgtgtgtgtgtataaaatcttctattcaaagaagtcgtgattgacaagaattatcaaagattgtaatcttctctttcctggcagccttctttagaagactcttctgaagtttttgacaatgtttgaccctgttttccccacaaagtctaaagctcacttcatatttcctgtataatttttcaatattccaaagtgatacctttttataatttagtatcattttgattttctttcaataaattctactgaaatctttcatagcttggactgttaaacctgtgtgggagcttagaaatcctatagtagtccttgtatttataacctgggatctgtggacggccagagtcagttgattgagcattagaattcctgagcactggagttatatgcaaaacttggggcacaaattcatacatgtattacctggaaagaaattccacattcactactttcccagaagtgattagaattcaatacagaccaagaaaagctgaccttggcaaaccctccctctttaatgtgaaaccatgggacccagagtaggaatgtcaatttccttcagtttagtcacaaagcctgtgctcagccctgtgttttctttttcatgagccaccttcttcttttctctttattccagattggtttctactttcccgcattatttatgctcatcaacgttggtatactattcccaatgaagaataacatttgccatgtgtgaaaaattaaaatgtatcaaacaattggctgattaacagaataaagtacagtttcaaatgggtactgataaaagttttccagcatttttgaatcctaaaaaaatcacaatattttatgtaaaatccagttacctgacacaacggttgtactggagatattaaaacgtatagggatgcatgcatcacttaaggaattcacaatctgataaattcaacagatacataaatgagtaattataatataaattaaaaattagtagaataaaattttaaaataaaaaataatagctaacatttattcatcccctaccatgtgacaagacatataaaattttaatagatttgaattttcacaaaaaagtatctgaaataagtcacatggtaatctttattctataagcaaacagatatgaaaattaaatactttttctaagaaagctcagtacttacaagctgtttaggaattcaaacacaggcaagctggctgcagtgtgaatgcccttcaactatgtgtgtacccattttatctttggaagtaacattttgaaatgcaaatggataatgagttgtagcatgaggattaaaacacagcatcagaatcacagcatttgagaaccaaaaggaatttagataatatgcagtatagctgtctggttaaggaacctatttcccctatgcttctatacgttctgtaagttttctgagtcgttctgatcacagctcatttctcgtgtatattagtatatccagcccccacacatgacttttatatggtaagtttccaataactggttctcaaaaggatcaaagaaagagtgagatgtgtcagaaatgactccacaaatatttgtgtagagctattcaaaatatacaaactctatagagtgttaaaaattgttgacacaagaacatagtaagttgaatttggggaagtgtgaggagaatggagaaaaggaaaagtcaaatcagaataggatttgctcctcaaatcattatagtttgggtgtcttaagatttgatgtttactgggggcttcaatccacatatttcctctacatatacaactattttcacatcttcaaatatgtgagccaatatttacaaattacctcctccatttcaattttttcttgtccaaattttccccattttgcattgagttactagatatttccatttgagcgtgtcatagaacattaaatatattatatccaaaatggagttcaccatgtcactccaaaatgattttcatacctctattttttcccagttaaataggataatcaccaaccgaatccatcctaacgtcttcctctcatattccttgcatcttatcatcatattaaccatgcacaatcttgcagacttttatataacgtcattttaatgcaggggctattatgtaatctttttcacactcccaattccattgtccattttaagactacatatttcaagaaaaaatagattttttgtgtgctttttttttcttaaattttctcagcaaagttcttcaatacttggctccataattcactgattagagaatatgaataactgctagcctcagcctctttccttccttcctattgaaattgcctttgcaaaattatgactgaaacagtgaaagagatctaactcaacttactacatcttgcttctaacctccaagctgtccttgttcattcctgggtgtaggctgaactaacttagtgggggtgatggttaatagtgagtgttagcttgattggattgaaggatgcaaagtattgatcctggggatgtctgtgagggtgttgccaaaggagattaacatttgagtcagcggctgggaaaggtagacctacccttaatctgtgtgtgcaccatctaatcagctgccagtgtggccagaatataaagagggcagaaaaatgtgaaaaggctacactggcttagcctcccaggcttcacctttctcctgtactggatgcttcctgccctcgaacatcggactccaagttcttcagctttgggacttggactggcttccttgttcttcatcttgcagatggcttatcgtgagaccttgtgatcatgtaagttaatactatttaataacccccatatatatatatacacacacatatatatgtgtgtatatatacgtatatatgtatatatacacacaaatgtgtgtgtacacacacatatatatgtatgtgtatatatatgtgtgtgtgtgtgtgtgtgtgtgtgtatatacatatatactattagttcagtccctctagagaatcctgactaatagagggagaaacttagtttatagtttaaaacaaagatgataatagccctttcccaaaacagacctccttcttgcctttgtaggactaacattagccacgagattcgaaattacggtttaggagttatgcagctagaggctacaagattctgactttcctaaactgctcctaagatcagtgcctaagatgttttgcagaccctgcacttgatggatcacctggcacctcccagatcgataaactggctcatctgatcttgtggcccctacccaggagctgacttagcccaagaagacagttttgactccctatgatttcatctttgaccaatcagtactcctggctcactggtttccccccacccatcatggtgtctttaaaaactctgctccacgtatgtttattgcagcactactcacaatagcaaagacttggaatcaacccatatgtccaacattgatagactagattaagaaaatgtggcacataaacaccatggaatactatgcatccataaaaaacgatgagttaatgtcctttgcagggacatggatgaagctggaaaccatcattctcagcaaactatcgcaaggacaaaaaaaccaaacaccacatgttctcacttataggtgggaattgaacaatgagaacacttgcacacaggaaggggaacatcacacactggggcctgttgtggggtagggggaggggggaggggggaggggggaggggggagggatagcattaggagataaacctaatgtaaatgatgagttaatgggtgcagcacaccaacatggcagatgtatacatatgtaacaaacctgcacgttgtgcacatgtaccctagaagttaaagtataataaaaaaaatatatatataaagcaaaatcaagaataaagtggaaaaaaaaactctgctccctgaatgctcagggaggctgatttgagtaataataaaactccagtttcctgtacaactggctctgcatgaattattctttctcaactgcaaatcccctgtcttgagaaatcagctctgtctaggcagcacgcaaggagaactcactgggcggatacgctatcaaattttcaaagattgaagaaccatgagtccatgcttttaagaaaaacaatatagaaaaaaaataaaacccatttttgttgttgttctagcaaaatagttcaactctataatttgttcatagaattgaaatatgtacttacattctaacacagagagaaggtcgttaccctttagccaaagtgtgagcaatgattactcagcacaacaaagaacaaagaacgttgtttcctgaaatgtttgtatgtgcatgtacaactacaagtacaaatacaaacatgtataaatatgtggtaaattttattaaaaataaaacatggaaaagtcagtctttaatttaatctataaattaacatgccttttataccttttaattataatttcctagaaaataagatttaacttttttcttttctgagaacaattgttcatcattaaatattcagaaagaaaatattttccatgtaataaatgtttaacgcatattttttcttcaagagtcttaatgaattgttaaccttatagattatataaaaaatttatttcaaactgtttttacctaaattaaatatactaaatatatcaaaatgttgaaataattttatctacttggatttagcacaacaaaagtaatataataatcaattcactcaaatcaactaaaaacaaatagcaagaatctataaagaaaacagactttttcagtctattatttttaagttatatttgattctaatattacttaatacaaactattttttttcaaccccaatacaaagtctagtcttagcggccacattacaacaaagtgttatccataaagtgagaatacattaaaatataatagcggaaaatttcaaagcagactgtagccaagtcagcaatttaaaaataataaataaataaataaataaaaataattccaaggtaaactaaaagtacattcttttataaatttttaggtagaaggacctgaaatataaacataatgtggggcttttaaaattatctttggagaattacactatgaaatctttgttgctaaggactctcacaatcaatcaatcaatcaataaaaggctttttgtgatcacaaaatgtttaaagtattcttaacttaggcattctctaagatttatttaacccaaggtactagtataaccaaagtttagatagatatacctcagatacacccacagttgtaaaaaatcttaacatgttgacatttatctttgttaaacatagcttttccaaatacatttaaacataaaatcatcttttattttcataaaatttattcaatagagccttgtttgggattaaagatagctaaattcatatattgtttgttactccataatttttttagggaagcaaagtatctttacgtttctaacaataatcagaatctatggcaaatttggtgtacttatctttacttagaaacgtcttaacctccattctaaactaaattcaaaaattacttctcccaggaagtgtttccagaaacatgaggcctggttaagttcccctctcataggcttgcattggactttgtactttcttttcagtcctcctattacaatttgaatcgaacaacaaattatagcattttggcatcattttttctcctacagaatgtaaagaagctccaattctgacttaatcattgtatccatagcacctaacacagttgatagaatttggtagatcctcaccaaggaagtgttattgcgtgaatgaagatattgaagctcacagaagtgatgagactattcagtattatagaaccagtgaataagtttcaagtttaaacaagagttcaaatctaaaacacagcccagaacttttttctctagacttacactgtctaatatggtaccatttggcacatatgctactcaaatttgaatttaaatgggttaaattaaatataataacattttagagcattattttacatttcaaatgctcaataatctcatgtggccagtggctactgtactggacaatgcagaattttcccatctttgcaggaagttctaaaggccaatgctttgactctataaacaaagtataatgtaaaaataataaattaggcctctcataaaacttgaatgttaattatatttactataatacctactttggtttcttttaaagagagttattatttttattaatctataaaaaattgaataatatcattttagaagaaaataaatttaataatcttaatatatatctttaaaataatgtcaatgtgataatgtgaaaatgacaatgggcctctaatttatctgtgctgatgacagacagtgagaaattagcttcattttgataggaagatttaattaaggaaaataattggacatcgcttgtgtctataaagcacaatgtaaattgaggatcaggttaatttgatcatcatggacaggccaaacaaagggaaataatacaaaacttgcattatgacctccattattaatttgggatatgaaaattgactctattatctgattaatacatataattattaaaattagtagagttaaaggcaaggacatttggacagtagcaagttatattagacaaaaataaaaactgagtccctgctttgacaaaaaaaagaacactttgctctctacatttaaaaaataacattaaaatgtattgcttcaagaaaatatttctgaaatgcaaaaaatcattaaataaactttagggaatgattcagggtaaggaaacaatgacccataaatgtcaccaatttctatgctataaaattcagaagctttgctagaagtgcaaacatgtttgatatttcaagactgaaaactactgagtttaatagaggcaatatagacattttgcctttcaagaaactaaacattattccaggaataaatctcaggaagacctaagtcctgatcctgctgaaggtgtggtattcttgaaatgagtggaatttcctagtcttgtataagcactcagaaaacctgaggctgctaccaattgtgtacatcaaggaagtatacaggcaggtggacattctccaaatgtgctgagagcagaaagaagacataaaaatcccccatgaaaaggtctgttatgaggtttttctaaagaatctgataagttcttaaatataccctgaattaggcagtatcatcagattgctttcaattgtcttgaaccttctctttttcaatgaacatttgctgatgttcatataatagggagctctttgaagacaactgattttttgcatccctttcctctatatatttacacttacaattttcaacattgagacatcatcaaaacaataatttttactatcctcattactacaacactgatgagtgtcaagtgtctgctcagaagctaaaacccatatcacatacaagaaaaatttcagtcaactatttgcccttaagaacataagatgtggttcttaacaataaactaatctattgagaagtgttagagggtatgtagagtagtatgctatcaaaaatatatgtggcatggaaccgagagcaacttaaaataattttgttcagatggttcaaatagtagaaaaagctccatatagaaagtggaaacatatttgttccttgatgaaaagttaatgagaaactcgaagcataaagtacaaaatggtatatgtttaatccagatttactaactgttgttgcaagaagctagaacaaatattattcagaattaataataatagccataatacctctaaaactggacattattactctttggaacctcctccatcatcctagttgcttacggttgccatgacaaattaccaccaacttggtacttaaaacaacacaaatttattatcttgtagttctagagaacagaattccaaaatcagtttcactggagaaaaactcaaggtgtcagcagaaccatccttgttctggttgctctagggtagaactgaatggattttcctgcctttttctattttctagaaagactgtcccattccttggttcctgtcctcatgtcattccaacctttgaactggccattctcacatcaccttctctgactctgatcttctgcctctctcttgttagaacgcttatagttatattgggtcagcctgaataaaccaggataatctccccacctcaagatctttaatcacatctgcaaagttatttttgtcacagaagataaaatagtcacaggttacaggcacggaaatacggacattttaagcaagccattaatcagcctatgtaaaagtgcctagaaaaatatgttttattttggtgggaacaactacatatttgcaagtcttggcaggcagagtacaggttggattttggctggtgcttcacacttctggtcatttgcttttatttcaggacagaaagagtacaactttctatatacagagggcctactattcactatgtgattgatttgacaatatctgctacctgctctaaaatatatctgccagtgtaaatacttgtaaatatctacatgtatatttgtgaacatctgtgaatatatttgtgaatacctacatgtatatttcattattccacttttgcttttacatgttctgttgggaggtaactgatagcacaagcctcactggaaagctggttttaaaaccaatagatggacaatatttatctgaaagtgtgttccagagggtagcttgcatatcattgaagatattttttttttggtatgtccaagacatgaaattgctaaagaagaatgtggcaatatgctggacactgtgtgcttgacaatccataaagttgcttaaaatattttttatgttattctaatcctttaagttttaattaaggccatgggacagtttcactaacctaaaactagtcaatggcctcagtttgaaaaacatttccattttctaaatcattccaactcaatgactagtagattaactcatgttttacttttcttcgtttactacaaggatacacataattgttagtaaacacacaaaaatagatatattatttgttttgttaatattattatttatttttttcaagacagtcttgctctgtcgcccaggctggagtgcagtggaaccgtgttggctcactgcaacccctgcctcctgggttcaagaattctcattcctcagcctctcaagtagctgggattaaaggcgtctgccaccatgcctggctattttttgtacttttagtagagacagggtttcaccatgttgaccaggttgttctcaaactcctgacatctagtgatccacctgccttggcctcccaaagtgctgggattacaagcatgagccatggagcgtggcccctttatttgtattcaatgtaacccagaatgataaagaaagaaggatttaaagtaatataacaaaagaatatcctatatttcacagataatttcacagattatcctatgactgactaaaagtcgggtctaaattttcagtctgcgtatagctttgagaattactgtgatattggacatagaaatgtttgtatttataagcattagtatcaaaaactttaattgcttagtttatggcagcataaagaggaaacgtaagagatcttttctcctaagaatataaaaatgacgagtagctatttttaaaagtatgctactaagtggcagagtcaatagctgtatttaaatgtcattaaaaccaggaatggtggtgggagcctgtagtcccagctactcaagtggctgagactgcaggaatgcctgtacccaggagttcaagaatagtctgaacaacacagtgaggccccgtctcatttccatgctatgttttccttttatgtttttacatttttgataggcaatttaattctatgagacatagatcgaactgaaatctcagcaacttatattcatgtcacattgtgacactagctacctttgtgatcaccctgttttttattccgttaattttgttctgctaatgctcatgcatgatcagctgattcatccacaggaaagatagttgagaggatgatctgaagtaggcaggaaagcaagggtcttgagaatggaaaagaagcctggagtcttttcacagattatcctatgactgactaaaaatagttgaggggatttggagagaaatcaacgttccatccaaggtttaaagagtacttctggttcgcaacttgggtatatataacatcattgaataatcagtctaatcattttaagttacttgtgatataaaaatcacaaacacaatttgtatatcaatattgtgtagatgagacaacacattgaatgtttttttcctcagtctggtaatagcacaggtcttgcctaggccaactttatctcaggttcattcaagaagaacaatattcatctggattcctgcactctgttgaagcaatgttcttgctttcaaaagcagataagtgacacatttctaagttagataatgcatatctacaggagccaccttctcaatcaaagtaagagtctagataaagatcatcatcatagcagagtacgtttttgtatgtgtgatttgcttcctactcctagacttttaattaaggctaacagcacaaaacctaaaatttcactaggccatatatttagaaatcatcttttgaaggccaagacagctttagtaattggtagctgatttagcccaaggcccagaatgtcatatgtaagataagctcatagtgacttgttaaacccttaaactatcatgaaatttaaaagtagtatatcaattacgtaagtgttgatacttaggtaggtcttaggtaacagctgtcaattgggtggtatattggcaatgtaagatttttaaaacagccatggagatttattaatccagtcaatttccgtaacatggatcaggaaatatggattttgattctatggctgcatttaatttaaaatatatcctcaggttatcagaatttatgatacaaacgcataaaaataaaacaaacttatattcatcccacttaggttgtatgcatcaatcaatggttagaaaaaaatgcaacctgattaaaacaagttatgtagacattaattacaaagtaaggggtataaaatgactatattccaaattcttttttggttctaaaggctttttggttttttcaaataataaacaaactttttcttacaacatatattgtatgcacacacacataaagcatacacatgtgtatatgtatatttacacatgcatatgtacttgcacatgtgtttgcataattttaaaatgcaaatcaggattttgacgcgtacaaggaagaaagaaggtttgaatgacttcaagaaaatgtagaagagcaacaataggattgagtgattatcaattttcaaagcaaatttagagccataagaggctaaaataacaaatgataacattgatatttttaattaaaatatccagttaaaattacacaacttgaaaagaaaacatacaattaaataaatccatttcatcttaaatgtagttcacttggagtgtcactaaaacacaaacattacataattttctgggtagtcgtttgctgtgaatatacatgcacacacacacacttttagatatgttattgctatatattttaaatctcctttgttacttccatggagttaaaacattaattctcataggaaaaatgtatttcaaagacacttctccctctcgtttgtagttgtctaattaagctaatactattcaggtaaatatttattaccttcatcaaaactttatcctcctaactgggatgaaatgatatgaaaaggcaacttgccatcctgctttgttcctaaagatgcaaagatcaaagtcgttgatgctgtcacacagttttttaacagtttttttttttttttcccataagtacaacttcagaaaagatgtttacctggtttgaggacaggctttaacattccagttgagaaacacgacttgggtaaaatgggaataacctatattttccaaagccccatttactgcagttgctgaactcagcggtatatattgagacttttaaacagaaacacattactgaaaataaattatatggaggaatatttcagatgatgattaaccataaattaaataaattcatattattagtattttctagttcccaatatattagtttttccttctcatatactgatttatacaaattatttgttccagtaaaaacgatattatgcttcttgttttagtgcttatataatataccatgttctccagaagacatatttttctttcaaaacaatatatagaagttatattttctaaaataataaaataccatttttaaggcagttgaatttcaattagagaacttacagtttctataataaaataaatggattaacaattttttaaatgtagacaatgtaaattagctatggaaagagagtatttcatgcacacaccccaaatactttgtgaaatttctcttggagatatagcatagaatgaaaccaatttataggaaacacaaagaactgtctcaaaattctctttcttcagaatgctgaaccttgttgggaaaatggatggatacagcccccacctccaaaactctaagattcctaagtaaatgaatgagaactaaaagtgaggttgaatcttggggcttaagaaacatgaggaacaagcaggacatgaagagcacagtcaaaatacagttttattttcccctgcccacctcccatattgccaaagtaaacctgttttgtgtatttcattctatcctgccccttggataaaatcaatggcatgtcacaaggattatgccagccgtttttcagtcattgaaatcttcgcttatttttgtcagaagaaaattcactttagttcagtctctcttcctaaataatatacctagtcctgtgtaaaacaaaacaatttaagaaaaataatgtttttatcttgaacctcccttttatatccaaatttctttaatcatctccaaagatagaaagaggactaaagctggaggagagagaataagtgaatggcaggaaagttttcctttcactgcccctgtcctggtgattcagcagggcaccctgtgggcatactgctgtttgaagcttgtcctttctctaaggtagctctgtgttacttcttcagagctgcatcctctgttctcacatcacctggatagcttacctgcagttcctctacataagcaaatgtgtccttcaatagacaaatctcttgctgtttataattaatatttaagcctcttggcatttcatggtacacttctagcatctttccactgatgtctcttcgcctccctcaaatgatccatctgtatctcaaggttccctgaaaaacactcactcactcttagttttgagaaatgctggacaaacaggcaaccccattcaggaaacctctattaactctgtcaatagaacaattaccagccctaatctctcagcctttggattacttaagtttaacatcttcactgtgtccttgacatcaggagacacatgtcagttctccaagcagtcacaccaaagctgctctctctaggtttgattcgacggtcatctgcagcactttcaaagaggtttcctctcaatccccacacccctaactacttcaacttcaaaccctttctaacttttagtagatgacgtgccaagtttccaagccagtatttaaccaatacacatgctagtctttttgggtggttatattttaaaatgtggggataattgttttacattctgttcaacaacaacaacaacaaaatgagactgaaaatcttccacctgaaaaatctcttttgtattaggctatcttcataaagctcggatagaagtttaataagctaatagattttaatggaaagatttttttctgacacagtcaagatcttttttgatgcatgaaacctagaatctagaaggaacccagaaagaatcaaatattgcacctggaatgtaggtaagcaaaaacagaaaacaaattattgggcttactgaatattgctataattgtccaatcgatttatttcttcagattatatatttttcaaagctttttgtactcaagttatgaccatctacaacatttccataatatattgatatttcaagtctgaaaatattttttcaaattgtaaacattaaatatgaaagttttataatgtaactttttatgttaacccagaatgagatatgaatagtcaatgaatcaaaatagccaatgtctatttgttgcagctactcctaagatgagatacatattctcttctccccaatagtgagtgtgttccctgtatataacactaacagcaaacttaaatactggatattccttccttgcattagcatactaagtatatttaccatcatgtgctttttcactacaaataggaatacttgtttccttagattgctgaacatcacaaacatgagaaaagatgagtcattcttcttgtataagggctataattccaatagatttgcctattaagtttctcatgtattagcatttttttattcatagactacttcattgtattcaatttgcaccagatatcttttattacattattcttctttttcttcttcttcttatttcttacaaggttattggatgacttttatcaataggcacacattgacagagagatctaaacaataatcataaacagttaactttttcagtctttcagtaacagatcaaagtttattagttacaaataaaaatattaacaagcctaatgcattgctaatgtcatctcattttaaaaatcttgaattgatataaaaaattctgatgtatttaatcagtggagacagtaacacaggaaggaaactatttttgtattaaataatacatgcttggattaaatcacatgtgtataaagaaagtctaaaattatgagctagtaactagatatgcaattgatcttaaactattttttaaatttggcttcattaatcataacacaaatctttcaaggtactctttatgagtagttagccagtgaaaactattgctagcttctcaatttcccatgttgtagtttccaactctggaataaaagtaaaacaaaataaagcaacacaaccacaacatatctggaaaacaagtttagtgcagtttacaatgtaagtaaaataaatctattttatttaaaatagtattaggctgagcatggtggctcatgcctgtaataccagcactttggggggccaaagcgggagtatcacttgagccaggaattcaagaccaacctgggcaacatgatgaggcctcctttctacaagaaattaaaaaaaaaaaaaaaaaaaagccaggcatggggagatatacctgtaaacccagctactcaggaggccagaagtgagaggattgcttgagcccaagaggcgaaggttgcagtgagctatgatcacatcataccactgcactccagcctgggcaacagagtaagaccctgtgtcaaaaaaaaaaaaaaattatatgtgtgtgtgtatgtattaaagaataagaaattaagcattacaaaagtttaaaaacattttttaagtaatagattaaagttcaaattaaattattatattaattctgtgggttttcttaatatatcttcaagttttaacatcactcgatgcaaaaaaaaaatatgccagtgaatgagtccaatttcctctgttccttttcctcccaataaagcctgcccttacacccacaaacataaaactataatgagattcaaatttcttaaaaaggcattcaacagacaaaaagttgagtagaaaacagatcaaagtatcattatctggtgaattattgtgatacagtgaagtaatttaaataattcagaaaaataataagaggatttcattatctgtttgcctaaattccctgaatgcttacactaactttaaatctccttttgactataaagttccagatatggtagaatgaggtggcactgataagtttatagttaaagagcagttataagaaaaaagttttcaaattaagattttaatttttttgtaaaagtaaaagaaaacagtcttatcctggatacaaagagtatatatttcctactatttttttctagatacttcttctggtattaataacatatgtaaggatttggagtttcttttgctactgggcaacaataactgaaataatgtatagaaaaatgctttatgattattattttttcaagaaatgtcaataaaaactaagtgcaattatgttagtgtcacaacaagaatccttatccaccttaaatgtcttcatataataataaaaagcacaaaacaaaaagcaaactttaaaaagaaccaataaagaggaaagggaacaaagaccttcagtttatctcatatatatatatatataatgccttgaatacattaattgctttgttaatttttttgttcagctgttatgagatgaaccttttactggtactgcgtattttgtactgaaatccaacataaggcttgataagaaataagtagtaatgacagaacgaacaacagtttccaacacccttgagcacaattgcacaccattttcatatacaagttaaagaaatctgaaactccttgttttgatgcaatgtgagtgtctctttacaggaagcacaacacaccatttctcctttcatttctcaccccattaactcccttgacaaaagatgtatgcagatcctgggagaattcattcttttctctgaatgtttcagatatgttgagctgaaagagtgggagtgccatatccattttatttagataaaaagtatttttcaaaaataatatttttcttagatgtctacagactccttacataaaattttacagagtgtttcttcccaacgctactttcaactctgaaactaaagatgcatagtcagaagataactttgaaaatgatgtgatttgttatattcaaatgagacaatctgaaaattgattgtaattaaatttgtacttgaccttatcatccacattaattcagaaatatcagaacggttaaatagaaagagcacttattttatatctgttatatggacttgctcttttttatatgcagtagacaatatggaatataaattacttctgcataatggaaaatattgacagcatcatactggagaagaggtaatgctacctgaaaaccccaacacattcatttgcatttattgatatggacaatgttgcagtattattttattgccaacctctccttttcttcctcatagtgatttcatgtatgtattttttaaatgtctacaaaactgcctgattataaaacaataaaattacaatactaattcccttaaaaatacaatagattaaacactcttagcaactttccctttaattacagaagacagtctgtggtatttaacaattattatttctatgacttctgaaatctcttctcttgaaaactgcattaatctatattatagctcattgaaataagtgaataacaactttgtaagcgaaacctgcattatgttttagcccttccaagctgagtgaccttcagagttagtggctacatgatatgtagcatgttcttgccatacatcaagtatttgatttatattttatatccccacgtcaataaacacctacaagctaaaaaaattgccatgatcaaaagagaaatatggatccacctcctttcttctaaagtctgtttattaaaagtcttctcaatcttgaaaaaggacctccccctttatccagttgctgaagccagaaatatgacatttttatttattcatcttttatcattcatattgatttattttagtatattttccaaccccaaatttaatatcatagtctcactgtatcaatgtttccctctttcttagtactgctataatcttgcacttggactactacaataatttttaaatttgctatgttacctaaatcctttccccttattgcccagcagaacaaataattctttagtattttaaaacatacattcaatgttgtctttcctctgcttcaaattatctaatggtttttatcctatttcaaataaaatccaatccagccctggctaagaaagctcatttgatcagtcttggaacctaaagatctgcttaccacaagtagagttccctgccaaaattctcctgtctccaggtttctagacccacctaataagccactttttttttttttttttttcctaaggagcttccttaggaactagattatctttctcagactggaatgctctttgcctaagcttaacatgcctgtttcattttggtcttttagatctcagatccaagtcacattctcaaagcatttaactctcattctcccttgaagtaactacctagtgattctctgttacattgctctattttcattctatgcattgcacttactactatattaggtttcttgtgaaatatccatttgtgtgtcatgagaacagggacatgatcatgttcactccttcattcccagtgtttagaacagcacttggtgtatggtggatgtctaatatatagagagtaagtgatcaaatgaatgaatgataaatgatttaataaaatttaaattttaagttctatctaattaaaacaagcacattaaatttattttgaatcaataaatatctgcccagttatttaaaataaatctttaatattactatgaccaaccaagattcatcccagcaatgcgaggatggttcactatatgcaaatcaatacacatgatctagcacctcaatagaatcaagaacaaaaaccataaaatcatttcaatagatgtggaaaaagcatttagtaaacttcaacatcaataaaagccctcaataaattaggtatagaaggaatgtacctcaacataataaaggccacatatgacaaaaccatagttatcatcatactgagtgaggaaaagttgaacgtttttctataagatctggaatgagacaaggatgtctactttcaacatttccattcaacattgtactggaagtcctagccagagtaattaggcaagagaatgaaataaagaagttccacattggaaaggagaaagtaaaattgtccctgttggcagatggcattatcttgtatatataaaaccctaaagactccaccaatgaagtagtgtagactccactaatagaattgttatgactttggtaaacttgcaggacacaacatcaacatataaaaatcaatagaatttttgaatattaccagtgaactatctgaacaagtaatcaagaaaacaatctcacttacaatatctacacaaaaaattacctaagaatgcatttaaccaatgaggtgaaatatcgctataatgaaaatgataagacattgaaaaaataaattgaaaaggacacaaataaatgaaaatatcttccaagtttataaactggaagaattaatattgttaaaatatccatactatccaaagtgacatagaggttcaacacaattcctattaaaatgttaataaaattcttcacaaaatagaaaaatatccaaaaatttctatggaaccacaaaatatcacaaggaaccaaaacaaccttgagaaaaaagagcaaagctggaggcatttcactacctgacttcaaaatgtactacaaagctatagtaatcaaaacagcataatcctagcataaacacagacacatagaccaatggaacagaataaagaacttggaaatatatttacacatttacagtcaaatgatttttgacaaagtttccaggaacacacaatggggacacaacagtctcttcaataaatggttctgagaaaattttttatccacatgcggaagaatgaaactagatctctgtttctcaccatatacaaaattcaactcaaaattgattacatatttaaatttaagatccaaaactgtgaaactgctagaagaaaacatgggagaaattcttcatggcatgggactgggtaagggtttttttagacaggaactcaaaaacaccagcaactgaagcaaaaataggcaaatgggattatatcaaactaaaaaccttctgcacaacagaggaaacaatcaacagagcaaagatacaacctatggaatgggagaaaaaatatttgcaaactagacaactgacaagaagttaacctagagaatatatataagaaactcaaacaacctaagagcaaaaaaaaaaaaaaaaaaaaaaaatgagttaaaagtggaccaaagcccttaatatatatattttaaaagaggcataaaaatagccaaaaggtatgtgaaaatatgttcaacatcattattaatcacagaaatgcaattcaaggccacaatgaagtatcacctcactgcagttaaaatggctattatcaaaaaaagaaaaaataacaaatgctggcaaagatgtgaaagggggaaactttcatacactgttgatgggaatgtaaattagtacagccactatcaaaaccagtatggaggtttcttaaaaagctaaaaataaaattaccatatgatcccacaatttcactcctgggtatttttacaaaggaaatgagaccagtatgtcaaagaaatgtttgtagtcctgtatttattgcagcattcttcacaataaccaaaaaatgagatcaacctaagtgttcaccagtggataaaggtatgaaaacatgttgtatgtatacgcacaatggaatgctattcagctataaaatagaatgaaattctattgtttgtgtcaacatagatgaatgtagaggacattatattaagtgaaataagacaagcacagaatgacaaataccacatgacctcatttgtaaaatctgtaaaatgatgatcccatagaagtagagcattaaatagtggttaccagaggcaggggtagagaggtaggcttatgagagaggttggttaataggtacaaagttacacttcgctaggaggaatagatcctggtgttctgttgcatagtagggtggctatagtgaaaaataatttactgcatatttcaaaatagcaagaagagtggattttgagtgctctcactgcaaagaattgataactatctgaggtgatagatatgctaattattctgatttgatcattacacgatgtatacatgtatatatatttttcctttgtaattttgtaccaaaattattactaagtaatcgattattttaatatttatatgatttatttgaaattagttattacagttttcattaatccatgaaaatttggtattttctattatgttgttaaccaaaacatggaagatatctattattttgaatatgagatataataagtaaaaaatggagcaataccactttttagaaaaccttaaatgcatattcaatgtaaacaaaatacagttattaacatataatttattctctgaattttccttctctctcattaaacttactgtccatggggaagggggagaagatttgaatttgcctttatttttgtcattagaaatcaaaaatcttcattagctttctagttcaatttgcattttaaaatgaaacataatttctacattaaactaacaattagtctttcgtatatcatagaaagataaaacttaaattttactgaatgtaagactactctgtgattattttaaaagtgtcacttaaaatcttgcaatacttatgagatccctacacaaagagaagaaacagtctgtgggaaaacccttacttggtatgtttgttttctcaggctgctgtatcaagacaccataaactgggtggcttaaataacagatttttctttttttttgagatggagtctcattctgtcggccagactggagcacagtggtgttctctcagctcactgcaacctccacctcccaggttcaaacgattctcatgcctcagcctcctgagcagctggattacaggtgtgtgctaccacacccagctaattttcttgtatttttagtaggtacggggtttcaccatgttggccaggctagtctcgaactcctgtccttaaatgatccacctaatctagcctcccaaagtgattggattacaggcctgagccactgtgcccagcctctcttcttttcctattaagggctctcattcctaaaatgggtcccaacctgggacctaatgtaaccttaatcacctttcaaaaactccacctccaaataccattactccggggtctatggcttcaacatatgaatctggaaggaacacaaacattcagatgataacaatgtgggaagatgcttggcaggttcaaagagctcattagaagccatgtgaaggaatgaagaagtagaagaaaatgatacctgagaggtaaacagagtgaggatatggaaacttttgtagattttgtttacaatataatgagaagtttgggaaatataaataaaattctgatgtatctttttaaaagcttatgttggctgtgaatgaaacattattggcagagggcaaaattagaaacagaaagtctagtaatatcgtcattgctgttgtcccagctgaaatttgaaggaggcttttactaacatggtactagctaaagtggtggggaaaaattattaacatttacagtctttgataaaaataaaacatctggataactggagaaatcaatagataaattttgaaatgatagcctttagatatttgtaaacaagtgatgtttaaaaatgaggtccttggatcatcagcattacccgggaaggaaagttgttagaaatgaatattctcagatccaataccagaactactgaatcagaagttctgagggatgaagtcagcaatttgattttaaacagacactctaggtgattttgacaaaagctcatttgagaaccatgatgtaaaccatacgcatgaaaatgtcaattacagaaatccataaatatgggtttatggatttcacagcagaagtttgagacagagatataaatctggaagtgatcagcacatagatagcacttacaaccatgggaatggttgaaatcacatacactaagtgggaccaaagagaaatgccacaactgaggccaacatttcatttttggtagtttgtaaacaacactttaaaaggagcatctacagagacaggaagaaagctagggatgtgagataccatggacaccaagtgaagaaagagattttaaaaggagtaaatgataagcaatgtccaataaagctaagaaattcagcacaccttaaacagtggtgggttgattgatgttcaacatctggctctctgaggaaaagcaaaatcagattagtaaagtttttccatttctgtgctgctaaatactcccgacatgcttaatttcaagccagtgaatagtgagcaaatttggcaagagacacacaatagcacgccattattcatttctgccatgtggatattatatatatatatatatatatatatataaaacgatctcaaaaagacaggtaagagaaaaatgtaatgaaataattagaagcaaatgagttttgagtattcattacaatgctttttttaaatgttttgtctatatatatgtgtgtgtgtgtgtgtgtgtgtgtgtgtaatcaactcttaataaagtctgtgtttaacaataacctcgcagaatttctgggaattaaataatcagctctcatgtgtcagtgtgtattgactcctgtacactattgctaacaaatctaagatttcaaacgttttccaggtcctgggaacttcacatgctgatactcttagtatattaaacacatatttaacagttttagatattctactacatttaagctgtccgctaaaggaaattatgatgtattatgtgatctatatcttaaacagcacagaacaaaagatttaacacgtgcccaatcaaactattgatttgtaagtacatccatgacctactcttctaaatctgaaagtctttgaatggaaaaaaaaaaatctgtaggcttggaaacctgtgaaggctaaatcatattataatgatattcataatataaataaattagctcatgcaagtttcagttttgacataatttatgcaaaatttgacacacttttctctagcttaagatatgtgtcacctagcagtacaggatctctgcatggttgacttttgctggacttaacagggtacaaagacaattgtggagctcacaacaaaagatcaaaaagatgcacaacagttttgagtgtgcttggagttccattctggctgaatctgaactgaattattcatggttttttttttaagtgcagtaaaagtgatttttttcttaaaaaaaagaaaatcaaggttaatttatctcctgaaaatactgagtccttttcctgacatgaaagcaatcaagctttcagagttcagacactgatctttatgctgaaacatgagtctgagtggaattcagataaagctgagccatttttatttgccaaacaagtgccccaataattgccaggggaaacattccaaaggtttcatgactgttttagattcttagggctgctgtgacaaaatactacaaactgggtggatcacaacaagagaactgtattgcctcacagttctggaaggtagaagtctgaaatcaaggtgtcaggtgggccatgctccctctgaagttggttggagagaatccttccttgcctcttctttcttctccttctccttttccttctccttctccttcttcctcttcctcttcctcttcttcttcattttttttttttgagatggagtctctctctgtggcccaggctggagtgcagtggtgcaatctcagctcattgcagcctccacctcccaagttccagcaattctcctgcctcatcctcctgggtagcttggattacaggcacctgctaacatgcccaactaattttttttttgagacagagtcttgctctgtcacccaggctggagtgcagtggtgcgatcttggctcattgcagcctccacctcccaagttccagcaattctcctgcctcagcctcctgggtagcttggattacaggcacctgctaacatgcccaactaatttttttatttttttttgagacagagtcttgctctgtcacccaggctggagtgcagtggtgcgatctcagctcactgcaacctccgcctcctgggttcaagcaattctcctgcctcagtctcccgagtagctgggattacaggtgcccgccaccatgcccagctaatttttgtaattttagtaaagacggggtttcaccaccttggccaggctggtctcgaactcctgacctcatgatccacccgcctcggcctcccaaagtgctgggattacaggcatcagccaccgtgcccggccctaatttttgtatttttagtagagatggggtttcaccatattggccagtctggtctcgaactgctgaccttaaatcatccacccgccttgccctcccaaagtgctaggattacaggcataagccaccacgccggggctccttgactcttcttagtgtctggtggtttgcctgcaattcttgctgctccttggttggtagatgcataactccaatttctgtctctgttgtcacatgaccaccttatttttgcatatctctgtcctctcctcttcctaggaagatactagcaatattggattagatcccatcctaaaaaaactcatcttaacttgattccatctgcaaacaccctatttcccaataaggccatattcataggtaccagagcttcggatttcaacatttcttttttggagacacagttcaacccagaaaccagaacctaccaagtacaacacattctggctctagagaaagaaaaaatacttctttgaatgtaccatacattttagctgaaaggccaacaattggggatttcattatgacacaatttctattacattatttaatagatctgagccttgaaaagagtaacatcacaaaattgatatgctttccaaatttaatatttagcatatctttttagatattttaatgttgcatatttgtttacaatatttcaataacactctatgaactcaaattacaatcactagaggtatattaaatgtgagactcaaaagagtttctttcagctgtttcttttactcgatttcagctatagttaatcatgctttgtgtttatttcaacttagaaaactaaatggcagaaaacaatactggtttggggttttgttttgggttttttctttttttttggcctattaaaacctctttttcacacatcttgaataagtatatccatttaatagcactataaaaatgttggtgtggctgtaacgagatcattaactttattgctataatcactgtacgaggttaaactgtaccctcagcaagaaaattagtgtccaactgttccaggtgtctctctaagaattttctcaatacaacatgtactctgttgtaattgaaaaattaattatctaccactcatgttttagtttttcatcttaaaaagacattgtatcacatcaagttccaacttttatttgtttgcttttctgaatttctatattaaaatttatattatgaatatttaaatgagtataagtaccactcctataatattttattcttattttaataccaaaattaagattgcagttattatgtaccatcaattttatacaatcaataaaaattaatgtattgcaacattaaaatttttgtttagctatcttattttaatcaaataataaacaaaaaatgcaataatatatcatccaggcaaatttactgtgtgagacaagagtatgtcaaagaaatgtaaagattaggagctcttagtgaagttagttcatattttttgaaggagtgaataaaactcatgtggctgtgataattatagaaacacactgactttgccatagcagtatatatagagaaaaccataatccataagccatagagcacaataaaaataataagaaaataattgcaagtaatgaattttgaaaactgaaattggctgggtgcagtggctcacgcttgtaatcccagcactttgaggcgggtggatcatgaggtcaggagatcaagaccatcctggttaatacggtgaaaccccgtctctattaaaaacacaaaaaattagccgggcatggtggcacacacctgtagtcccagctacttgggaggctgaggcagaagaatcgcttgaacccaggaggcacggaggttgcagtgagccgagatcacaccactgtactccaaccggggcaacagagtgaggcttcatctcaaaaataaataaataaataaataagaaatcactatctaattcataaaatgagccaaatattctaaattaataagtgaatggctgcccaaataagtaaatgaaaaattagagaaagcaagtgcaggtaatatgcaaaactagaaaatataagcagctagaaatattaagtttaaaatatcaaacttttaagaatgacattaaaaaatgtaaagattctttctgggttttgttttacttttacctgtaatataatttatttttttcaagtaaacaatatgattttactatgtgtcgtcattatgctgtacattacagtcccagacttattcatcttacaaatgcctgtttataccctgtgacaaacatctcatttcccacatctttcatgccttggcaaccactgtttggctctctgctcttacgaacaaagaagcagaaaaataaataaaaagcatgtttctgttttctcggaaaggcaaatacagacaaaaattgtggtgtaatattattttcagtcttgttaatccaaactttggaggtgtggctcaaaaattactcattatttaataactgcaaataaaaacgaaagtgggatctaaccttttcacttatagcagagatgtttaagaagttccataatgtccagtaatatcaagagtctgggaaatgcaaatgttataatcttttggtcactgtttaaataaattatgcaacttttctagagaacagttgatgatatctagcaatttttttttttttttttttttttttagacgatgtcttcctcttgtcccccaggatggagcgtgatggcacgatctcggctcactgcaacctctgcctcccagtttcaagtgattctcctgccttgatcccccgagtagctgggattacaggcgcctgccaccacacctggctagtatttgtatttttagtagatatggggtttcaccatgttggtcagcctggtctcaaattcctgaccccaggtgatccacctgcctcggcctcccaaagtgctgggattacaggtgtgagccaccgcgccaggccaatgtctagctttttttttttttttttttttttgagacagtcttgctgggtcacccaggctggagtgaggtggcacgatctcggctcactgcaacctcccgggttcaagcgattctcctgcctcagcgtcccgagtagctgggactacaggtgcgtgccaccacacctggctaatttttgtatttttagtagagacgaggtttcaccatgctggccagggtggtctcgaactcctgacctcaagtcattcacctgctttgacctcccagctgggattgcaggcctgaggcaccgtacctggccaatatctagcaatattgtaattgctctatttttgacctagtgatcataagaagtgagtagagaataatcattttactactgttaaaaaaaaatgaacatgtattcaagtgaagtcaaccaattaaacacattatgagttatctatagttaaaaaaaagcaaaaaaaaaaaacctgcattcattaaataaaggaagtaaatatctaagggctaaaaaaatattttccaagacatattagtgaacacagtaaggtacagaataatgtgtatatgaataatatggttgcctttgtaaaaaaaatttataaattcaatatataaatgacacatagaaaactttgaggaggagctgggtgagagtccatattttacttcatttactttgcctccaattatttattatattttgattttcatattatttatttatatatttacttcaattgtggtctcctgggagataattttcatgtttttttttcatttttgtcattatacttctccatttctatagaatttattaaatgttatatgagcatatgaatagtacaagaaagagtgaggaaaaggtattcaatcaatattgctgaaattttttaatgattgggaaaaatcagttcaaaaccttacctaattgtacaaattacctcatattatgcatttattaattccagatggagcaaagtaccctttaaaacaagctgaaatatactataagatacatctatcaaacactaaaagaatgataatttatgaatcttagaggtctaacagaaattataacaacaaactatccacactagaataaagaatttcttagagatcttacaaggaaactccccagcaataagtctgacaaataatatatcaagaacaccaaaaatatacagcttagttaaaggcaaaaatcagataccccttgccagaaacaaggagggaattaaagccatatatatgatagaaatgtgagggtcaggagaaagtagttaaaaccagggatagttacacataatcagagcctattgaatgtgcctgtgaaatgctgggatataaggctagaccccaccttttagagggctgttggacatgggcttcctgcaacaaagcctgagttaagaggagagtttccatttttgaaacagcaactaaaaaactaccatttgactcaggtagtcggatcaaactaactacctgggtggcatcgtggcaggctgcctactgtggtccctgggtggaaaaatagtcactgaagaaaaatcagatgccacccacacctgtgaagatctgggtctctggagacagtaacatgaaaattgaagtagaacaaatataattccttgagccctgacagaattaaaaacaaattctgcccatgggaatgtttacaaacttgtggtagctgcaaaacttttagagaagccagcacacactgaaattaaataaacctctagtgaaagtcagaaaaaagtatgtgagaaaaaataacaacaataaggtgtccactaaagcagaaaggaactcaactcattgcatataaacactgttaatttagttaattagacaattagcaaggagttttaaaaatcatgactaaaatccatgatgaaaaatttgtttcattaaagattccaagagaacaaaatatcattaaatgaagaaacaacattaaggagaaaacacctatggttccagtaaatgaacaggcagagaccacgaattaataaattacaaaaaagttaaagtgctattaggaacatataatcaagaaagtatccaaactaaaagggacaaatgatacatgagataaaataatgagtaattctttttacacaaatctaattagcaaaatatattaaccaacactgtcaacaattagctgtaaatgaatactctcacaattacatttgtgtgtgtgtaaaatgccacaatgcttctgaataggatttttttgacaacgtacatatgaaacaatcaatgatttatttcttaattcattttctaaaagcctactcaatgaaatgtgaatgctaagtatcctgtaaatttaaatatagtcatagttttaccatgtataaaaatgttttataatatgggaacaagatatgtaaacaaaattacacatattcagtggattattgcctggattcaaaaaacactgtatacagaaaacacataaaaatgtctagtactagccaaattcctcatgaataattgttcacttgttgaataaattaacaaataaaagagtaaatctataaaattaaatgaggtataaagttggggtcggaaatgtaggaaggttgtaataccctctcatctaaagtaaaaataagaatatttaacgtttttaaactgaagtcttttaattataaatctattaattaaagtattcattaatttatgaagttaatttagtaaacacagaaaatgttatttatcccctttattgttaaatgatttcaaagtagatattattttataataatcaaaagggcagataatttttaaaaaccctattcagaatgcttaccctttagaaaaataatcatatttactaatatcccctacatattagattcttcttttagtctgtaactttcttcaatggttatgttataagattccataccatttgatatggtttggttgtattcccacccaaatctcatcttgaattgtaactcccagagttcccatgtgtcttgggaggaaccccatgggaggtgattcaatcacagggacgggtctttcctgtgctattcttgtgatagcatatgagtctcacaagatctgatgatttttcaaagaggaattcccctgcacaagctctgtcttctctttgcctgctgctgtccatgtaagaggtgactggctcctccttgccttccctgatgattgtgaggcttccccagccacgcagaactgcaaatccattaaaccccttttcctgtataaattgcccagtctcaggtatgtctttatcagcagtgtgaaaatggactaatatgccattaaagtacaaatattgtcctgcaatatctttattgtcattttcatgtcctttcttttgttctttcctcaactcttcctcaccttttgccagctgttgtcattacagaaaaactcatgctgtttaagctactcccccttcaaattaatgaaattcgttttgacaagaccaatatttcctttaacgggatctgattcttctgttaaatgttggaattccctatagttctgccgttacccattttcatcccatcactacaaactcttctcctcaaagttcccccatttctctgatgtttaagaactttgtgtgattaatccccacatcctggagtgaggaaaaccactttccttccaaaatttagtggagattttaaaagatgatttgtgccaggcacggtggctcacgcctgtaatcccagcactttgggaagcccatggaggcagatcacttgaggtcaggaattggacatcagcctggttaacatggtgaaaccccacctctactaaaaatataaaaattaggcaggagtggtgatgggagcctgtaatcccagctactttggtggctgagataggagaatggcttgaacccgggaggcggaggctgcagtgagccgagattgcaccagaaagtccagcctgggtgaaagagtgagactgtgttaaaaagagagagagagagagaggaaggaagaagggagggggggaagggaggaagggagggggggaaagagagagagagagaactctgatttggaaaacatctctctagttctaatattttggaatctcttgtatctctaaattcaatactgacttctatccaggcctcgttttgtatatccagtctaattcctggaagttcacatattatttgaattttttggaaaaccagtgcctctaatgcaacacatatctatgctgtctcccaaatttataactccagccgtgatctgagctctggaccaaatactcaaaagtatactctgtgtttccaatttagatgactcataaagatcctaatcaaacatgtcacagcatggctcatgcctgtaatcccagtactttgtgagggcgaataggggaggatcccttgagggcagcagtttaaaaccagcctgggtaacatagggagaacccatctccacaaaaaatttaaaaattagctaggcattctggtgcatacctgtagtcctagctacttgggaggctaaggtaggaggattgcttgagccgaggagatcaaggctgcagtgagccacgatcatgccaccacactctagcttgggcaacagagttaaaccctgtctcaaaaacaaacaaacaaaaaacatgtaagaacagaacagaacagaacacttgacgtatttctcccataactaaatcctttaccattgtcacctctcagtaaatggcatgatcatgcactcagtgtgtcaggtaaaaagtctgcagatcacaaaggcatccattgctcaccatgtccatcactgtcaccataagtcaaaccataatctctcttacaaaaactataatagctcactctctgcatctacatatgtctaccagaatttattctttccatgaggcaaagcagattaatgtgttctcttactctaccccaccaacactttctcatcaccagcatcataagattagggttccttcccatgggttacaggatctcaataatcagcctcttgcctactcctggggcacggcttttattcttatctaaattcactctaagtaagtggccatcttactttttctctaacctgctgatctttttcttgctttagggtctggaaacatttccatctccagcccttggccagatgttgataaccctccttcctgagccctatgctttagaagaccctgatgatcacaaattaaaacagaaaatgtttcttttctccttcggaataacaggagttgttttgtttgtttgttttttgtttgcttgtttgttttcagtttttaaaagctcagtaacccaatggggcacatatgtttatgggccagtgatcgccccaaagctgaactgggatgtacagaccaaagcttgtaagtctgaaagagcaaaaaaggtgagtatgtatgattgggtttgggtttgtgtaagtgtatatgagcgagtgtatggctgagtgcaatgaaagtgtgtaagagtatgtgagactctgcgtttgtgcaggtgtgtgcacttttgcacacgtgtgtaggagtaaaggcaaaaaggagaaaaccacaggctctggagtgataaaccagaaaaaagaggaggctgcggtttccatttgtttaccccaaatccctcaactatgtatgtagtaaaacttattttctgacctctgctaggtttttgtcactttacagacatttacaactttttgcaaattctgagtgggaaaaatgaggcatggctcctcaggaatctttttttttttttttttttttttttttttttgagacgttgtcttgctctgtcaccaggctggagtgcaatggcgcagtctcggctcactgcaacctctgcctcccgggttcaagcaattcttctgcctcagtctcccgagtagctgggactacaggcacgtgccgccaaggcctgctaatttttgtatttttagtagacacggggtttcaccatgttggccaggatggtctggatctcgacctcgtgatccgcccacctcggcctctcaaattgctgggattacaagcgtgagccaccgtgcccggcctgctccctgggaatcttgattggatagcccaggctcaggagagttctgtgtttgatcttgatccccacagatccaggctgcccctaagcctcatactggcatgagatgagtatagaattggaaccttgacagcccgtgagcatgaattctgttaaaattttaactgtttagcgagatgacatgttgctctccatttgtactcttacatcaggtgcctggcatgtgagaggatggcctgtcaagaatccccccatctgaaagcaattcttctgggctatcatctcccgtggcttgttcaaatccacttaatgttccttccaatggacttccatgatgaaatcaactaagagttctcttcccacatcctgtcactctctgtctgcatactttgcattacattcattttcagtcacctctacctgcaatatattttaatattttgttaaagagttcattttccatctcttgcactcgaatatgggcttaatgaggggagggacttggtctttcttgtttacaccattcatcagtgcttagaataatatctggcacatagtagttgttcaataaatattggttgaatgaaataaaacaatggatataatttctaagtgcatgtaatatctaatattatgtctaaagaacatctaatgactaaatataaccagtctgtgtaaccagtttcacccatccctgaaatcaattttatcaaagatcaccagatccacctactaagttattgatgggatcatgactctttttcctctgaaaatttgcagaaattttattttgttttatttaggtttctaaacaaatcatcaaatcatctgtaatgattcataagattcttaatgctttgatagaaaaggtccccttccttagtctgatgttctgggcctccaaaatttagattagaatttcctgatttcagccttagtcttctggatacttgcagttaaaatggttttgcttcatctgtgaatgaggacccaatacccccaccagtgaaagctctactctcaggcaagcacaggatctcccagggagaagagtctttggttcttttgaacaactgggaagtacatgccagcttcacagaactaaagtaattggtatctaaatggctcttcagcatattcaacctgtgtgattttgtcaccatataaccatccttacacaaagagaacactcaatacatacatgactctccaacatatctttacattcctcactttaaggacatataactattaattgcataatcatgcatctctttcaaaattatatattcaataatgtggcttctctattctttattgatagacacactaaaatagttaaataacacaaaaatgcctcatttggcaggtaattcactccttaaatacaatattcagtttttggaaagctcagtaagaattctcaatagttacaactaataaatgatataccagtccccttcttgagaatagcatttatttgacttttataaaaacattgtatactaagtagttctccatagctttgttttacttacctatagtgtttttagtaatatgtatactggtttgaacctataaaacatttttatcttaattattgttaattttatgtaaaatttataataaaatgtttcatccaataaataatttatataagtagatacagctattgtcatatggactcaactatataactagaaaaagacataaatgtggtttttagatagatacagatatacacactcccatatcctctcaaaagtgctgaagtgtttataatgtctaacatattggaagtaattagaataatctcacatgatacactttctatgttcctttcacacaattgaatatttttaactgtttacattgctgatttacttctagtaaattacatattccctaacttacttgaggattagggttacctgtggtacttaataaatgttctaattcttgggccccaattcagatcaccttaatcagaatattttgagggtgaggggctggaaaaattatcatcatcaagaaggtagacaaaaccactgctcctgcatagcacatgccaccacagagcacctcaaagtatactctccaccaagtgaagagcaaacaaatatttttcaactaaaatttgaatggttcttgtttatgtttgctaggactgccatagaaagtagaataaactaagtgacttaaacaacaaatttattgtatcacagttctggaggctagaagtccaaaagcaaagtgttggcaggttggtttcttctgaggaatgtgaaggaaagatgtgttctgggcctctctccttctcttgtagaaagctgtcttctccctgtatcttttaaaatcaccttccagttaaatcatacatctatgtatgcatgtgtccgaataccctcttcttataggtatacaagccatattgcattaaggctcactccagtgactattttaacttgactcctttgctcaataaagaccttatttccaaataaggtggcattctgaggtactggggcattagaacctcaacagataaatgagggaaggtttacttcaacctgtaacaggttcaatggcagtcattttccagtgttatctatactgacttttagtggtgtatattctcctgtcatattttttctcaactttcttcctttaccattcattatagggaaatcatgaatgtgcagcagctgatgatgggaccaaagtcaatgtgtccaaacactctccttggtaggaaacacaaaagtccttactgtgcaatctcatagcaaagtttctaatattttcctgccagaacttcaggataattcctcaaagccctgcaatgtttatcctttcacatttgacataagtaagtctgcatgtcttttttcttcttcttctttttgggaaaatatcaagaactcttaagacaagaaaatgaaatctgctgagttaaccctggcagaggtgaaaagtcaaagatgaagagcagccttctggtgtagaaacttttgtcttgatgaataattgatgggcactgagagcacaatttgctgcttctaagcatgcagccctgacatggtatggcataggaatcttgagggtaaaaggattcttactttataagcaaacatcttgagaatcaatattagattctgaagttttcttatgtagttggcttaaaagaagaatggattatgaaggttaggaagccattttcttataaatgtagctgtactcccattattgagacttaaaatttttagtttttttctccttatttttccatttaatgaatgattgttacaattatttttattttattttattttatttattttatttttggtagaaacagggtctcactgtttgttgctcaggctggaaaacagtggcgtgatcatagctcactgcagcctggaactcctgagctcaagcaatctccccgcatcagccttctgattagctaggactacaggcacatgccaccctgcctggttaagttttaaaaaatttttgtagagataaggtcttgctatgtttcccaggctgttgttgaactcccagtgtcaagtgctcttacgtaagcctcccaaagtgctggcattacaagcatgagccaccttgcccagtcttcttttctattttataaggtagatgatagtcatcagattaattggtagatatgaagctataatatctatatattaaagcttttcagtgtagggcacttctgagcccttttttttccatcatactctcctggcaaaaccttagcgcttttttttttttttcttcaacactcctgctactctgcacccgtatctgaaaaactaaatttgtgtggagaaaaacaatgatcatggtgaatattcttatttttaatttaagggcatgtccaagaagtggacccttaatgctacctggaatccagctagatttctctaatcaattccctctctcactttcaaaggagagaaatccacaactcttttcttgtcaagcttctaggataatctctttctcggttgatgaacttactcctagttccctagaaaacaggaagcattcaggagaaaaattgcacctgttctttcaacacccaatgaacaatctccctaaaggtatgaatgttctcctaacacgtgggtgttctgccaacaaccaatcgacaagctctctgcaggtttgtatgtatatgcatttctgcaccttgcttcctattaagatttttcattctcttctctaatttcagtacctcactgtcccttctgcatgagatcatgtaatctctgtcctactcaaacactcttacaatagccttccatattccattcatcattgttttgtttactttctactgactcattattgtaaatataaaaatattttgcaatactatctcctatcttaaaatattttcttgatcccccatttccactccacatacaaggctacatttgtttcaacatttgataaaacttccatggggggaaaaaactgtatcttctgtctccaattcaatctttggtcatttcctctggaataaattccaaataatattttatccccattcctcaggttagggtctgttcaaggttaccaatgacttcacatggctaccagttctcagtctttgccttgctctaacagcaccatatgacacaaatcagtgactcctattttcttgtttcctttatttagttgacagaacaccctaatctcttatttttcaactttgtagattattttactccagattgtgttgctggatctgttaaagaaatagttcttctggcttttgttaaaatgctaaggaagactttattcaagagaagtgagatcatgctcaattctggactcagaaaaggcacctgaagatttatagtcaaggagaacagtaagaaggtcactgggtagaaaattactgagaggagacacccagggtaagggaattctttctaaaccaactgaatcagattcttactgaagcaggtgaaggactgatatgtcaagggtggaagactagaaacattatcacatatcaggggtaatcagatactatgggtgggagtattcttcctaaattagtttaaaaaattcttattaagtcagagcttggcaggctaaagacaggaaagaagtaaggtcaaggcctagtcaaaaagaatgcccagagaagcctgactaaactttagtcaatgagagagtttttgctagctgccattcatttttacaaagttctgagttttagaatgccctaaggatgagtctgcagatccttcctcttctctctctaaatttacttccttagctgagttgatccaggactgtgactgtcagtgccaactatattcttccaatttccactttttaatttctaacctgaacactttgactaaacctcagacatggatatccaaatggttgctagacgtgttaagctggatttcttgtaggaatttaaatgctaatatttccaaactctaactccagatcttctactcaaaaccagcatctctggcttctatgttttttctctcaaaaaaaaatctattatactgtggaattatcctagatacatctctattttattctcacatccattctattgaacccttgtaactttctcttcaaaatagacccaaaattttaccacacccagaaacatgatctaggtttatggtatcttgaactgctattgagatggttacatcagccatctaccaagtcttcctatttccacatttgtcttcatgtaaaatattctttattcaggaaccagggacatccttttaaaatgcaagtcatataacattccccctttgctcaatggccttcaataactttccattttacaaggatctgtggaataaaaaactcattaccatgacctttgaggccctacttgatctgtccctagaattcttcatcctcagctactcctgaaattttttccttccttctttactgtgttttggccacaatggctaatgagctttgggcattccatgattactcccacatctgtgcctttgcactggatatttgctcttacaaatattgttcctcaattttgaatatgactcaatttctcacttaaaccacatctctgctaacataaaaatttattaaaaagcctttcccgaactccccatataaagagatctccattctgctgcatcactctttatatacttacactgacttatattctttataaaatttaaagcacctattaacacacactacatgtattaaatattatctctctactctaagttaaattacgaaaggtattttgacttttttaactgctatattccaacactctaaagctttcatggtaagtataaaacatatttattgaatgaataaaagtgcctaaagcactcaccttagtttaatattttctattttgtaaagtatatgtgaagcatggggataaaaacccttatgaatgatgatatagaagtaatgttattaaaatggtagaaagaagatggtataaagctaggcccaatttttattaattgcaaaaaatttgaacaaaactttaattttgtaggtgtgtccttagttttaaaaggtaagtaaagtcctaactaatgtgatcacatttatcatagcctttctaaattactataatatgtggattttatttttgtgaatttctaaggtttataaatggtaaggctgatatagtgtaaattgatatatatagtgtaatggaaaatcggactgacatttctcagtgtcaacctgtctccttctcaataacattatctcaaaaagttgggttgaaattcaatctgagtatagaataaaaccctctaaatttgaagagaaaaatgccctgagacatagataatttgaataactggcccaatgtgatacaaccattaaatgatgaaacaatagatgatgaaatacatgatgaagcaaaagctcatcttcttacataacacagagtattgccagagagttggtccatttaactaagaatttagtaatgagtcacaaggtatgatgtgatactgcagaggattacttattttctttcacgaatatttcctgaaaaacagagaaggatgtaataatgctgatgacttcgtcagagagtgaagtggctgcaggttagttacaaagaaatgaatgatgactgcagctgggtcccaaaggaaaagccaagaactgtattttcaaataattgtagcagatcacctggacacatggactgatggaggaagacacatgatgtcaggggagtcaaccaagaaaaactgcagaaattagaccacagtgaatgattctcatcggagtggcatgatcaagaataaagaaataaatccaactgagttctgaaagaaatggataactgagtggtcaaatagacagcaatagaaactactcatgagaaactccataggtgattgttaacattagagtaaatcaatagtaaaggagaatattggaaagggaattaatctggtagagttatggtgatgaacaatgattatttccattgtgaatgtgtaattaagtggatacacatgaccagagagacagatagccttagcagaggaaaactaagatgatgcataatacatcaggttattaatggtcatatacaatacatagatcagaatgtggatattgatcatcacagagaaacgtctttcaatttttgttttgtttacatgcattattgtagaaagctgtccccaaagcaggtccaactctcatattttcaggaaccaagccatagtacaaataaagaatcacatagaatatttctcattagtaataattaatgaaccaaactaacaaattattacatacattctattctcctatttttgacaaacctttataacagctctgaagtccaggttagatagatgaggtcccatctctactactaagcaaaatcctggaagcaagtcctgaatggttgactagagggggtgtttgcatatctagtaggcactttgtcttgaattctggaactcatcccctcttggcaagaggtggaaccagggaacattctgagcagggaagaagaccctcatccttgaatctcaaagtcatattgtccaaatggatggccccaaaatgcttatagcatttctagttgggtgaaatgatctagaatgattgtaaatgtcttatttatactattgtgaattacttgaattttcttcgggaaatgttttaagtctatacttcaaatgaaaatgcatgcattttataattactaaagaaaaaataactaaccgattaataggaaatgatttaatataccctttctgggtctgtaatttatattttaggtgaaaggtattagaatatgtgaaagtatttaacaatataaaagaaaataaaaatattgactatattaatataaatacatttccagcagaagggatgcaccacgatactgaatttaacaataagaatatagtttctatttcatattagagtcactaggattctaattgcaatgcaagtgaagttaaatctattacattatataaaagtaaactatatcctataatgcaaaatcactagacttctttcctttgaactttttcattcagctttccccaaaaccttttttcttccaaaactaagaaattgcattttaatctttaaaaacatatattatagttgaaaagaaatcagtaactttaatctttcccaagaaacaagatattctaaatgcaaattttgaattacttttaaatactcgaaactgtattagctgtaatttacctggcctttcaaaaacaagatttcataaatcactcacaaaattttctagagattatttttttctttgaaccatctatatactaataaaaactagtaatgagaaactgccttccatctaaatgctaaatcctctgctagtatattttatgaaaaaatgtaagcattcacctgtataattgctttccaaattattcctcccttcatgtaactattctacttttctgtttttatatgaatttgagctaaaatgatgttgacattttatgtatttatcactgtcactatcagctatctacttaccctgtttggaaattctgcttatttttcattaacgttgatattaatttcagtataattctatacttaggcaaacagattggtaattcatacatatctgaatttttaaaattgtagctatataaataacctgatcttgatgcatttaagataagttaaggaattaaaccaaattatatgttttattgtttattgaatggtacacatcattcatattaaatagtacaattaaattgatgttaagaaatgattaatctatattaaacataaaattcacattttaggaaacttatgggtatcacacattttgtgcagtaatcaggtctcctcctttttctcccaaattaataaatcaggaacaccattaatgaaatttctatgaaatccctcacaatcctgctacccttctctctattgctgctgactacatagtattgtcgtaaattattaaattgagtataaatgatattacctcatcttacatgtaaccaatatatttatttgtataaaatactactcaaagtaatgttaatatattgaagtgactgttctaaaaattgtctatagatttatcttgtaattggtgtaccaaaattgtatacagtatttatataatattcactatatagggtgaactatactcgatatttgaattttagagtcaattatagattatacaatatctgatatcaagtggattccaaactacagagtcccaatcacacatcttttacctatttttataactgaggaagctggtaggcacacagtggtggagttaccatactgaggtggattgtggtgatttaccaaaaatctgccccaaggcccatcaataggccttttttcttgtaactggagaattattaggctttatccacgtatctcaacggttatacacacgcatacacaaaaaacaccctactgtttatgttttcttaactttaagttcaggagtacaagtgcaggtttgttacataggtaaacttgtgtcatggggttttgttgtacagattatttcatcagcaagatattaaccctagttaatctaaaaccccttagacgttttcccaatgctttccctcctctcacctttcaccctccaaaaagtcccagcctgtgtccttcccctctatatgttctcatcatttagcccctacttgtaagtgagaacatgtggtttttggttttctgttagtgtgttagtttgctaaagataatggcatctagctccatccatgttcctacaaaggatatgatctcattttcttttatggctgcgtagtatttcatggtgtatatgtaccacattttctttgcctggtctatcattgatggacacttaggttgattccatgtctttgctattgtggatagtactgcaatgaacgtatgcatgcatgagtctatgatacaatgatttatattccttttggcatatactcagtaatgggattgctgggtcaaatggtacttctatctttaggtctttgaggagccactacagtgtcttccacaatggccctactcttcatacagttaataacactattggactaccctcactgctaaaaagcaaaacaacaatgaaaagcggccaacaacaaaaacctcatgagcaataaggacgcttaggattccaactctttcacctacactgattacaataaatggtgctgtacagcttttgctaaagtgtaacatcttatgtcacatccacaaacctactctggtgaagaaacttagttctctgagaatgataaaaatgagttaacctttccattatcagttgtgtctcgtggcattttctaaataagatcaggttactttaaacataaaaaggcacttttaatccaagtaggggattagactcattatatattccctgagaaagtcagtatttggtaacatgttctaagcaagggaggaatcctatttaaatggaaattttattgttaatttttttgaatattgaaaaataggccaggcacggtggctcacgcctgtaatcccagcactttgggaggccgaggcgggtggatcatgaggtcaggagatcgagaccatcctggctaacaccgtgaaactccgtctctactaaatatacaaaaaataagccgggcgaggtggcgggcgcctgtagtcccagctactcgggaggctgaggcaggagaatggcgtgaacctgggaggcggagctttcagtgagcagagaccgcgccactgccctccagcctgggcgacagagcgagactccgtctcaaaaaaaaaaaaaaaaaaaagaaagaaataattttcagttgatttttaaagaaaagaatgtaaagcaatctagtaaacaacctttaccagctaaatatatgaaccataactaaaagagaagttcttgttcaagtagagaagtaaaaatttagctacctctgtcaacaaagatactaataaataatatcaagagcaaatgttttatgatggtgcattgacttctgtcctcagagcctgaaagacttatgctgcttactagataggttgaattgatgaggggaaaaaagccccatcatttgttgttaattatggatttaaaatcgcaaagtgcttccatttactcacataattaaaccctctatatcataaatattgatcttggtgttatttttttgtttgcctttcctaaaaatgctaacagactgatgctatcatttagataattttgaaaggtcttttcctagtgtaattaaagaacgaaatggaggaaaatgttttctgtttgctctttatcaaagagaatgatgctctaagtccaattagctgtattaatatttcaaagtgttctaacatgttcatgttttgggttcttatcatccatagggtgatttagaggccattatctggatacatgcaaaagaaaagcaacggtttgcaatagattcatatttcagatatcagggcctacagcagcaggtctgccctgctattactgaggaaggtatttatcatcaacattttcttgtttcagataaaactgctgaagataataagattacttttaaacataatcttcacaatatgccttatgatttaaatctagtctctttcatttttgcattcttaattttggtaacagttcctagtggactataacaagtatttgttcaacatcttttaaaagcatttacttgtctgctactaagtgccaggcacaacactaattactttgagctaacagtgagagaggtagacactaaaagaaaaagacacagatgaatatagcacagaagttagacaagttttggagcctcgatgcactgcataagaatgtccacagagatttcatggcagggatatggcctttctgaggaaaagacatctatcttaaaatttgcagggtgagggagggctctccagcttgttgacttgaatagatatgctggatagagaattcctggtgttacctaaaagtttattggactaatcgtaaacatttaaaacagcatctaaatcattatctatttgttggaaaatggataatgacatgagccttctgtaagaaattcaaagtcacatttcaataaaagttataatagttcattaaaatgtgtcaaagattaatatttgaaatgagcgcacatttgtttgccttttaatttctaatttttgtaatgtttcatatgtctttactggcctgtatgtaattaaaagagaactaaaatgaagccaaagacaaacaaatcaacacattaaattctcagtctactgtgacttctcttgatttgcccccagccccccaaaattaagtcctctatatcactattttattaagtaattaaaaataaagatcctatccttcctctaaaagttaggtaacccattgtttctatcaatttagaaaagattttaaaatgtcagaactttgaatgagtagcaaatttcgcatcaactagaattttctcatatttttgttcacacagatcatggcagatattagacttaagcaaacacataggcttcaagataattttgctgttgttgcctccctaagttatttttaggacatcatttttttttcaaaaagagttttggtttttgactttttttttcttttttactggactttaccaggagcaaagtacatttaaaatacacttagaggtggagtgtggtggctcacgcctgtaatcccagcactttgcaaggccaaggtaagcccatcgcttgagcccaggagttggagaccatcctgggaaacatggtgaaactttgtctctacaaaaaatacaaaaaatgagccagacatggtggtgcatgcctgtggtcccagctactcaggagacaaaagacgggagaatcacctgagcccaggaatttgaggctgcagtgagccgggattgtaccactgcactcgagtgtgggcaacagtgaagccctatctcaaaaaaaaaaaaaaaaatacaccttgcattcaattttatccaatagtgtccaaaggacacattgcccaaagtgcacaatcttaaccctaacagaagtgcatgagcttttcctcaaacaagtttccaaaggtgttgccgatcaataggactgccatagttttttccattgcaaatgcccaggtgtcaggctaaacaggcagagagattacccctgggaggcagggcacagatccagggtttttaaaagtttattcttcatcatttcaaaagattatcagtatttgcaatgctcacgcaaattcttctgaaatgcagtatcatttaaaaaagaaatgcaaatatttttccagcaagaaattatttataacatattttcttctatgtatttttatcaatcaaggtaaaatatgttatttagtctttgtgggttattgactagtattaaaaaaattattatgacttttcagatagtattacctgttatctcttatgttcatatttgattattgttttcagcctaaattcactaattgccaaaattgagatacaaatcaaaacaacagtgagatatcgcctcatgcctgttaggattctgttttaaacaaacaaaagataacaagtgttggcaaagatctgaagaaatgggaactcttgtacactgttgatgggaatgtaaaatggttcagctgctatagaaaacagtacagcgttttcttaaaaattaaaaatagaattactatatgatccagtaatctcacttccggttatcgatattcagaaaattgaaatcaggatctcaaagaaatatctgtaccttcatgttcatggcagcataagacataactggcaagatacagaaaacaatctaaatcaacctaaagctacagatgaattgatagagaaaatgtggcgtatttacagtggtatattattgagccttaaaaaataaggaaagcctgccatttgcaacaatatggatgaatctgaaggacattgttaagagaaacaagccagtcacaggaaaaatgctgcatcttccactcacatgaagtatctgaaatattcaaactcaaagaagcagagagtagaatgatagttgccaggagctgatggaaggaagacataaggagtcacttttaatgagtgtaaagtgtcagtaatgcaagataaacaagttctacagatctgctgtacaacacagtgcctataatcaaccatacagttttgtgcagttaaaacactgttttgtaaaaaacttgttaagagggtagatctcatgttaagtgcgcttgcacttaagaaaaaaacaaaacgagggggtatgaggaaacttttagagtgaaggataagttatttgtaaaattatatacattaattatatgttgtattttagtatatcaattatgcaccaatgaagctgttaaacaaattaatgtggatcatgactgaaggcaaaagaaagaaaatcaatgaagtccatgtaaactttcaaaacaattatctacaaaatcctgatttctattgggatagggactacttgaggaaagaacccatgaacgttaaaatgagagaataccaactaagagtcctaattttatatgttatttggtaggccgtcatatttcagataagaaaaccgagttcaaaaagaaccaggattctgaagcataatccagtagacttcctcatatattttgtgaagacaatattttcccgccacacaatcaggtctataaaggacctcacagcatgcttgacatgttagctgatcatttgctctcttgactctaccttgtgcagatttattatcaagaaaaaaatctccaatttagcccaaaaagtagtcttcccctctacgtacctttatgttgaacaaacctagctgaaaccagagaaaaacattcttgctagcaaatcaaatatttaaaacttatcatgtatataactttacccatattcttcttataaaaccatctgtaatagaaagtaattttccacattttataagattttttaatgaaatccagtttagaaaaatttttagcataatattaaggtttaatgttgtcagcataagagaatagtggaatttaacccttagtaagatattaaaacacattttcttgattatgcctcatattctctgttttactcactatcgtatgttaagcctacatgccatcatcaaatctctaccaagctaataaatatgattgtgtcggggattttcccaaaaaatatataccattcaccttggaagatgataaattgataaatgtccatcataaaatgtccaaaccaatgcagtcaattcatccatatggccagtgtgttctttcagtgatggatctcctctgacaatgcaatgcttcatttgcctagctggtaatttagtcaagtttcttaaaaaattatctagtgacttttggaaagtatataggaagaaactcacacctcccccttctcttcaactaccacccttctcttctctttgttactttgaagatatacagatttttttaattgatcaatgaaattagaaaagaaaatacaggctttataatgaaaagtttctggaaaatgtaaccacttttgagactatgtcatgtcaaaatttttgccatgtcacgtctattaactgcaggaaaggttgaacaaaaaattttaagacacttctgctgtctcaagtttttaaaaatctacttagagacacaaattttaaacaaacattgaaaactacaatatatatgaacacattctttttttaaataactatttattgaatacctacactatgccaggagctgttctaggtattgggaatacagctgtagacatgatttctgcaaacatgaagatgatttcctagtggtgaaatgcaaatcgaagaaaagtaaacaagtaaagccttttaagtgatagatagttgctgggcttgttactctaagaccatgtagtgatggaagaccctatgacaaggaggtaggcgagtagagctctgtacacagtgagggaatgagctttgtgaatatctgctggaaaaatttggccacatagggaacagaaatataggaaaccttatgcagaattgaaatcagcctatccaggttgaaaccaggataagaccaggttgggcaacatagcaaggacctgtctctttcaaaactatatatatatatataaatttaattaattgggcatggtggcatgtggctgtagtccctactactctgaaggctgagatgggaggatcacttgagcccaggaattggaggttgtagtgagctaatattcaggttcaggtaagacatgagtatagaaaatgagaaataagtgatagaagatatcaggggccatataagatcgggaattccaaatttcagaaacaaacttcttctaaccgtaagaaattgtttatagcaaacatactttatctaaaaggtggagtgtagtgttgctaaacttaaaaactagaaataatgcatagaaaattcaagaaagtcacaaagaaaatattgatatatttggatgctaggttacaagtgatattgattatcttctttttctcctccagaaacatcatttttctaaaaaacagtatttatgatttattgaaaagtaaaagcatatattacaaaatatatttatgctaaattagcatttatcctctgactttctatcaccagtggcttgcttgaaagtgagggatttcacgggtaggtcttaggcagatgcatgatgtgaggtttgcttggaagacaacgattttgaggggaagcaaagtggagaattaaagagagtagacacagctttagacatacttggatctgaactctgtctcccaactctacttctttaatcatgttgcacactccttcagtttgagacatgaaaagtatattgaaagcataatgagaattgtgcagccagtaaacactgaatgtggaaggaaagacgatcaccatgaacttggactagacagtactgacatggactcaattccttcaaacttgaagccttgaagtaaaggcaaacctgttttttaacaatatatgtactaaatcagcagggagatgccagcaccgacaaagtataaagaacaacaacaataaataggatgaggaaatagaaacatttgccatccctcctggcacatgtgagtctcacagaaattaggccaaattctagcaattgcttatattgcacaaatatgtttcttcaaattacacatacatatttctcctattttgatttatgtaataacaggattacataataatatagtagaacaataacaacatattatatataatatccaaagactcttgaagaatgagtatataattacatagtcattcttcaagggtctttggatacatatttgtaaagatctaaaaaatattagggaaaatagaattttaccttactatcttagaaaatgtataatgcagttttttgtaaaggaaaatttctatgtacttctacattgatatttcaatgaaaatacaccacatgaatgttgttcaggtgtataaaaacttgtccattgtttattatcttatttatggagaaatttggtatactgcacaagcttttcttttcttttctttttttttagagacagaatctcactgtgtcacccaggctggaatgcagtggcctcatattagttcactggaaccttcaattcctgggctcaagtgatcctcccatctcagcctccagagcagtagggactgcaggcacatgccaccatgcccagttaattaaaaacatatacattgttttaaaagagacaggtccttgctatgttgcccaagctggtcttaaactcctggcttcaagcaagactccttcttcagccatccaatgtgcagggattataggaatggacaattatcctttcttaaaatatatttttcatcctttttattcttatgcttttttcccctggccaacataaagttaaatcatttggattttctccagaaagcatttgtattaaattagatttagagtattatttgtatagttttatcttccattttcttttctgttctctttagccttaaagtttacaacatagctttaagttagattttaccttatcttatatattcacatggactaacaaaacaggtacagcatggaagaaattgttttatgattttccaaataatagaggaaaacaccttagctacaagggagaaattaatcatatcaaaataatgacacaaatgcctacctttccattttcttgatttactcatacatttctaatgtttttattaagaaatattttgctaggaggatatcagagcaaaagaatacacagcccaagaggggcaatagggttaaagcatttctggtccaatagtggcatgtcttcagcactggataagggacctttttcaaagtgacttccaaggaagcaggaccaacgcagctggaaagcctcacccactgtcagctgcacatagctgctgccccgtgcctgccctcagcctctcctcatcaagtgttttctactggttgccccagccagaatcacctctctgtttcttcccatgatgtccttgctggcactggcttcatgacaactctcctttctcctctgaaacatagttctagttatagtctcagaaattgtcacctttcctatcatacactaggtccttcagaacattgtggtcctagatataaaagtcaccacccactaactaatattatcactttattgccttccagatgttaaagtaagacacacaaaaaactcatcttgtgataatctaagtcaatacaacaagtagaaataggctttgaattacagatgaagcaaaaggatgagaagtggtaactagtaattttttttttttttttttttttgagacagagtttccctcttgttgcccaggctggagttcaatgacacgatctcggctcaccggaacctccgcctcccaggttcaagcgattctcctgcctcagcctcccgagtagctggaattacaggtatgtgccaccattcctggctaatttttttgtatttttggtagagatggggtttctccatattggtcaggctggtcttgaactctgacctcaggtgatccgcctgtcttggcctcccaaagtgctgggattacaggcatgagccactgtgcccggccagtaacttgtaattttaaccaatagttctggtggtagagatttgaaaaggcctacttaaaaccagacataattatgggtaattatgatgatacataatcattagttgcacagtgaggtggtcattatctccaactttcacatctagacctggaagttcattgaggtcaagtgtttgcaaagatcttctggcctaacttaggggtcagagagcgccatgtctgggggcaaaccataaatgtgtttgattaagattaaatgcatactgaggaaaatgcatatatacatacggctttttttgtgtgtgtgtggcatgatctcagcttgctgcaacctctgcctactgggttcaagcgattctcctgcctcagcctcctgagtagctgggattacaggcatgtgccaccacgccccactaatttttgtattttagtagagatggggtttcgtcatgttggccaagctgatttcgaactcctgacctcaggtgatccaccctccttgacctcccaaagtcctgggattacaggcatgagccactgtacctggccaatgcatatattttgaacaaacaatcaaaacaagaaaggatattgattattagagtatatagtggacaacaaggtaaaaaacagggataaaatgtatatcgcataatcacataatttgacaataatagaaggaaaaatcagggatttcctggatctgatagaggaaatgctgtaatttaactgccaggtgaaagacagtgaaacttgagggcacaaaaagtaatagatacaaggatatacatacattaaatgaacaataaagcaaaaacaaaaacaaaataaaaacagaaagctgagttgaacactgagtctaggagctgtaaaaatgtatgtcaatatataaattagagatgcaatatcaaaaatattcattgctcattgactaatggcaaaaaaatcagtacaaaattgaagaaagcaaaacctacttacctcagggctagcaaaacctaccacctgcatgtgttttaatgtgcatacccatatccagaccaacagctcacattaacatagaagaaaatgtgagcaactgagaactgtgcttaatattggcatgcaattctgcatactaaaatttaacttttaacaacattatgtgcttgactagttatgtaaatccatcatatttatttcatataacaggcatgtctgataatataaatgtcaattggttttaacaacttattttgataccacgtccatcacagtaaagtattaatggcaaaagcagaagtcatgtaatatattctggaattgggaatggtgtaactcataggaaagtactttgtaacaaagaaacgtacaattgtagtgttccagtttaacatgatttgacacacctcatacagaaaagtcctgaaactgacagctaagtaagtcttcaaacaaaatctgccaatattcgttgtctgcttttccttcactacttttaaataacgcagcaaaaatgacttaatcatttaaaccatatatagatggccatttatggagaaaatagtgcaaaataaaagaaatatttttttccgtgggtgtcaatttaccttgccatcatttaaatgttttttatttttccagtgtcatggctatcttaaaaaattgcaattttgtaaaggaagtcaagtgaatgcagttttattaactatgccttttatttcccatattttaatgcttttacattttggggcttcactgatcctgaaaggactgcccctcaaagggttagctcattccaagagatagcaaacaattccctgggaatgtgcctttcacatgcaaaccaaccaatccagaggccatacctctactcatcttctttactgggctctcaaactctgggccactatccatctaccctaattatcctagggccaactaccagacaacaaagaactgcacctatttccaagagccactgaaattcttcaagctagcccatcctaaacctgcttaccctgcctcatcagcccctcctgcagaaatcacaaaggtttccataaagattcatttggccacatttgcctcttgcaccctctatctactggccaatactggtacttccctatgttgtcccatgtggcatggcatggccctgtttctagagaactgtgaatgaaaacttcttccttaatgatagtcatttctatgcttgcatgtcttaaattatctgatttttaaaaatcctggtacccttatgacagccattttttttctattattatgttggtgtgaaagtaattgcagttttttggtaccacctttttttttttttttttttgagacagagtctcgctctgttgcccaggctggagtgcagtggcacgatctcggctcactgcaagctccacctcctgggttcacgccattctcctgcctcagcctcctgagtagctgggactacaggtgcccaccaccacacctggctaattttttgtatttttagtagagacggggtttcaccgtgttagccaggatggtctcaatctcctgacctcgtgatccacctgcctcggcctcccaaagtgctgggattacaggcgtgagccaccacgcccggacagtttttcagtattacttttcatggaaaaaactgcaatcactttcacaccaacctgtaaatcttaaaaataaaggccatttgataactgagttatcaactttttattttgccatggaatgacattagaattaaaatgatctttctactgttggcatgatttcagtcgcaattttggtattgaagatatagctacaaaaaataatctcaaggagtttaagttttaattggatattatttattaaaaacactagctgcatatgctgcaattttatagctgtaaatgtaaagactgaagattttaaaactgctttgtgatgccttgtgcagtgtaactttttttttttttttttttttttgaggcagggtctccctctgtggcccaggctagagcacaaatacggttcattgcagcctcaacctccctggatcaagcaatcctccttcctcagcctctggattagctggaactacaggcacatgcccagctaattttaaaatttttctgtagaaatgaggtctccctatgttgcccaggctggtcttgaattcctgagctcaagtgagatcctgcctcggcctcccaaagtgctgggattacaggtgtgagacacagtgaaatattgtcttggaaatgtatgacaagtcctacttttatattgctctttaatagtgtttgagtttgcctactgaggaagataaggtataattttaaattatatgtccactggatttaagtaatacaatcttaatagctagagcaatagtgacaaatatattgttttcaccttttcctttgattatagctggaaaaatatttaaaaccatagagcatccatattcttatgtgatattacgcatatcactcacaggaaaaacacaactaattttgagttgaacccagctgaaataaagagaatatgagcatcacataaagttagtttttattctcttataatattgctttcactccttctatactgattctaattttgctaccctgattccaagaaatccgttttatctagatgttatagagttctgctttctctttattgccttgagcagtaatgggttaatcaaaccaggaaatacctgcataacaagccatttcatatcgagaacaggagaattgagaaagagaaagtgctgataaatatcccccattcataagaaaaaaattcacaaagacagaaaatccatagatgaaaatgaaaaaaaaaaataaggctctctgcaaatttctcaactttagaattgaagtaattaaagattactgatctttaatcagttaaaaaaaaactgaggatggccatagtttgctgtcttacttctactaaatatacacattttaaataaaccccacacaactaactacctcctatgaacattatttagttgataagtaagtctcctttttatagtgaaaatgtagggagaactaacactcttgcctttaattgcacagccttacaggttttgagagatgcagtcaacactttgtcaagaactgtcattgtgagccagggaggtggaagcacaattctgttcaatggtttcttccctttacatacaggacagcctagattccttttattttattttgtttttcaaacttcctcatttctatttgcttatttgtttataatttttgattcaggaggtccacttgcaggtttgttgcataggtatattgcacgacactgatgtttgtgcttctaatgatcccatcacccaagtagtgaacatattaccttataggtagtttttaatgcttcctccccttcctctctccctacttttataatacaatccccaatgtttattgttcccatctttgtgcccatgtgtacccgatgtttagttcctgcttatgagtgacaacatgtggtatgtggttttctgtttctgcattaactcaattaggataatggcctccagttgtattcatgttgctgcaaagcacatggttgcaactggaggctgttatcctgagttgtttatagctgtgttgtattccatggtatgcatataccacgttttctttatttggattccatttaagtagacaaattgttgtatgttacaaaaattcatgggatcatctattagttaactaggattgccataataacatatcaaagactagatggcttataggggtgtccaatctgtcagcatccctgggccacactggaagaagaattgacttggaccacacagaaaatacaccaacagtaaggacagctaatgagcaaaaaaaaaaacaaaaaaaaaaacaaaaacaacaacaataacaaaaacataatgttttaagaaagtttacaaatttgtgttggaccacattcagagccatcctggaccactggctgtgggctgtgggttggacaagcttggcttaaacaatagacaattattgtctcacaattttagagtttagaattccaaaatcaaggtatttgcagggcttgtttcttctgacagctctgagcaaagggctgttcgacttctctggtttgtagatgaccgtcttctcctgtcttcacgatgtcttctctctgtgtctgtggccaaatgtcctcttcttatgggacataaatcacattggattagggctcactataacgacctcattttcaattaattacttcttttaaatatcttatttccagtgacattctgaggtaatgggagttgggacgttagcatatgaattttgaggacacaaaattaagcccataacagttgacattcttgatgatcagaagccatggccaagacacagcctggcagaagcacagataacagcgccctggagaatatttccttctcacctccagaattcagtatataggatgtgcaaaagagaagctgcagggcaggaccctacagcagagataaccagtaagaaaacagcaggactttccagtctccgttcccagacttctttctagacaaataccacactccatgcctacagtctcctactaaaaatgtttttttttttttttgagacagagtcttgctctgtcacccaggcaggagtgcaatggtatgactttggctcactgcaacctctgccacccggggtcaagtgattctcctgcctcaacctcccgagtagctgggattacaggcatacaccaacatccccagctaattttgtatttttagtagagacagggtttcatcatgttggtcaggctggtcgcaaactcctgacctctggtgatccacatgcctcagcctcccaaagtgctgggattacaggagtgagccacagcatccagcctgatttttcattttctaaaacttcttttgtttattcattcctctatgaatatgcagttcttatattggctttatttgcagaatattgctcactctttaagatctgtcttaatggctggctccttccagatagcattcccacacacctgtgtgggaataagttttttctcccttgctctcctgaggtcaccaattattttttgttttataatcctgccatttccttgctcagtccactctgaagaccaccgatcgcacacagaagatccaaactcctcatcatagccaaaaagacccgaaagatttggttccagacaacttatcagatatcatatcctttctcaatctctctctgtttgcccactgaagccacggtggtgttcacttttgttccacaaatatgccaaacttatccctcctgggtgtcccctctactcgtttttacttcccattgtaaattcttttctcacatgatctcatcgtggattcctctcagttactcgtatcttggcttaaatggcttcaagtcagaggcaacttttctgaccaccaatctgaattaaactcccagtgtgcctctaatacatcaacttccttgattggctttattatgcattattagtccttaatcatatcttataaattaataattcatttgttgattttctgtcaccctcaactgcaatgtgaactccaggggagcagaaacatactgggtttgttgaagtctctaccaaggcactcaaataggtgcatgaaatatattgagaaaaatttttgaataaatgaatgaatcgttagaaaaatgaatataataaatttaatgcatgcatagatacatgctacgcactctacttggtactgaaaatagctttagaggacagggagcatgcactatttcaaaaatagtttttttggttttttttgaaaaatttttttttttgtccttactttttcctttaagaagtatccattgagatgatctgaaagttgggtaaaatttttccaggtaattatgaataaaagaggagaaagccattccattaagatggaaaagtttatggataccgtgagatgggaggaaaggctgggtacttgaaagaaggacagaatacactgaactgagaatgggccattgggcagagtaggccacagggccttagatgagaccatgggacctggaaacaagcctgcaatgtaatgttagatacagataactaaacagacaataaacaatgtgatgggatggtcaaaacaaaaggaatctgacacaggttctaggatgagtggacaagctgttggcagtgggatggtccagggttgggggaggcagtgttcaggtgatcagataagaggagaaaggtgtctgggcagagtgtgatcatgtgaaacccccacaaattgggagggctgtggttgagaatgaaagttttgtactgtatatggtcgagcatggtgtacagtaagtcctcagaaaataccttttgttcgacattgtttcatagtaatgttgatgagactaaaaaatgtcgaatctgagccagggtcaccgtctgtgcagttggtgtgttctccccagattggcgtgggttttccccaagtcttctggtttcctccttcatcccaaagctgtgcacattaggtgaatcggtgtgtctaaacggtcctggtgtgagtgggtgtggatgtgggtgtgagtatgccctacaatggaacagtgccctgtctggggcgggttcccgcctttcaccctgagctgcgggcaggctccggctatccacaaccctgaactgaaatgattgggtaaatagttactttatttacatttattcatctctcttaaatgtacatacaactcacatgtatttcaatgtctaatgtaagaagtgttttgatctttattttgaagttttgtgatgttcttgtgaccagaaatctgctccaggaacttacatcttgtttatatcaagtagcgtatggtaaaactggtttcattagatggcattttgaataaagctgcagtttccaagaacctattgatgatgttaagtgaggacttactctaccaggtggggcagtggctctaataaaagctggaaaaacaaagaccatcccatgaagagcctgtgagacacaaggttagtgcaagtttataactagaattaccttatgctgctcagcaaacacaaggagtactctgtgatgaggctggagaattcaatttaaggtgtagtgataccccggatacattcatgcgtacctttaatattccctatcgttaagaagactcatataattttgaaagaaaatgagacgataattaaactatcaaaaggctacaacacagcatcttgcacttctgaagaaataccatttgcaaaacaacaacaacaaaaactcctttttgcacaattgaagaagcagttatcctatatttcaccccttctgtcagaccccacgggtatacaggacatatgctttctatctggtttcaaacatgtgcttagatggcaggcatcacttggggcaagaggaaaaatgaatttcaaacaacacaaaaaaatggaataaatatcatgcttaaaaactgaatttctccatctgcctcatcatatgcagcaaaaaactaaaggatcctaccactcttcacagaaacattccttaaagatgttcattgagaatttttgaacattgattatgttatttggctatttatgactgggaaaaatattattaaaagtgagaaaatgggaatgtttttagttataaattcaattaacaaggtggtggggctaaatgtgttctttacacatgatttattgtatccaaggaccttatgtctgtcaagagtttcagtagcagcttccatatgggagggatgtcttgctatggtgtatgaaacatgaaaagagtctgacaagttggaagatatatatacacacacacacataaatatatatatgtatgaatgcatatacatatatgccagaaatagatattcatttaagacatttcattaaatcaatgtgaagtaattcacagcgcaaaaaacaaatttagaaatataagaaaaaataaactttagaacatacaaccactaagaatgcagtgaaatctatgagaagaaatattaactgagtatgacgcccttaataattgcaatgtgagttagctttcttgaagtggaaggggatccatgaattttgacatcggggaaacacagaagagggggaacattctattccttgaaaattctagaggaaaacagaaatatggaacttacttttttacaaaccacttaaactggtttcttatagaccaggcactgttctaactttcagaaatagtgtatgcaaatatgaactacataatccttataaacaaccctattagatgcacacgattcttggaccaatattatttcatgttgtaggtgaaagaaatgggaaatggagaggttaagtaacttgtcactactgataaatggctaagctgaattggaaactaggccattcaacatgaatcctgtgcttggcacttctacagtttggtgacatatccaacacagctaagcactgcaacctaaactgtccaggcaaccctaaaaggcccaaaggagtcaatgctactttgttagtaacatggtgaattacccatttaatcctaattttgatgacataaaaattaagaattttgttggaggggttctaagtttacatgttctagggaaaatgttgcaacataatgtagatggattttgatctatgtcactttgttataatctctccttggtcatttgaaatgtgtatgacaaattgtttttgtgaatttggaactaggaaccataagtatgtctttgctttaaaatagcacaaaaattccaaataaatctttctcagcaattcctttcaagcttctgccttgatcttgaaaattaattctgtctttattttgttttcgtagctctcatcaaaatttttgctcagcaatccatcaacactgctgttgtcaacataaacaatggaatccacgttgtgattccaatcatctgtgctcagtcttgatcttttaagattcatcagcagcaattgacccagttgaaaggcttccttcatttaatttcagaacaccacacttcttgtcttcaccctacactgaccacttcttttgctctttttatttttcttcattcctctgatgtttttcactcccatgcccccgagcctagttcttggatatctattctcgtctgaacttgttgcattagtaatcaaatcctgggtcaagttgagtaaaatcattctattgtgcctgggtctgactcccaattctgccacttaccagctgtgtgatcttggaaaatattaccttagacttttagcgtcattttctcatctgctaaatgaacataatgttaatagtgcctttctcatacaattcttatgaggattaattaaacaacataacacatactaaaatcatagaataacgcctgacatagaaagtgtgatgtgtttgtttaaataaacaaatcttagtcaatatcatataacatatctactaggatgaactcacccctgaattttgtatgaatatatcaaatttcctagtcaacatttctcctttgttggctaaaggcagctcagacttcatttgttcagttactggcaaagctatattcccattgctcaggccagataccatgaattcaccttggatctttctcatttcctcacactgcatatataatacatcaccaatcatcttgtctcaaccttccttcctttgctcacccgttattctgctgtatctctgttcccacctagtatcattgctcaccaggttgttgtacttgcctaaaaaggagcttcctaattccacccctgggcctctatagtgcactatcaacacatcagccagagaagtcctctgaaaagataaaaccatcaaggtccttccaatgccctcaaggccccactgcctgtcgaatctcttttttttttttttttttttttgagatgtaatctggctctgtcacctaggctggaatgcagtggtgtgatctcggctcactgcaacctcagcctccgaggttcaagcaattctcctgcctcagcctcctaagtggctggaattacagacatgtgcgtccacaccgggataatttttgtatttttagtagagacggggtttcaccatgttggctgggctggtctcaaactcctgacctcaagtgatccgcccaactcagtctcccaaagtgctgggattacagggatgagccagcgtgagccaccgtgcccagctgaacctcttctataatctttctccactctctacaagtttccatcacactggccttcttgttggtttttgaatagctcttaccttagcgacttgaaatttgtgatttaatttggaaagctcttcttcagacactttcaagctttgctcccatatctattccaagtcatttcaaatgttattttatcaggaagatattcttgaaacatattttcagaatttgcaaactaccatttccccttctctgtacaacacagaaacttcctggcactcttcccagctaattttctgcatagcatttatcattttctataaacttatttatacataatttaaatattatataatttaataacttgtttgtattctcctcactagaatgtaaacaccaacatggttaacaacatttaatgattttttaataaatttatccacaacccagagaagaatccttgacacaaaataatatagagacaattttcaacaccatatttgagtaaattaatccacgagtctataatccatccccctactgatattttatataaactagggataaaattattaaggagaaaaaatgaaaggggcaaagtgaattcttatttttctctctgtcacccagaatatgtcacccaaatatgtctgtttacaaacatatttgaaatacaaaagcatttaagaatgccaaaaatatacatatgatatataatattatttctcaaatctagtctgccaatgtttaagtcttttttagttgtagttttaattgacacgtaataattgtataagtttacagggtataatatgatggtgagacacatgcatgcattatataatgattaaatcaaactaattattttcatttaataattattactaaaaataatttatataatttatataagtagacatagatacaaatagtgtgctcttctttttctttttctgtttcttttttttttttttttttttgtgacgtagtcttgccctgacacccagactggagtgaagtggcatgatcttggctcactgcaacctctgtctcccccgttcaagtgattctcctgcctcagcctctcaagtaccggggattacaggcacctgctaccatacccggctaattttttttttttttggatttttagtagggacagggtttcaccattttggccagtgctggttttgaactcctgacctcaagtgatccgcctgtcttggcctcccaaagtgctaggattataggcatgacccaccgtgctcagcccagtgtgatcttcttaaaaggtagttttactatttttagcagattctgaaatatccacgaatgtgtggttaaatgacaaaggttattatgtagtcaagaaaagtgatttattctacttttagttcaaagataaaatgtacatttccccatatatttatcttagtaatcagtcttagtttacatggcagaaaagtctagctgggtacctaaagttctgtatctaccttctctagaatggttcctggggaatgcagcacagtcttgttagaaaacaggtcaagaaaaacgaagtgcaatgctatacaatgtaacaaagttgatatactttgaaatcattatatgagcttgtgtcaaagaatacatacttaatccccattccagaggaagaaaaagtggtagcagaaaaagatatttgaactagaggagcatattattgcctgctaaatggaaaagatggttattcgtccctagtatggggtgtagaatagggtatacccagtgtagaagtagcccaaattacagtatctggcatgttattctggctgttttcaaagataaggcagtgtgactttctcaaaagtcagatgaaatcatttaaaaatatgaacgaaaatatattccaatgccaaatatatataaaaaattatctgccacactggccacactacagttctccttaactaaaatagataattatgtactgactacctaaaaataatcattgccaggggatatttatattaaactgcagaatcagaaactgaatctgtttgtatctccttaacaggctcatgatcgtccttgaataactgattttttttatttcctgcactgtcttggcattcttataaaattggcaaatttagttgtatcatgaacctgatttaaaagaatactggggaaattaacagattagcctttttcaaaagctttaaaatttgattaaagtttctatcttcaacacaaaatgaaacttgcctcactgtgtatgaattactcatttgaatccaaagacctttgattaggataatttttcaaatataaacaattagtaacagaccatttatttactaaatgttataggagagagccagctgtctctatttcccttccttgattatttgaagttagaattttctcatgacatttagccatttataaatgttcagttaaacatgacagttgttatggattggatatttgtaaggtcatttttcatagactgccccagaagaaacatatttcaatcaaagcaaatgataagcatttccatataatttgactccacttttactatggcccagaaacatatcttatcacttcctcaatttaatttgatatggaaagggcctctttttaatcaactttaaaattatgttctgttgacttgcaaatgacaggtcaatgctaattgagagaggccttaaaaactctgacatctttgattgctgcacaaagattccatgctcagtatgttctgatacttggcttttccatattcccttacgaggttaagaagatgaatgctcattggttttaatccttaccatgatttatgagcctcttggtatcctttccccagagcatctacaactgtgtggttgttctgcctgctgcttaaattacacagacatctgcaaactaaattatggattgttgtcccatagaccataaccaagaattctcttcatcactcctgcagtataattttttttttctgattaggacaaaaaacatgtatgtatttccttgcttctgtactaagggcattttaagctaatttgaatgatagcacaataacctgcattgtgacctatcacaaaaaatcaaagcagcatgaaatataacaaggtagctttaaaggcagaaagaaaaaaaaaagatcctctatttatttatatctttcatctttatttaaggcattgaatatttagactcacagaaggaaagtgacctttaagattaactgaaaatatgcaccatggaataaaatgcatgtaaatgacctttgtgtctcttgagtgtgattttaagagcatcgtgtgatctgatctatgactatttaaattaaacacaaagcaaagaaatagaaaattacataaaggataattcatggaagactgggataccttttttaatgtactcttttctgctggtctcacttgtagtaaacctgttttaataatctgaaggcttgaagcaatcatgagtaattggaataactctttcgtctgaattaaaagtctggtagagtctactttggaataatcaactgtttctgtatttttcctttcttttctctccttgttattctgtgtagatgatgaatcataattcccaatgacaagtccattgtgaaatcctaacaggcgtgtctcaaattattaacctttgacaattaccaaaattagaaatatccctgcatttatcttcttcagatgtgctaattgcaactctaacaataacctgccagggaatatcacatgaacaaaatttaccaaatgatttttagttatgccttacaaagtatattaaaaaaaaaaaaaaacagatggctctgcaattcattttttgaaccctattgtcaactcagcaggacacagtgaacactaaagaaagactcaaatccactcctggctgagcagatctgctgttccctccatgtttccatcagtttctgtttcacctcatcactgctgaaaggcaatgttttctgagtgtcaggacctgatattcataccaatgccctaaagacttgctttttaaaaggcagatcctagatttgtttgcctctgtgtcagtgaaaagctcacttccaaaactttccatttgtcgacactctttgcatcctcatcttcataaaataaaggattagtggaatcttgatagttgatatggtttggcttgtgtccccatccaaatttcatcttgagttgtagttcctataactcccacatgttgtaggaggcacccagtgggaggtaattgaatcatggggtgggtctttcccatgctgttgttatgataatgaataagtctcatgagatctggtggttttataaagggatattcccctgaatatactctcttgcctgctgccatgtaagatgtgcctttgctcctcctttgcctttcaccatgatggtgcagcctccccagccatgtggaactgtgagtccattaaacctctttttctttataaactacccagtctcaggtacgtctttattagcagcgtgagaacacactaatacattagttaaaaccctaaactatttaaacatatcttgaaataaattatttttgaataattatttaatttcctaagaaattatacaggatagatggaaatagaattaaattggtgctcccaaaagatctgatatatatataatctcccagtctattgccagcagtcatctttacacacacacacacgcacacacagacacacacacacaaaacctccacatcaggttattcttctacattcaaaagcaaaccgactaaaacaacaaaacacagctccacatcctataaaagataaagccccaatcccagacatatttttcatttcattaaagtttcttcatcatctaagcctattcttctggatttatctgccagctattcccatatttgacacacatttcattctctaactcctcaaatggttttaaattcaccacatatgaaatgatatcatatatctttgtgccttttatacatctatatcctcttctttacatatttttatctatttctctttatagtctagttcaaatgtcctttggctgcatttttcctactctttccaactactacaggaagaaaaaaaatgccaacttcaaccatatttttcatactggaacaagaaggtattctataaatgatcaaagaatgctcatctaaccatatgaaagaagaaagatttatttcctttctctttccctttacttttttgcatgatttataataaattcatacaattacttaagtaaacatgaatataagtgagaaatgaatagaatgagagtaagttttgcaaaatgttaaagaaataatacactgccctatgtgattgttgaaaaagaaaattataaaagggggtggtaacatcataaacaggctccacagcattactctattaaaagttaaattgataaaagaaaactgtctttcttaataaagaaatgttaataatcagttagtatggcttgaaatctatatattcattgttcttgattatcactctctattttgttatagcattccactgagattattctcagctgtatttgcttatgtggcatttatgaaaatcctcatattaaaaagaaaataatttcaagccattctcctcaaatgcattctgcatcaatatgaattccactctaattaaaaacaaatgaacatgccaatttctttaaattaatcctttctcaaattattatctttaaagtagttgtatgttaaataaatatcaaactatttttatttcttcttatcgttgtacatagcacagagtgaaccaaaggacatttgggaggagtatgagtctcttctcatttatctgggcctttggatgttttaatgctctgttatgctttaaagaaaaggagagaaagtgctgcatttatcattggaatggcttagtatcaattattcattattcatatttgcatcacagataatactgaggttgatataatcatggatatttaagaatatggagttgccttttataggaattaaattcaaagtgttcacttctcttattctataaataaaagatctggactgaaaccccaaaccaaaattatccaagatcagagatttagaaattaattaaaattttctacaaaaaatgcaaaaatttcacaaagaaaaggtaagcaattttctacatagaaattttgaatattgatgagaacaaattactagataaaagagatgaccatggggggagaggaattattaatagttgagatattaaatggttcattctatttcaatcttaccatcttacattgttaatctaaaatttgtatttttttcctcaaatctgatagctgaaattaattgataatgttttaaaactacactaaagcctaacctttactgaataagctaatctcataaaaggataatgagaaagaaaaagaaaaggcttcatctttctacttcagaaatatgggcatgcacagagagtttgaaaaccatcacaggaagattcataaagccacattagtttaattacacatctgccttatctcttcaaccttgtctttctgagttgttatatcaatggttaatcttaactgatctctgattagaactgagaatataaagcttgttttgactacagcctaagtaagggtagattctcccattaccaagcggggagtgtcaaagcagcactttaattactatgtctgtgaaggttaactgtaactgtctaaatctcagtgtttagattcctaccatcagcaaaggaaaagcagattacaattgccagcgcaagaaacaattgaaccagtttgtgccatatcaatattcgtaaagaagagaaaatttatgactttatctctgtttcctatgtgagagtttcaacagaggtttccctttgaaatgagacgtatccaatttaacaaaaataatacccgctaattatgagggactagacaaagcatcataaaaaaacagaataaaaaaggcagaaatcactttctgtttttaggaggaacatagtcattagatcctctcaaattggcatgtaaaatgaaactgtgaggaaaaataaaacaaagaagctaaaaaataaataattataaaaataaagaatcctatattctaaaaaatgtagaaataactggttacttcaagtttcatgattttgttgtgtttatgtcaactccttgtaaatatacaaatatttgaatattttgatttctaataaatttttttaagtaaagaagttttaaataggatttgcattttcaggtattaattaagaaggtaaaagcatatatcttgataagattttttttacctacctttaaaaaggctggcattctttaaaactcccaactgctcctgggttccagcttgtctatatttcccaaaagagccaagctgttaggtaacaaagctggaaagacaaacatatacagtcagaatgttaactatcttttctaataaacatttattttagaatatttttacattttcttaaaagttgcaaagatggtatagagagttcctgtatacctcacacctgattatcactattgctaatatcttacattataagtgcatttctcaatgtacttttgatgtatgtacaatgtacttacaatgctgcttttgatacattgtgatatatagtgatacattgtgatagatggatccaaatgaaccaatattgatacattattgagttcactagtttttctcctaatgtcattttctattccaggatatcacattgccttgtcattatgtccccttggcctcctcatggcagtgatagtttcttagactttccttgtttttgatgaccttgaacgttttgaaaagcaatggtcagacatttataaaatgtccttcagttgcaatttggctgatgtatttctcatgattagactggggttatggttttttgggaggaggaccataaagtatcatttttgtcacttcatatcaagggtatgtgtgtcatcagtatgacttattactgttgacacagatcttgatcagctgactggagtacttattactgttgagacagatcttggtcagccgactggagtccttattgctgttgatgcagatcttgatcagctgactggggtacttatttctgtttacacagattttgatcagctgactggggtactgtttgccaccgtttcgtactataaagttccttttgttcctcctttccatactgtactgtttgaaagcaagtcaataaaagcagcccacagtcaagggatacagagttaagctccatttgctggaggggaaaatgacacaaattatttgaaattttctgagagaaatttacctattctccccatttgtttgtttccttgtttgtgtattcatttattcattcagtaatttatatgtatcagtgtaatctcatggatatttattttgtatttcatgttataatacaatactacactgtttattttgttggtctaattgttttagctttggacttcgtgagctctttcaattagcctctatgtcttttttgacataccatattggttggtttagtgagtacttccttaagtcctggcatgataagatagtccatgttaatttaaaaatgcatactataaatgttataatcttcttgcctcagacctagactcagcctttttttttcaaggatctctggttctttttatcagagaatggtgagaaaccaagatctgactactagttatggttccttgccactggggtgccattacttctaagccctctcagtgaagtgagctgggaaatttatgtatttatattaatgtgtatatgcagacatccataattgtctctatatctatcaatctgtatctataattagataacattatttcatactgataacttcaactccagcttcatattattaacttcaggctgataccttcaacttccttaatctatattaaataaacagcattttgggtgcaatagagtatatattaaaaccacatttttcatttctttatgaaatgctcctctctcagtaatatatcaagagtgattcttataaagatgtccacacaagtggacatgtttatgatgcctgattctgaagaatcattaagaaagcccatggacatttattttcattcgtttctactaaagttcattacgcttgaaaaagaaaagcagcttttaataccgtgtgcatacaaccacagctacctgatggttttttcaccaaatgccatagactgcaacaataaaaaggacttgaggagatatatactgctttataagatctaatatattttcttctattgaggcaacctattactatgaccatgttttcatataattcatttttaagacaaaaagtctgagttagctcaattatacctatgcaaaaaatgtaatttttaatgaaattataaaataattataattaatgtacatgttaatcattacagctaaatagtagtcagaatatataaatgtttaacatttttattataaaagtttagtagaaaatacagatagtaacaaggtagactaataatccagatgggataacttattttctgaaagtaaaaacaccaactcattttatcattctgttattctgataactaataaaggcttccctgtcaaacaaaatctttaggtttaaaaaacattaaagtgagacataaacttccaagaaattctaagccatttcattcccttcatctatattagatattttggttagaatgtaataacatctgtatcagtttcctgtggctgtgacaagtaattaccataaatgtagtagcttaaagcaacagaaacttatcctctcacagttttggaggtcagaattctgaaatcaataaaagattgagatgaaatcaaggtgtcacggtgctgccatcccttcagagggtctaggggaaaatccatttctcgcctcttccagcttctggtgactgccatcgtgccttgccttgtggccactttcagtattcaaggctaacatcctcaaatttcttcctcctcctttacattgccttttcctctgtgtattcaaatcttctgcctctcatttttaagaatgcatgtgtttataatttgggcctattcagctaatacaggataatctcctcgttttaagatcctttatttaatcacagctgcaaagaccctttcttgtcatataggttaacattcaaaggttctatgaattagaacatggctgtctttgggaagtcattttccagcctaccatagatcatgaggattaagctctgaattttttatcttgcccaaattcctatctaaggggtctggagagtcatcccctacaaaccatcaattctcaacagatgggttttatttaaccttgtatatggtgacttactttgcaacctgactcaggcatcacattaggagacaaggaagaaaatcaaaatattttaccccaaaacatgtttctttgccatatgttgaactggccctgcaaagctgtccttcctggtgaacaatttgcatctgtaaagaatttctattaacataggtagatctttttcttccaggccttcccaatcctaaagaggttaactaaaagtctagcaccttttaaagatctgaataggaagcatttgtcatctgttgtctctaagggcagccactataagacctcaaaagaaccttggtctccacaatctttgatcttaacttgaacatttcctttctatgaatcccaggtctttagacaaactcaactaatagtcaaccagaaaatgtttaaatttacctacagcctggaaaccaccccctcccgccccacagctttgagttgtgccacctttctggagcaaaccaatgtatgtcttacatgtatttgattgatgtctcatgcctccctgaaatgtataaaaccaagctgtaccccgacaaccttgggcacatagtctcaggacttcctgagggttgtgtcacaggccatggtcactcacatttggctcagaataaatctcttcaaatattttacaaatattttcattgataaccaacttatagatctacttcctatccgcttccataggggagaaaaaaattactctaataaaacaacttcctcatgactctatctcactacaagacagtgtgtatggctaaggcagcagaaatatatacacacaatgaaagggtgttttaaaatattgtttaagacaacctaggacaggcatataattaacttgcttagagagatggatagatgttacttaataatgaaactctaataactatttctttcccttcagactaggactactgataacctgcaattatgtgtgacaagctgaacaaaaccacagaaccagagtgtcagactatggctacataatttttagaaagagcttaattaagcaaatctcataaaagtttttaaaggaaatattttctaaagtcaaaagcaaactacattcataaagtgtgattactggtacagtacacctttcagtgacattaactttcaggggaccttgacaggaagaaaaaataaatctcaagctactagcaataaagtcagaggagtggtaactgatgatccaggaaattttcacagaaaaataagggtatgaatggcttccataaggcttcaattaccaacgttgttaatgaaattcaggcatcttgggtcgcttgaaggaaggaactaataatgagctgcttacatgcaactagtttgtagaatgagtagtcccatcatggaatgggaattagaagaaaaagaaacaaacacaaaaatcttctgtccactagtattgggaagctgcacaaataccagctgttcaagactggccatagatagaaagaggttaaccttgagaagcagagggcaagcttgagcctgatgtgtgtaaactccagatttgcccaaatatataatatggtggatgcaacccagagtagtaatataaagcatggtatagcactggagaatcagtaggacctcagcagagcaagtaccaaaatatcttgaagagattctttcacaacgtaagaccctagattccataacaaggaaaaaatttaaaaaaaaaaatgtgagagaacacaatacaccctcaatgaaactcagtggagcgataaagagaaaatttatttcttaagaactaataataatagaataatctgtaatagacacataatacacatttaaagccttcagagaaaatggaaggaatgtaaactataagaagagcatgtcaaacacataacaaacaaatttgaccaaaaatgctttctctctatatattactctagaggtggtcctatgggccacccatagctaatcctaatattcatttgaaagaacaaaacccaagaagttaatagactttgttggaaacataaaattaccctatccgatataaaaaaattgttataaaaatatggaaaaaaaacgtatgttattggcatagagtctaaatgatacatataaatatgtacgaacgtttcacttaaatcagtgggaaaagaacagacttttaaataagtggaataggaaaaacccaccatgcagatgcacaaaatcaaagtacagtcatccttaggcagccacaagggattggttccaggaccctcctaggtatcaagagccacagacgctcaagtcttttatgtaaaaaggaatattatttgcatataacctatgcacatctcctgtattctttaaatcatctctagattacttataataattgctatgtcatattgatattaatttgtattatttttcattgttataattatttttctaattatgttcaatctatggttggttgaatccaaaaacatacgctccacaaatacataaggctggttacaggtttctttaattatatcatacataaaaaataactttcagatgcatgaaagagaaacagtttaaaagtcaagaacatatataatttttttttttttttccgagacagagttttgctcttgtcgcctagactggagtgcaagggcatggtctcagctcactgcaacctccacctcctgggttcaagcaattctcctgcctcagcctcctaagtagctgggattacagacacccaccaccatgctcagctaatttttgtatttttagtacagacagggtttcaccatgttggccaaactgatcttgaactcctgacctcaagtgatctacctgcctcggcctcccaaagtgctgggattagaggcgtgagccaccatggctggccaacatatataatttttatgaaataggaaaagctttctttaaacaaatattgaaaacacaaaatttgaattaaaattaaaatcatatatttaaagctaaacttgcaaagaaaagaaaagctatgtcattgactatgagaaaatatttccaatcatggaacataatttagtgtaaagataatattaagaatgtcaacaatcaataaagtattgaatttggaaatctataaatggaatatttacaaaaagaaaaaaacaggacttctaaaaagcatataaaaatgattccacagccattatcagagaaatccaaaaaaagcacaataataacacataatttctcattgaattagttggcaaaaaagataataaagataatgtctgaaattatcaataattggcaaggatgtggagtgatggaagctctcaatcatatcgtgggttggtaatccacatggacacaactgctttgaagaaccatttggaatatctactaaaagtgaaatgcaggtaacctggaccgcaggaattctgctcctatatgcatgtctaaacaaagtcttgcccgtgtttataagatgttaactatagctttgttcaaattcctaaaaacactggcatttttgaaaagcatttcagttatgacaatcaaaaaataagtaattgcttacataattatttcaactaatgaattcatgaaaatggtcttataactcattggaaaatatttgtaactatgattgtgtgtgtgtgtgtgtgtgtgtgtacattcaattatatatatggggtttgtgtgtgtttgttgagcatgtgtgatgttagaaaaggtagttcaaggtttgctttattatatcatagttacaattaagaatatcatacctaacacccaaggggaacaatcacaaaatcacgtcagtattactaagatgagttatagatacataagtattagaaaatacagtgagccagagtcacgaactttaataaaagacaacacgagggcaacaaaagactatattaagtgaaggctgttagcttacaaagtgataagagtagagattcattttatcagtaaagaggatatattaaagaattagatacacttgctttgtgttcttctacctgattctggcataaagataaatcctcttgtaattagctaagctacttcactgtggggtggtggtaaaaaaagcacagcaatgaaaataaatgacaccagaaaaatgtaagctgagagacatgtcaaaaaaatcaggtagtagttgtgcttcaacaagacccagggcactagtttggggtaagtacagtctgcaagagcacaattcatgaggtcatttcagctaacctaagaaaacccaagactaatatcagctgaggacatgtggttatcaatagtggggtaacagaattccttgtaagaagctgcaacttgggcatagacatacatcttgtttccaatgcccctacgataatgaaaaggattttaaaaggaggtgaagtctgtactaatgcaggaaagtaaggaatggaatcagagaaattgctgctaaatgtgtgagatgttactaacatcaaaaataatccctgctgggagtggtggctcacacctgtattcccaacactttgggaggcctagtcgggtggatcatctgagttcggagttcaagactagcctggtcaacgtggcaaaaccccatctctactaaaaatacaaaaagttagctgggtgtggtggcaggtgccggtaacccaggagggttgaacccaggaggcggaggttgcagtgagccgagatcccgccactgcagtccagactggacaacagggcgagacgctgtctaaaaagataataataataataatcccaagatccctgtaataattttatttaaaaaacaccatgttataaaagaaaatagaataatcccagtaaaatcccactgatatctcttgaaattagaagactgaggaactgaagtgcatctgtggtgcacggtacttagaattccttcaaaggcaaaagcaaccacactgtgaggtccaccaccaacaacaaacaaactaaaggggatatctgcagatggccaagttttctcctgatacagctgagcattactatactagaaaaggaagaccaacaacatagaaagccaggtgtggaaagttgacaacaggttcaaaaaaaaaaaaatgtattgacagcttttctcccacaagcactctccaggcccttagtgtctcccagctttcactgaataatgaacatgaaatgagcatcatactcaccagctttctaacttcagattctacagcatctgagtatcttctacgtatcaaagaaggttatacagacctttgcaatgtattttagacttggtttgctatctttgtattcaaaataccatgggagtcctgggctaaaatttgcaatatagaaggatgttatagagtacttagaatgcacaacacaggccaggcatggtggctcacgcctgtaatcccagcactttgggagactgaggcaggtgaatcatgaggtcaggagtttgagaccagtctagccaacacggtgaaaccccatctctactaaaaatacaaaaaaattagctgggcttggtggtgggtgcctgtaatcccagctacttaggaggttgaggtaagagaattgcttgaacctgggaggcagaggttgcagtgagctgagatcctgccactgcactccagcccggggccacattgtgagactccgtgtcaggaaaaaaaaaaaaaaaaaatgcacaacacattacgaaaaataatgtttgaaagaaagtagatacatttttaagtaatataagtataatacaattattttataataataaaatgatagcaatattattactaattagtaattttctcatggtaaaattagagactatgggtcaaatgaattaaaatatgaaagataagttgtcaaaacacagagtaagataaaaatatgtctgcctgaagtcggtcaattgacagtatcataacctttaaaatcacactgaagattccagataaaatagaaaattagaaaagtcaccaaaatacatgaacattattaattgaaaaaaatacacagaaacacataaacatatttttaagtgaatggttgaatatgaaagaaagtaaaagagatgttctaaaatgtgcagcaaagctgaaagacaagcacagggaggagagtgctatagatcaagtgactcatttagcatctatgaagctggcacaggttgaaggtggattggagaaaaccagaaataaccagatcccaggaagcctatacacttaaaaaaaaaaaagtatctcctaaattagaaaacaagtaaagtttattgttgcttctagagaattttgttaaagacaaatatctgttctgaggatgtatggcctggcaggctcttatctgagtttgagaatttaatttacattatttgtttggttcaaaatcaatccttacatcaggatttgaatttaaagtggattgggtgtgcagtgccttccagatgaacataatcatccccttagaaaataactcacaactcacaccacaaagatattttcaaggttgagtcttaaatcacaaaacacaaaggatatctgatatagttcactaagataagaagaacaagaaataacaaagacattaaaaaggaagaaccctacctgacattatttagagatgtgattatgttttactttaaaaattcaaaggatcatctaccaaagatatgcaattaataagagattttagcaaaatttctgaacaatgtttaaataattgcattttaataactgttttaataattgcattttaataattatctccttgcaacaggagataaaggtataattttaaaatcacttaccttaccaatattcattatatgtatcaagaaataaatttaagaaaaggatataatacttttagtgatgcaattgtaaaacttgattgataactattaaataagaactaaataagtgggaagacatatcctgtcattgaatcggatttaagtatataccaattcaaagaattccaggtaaaaggaattcagatatttttccccatggaacttgtaaagctgatagtgaatgtcatgaaagaacaaaggattagaatagctaagacattaataataaataagtacaagggagatggtattgtcctgctcaataataaaccaaaatatattgattaaaacagtgagacgtgaagtataggaaagaaatattgatcaatgaatgtgatattttaaattctacataaatacataattctacatagttgacatttttaattcttcatgatgcttaagtatttcccattatttataattatttagaaatggaagggagagccttgaaacacacacatacacaaactcacactgaaaacctaatatacagcaaagctgatgtgaaaaataacagggaatcatagactatttgatatgtagtaatgagaaatttgatgatctctaattaaaaatttttatatccctacctcactctacatacaaaaggcaattctatgtagactaagcaattaaatgtgaaagatcaaagtgtaagactgttgatacaaaatatagtaaaatatttttatcaacttggagtagaaaatgttagaaaagtactaaaaaattctacccatacaaagacaggcttgtaaatttctatacaacatataaaaactttataggacaaataattattatcctgatcatatgaagcaattgtacaatacaattaagaaaaaataaccttataaaaatggttgaaactcattaaactgttatttaaaaaataacatacacatgacttaaaccccatttaatgatgcccaaactgattagtaaagaaagcaatgcactatgtcgtaaaactaaggacataatgagatactatgaacataaactaagatggcaagataaaatgtcacaaatggccaatgttgagaatgtggcaaacaattgaatattcatataatactgacaaaaatataaattagtacagccctccaatacaaataatttgtcactatgtataaataattctaattacagattttaaaaatggaatataaataccatttataatttctgaaagaaataaatggctctattaaatcaagaaaatccaaggagtagtaaaataaaattatgaaaacataaggtttttatttttcatttttattaagaagctaattgctataatctattgatattggtagttataaagttctatgtctgtaataataaacacacaatataatgttaataaaagtggctgggtgcagtgggtcacacctgtaatcccagcattttaggaggctgaggtgggtggatcgcttgtgtccaggagttcgagaccagcctgggcaacatggcgaaaccttgtctccacaaaaaatacaaaaattagcagggcatggtgatgcatgccggcagccccagctactagcgagactggagtgggaggatgacttgagcccgggaagttgaggctgcagtgagccatgatggtgccactgcactctagcctgagggacagagcgagaccttgtttcaaaataaaaattataagtaaaattgtggcatattaattatatcaactagaaaaaaatgaaaaaagaaaaacagtatattaatacagaaatgaaaagaaacattggagaggtgttaaaaaatgaatggacaaaaaataccagatgaaagaagtttagatgcgaaaaacaatgcaatacattaatcagattacaaaaagctaatttttgttgttttcattattgaattacattttctttttaaaattttttaaaaaatagctatagtaaggttatatatcagtaggagaatataatatacattttaaaaacagaccattagatctaaacacagaccagcagaggaaagataaagccactatttataaaataactttaaagtattttacagtttaaaaataagatatatttagcattttggaaatgtttattttaaaatgcttgaaaattagagttggcttttaaaattctacataatgtttaagtattttccattttcaatacttatttaattaatattatttttgaaattttgccttctgccactataaaatttagtcgtttaaaaaatctctagaatttaaattcatcacttttatgtttatcactctggtaacaaagttacatcatatttacctgaaaatattgaagttcaaagggaattttaaaaaatatttccaaagctaagtgaatattatcagccacaaaactaggtaaactttggtaaagtaaatgattgatagcctccatatgtggaagaaaaccacactattaaaattaaaacctttcttttaaactacaaactacaatcttattggttctgtttctctggagaactctgactaatacactaactcaaaataaagcatcaacatctgctgccaaaaattgcacaggacatcagactacagaatttttcagcttacgtttatttattttttcctaatctagtcatggttccacagtacaattagttacttccttgtctctattctctacttcctgtcttttgtttctctattcacattttactaggatctaggcaaatatatattttttcctttccaacaatcaagcatctgggttctgggggagaaaatatctcacacattaatacattaatggattacaaatggctggcttccaacctcaactgggcgttcatgtttctcagcaacattttcatgttactttcattaattttcctggttcttccttacagcagctttttatagggttacccctagagtgtacaaggataagacaggtagttttgtggggtccctgtctgtttaagcaaattgattaaatctgtactacacaatccatgggctcatctgagttatagtaatttattgatgaagatcacaaatacaagtagacaagaggaattaatgtgtttgtttcttactcaaacatcacatgtgaaggtccttaacagagtccaagcaccatctcttcatcatttactgtcaaatgtctcattcctgaataattttatgtgtttctccacaaggaaaatgtagcagaagtattacaatggctctttggagcctgttgtattgaataatatagttcttcttgccacttctctaatgccatttatataatgaagtttatatcatcactcatccattgtggtttccatgcatattggctttcagtggctctctcaaagcttggatctgcgctttgataatgataaccacaaatgcaattatttaccaagttagatcaaaaaatgagaaagattattgttttgttctggacatgttaaatttactgtttcaagtgttatgacataaatgttgaaagacatctttcaaccatgccttttcttgtacgaattagaccataagccttgaattcttagcatgtaatatttcacaatattgaccttatctctgacttccacaccctgccaccaactaatagaatagtcaacgacaatggcatggggcaaaaagagcagtttcactgatgcaaggagtgcctttggtaaacacagcttaaaactaagctgtgggtagtgtgtatcactacattgattggaaacaagagagaaagtacaggaattggtagggcccgttggtattactgtgcaactgtcttcagaagctcttgggagacaggcttagtcatccctgtaggactgcctgacatgagaactggacacccctagcatggggtgacctcctggtaccagtgtccagggaaatacaccaaagtggcattgccaatgccaactcatccatgccaccagagaaagacagaagattttggggtagattattttggcaactaggactcatgtcagaccagattggggtgcccttttctcaggtactgtgagtcttagtttgtcccaggcactggacagtatccaagaggcacaggactaagagcaaaggcctcccttgcctaagactaagggctgtactgctcgattaaatctatttatgtttttttaaaagtatctatatcttcttcaccaccatttttattctctataggccatgtcaatgtttactttagtgtgaacattgaagatataaagtaaaataaagttctctcaccatgtccaacttgccaacattcaactccaatttacagacaactccgtatccacactctttttttttttttttttgagatggagtctcactctgtcacccaggctggagtctagtggtgcaatctcggctcactgcaaactccacctcctgggttcatgccattctcctgcctcagcctcctgagtagctgggactacaggcgcccgtcaccacacccggctaattttttgtatttttagtagagacggggtttgaccatgttagtcaggatggtcttgatctcctgacctcgtgatctgctcacctcggtcaaattatggtagttgggaactttcgtgttagaatgaaagagcgcttcaaattacaatgtctaatgttaacacagaatagctgaacaatactgttcagatccacagtattttactgtatagctaaaacattatttatttgtaaaatacatatattatgtagttcatggagttgtggtgaggtttaaatacaatataataatgtttgtaaattacagtgcctggaatatagagcaccctgtgtatattgtagaggtagcatattcgttcttataaaataatagacttgttttttttctctctggtttaagagatataaaaatgtttctctgttaaaatttactctatgatgagaaaaagctataaccaaaggaaagtaaattacattttatatgtgagattttggagcagaaacaagggtttgtctacagataaaaagaaaaaacactaaagcaatttcttaagcgaggaagaaaagttaactgtcctagccagtaccagctcaataggtaacaaaagccacaatgtgaatagtgattgttatttatttttcaattcattatataaaaatttatttttatttacctattcaaaatttacatgtatatgatggaagcttgacatttatataagacagggattggtagagttgcataatataattccacagatgaacaagtatagataaatatgcatgcaacattttttgataaaacattttagttttcattatacataagaacatccattataaggaatccagcaaataagttagattcaagtaacctaaagaacacttatggaggtgcccttaaaaacaatttagtctggagggcatggatacttgtatgaataatacagccatggagtcttacttatccaacctggcttaaaatacagaaaaaaataggtaataatatttattggagcatgagaaacagtctgtgtataaaggtgtggaggagctcaacacattaagtctgtagctaatgatgtcaactaaagtgtaaggaaagtatcactcttcagtgatcgttatataaagcaaacaggacttattagttggtgttttagaaattcaatatagttatttgtatataactacaagtgtgactaagatatatataacatactgaaatatctgacaaggagacgtgaactatgtcaaaaggatcatactttgtttagttacacgtaagtatattgcacgtggtttccgttagttatttattatgaatcctctttagatgtttttagctccattgcattatttgtgtgacaagcaatcaagcttgctccccttctttctttctttctttttttttttgtcttagtaaagcgtgttgtttaactgagcatcctgtatcatggcaggaggtaggagaaggagaggagatgctgtatttcatatctcttacatgtttctggtaatatagagatcattaaaagcaaagatctctattgaaagtgttgtgtatcttatcagttggaattctaaactgtatatttgtaacttaatgggcaattggatggggtaagcataatccttaatcgaaattaatattttattatattaatatttaatggcattttatcttagtaatatatatgaattgcatttttaaactcatctattttattagtcttatggtagttctgaagtttgtatatataatgtttaacagtttattctttgaatgtgataagtaaaaggaaatagaaagtatattaaaattgtggaacttatatttagttaggtctttagtaaaaattatagacaggacatgtaatattttccctgaatcaacttccagataagtaaaaaacctaatctacatattctataccatgctaaaaagtaatagagattcctcatgaataaatacaaatgttaactgttagaatggtaacctattacatttaggtacttatagtaatgtttgtttattagctaaaacaaagataagccagcttttctgtaaggagccagacactaaatattttaggcttagcaagccacatggtctctgttgcaactcttgtggtgtgaaagcagccatatttgccagtacttaaatgaatgaacgtggatgagttccagtgaaacattatctacaaaaggaggtggctagccagatttgaccagcagcctatcgatctctgactcctaagttaaagcgaagtggatacctccaaatagagtttcctaccttatataagactcatttttatgatgtctaacaccacagttctcaaccaaattagcaaaaagttgttgaaaagaacttaatatttatattccaacattgcctgtaagtcacaactagcaataattaatgtggtatgtcattaagcgtatcaggaaagttttatgtttctgattatttctcatatcaacagccttacacactaattctttcatagtgaattattgtttttcagttatgataagacatagtcatcatttgaagatgactaagtattacataagctaaaattagattaggtaaactatagttagtatggtattaatgcacatattatgttggccctaatgaaataaccacacaagagtagaagtatggattaggaaccaaaagctcatcatgaacatataaactgaccaagtttccactaacagtaaattaaattggagcatcaaatatctatttttaaatttgactccaaagcccatgctctgttctaacagactactcaactgtgtacattgtctactattgctctggtatatttaagtgttgcttgggaaaattgttgttatttgcagacactgaaaattccactgaacattcatagctagtcggattctctgtatttcattgttgttgtcctccaaactgagattttctccatacctccataccctccttagactcagcagtgaagcttccttctacacactgaacaagatcttacatgaattcctataacttccttacttcttactccaaatagctatgaactgtttcatttgttactctcttttattattttctccaaaatattataatctctcatctacttcactaagccagttaacacaaccttcctgaatctattctttctcactacctccagaatcatacttcaactgtgattttgtgttctgtcattctgctagtttctaatcctccacctacaaacatgcatgggtctcttctaacctgatctcactcccctaattcctcaaactattttcacttcttccctatgtctttcactaaaaaatttcttgaaaaaagagtctatgtccctggacaactttgccatccactcagacatcatacctcatgcacacgatcctctgccatcattattctgctgaaattgacttcttaagggtttcctgcaattctggagaaatccctcctggttggccttagcactaggtatctggatcctaagatggcaattcatgtggtaattcccctcttgactttgaaaactctttcttagcttttctttatcttttcctagaattcttttattttccgttttctttaaagaaaggggtggtgctgatttcacgtcatatttgtacttttttatactcccttccatggtaatctcatttactttcatatattcaaatgttatgcaaattctatatctatatatgcactctaggctccagtttcttttctttccattttcaacagactgtttgacatcttttcctgaatacacttctatccattaaaatgtaagctggtccagaacaaactcatgcacatccactagagaatgcatttttttacaactgtctgaagctcacatttcaaagtatcttgaactattaattttaatttcctcctcaacttatttttgcaaatatcaaatatttcaggttccacgtgtacaccgttatttatagtcagtgtcctttttcttatcttattgctgttgcaggtcaatccttatggctcctcatttattattgactttactaatatcttcacttcacttctctcatcacttaaaaaatttaaaccagacagcatttttcagttgtaggttgcctcatataattctctcttcttcaaacattgttaacgccttcccagactatttaattattttctttccaccctgacctctctagttgtctagcatatggccctggaatatatacccaatttcattttcaagactctaggtactggatttaagtcagatctcattagattgactctctagctgaggtgaaaaccactgtccaaattctcaaatgtgttttatttccattacctgaaatcttctatgcttcattcatttattattattattttttttttttttttttgagacaaggtttcactccatcacccaggcttcagtgcagtggagccattacggctcactgcagccttgacctccctgggctcaggtgatccatccaccccagcctcctgagtaggtgggaccacaggcgcacgccaccatatctggctaattttttgtattttttgtagagacagagttgcaccatgttgttgcccaggcgtttctcaaactcctgagttcaatcaatccacccaccttggccttccaaagtgctgggattataggtgtgagacactgcacctggcctcatttataatttttatcatttaaaaatttttctgtccttcaagactcatttcacattctagctcccttttgactgcttttatttaattccccagggggatataatccctttccctttggaaacaccagtttgtgcatctcttatggcaattatgtgtctcattgtctaatataccctactatattttaaaacggccaagcactgaaactgtacactatactacttgtaaacgtgtgacatgcatatattatataaaacattttttctttagttgacagcataaagagacaatttccttgacttcatattgaactgggggtgttcggtcacataggatacctggaaaacgtatcaatgttgcagtatcagttggaatagaccatgctacatatattgtagcaacacaggcttccatatcagagtgggttgtgacagtaagtcatctttattgctcacattgtatgtccaccaagtgacacatgtcacatctcatattttattttatttttatttttatttttatttatttattttttattatactttaagttttagggtacatgtgcacaacatgcaggtttgttacatatgtatacatgtgccatgttggtgtgctgcacccattaactcgtcatttacattaggtatatctcctaatgctatccctcccccctccctccaccccacaaccgtcccagtgtgtgatgttccccttcctgtgtccatgtgttctcattattcaattcccacctacgagtgagaacatgcagtgtttggttttttgtccttgcgatagtttgctgagaatgatggtttccagcttcatccatgtccctacaaaggacatgaactcatcatgttttatggctgcatagtattccatggtgtgtatgtgccacattttcttaaaccagtctatcattgttggacatttgggttggttccaagtctttgctattgtgaatagtgccacaataaacatacatgtgcatgtgtctttatagcagcacatctcatattttattgaccaaaacaaatcacatgaccatgaccaagttacactcagtagaatgggacaggggatattggtggatagttaaaccatctacatcaggaagcaatggtatgcccttaagaagctggtttctgattaaatgggctaatgtatgctttctggagagagagagcaagagagagagaaagagagagagagaaaggaaggaaggaatgaaggaaagaagggagggagagagggagggagggagggaatggaatgcattaaagatgtcctagtatgacgagaaaattttacaacacatgtcaataactggaatgtaactccccacacctcatttccaatttttctctctttctccccatctctctttgttttcacctttctttgccataggctccccctcagagaagcaacttcgggctctacttgtgggtactgggtaggaaggagaaaaaattgcatgtcatgtagtccaagagcagactgttcaaaacctggtgttaaaaatttacccaagggttatgagcataactacctatgtcaagaacaggttccctccagatgatgaattctagaatatagtgaggattaccaaatcatgacctaaatgagaagaaagtatattagtagacagaaacttacagtatttatctctttgcatgattcctttcagaacatcaattccagtctaagtttcagggagttatctctactggtctgccttgtagtggcctgcataaatctttctttctcaaagccgaaagagtctttactcatttcttcactaatatgaaaaatatttatagagtgtctattatatgttagtctactgacattcggtgttttatatattaactaaatctataaaatttgtgcaaaatagaggctttgttctgtttacaaaagaaaaagcaaacgttacttcaggaattaaaaaaaccctgaaagttcaatgttgacttactcatctttcaattgtaacacaggtcaaattggcataatgtcatcaatggtaatagaccagtttgatatcttgcagaagggaaaggtgatcaatatttctgcatattaaattatgacatagacccggagaatggacatactcctgaaacaggacaatgaaggtgtatttccagcactgtcagcttaaagcaatctacttttagtggtccttattgatgggtgtagaggaagaaagccatttgccagatcaatagctgcatgtcaggtattagagaatgtgttaatttgttcaagaaatgaaaacacatctggtgcggcagctgcaattgatgtcaccacctggttaagcttatgatactccactgtcattttccaagatccatctgtcttcagcactggccaaacagatgagttgaattaggatatggtgggaatcactcctctacatctgtaagtccttgatggtggcaataatcttcgcagtccctccagaggtgtggtattgcttttagcttacaattttcctaggtagaagcagttctggtggcttccaattggccttttatactataatatccctcacactacaggtcagggaaccaatgtgtggattctgccagctgctgagtatgtgtattccaattattcatttcccacctggggaaattatctcatggtgggttcagagacctgcagttcctactataaggtgaacttgagcaaaaactccattgatcctctagcctccataagctcttactctgactggtgggctacagttatgttttgagtcttatagaattagtgtcagttcagaaccagtgtcaaaagtccccaaaagttcttctcatttcattttgtaccaagcacagttcaactgctaaaagttcttaggtccctttgggaaagggtaaaagaaagactagtagtataaattagtataaattcttggcattgttctgggtccttcttcaaggggacttgtcttttcctctattcaaggggtgctgggtctataaactggcttatgtttgggaattgattgagagtcatgattgtgactctccatttttatagttcaggttagacttttgttcatttaactaaaaactttgctgcttttaaagttctacattataactaggtcaaggaagaatttaataagcttcctattttacttctaggaacacactgatgacctaaccagtgccataggcctgtgcaagtcagactactctgattactgctttgagtgtgctgcccattatggtaaccacatccacattgacttcagttttcactgtgaggtctggcttacagagaagagtgatcacagagcacttcaaagatgccagggctcccttcacaaatttatttgtcaatcatggtagaattcatggtagaaggtatgtcttctggaccctcccaggttaggtgactagattttaaatggcagatctactctaacattctagtgtccctgaacatttgaatctcgttctccacattgagccaaggcagcttaggcatttcgatttgctcactatgggtgatctgtcggtccatgttttagccaaacaaccaaatagagcctttttgaactccctgaactgcaacactaaatgcagaatctctgctaagtgagctcatatcgataaattcatcctggttcatatttatgttgcacctgctgctattccacactcttaatatccatttccacatgtttcctggatttctgtctgtataaactagaaaactcaagcagttctcttggattatagcatgtctcctcatgatccacactttgtacctaacctttagggccctgtatagaattcagattagttagaggcctagaagcaaagaaggatggtcatagcctgtccagaagaaaatcacctttgtcttacatgacaactgcttcgggggaagctattatagtttccttagccaattcaggattaattcactctgaaaagcagagaggtcacttccactgtgagtagggggggttgcttccactggtggtggagaggtctcttccattggcaaagaaaactcatgagaatttggggcctcaatgtcctgagcttcatcaatactctccacatattgccattccaactttcaggatcacactccttctcaatgaataccctccttttaacattagacagcctgtgagtctgagagctcaacttgcattgtaattcagaatgagattctgcacttgatattcagcaatttcagacctgtggctactttatcctgtggctagaggataatggactccttcaggggacacgtagaagctttcagatcatttatgtggtgcttaagctggaaatttaaattcctaagctcatcattttccttctcatgtccaacaacattaggagtgaccagccaatcttattatatttttttagtttgagaaaaatgttcaaaagtatcatatacaaagtaccaatttctttgactcttacaagtggttgattaggagtgtcactgatgatgttttgtgtatctttattgccagagaacaccatggaccaccagccttctctttactaatgaatatagaattattagcatctttaaatctaactagatcaaagagcaaattctagaaacccagaaccaattcagaaaactcatttttaaaattatcttcctctagactactcccagtatcaaaatctatattaggcagggttccccagggaaacagaaccaatagaatgtgtgtctgtatgcatatatgcatatatatgcatatacatgtgtatatatgtatatatgcatatatatgcatgcaaaacatgaatatatgcatatatatgcatgcaaaacatgaatatatgcatatatatacacatatatatacacatgtgtatatatatatatatatatatatagagagagagagagagagagagagagagagagagagaagagagagagagagatttattataagaagctggttcaaatgataatggaggctgatgagtcccaagatctgcaatcagctagctggtgacccagaagagccaatggtggagttccagtctgagtcctaagccctgagaattgggagagaaatgatgcagtctcagcctaaattctgacaggctcaagatccagaaagagctaatgttcccatttaatccattggcaggaaaaaaaacaatgtcccagatcaaggcaatcaagcagtaggaatccacttactttggggagagtcagccttttggttccatctaggccatcagctgattggatgaggcccactcacattatggaatgcaatttgctatactcggtctatttattagaatggtaatttcatccagatacacccttgcaaacacattcagaataatgtttaactaaatgtctgggcagcctgtggcccagttgagttaacacatacaattgaccatcacagtcctctttagactggggcaaggcattagagacattggctatctttttatctgagtgccagatattggcaatgagaaagaaaataattgtttatcctttatttcaaaaacaccattcaatttcaggatctaagggcaacagatgttcagcatgaatggaccctctgcaggctcacagtctgctgtcacatgtaccacctgtagaaagttcttctgggcaacagtacactgagtacactgagatacctcaacagcaaaacagaatattaaaataatgaaattaagcttaggattccagttttacatctactgtaatcattgaaatttaaattttaaattttttcattcctatttcaaattgttcgatagtattaagttaaagatgcatgtcaaagcaattttaagtaaaattcaaaccatcaaagagtaagttccttctgaagaatgagtcttgcaaaagtaaaataattgaactcatctttattctagaaaatggaattctaagaagaggtaacattagaaaaatacttgtaagagcatatatgcttttcattttgtcctaattttgctttgccatatatttaacatccacattaatctacatgaattttacatggactcatttgaaataaaagacagaaaatcatattaaagtctggtaaaatatttttgcttcagatgtttgtagaggggcagagtttaaagatgtctaatattttgctaaatgaatagaagtatcctttctttgaagaaattagtccactaaaaatacctacctcattaaaattctgtttgcttagtttgaactttaaagtgcaattccttttctagtgaaagataatagctatatttaatagtttaacttgaactttccagaaatgactgaatgaatttcttaaatcatcttaaaactaacattagtgataaaaataataatatattttaaaattcagagttttatcattggtaacaagaagatgttgtaattctatcatctcaatgctgtagttgtacaagtaaataataaataacaccactcaaacttttaaatcattttctgcattagtctataggcatatttattattattaacaaataaattagcatatttcctcattgctgaacaaggactatcaatctaacctagattttttcttaaaaattatattcttcattacagaacttacatatttcctcattgctgaacaaggactatcaatctaagctagattttttcttaaaaattatattcttcattacagaacttacatatttcctctggtgtcttttttacatggattcatatgtatatctctgaaagtctttgctatgcatgattttttggggaagagaactgttctcaaaattttaaatacttaactcccctgctgtgattttctcctgctgacctcccatgcacccccaaaatggaccacaatatgctaaagacaaataattgcagcacaatttaattatcctgtctaatcacaatataacttatacaaaaattttgggggaagtcaggcatgtttttgagagagggtagagaggagattagagttttcacagatgccataataccatcttagtgtttatattttctttaatttttgtcagtgttttccatgttatggtgaatgatgcagtagaaacagctaagaaactctgaaaggagaaaaaaatcaactacactacaaatttttaaatactttaaattcagatgtgtattgtagctaccacatttataaatatatctattgaatattaatatattgcaccttaaccatcagtacatttgtctgcaaaacataggatgcacctttgtgggagggaagggctatctccttaaacttagaataagtattctaatgtataacatattatgcagaaatattaaatatttttagttataatggtattttttataaaatattagcacaccagaaaaataatatgtagattgcaggtacagatggcaaaagaaattccaattcacaccaaagaatccggaaaagactcaaaaatggaggcaactggtaccttccaatgtaaggaaacacactggtgtaaaaatagaaagattggctgaaagtctgtattagaagcagctagatcccaaattccctatgatttcctgcacagccagaaagcaactccttccacaccatgactggcagtttgagtttacacctggagactgcaacggagagtctctggactgtggttcaccaggcagggctgaaggctgggatggcattctgagaatggggattatcagaggaatctctcaaatcctgtaaagttaggaagaaatcgatatctcaggggctttgagggacaagtcacatggagctgcataagaataagaaataggaaataagagaaaataggaataggagagaaaacattaagcatgatgtgtactcaaacacagcctgcctggcctttggatgctcgccctggcacagttacacatggaccttctgttactggtcaactcctttgtacgttttcaaggatgtctgttaagaaaggaattttacctgcacgacatggcacatgtgttagaggagctatggtttgatttgctttggcatgggcagttctaacagataaattatataaataggatatatatatatatatatatatatatatgtatgtatcctattttgctcctatccaacagtttcacagtacctaataagaaaaattcggcaatatttgaaaaatctggatttgatcagatttatatctaggacatattagctgtgtatttttcttttagacaggatttccagagctcaaaaattacttatttaagatctaaccctgctaatttaaatttctgctgaattaagacttggtttaattttaccattgggaaggacagacccagctctgacttttaaatctatagtatgctgagtccttcttaacttttttgatgacttttggttaacaaagtctcagatgtgaatttatattaacatggcatggcgaaaacctgaaactaaacccccaaaatgttggaattagtgaaatttgtaattaaaagccttaaaaagatcttgcagcatgtttatactgattgtgattttttcacaaataaatatataatcaaaaattttaaatactaaataataagtctatcttctgcataacaaaatgtcattattccactcaataataaaagcataaaggataaaatatattaaataaaaatataatattatcatagtccaaaagtatacagggcaaattactagcctatttgaaactttaaagaggtatatcctgaaaattttgttgctactaaaattatcaaagaaaatagatgttcccaggtattgcaccctgtctttgttatttttttcttttttctttttccttcatccattggctgtttttctcctgtatcagtggttctcaacagggagagatttgacaatgtcaggggacatttttggttgtcataactggacgaagggcactcccagcaaggaaggtcacaaaacattctgtaagacacaagagagcccctgcctaataaatagttacctgaacaaaatgatcaatacttccaaggttaagaaatcctgatctatgtcttttggggtttctcacaagtcttctttctgtacataatgcaactgttgtcataatataacaagtataaaaaaattctctgtagttttgaagagcaaaaattctgagtcaagagacttgttttctatataagaaggtcttagagacttgctacttgaccttgaataagtcattaaatctatcaggaacctcatttcttcaagaaaaagttgttggtaaggttttggccatgcttcctaggtaagtaattaattcattaaagaaacttcatattgacaaacaaataaataaaacagcatagacaccaccctctcaatattgagatgtaggttgggtttagaattcaggcatgatagaccctgtagcaactccacaggacatcccaagggctctactgagcacagttgaaaacttctgggctttaaggataattcagtaattttgagaaagtaaaaactaaatgaaagctttaaaattaaatttagaggagtttttaggtgattgtttagagttatacacatatatgtatatttcaaaaatatacacagacataatatttacatttctcatgtttgaagttgtagaagttctagtccttgcatttatgaaactttcctagagctaagtagtatcttataaaatatgcaataagaaccgacttgtctggttcctcttatgctttaaatatatccaagacaatgaaaaaatttttaattgttgattctaaaatgtgctataaattactgaatcactgatgtgctcttatgttaagaaaaatattcaagctcttctccccttgctttaatcaatagattgtagcaaaagtgaggctctgagatttccaaacacagcctctttacttcttttttttttaatttttttatttccgtaggttattgggaaacaggtggtgtttggttacatgagtacgttatttagtggtgatttgtgagattttggtgcaccaatcgccggagcagtataccctgcacacaatttgtagtcttttatccctcacccccttcccacacttcccctgagtccccaaagtccactgtgttattcttatggctttgcatcctcatagcttagctcccacttatgagtgagaacataagatgtttggttttccattcctgagtttcttcactttgaataatagtctaatctcatccaggttgctgcgaatgccattatcctactcagccacaagcagcctctctgcttctttttgaagacctgtcactctgctgtgaggatgtccaagttagactactgattacagagaaagcacactagttgcaatgaagaggggaggagagaaagggaaagaggcaacaggggagaggggagaggccatatggaggagtacagggttccaggactcaatggaacagaaaatgcacacatctgtcccctaccattgaaaactaatgaatcattgctgttttaagattcaaagttttgagatttttttttttagaaaacattagatagttcaaacagggtaattagtagttaaataaccataacatagtaaactcttttttgttaaaaatttactgttatataatattattatatttaatatattttataaaatatatttcatgctttaaaactggccatttttgcatttctattgcattttttttttttttgagacggagtctcactctgtcacccaggctggagtgcagtggcccgtctccgctcactgcaagcttcgcctcccgggttcacaccattctcctgcctcagcctcccgagtagctgggactacagacgcctgccaccatgcctggctaattttcttttttttttttttcttttttttttttttttgagacggggtcttgctgtcgcccaggctggactgcagtggcgcggtcttggctcaatgcaagctccgcttcccgggttcacgccattctcctacttcagcctcccgagtagctgggactacaggcgcccgctaccacgcccggctaattttttttgtatttttagtagagacggggtttcaccgtgttagccaggatggtctcgatctcctgacctcgtgatccgcccgccttggcctcccaaagtgctgggattacaggcgtgagccaacgcacccggcctctattgcattttttatctgtcatacatttgatgcttttagaaaaacagattctttattataattttaagtgttatcagtagattcaaagcatgtattcttaatattactattttgtaagtgagataaaagggtttgaaagaatttgatttaaaaagcttaattctattatgctaatgtgaaatcaaatgattttaaaattagaaattagaaaagtaagctttagtatgctaatgtgctttctctaagagcaaatataaaatgggatgtcccctaaatttatttgaccatagaatccttccttactaaatcctcaacaggctttaaggtaacaacagtaactatggggagggattatgaaaatacagtcggacctctgtattcatgggctctgcattcttggattcaaccaaccacagatgaaaaatattttttaaaaaattgcgttggtactgaacacatacagacttttttcttgttattattccctaaacaatagagtatagcaactatttacatagcatttacattgtcttaggtattacattttgtctgaagataatttaaagtatatgggaggatgtgtaggttatatgcaaaaacaatgctattttgtataagggacttgagtatctttgggttttggtatttgagggaagttctagaaccaatccctcatggataccgaggaaagacttaatatttcctttgttctcaagtagcaagtgtgctttgggttcactttgaacttcaccccatcacaacgtatgtactgaccttgcgaagcaatctcatcattctatgtcttagtttctttgccatcaacaaatggtcaccagagtatccaattagtatgattgctatggggttttcaacatagtaaatgtaaacaggttaaaagaatgatgaaaatgtagcatgtgctccataaatgttagcaattgttgctggtggtggtggtggttgttgtggtcgtggtggtggtgatagtggtagtggtggtgttggcttgctgatatttttgtacttgccaggtattgaaagtggtattttttacaggtcctaatatagttattcagttgttgatgattatgctaataagtgctaatgtattgcaacacccaatatcataaataactttggtaaaatattgttgtactaattgtcttgcctaagatactccatctttcttacaaattctgtagagtatataacgcatttgaatttagaaaacatacatagctaacagtgcagagctaaaaacccctaaactagtggtgaacagctcaatttgttagaggaccatgaactattttttgtttatttatattgcaggttaattgtatgaactttaagctacacatttcaatgcttagctcagccctgaatccacttgactgcacaaaaacttctccttagctttctttttgtggtttttctgatataaatggcctcctgtgtgacctacagaaataacactgcattttaaaaagagtattcaacattcattaaaaagattaaaggcctaactcttggttttgaccccatcagaactgacacaccaagggcctttgcttctgaatcctggagaccaaataagcaccttttattatgaccttgagacacagacattttcttatggtgccattaatagaaaatgatcattacagcaggctgaaacttttagtaatatgcacatcaagcaaaactataaaggtaacaagattacatatcagtaaagaaatgttctttatatccaaccatcaactgggtaagaatactgctgctaaattgtgaagttaacaaggtacccattggcaataccttgaagagtgaaaacaaacaaattcactccagtcggcataggagacagcttaactctaaataaaaacaatatgtttatgaagtcttaaaggaatttaatacagtagtattgacagagcagcagcatcactatcttggacgagcactgtcattttaaagttcaccttgatcaaaaattgcttaaatccaaagggcatcagcctcatggctaaggtcagcatggccataaatcacaaataacatctccaaccagaaacattccaaacccctccccaaccaaagacatgccagccctgagataacctcccctctggccggagagatgtcagccccaaaataacctctgctccaaccagagacattccaaccccaccataaacttctcccctcacagaaacactccaagcttgtgataagctctctcactctaaaaaaacaataaatactcttagagagcgctcctgaccgaaattgtccagaagcccctctcaggtttattctccaaaataaacttgtctgtgactgtttagccactttttgtgtttgtttccgctttcttttactcttacagtatcacttctgaagactttaagaaaaggctgtgaatgattgctgtgttaagtagtctgcagttgcttagagcagagttttccaacctgggcactgctgacattttgggcttgataattctttgttgtgggcaaccttatatagaaaaagatgcagcatgcagtaaactaggaattcaagacctagctggtctttcccactttcctccctcaggttgccatcagcagcacattctaccaccttagggactgatgttggaaggcatcaggctaatcttttttcttcaccccaagtgcattccataccatttgtatctgtttctttctctctctttcattaactaccatctccgtcacagtctaaaaatcctcatttcttcaccctgaatgattgaaaactctttttcagccaatctactccctctggtctcacatcatatcacctccctatcaactgacttaaaatatttctcaggcaaattcttcaaatacctttaagcaagatggattagtctctccaccaacctccccaaacattcctaactacctataaggccagatttctaaacaccagcatcctgatatcttacagcagataattctttattgtgggaggctgctttatgcattgtgagatctttaacagtagtcctgacttccactgacaagacaccggtagcaccatcaaaccagtgtgaacaaccaaaattgtttcgagacattgccaaatgttccgtggggctggcaagaggcaaaaatcacacccatttgaagaaccactagcccagtttagtacttctcaaactatctgtggtgaaataccagtattttttatttttaatattttaattcaacttcagactgattttttataataatatttacacaacactcatgctcaattcatgcatttgtttgattgtgttcagaaaccaaaatgtttgagagtggccttggtcaaggtacactgctaaaataaggtattgcaggtccagtcaatatttgtattaacacttcatataataaggtatgcaactagtttgtttgtttacttaatttctctttagagacagggtctgattttgttgcccaggctgtgttccactggcacaatcatagctcactgcagcctcaaactcctgggctcaagtgatcctcccacctcagcctcctgagtagctgggattacaggtgcaagccactgtgcccaactgcaggaagtttaataatattacaatgcaaagtgatctaaacagttataagaagagcttgcatatttgaaatgtcagggagttcagaagagcaaataatgcatatgtgtgttgatattctgtgtaataaaaaagtgtctgcaaataatatctacagatgtactgcttaaatgaatgggtgagtgaatagaacactaagaaggagtctttcttgactgtacataaagtttgtgcactcaaagggagacacttcatggaagtgggtctccataagtccagaggtaatgtctgcacatcaccaagaaaggtgttaagcacatagttattgcctgataactgtattgaataagtaaattattaatttcatttctgcacatattaccagttaataaatgaatgggtgaataaaggattgaagagtagatgttcttgagaaaggcaatgaaaaatcttcctgtgtaagggacacaaccaatcgtctccttgctttgtccacaaggtctgtgctgtcgagatgatgtattatatgaaaatgcatgtcagagtgtgatgtaaatatgtgatgtttataaatcaagatacagaaaagtggccaaataaatgaggtggtgctaaaatccaattccagaaaagtttgttaatttgtccttgagagtgtatataaaagtacgtgagagtgaatgagcgggctgtatggatgtgatctgtagagatgccctgctttccacagcttgagtactgcaccatttaatcaaagtagcaaggttataaaaatcgtatctctgaaacagaacccaatcttggtttcaaatgattttatgatgtcagctcaacaacttgatcatattgcttgccttgtaaaatgttaagacagctatcagactgtttttaatttactctcttggcatggatctttctctagttcttgtagcattctgtcagcacaattttcctattgaatgtcaatgagatgttctactgtgatttcttgtttttaagccaatattccaagtgaactacaaaacatgggagtgttgattgacacagaagaaatgtttatctttttttagcacagagcaattttatattttacattatcaaaatatcacacaaaattgagggataaatatattcatatatgtctcatcagtatgtcagatacatatatatatgcatatttatatatataaagaggatgagtttgttgattctatatcatttcattaattaaatgtatttcaagagaaaactacacaaaatcatagaagttattattatgtttaattccaaataagccattttaagagggtgtttttggcaattttccataagcattattacatttttagaataggagtcagaaaaagaagggtaaaagagaaggatcacatttttaaacagctaccttcacttttagtagttttatgttataatgaacttcttctaaagctatttttaataccaaaatcatcatatttttataaaaagaaatccatttgtaaaattccaagactatattactttagatgtgattgtatacattaagaagaaaataattcacacaggatttcttttagtaccttactagtctggtgaaattaacatatgcttccacctacacataaatttaaagaatacatttgttgtgtaaatccaggttcaggtgtacagcccctgcatctgttcacccagtatttcaagaaaattcacttaatagaaagacctaaaaattgaaaaagcgaagtgtcaattctgtaaagcaaatctttcttatgacaaatttcatatcagtaatgtatggatatatacatatgcatttatatatatagcaattattggtaatggctcaattaattacccacacctgtctcgtgttttgaagtctcatatttgaaatatttctctgttgagatgtagaaaataatctcactcttactaggagggttgacttggagagggaaagatgttctgtctcttggtctccaacagaagtcatttgtttcctggtagttaggtttgtatttttagaagtgactagtaagttctatgtaagagtcatttctttggggaggattaattgtagctatcatgcctatcaagccatcaaagatcccacctcctgccatgagcagacaatggtgtcagatacttgagtgacacttcccctgtcaaagctccataaaatcccacctggctatgcagctgctgcagggctttggcagttcgccagaaactcttcatttcaggctcttgcctcttaacttgcacatgaagtgtgagatgaagtgctcaatgttcatcaaaatgatgcatagctctcatgcctaaaatagacaccattttataattttcaagctgtggggtgtgaggcaccatgttttatctgaaattccaatgtcccaaatgtcctgaaagtgaaaagatttgtcccacaattggtacacactcacttagggacaaaacctgatcatttgtaaggcaatgagagaatgaaagtgcctcctaagtaaggttattcttggtatcctgtaaaaataatgatgactttaatgacagggtaccatcccccaccccagtggggatgtaggtgacatactgtgtttgtgccctataatcatttttaaaatctccacaagtatacctttcaaaatacatttgcctccagagattcaaaggagagaccaaggatctataccttagagatgtaaccttggcctcttaaatgacaatgagtaaaactaggacctaagatttgggatgtttccaaagataacacacctgccaaatgaaggactagaactagaatttttctaatgcttccaggacttgaacccagtgtcaacactctatacctcactgaaagatttcttttgaattgagcagaattgattcatggacatggctttcatttgctctgttagggctacaaagccaatacagacaatatttattgctcttatgttgcttttacagatcactttcctgagttttaaataggtacatgcattagaggaatgactatagcattgcttttaaaagatggtattttcctggtcattgtttataatatttaatcaatgttgacaactgcaatgtaatttttatttacaggttagaataagagaagacaatattactacctttcctagcgttaagttctggtgtttttactgacatatgatttcatcttgcataaactccacctagcttttaaaagcaattttaaaaaattggtcagtaattatacaacctgtccctgaaatccaacatataacttcttgtacaataattgggaggaaataaagtggttaagaagagaaaatgatccattgccaagtggctgttcaatcatgattgctactaagttattttaaagaatattagtgcactgtaaaccaattttactgatttataatcactaggagagtacccagaagtggctctggaattaatgatcagtttgtatttaaagtaaccacctttagtaatggttttctctaagtggacttccttaagagtagcactttgacttaattacactgacagttcgtgtttatcaccctttggctgcagtggggaaccttaaaaagatttaacataaatgtgattcttttttctcatgaggtgcaagagcaatgaagcaatgtaagatgtgaaaaaaattctaaaaatagtacacttgtcaacagaaactagggcattgaacttaattgcttaagttaatgatgcctatgacacagattacagcaaagcgtatatggaatgcacagatgcttggctttaattttatgttcactggcattgataatttttgacagtcacatttaaataggcaaatagtaataaatatgatttgtttacaaggtattttccagtacatattttctcaagtaaaaagattatttttgcctgtaatttattttaaaaagtcagagaaagctctgattataagttcctataattcctcaaataaggaaaagagcaataaaatcagagtcatgagaattatgttcattcttattctctattctagtttactgcaagacttaaagcaaacaagttatcttttggtcattccaccttaaatgccaaatgaggttaaaaatgcctaccccatttacaatacagagttaataggagaatcaaatgggataatacacataaaacttgtaaatcaagaacaacttcttaatgttatttaaataaaaatataacaattgtatacctttgacaataacaaaacctgagtagactgtgttccaatcatgtagcatacaatgttttattgaatgctgtaataggaacattttcccatttattactgattataaaaagcctagcagaaaacctggtgaactcagatttaccagattgtatgacgctactttaaaatatcatttactctaatagtaaaattattaataattaaactatgatctcttagcttaatatcgattgttgattctaatattaaaccaccaaaaggaaaataaagttaatattacaactgtacccaagaagtaaatgttgtgatttcttcatttctgagaacctacagtctagaaagaaaattagtaaaaaaaaggcacaggcaatctgggctgtctttacacttctacaataaactagccttgtcatgtggtctgaaccacagtgatcttacatttaaatgaagatgttgaagtaaacaatttctaaagtaagctagagtcctatggtaggtaccacaagcctttggtcccaagacacttactctctgtatcaatgctcatactttcaaacatatttcacactacatgtccattttttagaaaaataaaacacatcaaatacgtttgtcattttctttttttttttcacaagtagctcctgatgtgcctaacagtgccgtggacaagtctgtgatctgctaaagcctatccctacctcctcttagtcaaaaatcaaagaattagaatcaaaagatatatagatgtggttaaaaatgccaataccaatggaacaaaaatgggttcatttttccttcattcatctctacagcctttcatccagccaggattggtgcatcatttacttttttttttattttcattgcctatttggctcttttctcctctaggttgtctccaaataatcacagttgccttccaatgatgcagagtagtatgaaattagaccatgttcacacatggtgactcctgttgtttacaatctgatgaaaaattaaacagctaaaataatggcaggaagttaattgatgaggatagattagttccatatataattatttgtccactaacttcatagagttagcaattagtttatggttttggaccctctcactctatagcaaaatcaggtcttttaccatatgttcaaaatcattctgtacaaagattaaaataatatgtataatattagaatctcagatcatccatcttagagtgagtagcaggtatattaaaaatgctctgttgccaggcatggtggctcacacctatatttccaacacttcgagaggccgaggtgggagaattgtttaagcctaggtgttcaagaccagactgagaaacatggcaaaactctgtctctacaaaaaaatacaaaaattagccaggtgcagtggcacacgcctgtagtatcagctactacagaggctgaagaacaagcactacttgagcctaggaaggacagattgcagtgaattgatattgcaccactgtactccagcctgggtgacagagtgagactctgtcaaaaaaaaaaaagccttgtaataggacatattattaaaggtcaccttttccttcccatatagtcaccatctgtgtcccactgaaagaagaggctacaggtgacgttcttttttaaatcagagacagctcaatataaactatattctagtgagatgtggcaaaaaaaaagactattccatctactcacacacgtacacatacaaaacacaacactatttatcagccactcatctgtctgtgtaacacataatttagtgatgggtttttacaagatgcctctggctacttttgaggtggatatttgtgcagagaaggacagtttcctaaacctgaatttattatgttattgtgctgggacacttaaaccaatgtagttcaaaggactttgagaggccatctccggtgccagctcaatacccatcaatggtgggggccacactgcctctaaaggatgttcttggtttgtctgaatatatagacaggaaggccacagcagcaatagcatttaaatgaggtaaaattctctttagctccagcaatggcaagtcatgcttttgccacttcaagccatgaaattgtttaaaattgtgtgacaaaatttaatatagcaacaaatatgcagggcaaggtatagacagatacaactgctctaatatagatccctagatgattcaggatacacttggggaacaagaatagcagggtcataacaaattctatactaagattgaaataaggataccagcatttctaactcgcagtctcaaaccatatattttagatcatttggtaagcctacgatcaaaataaaagtatcttctgtagatggcatatgtataatcaacaattacattttaatccataaattatctccttttgtacattttaaatgatgtataaaaataataattgatgtaaaatataattatactcattctatttttctcttttatttgacacctttgaattaatgtataactgctaagtacaaggtgaaatcacagcaaagttatctgagaaaaaatgtctattggtgaaaaatgtgcagtacttacttttttctttaagtatgtttgagttatacagtaatgtcacttaaactgtctagatttttgttgttgttgttgttgttgttgttgttgcttttgagatggagtctcgcactgttgcttggggctggaatacaatggcacaatctcggctcactgcaacccctgcctccctggttcaggcaattctcctgcctcagcctcccaagtagccaagattacaggtgcccaccaccacgcctggcttattttttgcgtttttagtagacacagggtttcactatgttgtccaggctggtcttgaactcctgacctcatgatccacctgcctcggcctcccaaagtgctgggattacaggcatgagccaccacacccggccaattgtttttgcatcagaaaagtataaaatttactattttgctcaatatagtcatgctattcaatctataggaaatgaaataaaaatgctgattaatgagtataaattgcaaaagcaataccagcactgagtctagcgaaaaaaatgagagatgtctgaaagctctgtagcatgttcagaccatttcatttcataaatttctgtgtataaactaaccaatcatcgaccttccatatatcaggtcagtttaatttagataatgttaggcaatcccctctctgtaaaatgctgtgagaccttgattttacatctggaacaaagattttttcttttaattttgagtaagtgttatactgaattacactataaatcatagagcacatacattgggcaatgttatggtacagtctgacatgtcaatttagtagagtatgtcatttctgcatagtaaggaaagaagaatgggcatgttctgtgcttgaaaagacagagaacctataatccatatgtatgcacaataaaaaaatacattgaaagccttttgcatggtgtatcaaagtatatttattttctagggccccatttaaaatcttaacgcctacatatttttcagtattacaaaaagccaagcctacttatcttactgtgatctcaagcaaatgcaaaacaaataaactaatctatttggtatttcatctgcaataggtataacaaaaataaagcatagatctgtttggaaaatgcgattgtaaagtgcttcagatggtggtgcattaggagataacttttgcattttaaatcatatttatgatgcacatccatttgagggctgttttatagaccatatgcagaaaacagtgtcctaaagaaagttcatctcagaaaaactgttgtaattaaaaatttaaaataaaacaaactcatgtagcaaaactggatgggggagttagtgtgaaagttagttttaaaaggttagcttgtgaatgtccagttcaatatttactggatcactttatacagacaagagacttgttacataattacatgtatgtttcagagttgagaatattgagagacatgggtaagtatctctctcaaaaagccagtaacacgccttctcaatgactggccggtgattcagaatgctgagactataaatgcattaattagtcgtcagtccaatttctcctcaatgaaaaatgtatttgtttataaaagatcattgtcatatactattatattttctaaactataccattttcctgattagaaatagaaattttccttcttagtaaatagtgcttctttctatttctggtgcattccaaattttagataaaattaaaatgtacagtaacatattccagagctgataatataaactcattgggggataaaaataaataaatgcattttattttataagtcatgtatcaactaatacatcaaattgtgttcaatatgttttgatagtgggttaattaacatcaattatagcttatttagtgtttaaataggtaagtggtctgaacgtattaggggaatttgtagaaacaaatatctaatgaataaaacacattgagtaggggattggaatattgaatgatgcagtaatggaaattcagtctctcgagcactatttccgcccatggaaaccttctccccaactccattattaatattacatggggtaaattttataggcaaatactgcattggatccaaaggaatgaaattagtttgttttgattattctgttaatcaatttgtacaattaattgatcttagatctgaacttcctttatgtctgtttaataaatgtcatgacaccttctgcatctataacacactaaaaacatctactttacaggttcatttgttatttgccttttaacctgtcaatatactcccataataactttaaagacttcagatacatacaaagtggatcaagtaacagaaatcatgttgacgtagttggtcttgttaacatagctgacaaagcttatttatgcttatagattattgtcacttttcctcctcccaccaaagatgaaataaatgaaagtggagtttgtacaaaggataattttaacacgtttccaatgcttctgcaaccctccactaccctgtgtggcttgtataatctaaatcttcacagtgtatttatacgtacctagaaatacaataaaaacagcatatccagtgcttcccagatttaaaacccctagaaaattagaaaactatcattttttttccatttaaaatgcctaccaaataacatgaaagttcccaaaaagaggttggtgaactaggctgttgaagccagcttgttggtgtctctccctgtgttcccttagcttactctcttggccacagaagggagtctccgtgagaatcggtgcctcttgtgtgtatctctataacatatccgacccacctatgggataggccatcctccgagaggcaggagaaggtaaatcattatcctagataattccaactttcaaaatttatcttagaaggttgccagtgggtctgaacacagtttctcacggtggctattagtttgtgggggcatgtcgcattgccatccctccattcttgtctctctttcctctccccctttctcatagtgcttcctagaattgtcacccctcaaaaccatttgaccaccaaatccagggttttttgtttgtttgtttgttttttaagtgacagggtctcgctctctcatttaggctggagtgcagttgcatgatcatagctcactgcagtcttgacctcccggcctcaagggatccttccaactcagcctcccaagtagctggaacttcaggcatgtatcaccatccctggcctagttttttgtttgtttatttgttttttttttgttttttttgtttttttgtagagatgaggtttcactatgttggccaggctggcctggaattcctggccttaagcaatcctcccgcctaggactcccaaagtgctgagattatagacctgagccaccgcacctggcctccaatccacttcttaagatttacttttgtgccactcagcccagccatcttggaatatgttttcaattctaaggcaaaattatcttttccttttttttttcttgaggaaataataaaaagtttactttcttatcattggatctcccaacatttctatatataaagtctcaaattccaattcatgtttatcacagccaagatactttatatttttgtattttttactcttccagagagctattttgtttctgagttaaataatagaacaatattatgtaggcatctactctgtatttggcctgcctctcagtggagaaagcaatattgatacagtaccatagttacagttcatctactagttgctatgtagttcaaaacgactggaaatttctaatatagagaaatatttcataatttgtactgttcttgttggtgtcatggttaatctaaaaaccaaggatccactgtgagataattgaatgttgatttttagttaataccaagtattgatcgacaatctccagattttacagaagagcaaacagctgaactgaaagggaaatattttcccaattaccttcaactatgggtctcatatgtgagctcctcatacagcaaaactcgtgacagctctaactgtatttgctgttcctagtttgttgtttcattcagtttctctctaaattggattcacgaaattaccttccaggtattttgcccacaacttcctcttaccaagtgctgtagccatgtctcagtcttcctttcattccactttcttagcaacatctcacacacttagctatcactgcttccgtttcttgaaatctgtgactctctctcactttgtttctttcacatctcagtacaattttctgtctcatttcctgatttctccttctcagatcaatactgtagtgaaatattctaggacttggttctttgttttcttctctactctatcttcaaatccagaaaattctatctagtgccacaatttcatatatcatttgtatcttgaacacttatctcatttagaaactcctgactgcatttcccattgccaatctgacaaatctgattgtctaacaagcagcttaaactttacatgtttgactcagaaaccctattttcccacagaaacctatcccttaacttgagatttcccatctcaataaatgtcacttaactccattgtttgtcaaggataaacccaagctgtcattcttaattcctctcttttcctcatcccacattgaaagcttcagaataacaagtcgattctaacaccaaagtgtctccagaattgactacctaatagctttactactacaccttaagtccaaataaccatttctttttgtccacacactgcaacttaatggtttctctgatcttatccctgcccattacagaccattctccatccagcatgcagaataatcatttaactttatccagttataacgtttttctgctgaaaatatttgttgtctttcctttgcaattaaaatggcatccaacttcttcaaaatggcataggaagccctgaacatgggttctgcctcctctctgcttccacttctgcctcgtgtgccctccctatgcttcagccaggtgaggctttttcttctgtgctcaaaattgcttgggtgataattgcacctaagagtaaacttagctgttttaataaattgctggctttgaaacatactgacatgtagctttgggcaagaatcgcaacattttagaggtttgactttctcaccacacagtactagtaataataggatgatttccttggaatcttgtcagagcctttaaaaaggtaattagaattaaatgagatcataagggcgggacctaatccaataggactggtgtccttataagaaaagggagagacaccagagatatctgtctctctgagcatgcacagatgaaagtctatgtgagaagacaggaagaaggtggccatgtgtaaaccaggtagattggcctcacaagaatcaatcttctggcaccttggtcttagactttgagtctccagaactgaaagaaaacaaatgtctgttgtttaaggtacccagtctttagtattctgttattgcaactcaaacagcctaagatgataccaggtggcccaacccagaaaggagacaagctcagatcaggcaggtgtggttgctacccaaccttcacatggcccacaggaggcaaaaatattttgtatcaacttaaaggcagagctttcagtatctctacaaaggccatgccaagtacaagggccaccacactaagaaaagcttaacgcatagcaaacctgtcattctagatgcaatttctttatcagtgttcatgtttatcataaaaaacatgtgatattcttgtgagggacacagatagttatctaaaggttaaatgcctatggaaaaaagaagcaacccattataaaaaaaataaataaaccaaaaataattgttgtttatttaaaataacagctgtgcaaaagagatcaatagataaggctagcaatccatttgaggtcaaagctatacttttccaaaattataacaacaaaaacattaaatatgtttattagaattatagacatgatggttttattttatttccttttatcttacatcacaatcttacatgatacactttaaatattcttactactaaacattttaatagtttcctattgttgttttttggcaatatctctttaaatgtaagtaatatacctacagatacaacctgggaggcagtgtatataggagtgaacagagcataggtgattttctggaagatacagtgtcttgttgaattacctgagcttttctttaagaaaataaataaatagtgccataataattttattatgttgagactttaaatatacaaaggggagagctccttctatagcctttcataatatttttaaacttattccccaagctcatgttttcctaagatctcttgttgttgcttttttaaaacaaaacaaaacaaaaacgaaaacaaacaaacatatcatcatgccttaaatttctaagcattacaggtccctgcaatttaattcactgcctagcataccggttcttctccttcaggagaaaaatgaaaagacaccttaacacccccattttcttttcttttttttttttttagacagattttcactctgttgcccaggctggagtgcagtggcatgatcttggctcacagcaacctctgcctcctgggttcaagcgattatcctgcctcagcctcccgtatagctggaactacaggcaccagccaccacacccggctaatttttgtatttttaatagagatggggtttcaccgtgttagtcagggttgtcttgatctcctaacctcgtgatctgcccacctcagcctcccaaagtgctgggattacaggtgtgagacaccatgcctggccaacactcccatttttctattaacattttatacaggtatgatgagttttcatcgatcacattgtaccgtagttttatgtctatggattttttatcccaatggattctggcacacatgaggatgggtattatttatatgagagagaaagagaaagcttttgaatggtttggacaagagcagctgctaagaactaaaataaatttaaaatctacatgaattaacattcttttcaatatttcttaaaaatatataatatactggttaacttgtatcttttaatgggtaggcatttctacttgtttgtttccaataaatgcctacaaaacctcaaaaggtacttaactccttgcctaaataaacaaaagataaataagggaatgttttggaaaattacacttttaaatcctaaggagaatgaaatcttcctaatttgttaatggatcactaacttttaatgttttctcctgcaaatgctatgacacccaaaatgataatttaaacattggaaacctcatctcttagcaatacaaaaattgttgaaatcaatttcaaagagtaaatatattcaagtttattttcagttttatcatcatctgaaaattaattttctttcttttttggtgtcaaacactttggtggcaaccactattttatttcagtatgtaatcctgaataaagcaccctaaagtagaagagagattcttttctgacttatgaccatccctaggctgtagcactcagtctagcatataaagagtacattgggaatttgaaattaaagaaaccacatcatttatattaatacatcccaaaatgaaatacttaggtataaatctaacaaatgtgtacaagatctatatgaaaaaaaactaaacaacgctggtgaaagaaatcaaattagaactaaacaaatggagagatattccataacaatggatagtaagactaaacactgacaaaatatcacttcttcccaaattgatctacagcagcagtccccaagttttttgacaccagggaccagtttcacggaagacaatttttccacagatagggtgggagggatggtttcaggatgaaactgtttcacctgaaatcatcagcattagattctcataaggagcatgcagcctagatccctcgcatgcacattttgcaacctgctgtcaaaaactcattctgatataatgtggagtataaacataaaagaatacacaaatacttaaaaatgcttaaggaaataaatacatccttaagaaaaccctgaattgaaaagtgggtctaaagcacatatctactataatgtctataaaaatcagtgattgaagatgaccataaagtgagaaagaattttgaagtgttttaaataaatcagaaaagaaacaattatggagacagtaaaaagatcaggtgttgctgggaattagggagagggtggaatgaatacatgcaacacagaggatttttagggcagtgaaattattctgtatgatactataatggtgaatacatgttattatacattagttaaaacccacagaatgtacaataccaagagtgaaccctaatgggaaactatcaattggctgataatgatgtgtccatgtaggtttattaattgtgacaaaagtaccactctgttgggagatgttgataatgagggaggctatgaatgggtaggacagtgagtatatgagaaatgtctgtatcttctgctcaattttgcatgaacttaaagctgctctaaaaaataaagtctatttctataacacaaaaaagagaatatgacaaatattctcttaattcaattaataataaattaattgttgacataaggatggttatggaatgaaggttaatttcaatatctaaaactactggtgagtggacatcccattaaatgcagcacagtatgactcagtgtatctttgtcagagaaattaatgcttcctacaatagcctatttaactatgtaatgatatctgctagcataaagtgacttactatcactactgactccattaaactgcatacagatattatcttcttattttacatatctatggctgtgatatgagtcatttaccattgataagaaataaaaccaggaatcaaaaaagggcatttaaaatctatttaagtagagctaattattgtgatccacgtatttgttaccctctcaagcacacttaatcatgtgctagggcacaattattaaaattagtacaaaaagctgtttacccaaagagcatgaagaaaataaaaacagtttattcatgttttccttaaaaatatatcatatggctgatatagaacataatcttgcacagaatattgttggattaggaagattaactataaatttccctgtaacagtcttctgaacgcataatatcattttccttcccaaccatccagtttagtcttaaatgtatcttcttgtgcctctcttttctttcaaagaaaaggagaaagatattctatgattgtaaattaatataaacaaaaaattgtatttttttcataaattaaaaacacaactagaaagcaagaaaagccatgaattttcttacagtgaaataatcaaagataaataaactcaatacttccaaactgaatctttcttgtatgcttcatttatataatgtcttcacaatgaaaccaaccatgcaataaaagcagcagtatgcctgtggaaaatgaaatgccatctctttagaaatatccttaaaatgagtgtgtgggaagaatatccaatattttgttcttccagaaggacaaaatgttgcaaaacacagaagcaaagaaaaaaatagtgtcttctttgaaaaattttttagaatcatggattttaaatataaaataattaagcaaaagatcttgatttatttaaaacacttcaaaattctttatcatttcgtggtcatcttcaatcattgatttttatagacattatagtagatgtgtgctttagacctatttttcaattcagggcttccttaaggatttatttatttccttaagcatttttaagtatttgtgtattcttttctgtttataccccacattatatcataaagatcttgaagcagtttattaaaaacatgcataattgcataatgcaataataaaacacaaacaatcaagaccaaacaagatatatattacaacaaaaagttaaaaactggtcaaaaaaaaggacagaagacacagatatattagataaacaattgctataggtcaaattgtagtagtgtttggtagacttttatgtatcaaaccgtaacagagaaacacaatcagctacattcctttattatctctgagaatttaaaaaaaaaaaatttcaaagaatgaaatatttttctacaatcagttcaaaaataaattttaacatgtgctttaaaacaggacacagtgaaagatgcaatagataaaatacccaaataagtgtacttgcctttgataaaagcagaaggggtagtatattaacacataaaagcaattctttggaagggttggaaggggacagacttctaagatccatgaagtaaggctatgggcaagcactgacacaatgccaagtgcaaaatatgtgttaaataaaaattgtgatacttgtttttttggaaacaagtgatcaaatacaacttgatggattaatactccatctccacagaaacgtgagaaaagttagtgacttcaggcacaaatgaaaatattttctcaagaaccagccatgagtctcctcaacatgcattgtatatatccagaaatccttcagtccagcctttctactgtggagaaagcacacctaaagaggtctagcattgtgttatctgatgttctatagcactttttaaaatattgtttttggttaagaatacgttaaataatttttaaatgtatataagccagttgtttccagatgagattttttatcagagaataaagatcaacatggccttaatgttcctctcagtttgactaaataggtttcatcttgaccataggtccttgacttacattttcttagagtatttactttgaaaactctccattgtaaattctttttctggcccttcgagatgtaaatcttctacaacccagaaatgtctatctcaagacatgggagccattcctttgacatataatcatgaagaaagacagagcccctatctttcaatctctgttggaaggttggagcctgactttgataaaggacaattagcaaacacagatggcctgatcacactgaccaacctctccgtaacaccctccagtacttttctactagttctctcttggcttaaaaactctcccaccttttgttccaggctagttaagtataattctttcccctattgcaatagtcttgaaaaaagtctttcttgctttttaaacttgcccactataatttttctttgacagcataaatgtaacatatattcatataattaatttgttaaatacatacgttttcacatattctaagggaaaagggctaagttgaaaaccaggagtaggtgatttaaaaatacatttccaccctgcaaacatttacaaacaaattgaaagaaatatgaaagtataacaatgcaattttcgtaacagattgatttacagagattgggaactctgagaggccataaggcatcaccaaggaggtcttacccgaatgaacatttgagcaacggatacaatttttacaggtgaccaaacaagggaaaggcattgccagcaattctggcaaagataatgtgcattggaagtgatctataaaccaacagacagaaggcgtgggaagaaaggaaaaagaaggaagaatacgaacgtaatatataaaagtcagtttcaagtggggtaattccttcttaaagtgacagacagcttaagtcaggttgccatctgtatatagcatattttattcaggccaaatttgaacagccattattaattgtgcaattacctacaatgataaacttcaatatgtgttttcaagaattacaaagaaaaaaatcaatagaataccaacttagaagcttgtattatgaagattagctgactaatctaattagtcattagtaattcaattaagtaattattctcaatcttttctttcaggaaacatagacttacttggtaacaacttgtgaatgtgtaacgttttattattcagtttggaaagtaaatatttttgtccaaattatttatgtccaaaaaagataataatgcttcaagtttacaaggcagggtatgtttatttcctctcattgcttaagtaaaattacaataagggaaaactcttggtaaaaatcatggggagaataaagaagccacaagaggcagagatttcaacaagctcaggaaagagaaaaagattagtagattttaaaatcgcagcaggagccaggacctagtgcatatgcaaagagataaaccagagaaggtgtctgaattgcacaacagaaagtcagacaggctcttgtatcagaggtagaagttacaaggaaagttggaaatggtactctatggagacagattaattgaaagtgaatgttaagaactgcctcgactgtctcacctcagatatcaggaaacctaacacttcctgccaaaaggaagaagaggttgttgggtggtttggcaggaaagaagacaaaatatgttaaaataaatatttggagaaaaataaggtagctattatgggtaaaaccattttcttctagaagactcctaacaatatgaccaactccttatctgccatacgcagagtgaactttgcaggggacaacctctgctcactaagagttagtctttaagtggcttgattcttaaataggaaagaggcaacataaagccaagagagacttgaagaacatttgccatatgaaaaaatacccacaaaaataaacaaagagagggggaaaaaaccataaaacttaaggaaatggtaaattacgaaataaaaaaataagtctccaatgaatatactgagaaaaatatttaaaataagaacatgcaattaaggtgtcaaaggtgtaaataagagaaacatggtaagctgaaggatgcttcccttattttataaaatggcaatggaaacaatgtgctttgaaagaagaagggaaagcgagatgaacatttccctgtgacataggaaattaacagagaaggtgtaaaattattaaaaactattatttaaagaaacattatttactaatttaaaaaagcaaaaagatgccactgcttgtatgttggtttggttctttgtcactgcttaagtaagtgactttcacagcctccttttctatctactccttaccacccgtttacacacccactaaagtcctgaagtcctggatgctagaaaactagttgtagatttgtccttcaaataataacaaatggcttattcttgtactcctgataatgaaactgggcagagaagtaatttaccccataacacaacatgaaggtctgaggtaccactagctaggctggttgtacaggaatctcaataaaatgaaaatcaaagagaaaaaatgaatataaatatatttattaacactgaatccctgtacacttaaaatgggaaagacggtaattatatatgcatactttacctcagcgaaaaaatttttaaagttaaaatcaaacaacaaaagagaaaaacaacagcaatgtaaaagttttgactacattgtattttacttcatgaacatacatcagaaatacaccaacatatgcacattttctatacaaaattatgtaagccattttggaagagtgctatgaatctttcaaaaaatataaattaataataaaataagaaccagcaagacaaagaggagaagagtttgatgatgttactttttatctctttttaattgtttgtaatatgtaacaaggatcaattttcatgtttttctctgagtacttcttcaaattttaactgtatgaaagttaagacagctgggtctataatcacacacaaaaaaatcttaaagacaagcaaggctaacggttgtcaccagtatcttattatagtttctggcagtttctcattaagtgttatttgccttaaattatgaagcatatttaggttatgaattaaagtggctttgaaaatgaatatattatgtcatacatgatgtaatccataaagttcccttagctccaatcagagaaagactttgttttattttgtcacttgaagcaatgccctttagtcctttaccttgcattaagtggagcctttgagattttactcagaaagctgaatctgaaaggaccaatcaatttgtgcatcaactttttattatccatggtcattgccaataaaaagctctatttattgagattatatctgtgtattaaggtatttttgatgaagatgtctttaaaatgatggcagttcactttcattcatggtttcaaggtttcagttactcatggacaacatcagtccaaaaatattaattgggaaaattctgaaataagcaatttcgtaagttttcaattgtgcaccattcttggaagcatgatgaaatctcctgctgacctgcttcatcctccaggcatgtgaatcattcctgtatccagtgtatccacgctgcgtgctatctgttcattagtcatttggtagctctctcaagtatgagagtttttaggcattcactggggctcttgaaacctatcccttcagataagaggtgcttactgtatctcagttttctttatttatatagacttaattggaacagttttctcctactcaccataaaattaacaaaatgttgaaagcaaaaatattaacagcaaaaaggtattgcaatttttcaattacctaagaagatatttaaatttttaaatatttgcaatatttaaaattttacaaaaaataaaggtaataaaaaaatcatttccaccaagaattgtcttaaagtaaggagactgagaaaaggatgagatgtactgcacagatcgtcaagttttggactaaccaccttacaaaggtatttaatttattttatattaatgtgccttaacaagttgtattttgctacatcttatataacattgtgaaacttctaaggatcagaaaattgctttctttagtttaacaaaagcaagatgaattgtatgcttactagagtagaatgctattttgtgcataattggtagtcttcaacctagagcacagaaggttgggactacttaatattctgttacagaaagagacaaaaaaggtggtaacactatattttgctctttgccacatcacaaatccctcttttacatttaaaaatgaagataacatgaaattgattaaagcatatttactttcaattcctgggcagttttagttgaaaaataaaggttttgaactattgttcaaaactattattttgtcaatattttctacaatgtttttgggtttcaaagtgacttcagtaaagctgtcatatttggagacattcaactttcaaatggcataagacagtgttataactggactaagagcataaatataataaataacttagacaaaggccactcaattaaaaaaagttttgtccttacccatatataggcacaatccttattattcaaatattccattttccttccatcaggtaagtggtgaatattctaacctaacaattgattataattcattataatttaatttgaaataattataattgcatataattaaaacaaattaattctgattaaaggcagaattagatctcaaaaaagacaataaaatctgtatttttttttccacctaagggagctggatctatttcttcatcctatctttggcctggtggggatttcacattataaatgaggattcccagaatatgaaagctatctaatacattcaggcaaaaattcactttcaactttgtgttaagtgagttatatagaaaggcgagggcagcattttttgccagaggaaactgaagtcaagagggagctaaatagaatctggaatgtaggatctctaaattgcatagagagtgcaaaatttcaagttagcagtctgtcaagtacttcataagaattactactgtgttagctctggtaaaactggacttgattcaccctttaatcctggtatatactctcatgaatgatgaatattaagtatctattaaatagaaacctttttttggatgaaacatgcatggattaatcttcttattgaagataattaaggaaatactgtgttccacaatttataagaatatacagtgtataaaaatgttttcatcaatgtaatttaaacatacatagaggccgggcgcggtggctcacgcctgtaatcccagcactttgggaggccgaggcgggcggatcatgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggtggagctggcagtgagccgagatcccgccactgcactccagcctgggcgacagagcgagactccgtctcaaaaacaaaaacaaaaaacaaacaaacaaaaaaaaacatacatagagattataatggaaaaacaaaactgctaggaatttaaaaaaatacaaaatgaaattggcgtgggcaatcgccactttctgtctaaaaatcatttgcctttgtctctcctttgtctctcctaataagcaataaaataaatatatggattttctacaaaagaaaagcccatatcagaaaagaaaatgggaggttgtcagctttcttgaaattgaaaactggaagggattttttttttcttatgaaaataagaggcagaaaaaaagaaatcaaaaaggaaatcacttttactttatcaacagaaggaagatgagtcagttatgaagactttcactcttaatgtgaatatctaatgaaagaatacaacaaaatgctaaatatgcaaacaaaaaacttgaccttggaagaaagagagacaaaacagaacatagaagataattattttataatctattatgttatgaaattatttgaaaaatctcataaatgatctcttatagtctatatatttttataaatttaaatttatatatttaaatatagaaatatatgcacatatatcaacatctaaatttatatttttaaatatttatattttatataatgcatgtttatttaaatataaatttgaatatttatatatgcaaatatatatttctatatttaaatgcataaatttatatattgatatatttaaatatatatagatttatatatttatatatatatatgtaaatttttttcttcaaataataggaggaaaacctaagctcaaataaatctagcagacggaatcaaggaacagagtcatgttgtggccaggatgataaaattgggctactacaaaagaaaatgtattctctcacatcctagccagcacctgtatttatctgtctttttgataaaagttattttaactgaggtgagataaaatctcattgtctttttgatttgcatttctctgatgatcagtgatgttgagtaatttttcaaatacctgtttggcatttttatgaattcttctgagaaatgtctatgcagcttttttgcccattttaaaaatccaattgtatttttcctattgagttgtttgagcttcttatatattctggttgttaatctcctgtcaggtgggtagtttgcaaatattttctcccattctgtaggttacctctctcacagaatgggatagaatatacactcataatttaatctaaaatttaccactctcccatattctagaaattctacttccttattatttttattccttttcatggatattgtcttattttatttaaatattgtattaatctgttttcacactgttgataaagacatacccaagactgggcaatttacaaaagaggttcattggactcatggttcaacatggctggggaggccccacgatcatggtgtaaggcaaggaggagcaagtaacatcttatgtggatggcagcaggcaaagagagggcttgtgcagagaaactcccatttttaaaatcatcagatcttgtgagacccattcactagagtacagcatgagaaagacctacccccatgattcaagcatctcccaccaggtccctcccacaacacatgggaattatgggagctacaagatgagattttattggagacacagagccaaaacatatcgattatataaatgaaagatgaatctatagccttaaaaaaactacaaccaattccgtttattctaactgccaacccccaaccacaccgttctctagaagctatcaattttctgatcattttgctgctgatcatttttcattattgtcttataaaaatatagttctgaattcttcattagctttcagtaaatggtgtcatatcgtacatactttactgcaactcacattcttacctgaaactattttggagttctaacttggctggacatgtacaatatctgtgtaactatttctctatcgtatgaactaggaagtggcctttgatcaagtgtattttatatatcaacaaatgtaatcaagtttccctccaatgtgacttatgaatattcattgccaccagttcattttgagagtgttcactttaccaccacatttttaatatttgatattaccaaacattattattgttcttatctgatttgtaataattgtaatattttaatttgcatttcctctttttgtgtgtgcctgaaaatattttctttcttttaaattttttacttatgcgattttcttgcttacacgtttgttcatttttcttattggtttgttattttgatttttgatttgttttctattacttacatagatctaattactctagatactcatctttggacttctttatataatgcatttattttcctttgatttgttgtatttaactttgtttcactgtgtgctttttatgcattctgatgtaaaatttattcatctcttcttttaatgatggacatttaagtagcttctgaatcttggttatagtgaatagtgctgcaagaaacatgggagtgcagatatctcttctcttgatgaagttatgaaaatcagatatactgattacctttttttctttgttttttgtttgtttgttttttgagacagtctcactctgtcacctggctggagtgcagtggagcaatctcgggtcactgcacctccacatcctgggtttaagtgactgtcctgcctcagcctccctagtagctgggactacaggtgagtgccaccatgcccagctgatttttgtattcttagaagagatggggtttcaccacgttggccaagatggtctagatttcttaaccttgtgatccacctgcccctgcctcccaaagtgctgggattataggcatgagctaccacgcctggctttgatttcctttcttttcagtatatacctagcagtaggattgctgggtcatatgatagttctaggtttagtttttgaggaatctccatagtcttctccatagtggctatactaacttacatttccaccaacagggtaataaggttctcttttctcctatagcagacattttcaacaaggtgtgttcaaaatatctttgaaactgaactctctctatatttatatatttttacaattaactcatttcctgtaaggctgaattgtaggtcaggaatacttcaggaattagctgttctccaaaacataaattatatgcaatcatttgctgcccaacatatgcaacctttctttgctttggaaaagaaagagaagtaagagaagtcacaaagagcccttattgtgtgcaaaatcctcttgggggtatttgcctataatattataactcaatatgacaacatattgattcagtgcctcagagacagtaaaagccatgtcaaggacaggcagatagcaacaaaaaaggagggtatttcacagagtttgctgtgatctgtagtctcctacatttttctacactgaaactaacatttttgttattttatatgtattttaaattacattttattttttatcaggacacaaaaaacaacaaaattctatgaagccataagaagtaatagagcttaaacaatacaaaatacaccaagaaaagatgagatcttggatccaagcaaccatggaagccgatttctaaatttccgccactttaaaacaatttattagcctgtataattttccctatttgtgaattgagtgaattgatgtctgaagtatgttacagattccattcaaatctaagactagattaattacttggtatttaaaaaagcacacacacaaaagaatatatcgtaagggcctgtcaccaggcatacatattaaagtaaatacctgagattcttgtacaaagtcactatgtgtccttttttttgttgttcttttttctttcttttttttttttttgagatggagtctcactctgttgctgaggctggagtgcagtggcacaatctccactcactgcaacctccacctcccagattcaagtgattctcctgcttcagcctcctgagtagctgggatttcaggcatgcaccaccaagctcagctaaactttttgtatttttagtagagacgcagtttcaccatgttggccaggctggtcttgaactcctgacctcaggtgatccaccgcctcagctcccaaagtgctgggattacaggtatgagccaccgcgcccagctactatgtgtcttttaattattcattttgtagcatgcacttggctgtgattggcataaacaatgaatgaatcttcctagaatctttcttctcagttttcgcttttgttgtccttggtttattgagaaacaaaaatgctggttagcgtccggaattgggtcctgacgtagtacattatgaggtacttacatgtcactcataatgttaaagtaataaccagtttagacccaaaactaggaaaacaataataacattactaaacaggatgatactgtgatctctatgtctcattgctatggtcgctgtttttcataatatacttgacaagtgacattcaaatgcataacattcaatcatgtgctgtacattctatagagattttgtaagtaagaaaggcttctgaaaatactcctatgacattacccatttggttttgggacaaacaaataaacgatgtcaccacaaatgagaggtggctaaggcactaagtgaagtaattgcaaaaaagttactcagtctaggaagtatggtcctatgccttaactattcttataactcctcggatgttttaatatacttgtggtaatattgaagaatagtcatcttcaagctacttatagcagctacgcatcaaagtaacttcctgaaaatgcctcagttcacaccattatcccaaggtttggagttagccacattgtattagatccactttcaaccattgtccataaaagatgctaaagaggtaccacttaatgcaagtaacaattaacctggaaacccaatttgaaaatcctaaaactagaaatattatttcagaagattttcaaagcaatgttacctgctttaaggaagcctgaggggcatggccgtctctccctcatcaggtcttatctctcaatgtcagggtataagaaacttattacattgaatcagtactttccagttttcccgtgtctttcaagaatcacatgtagtttagggcaatttgtaacagtatatctattatttctcaagtcctagaaaagtatttgacaaaatggtgctttgtggaaagacaataatttttttctgctccattttggtctcttttgttataataatcaggcaaactgaactagtgtaaaacaaagctttatattttcctctttaaaagagcagaggaagaatgtgactaaatttactttggcatcattgattgagtacatcctatttgcaatgatttggattagctattgaatggcaaatggtgactggtaaatatttgtgtatatttgaacagatgtagatgtaggatcagcacactgacgtacagataaaacatttcttaacacacctgtccatatagcatattttgacttatttttgccctggtcaatcccagtgtgtacctatggtaaccttatgggaacaatagttcctcattcctcaatatacactatcactgtgtgacttcttcagtgtttacaacacacacaatttagcaagatatttgatttctatgtaatttaatatgtaattgttaaacagtttcatatagaagactttgactttttactaaggcactggaaaacctaagaactggattttattctagattgttatgagtcagaaacttgcataaattcttttaggccttagaatgcctgaaattctacactaatgggagtataatgccatagcataagatgagcagcataagatgcaatgagaacttactgtatttatctaagacccaatctgtcatttgcatgtctagctcagtgcttataaaaagtatatgattatttaaaataaataaatgagcatgttggggttgatatatatgtagaaaaagaatgaggatagaatgagatattaattatatgtctacacttgatgcctctgcgcatttagacttcagctacagttacttcaaatacctgtaagaaataacgacaatctgacataacatttaattttatctgttaaatagcaaacacatctgcacccaaattcaataactcctaagtgatgtaggcaacagaatgacgtatatatatgaaattttaaagacaactactttaaaaatagattttaaaaaatgaataaatggtaagaaaacactgggtcttggtaaacaaaagtgactaaataataaatacaggcacagcttggagacattgtgggtttggttccagaccataagaataaagcaaatatcataacaaagtgagccacatacattttttggtttcctagttcatattaaaattatgtttacactagtcttttatgtgtgcgatagtatgatgactaaaaaaatgcacataccttaattaaaaatgatttactgctaaaaatgctaatgctcatttgagctttcagcgagtggtaatctgttaatctttttgctagtggagggtcttgtcttgatgtggatggctgctgacaagcgatgtggttgctaaaggttgtcgcagctgtgacaatttcttaaaataagacaacagtacagtttgtcacatccattgactctttctttcactaaaaatttctctgtagcatatgatactgttcaatagcatttgatccacagtagaacttctttcaaaattgtagtcaatcctctctgatagagtttggatatatgtccctccccaaatctcatgttgaaatctagttctcagtgatgaaggcagagccttatgggtagtggttgggtgaagggggtggatccatcatggcttggtgctgttcttgcaatagtaagtattcttgagatctgattaagtgtgtggcaccccacaccaccactctctttcactcctgctttcaccatgtgacatgcttgctcttgcctcaatttctgccatgagtaaaaactccttgaggcctccccagaagctgagcagatgctgatgccatgcttcctgtacagcctgcagaaccatgagccaattaaacctcttttcattataagttacccagtctcaggtatttctttatagcaacacaagaatggtctcgcacacctcaaatcctgatactgctctatcaactacgcttaggacatattctaaatcctttgttgtcgtttcacaatgtttacagcatcttactaggagtagatttcatttccagaaaccattttattagattatccattaagaagcaactcctcatccattaaagttttaccatgagttacagcaatttagtccaatcttcaggctccacttctaaacttctaactctagtttttttgctatatctaccatacttgcagttacttcctctactaaagtcttgaactcttctaagtcatcgagaagggttggaatcaacttcttccaaacttgtgttaaggttgatattttgacctcctcccatcaatcacaaatattcttaatgacatcaacaatggtgaatcctttccaaatggttttcaattactatgctgagatccatcatagggattagtatctatagcagtaggtataatcttatgaaatgtatttcgttttatttatttatttatttatttatttatttatttattgagaccgagtctcgctgcgatgcccaggctggagtgcagtggagtgatctcggctcactgcaaccttcacctcccaggttcaagtgattctcctgcctcagcctctcgagcagctgggattacaggcgcccaccaccacacctggctaatttttgtatttttactaggtttcaccgtgttggtaaggctggtcttgaactcctgatctcaagtgatcctcctgcctcggcctcctgaagtgctgggattacaggcatgagccactgtgcccggccatgaaatgtatttcttaaatcataatattcgaaactcaaaattactcctttatccatgtgctacagaaaggatgctgtgttcacaggtataaaaataacattaatccctgcgtatatctccctcagagctcttgggtgaccagatgcaatgtctatgagcagtaatattttgaaaaaaaaaataacatttatagatagtaggtctcaacagtaggcttaacatactcagtaaaccatgctgtaaacagatgtggctgtcatccaggcttagtttccatttatagagcttacacagagtagatttagcataattcttaagggtgaatttgaaatgatatttgaaatgataaatgagcattggcttcaacttaaagtcagcagctgtattagcccctaataaaagtcagtctgtcctttgaaattttgaagccaggaattgacttctctctagctatgaaaatcctaggtgacatcttcttcctttataagactgtttcatctaccttaaaaatctagtgtttagtgtagccaccttcatcaattatcttgctgtatctcctggaaaatttgctgcagcttctacataggaactcgctgcttcactttgcagttttatattatagagatggcttattttcttaaactttgtaagccaaactgttagtttcaaacatttcttctgtagcttcctccttctctcagccttcaaagaattggagcagtggagcctttctctggattagggttctatgcaggggtatgttttggctgctttgatctatccaaaccactcaaactttctccatatcaacaataaggctttattaacctctgtgtgttcactgcagtagtacttttaatttcctccgagaacttttcctttgcatttacaacttggctaactagtgcaagagatgtaactttcagtctatctcaacttttgtcatgccttcctcactaagcttaatcatctctaacttttctttttttttttggaaacggaatttcactcttgttgctcaggctggagcgcaaaggtgtgatcttggctcactgcaacctccgcctcctgagttaaagtgattctcctgcctcagcatcctgaatagctgggattacaggcatgcgccacaacgccagactaattttgtatttttggtagatacgggggtttctctatgttggtcaggctggtctcgaattcctgacctcaggtgttccacccgccttggcctcccaaagtgctgggattacaggcatgagccaacgtgcccggcaatcatttctaacttttcatttaaagtgagagacatgcaactcttactttgacttgaacacttagagattactgtagggttattaactgacctaatgtcaatgttgttatgtctcagggaataggaagacccagggagagggagagagacaaggaaaaagccatgtggtgggggcaatcggaacacataacattaattgattaagtttgccataccgtgggcatggttcatggcactacaaaactattacaacagtaacatcaaaaatcactgaacagatatcactataacatatataatagtatttaaaaagtttgaaatattgcaagaattatcaaaatgtgacacagagacataaagtaagcatatgctgttggaaaaatggcgctgacagacttactcaatgtagggttgtcacaaaccttcagtttgtaaaaacaacacaatatctgcaaagtgcactaaaataaggtttgtttgtacttgagtctttacaagtaaacatggctcatttctcagaggagctaactcaaaaaaaagttatatgagatcttaccttgccctaagatttcaactaactggacaaaataaagttgctgaaaggtaccgataatgtgaaggaataaaaagccttaaattttccttaaaatttaatactaaaaattttttagtatttttagtattgactactggtgggtcaatatttttcatctttgaatattcatttgacagaaatttaccagcattagttaattgtatcaaaggctgtctctcttcattacttaaatgcaatgaaattacttattttatttctttcacaaaagcagttagtggaaggtaattttcatatgtagggctccattttcctctaatttcttttcccccaggattaattttttttttcagacagtaagaaggttttcaaatcttccctctgaactcattttaaaactgtctaaaaagcaaagcttggtatattggatttatagaagtctcaggctaacatcaattctgtttctatattaacatatgacaaaaaacaaccctatcttttggttgaatactgaaagggctaaaactcataattttcttcttcttatctgatttctaaatgaattctttacctcacttattctgaaagaacaaaagtataaatagttctatattctattgagtgttctattaaaagcacctttagacaaatccagaagtagatctaaaggttgccctcattcatctctcagagacacagcagatgaaacaactgttttacatccttcagatgtcagcaagcattaatctattttatgccaccctcaagtgattccacatagtttgggaaactgaaatgctttgtattttaaaaaattgagtaatgaaaatagctcaaaattgccatgtttattttgcctaaatgcaaaacatccctctccaagattcaataaatgtcccattttgatgatgtgcaaaattctttaaatttgcagcagtacttgaggaacttgtgctaacaagcaggtaaatattcctgtatgagtcacttaaacttgttttttgttgctcctctatacaaaagttggagttgtccttagaacatttgacaaatttttgcaacattttcctctttttactcagtgaatttatatacataaatcatacctatctcattttttaaaatctaacttttcaggtctttcagactttctcagagttttaaggtaaaacttgagtgttgtgagttcagttttcgagaacacttccccaaattgaataaattaattgcattacagtttatttaacaatatgtatataaaaaatattgctcagatccacaaaatgtaaaataaatgtttaaaagcacacacacaaaaaataataaccagaattatttagcatgtggttaggggggagatgggtatgtattaactctaattgcctttctaaaagaaagcaaccatgtctaaaattaaaattttagtttcaattattcaggtccattttagtggtaaaattatattgatcttttaagtgtactattgaatattgcatatgctgtatgacatgtatttgtgtattttttttcttacagttttcgtgtttatttcttaagatacttggttaacaaagtattagataagcttcttgaatttggagattatgtctcctctcccagaaatccacaatatgaaattgatatattggactgtagaggatcaatatagactataagacacacagtatgccccctctaacctgctgaaacagagtttacctctggaaggaactagcttccttccaatgaagtgtcacgctaaatggtgttgaacactgactcttcttggagtgcaaaagacttatttgctgtggtctcctgtgcaatatttggcacattctttataatctttaccttaagtctttttcatggatacttttctctgtctctctctcttttttttttttttttttttttttgagatggagtctcgctctgtctcctaggctggagtgcagtggcgtgatctcagctcactgcaacctctgcctcctgggttcaagtggttctcctgtgtcagcctcacgagtagctgggattacaggtacgcaccaccacacctggctaatttttgtatttctagtagagacggggtttcaccatgttgaccaggcttgtctcgaactcctgacctactgagagtatttcttaaacctcttatctaaaattcatcaccgtcttcaatttcagcattcatttgtctattcctttatttttttccataacatgccttcacgtaccataacactcccttacactgtgccatttatctgtttagcaccatgcttacaatgttttataaaggtagattttatggaatcagcaacctatcaaacttattaatctgtaccttccacatatagtaggctctcttaattatgtaataaattaatgactcaatattgataaactgtatctttctcaaattccataagatggatttctattatatgtgttcccagactttttccttaaaaagcctctatcttaggttcctacgcttgccttcaggagactgacttaactttccttctcttcctcttaactcaaatgctatcaggtatagtcacggaatcatattgtgggtttccatgactatacttgaagtgcttccatacctgttagcatttgataggccagaaacacgagccctagaatgagtgtactttgtgatgtttattatgttatcagagatgagtgttctaacacccaaggcttcttcacattcccaatatgtgaaagtgtgtttgcaaccacagagaaaagcactcaatgcagacttgattttatatattttgctttcaggtaaaattaaacttaaattttggtttctgcatctgtaaaattctgaagaaaattttatgttcattcataatgagtgaaatattggccagctctatctaggacagcaggtagaaagagaataggatttcatgacactaacaacgttttacatgaatgcaaggagggagaaatagatccctcacccagtgtgtggtgtgcttgtgtggactgtgtgcttaagcatttgatacagacactttttttcctatatttcttggaatttggtaaaataaatatatcctccttccccaacccttattgtatttcttcatcattttcaaccacttttccatcctttcataaagctgatcaccttttgtgtactctgggctgaggatataagcaaaattgctatgcagttgtggtttgaaacattttttttttttttgagacaggttcttactctatcacccaagctggagggcagtggtgtgaccatggctctctgcagcctccatctcctgtgctcaagcaatccttccacatcagcctcccaagtgggtgaaaccagaggcatgtgtcatcatgcctggctagttcttttatttatttatttatttgagacagagtctcgctctatctcctaggcaggagtgcactgttgcgatctcggatcactacaacgtctgcctcctgggttcaagggattcacatccctcagcctcccaagtagctgggattacaggtgtgtgccaccactcctttctaattttcgtatttttagtagagacagggtttcatcattttggccagactggtcttgaacacctgacctcaagcgatccgcctgcctcagcctcccaaagtgctgggattacaggcatgagccactgcgcctggccttatttttttttatattatatttatttatttgcttgtttatttatttttatcagtgcagggtttctacaggctggtctgaaattcctgggctcaagtgatcctcccacctcagcctcccaaagtgctggacatgaccaccgcatgagccaccaagcctggcctgaaacacttctttacatttggtaaacaactacttcccagaggcccccaagggccccatctcactttgtgttccccaggaatcttctgtgttctcaggatatacaaacctaaaagttaacgcctattataacaggggttcttgaaccctgcttcattcagtgctgatatctgaagactttctggttgcatgatggccatgcgcagtcctgctttgaagttctcactacctggcttctgaacatcacccctggcacctttctcacaatccacagagccactctgcacatacttcccaaaccctaccctgtccagagaggaaaagaccatggaaggtgaaaggggtaaagaggcaaccttcatgttggtgttgggaccacaaatgcctgtcctaacaccatttgatattttgaatagcacattaatcataaattgagatgaataagaggtatccaatgcccttaaatatatggagaaatagacaagttaaaaggcaattactgtacagttatgttccgtagagttttgtgcactaagcagtatcttcaacccagccttaacactgaaagaactagaatcggaggaaattgccgttaagcaaattcctgaaggccacatagccaagaaagttgcaggtatgctactggggagggcagaaaaaaatcctatgtagatctccaaggaggcgatggtccttgcgtcttagggaaacagaaagtagttcagtggggagagaattgataactgagagagagagagagatactggaagtgagaattgggagtagagacatggtaaatatcatttgtgccaagggaaagatgtttttcaatctttttctccatactctagcagagtttgctttacgaaaccttacttcttaaaaactgttatcatcactccacatttctcaaaggaataaatccaagcctttacccatatttctctagaatcatatttacaaaatgatattaatattaaaaaaaggagattgcaagacagagaaatggcattaaaacatggaacatttgtccatctttctacctgtggtaacatttaaaagcctgcgtattacaaaggctgaaagcattggcccagagacaggcggcttggggagtacccaggtctgagtccctgattagacccataacattgtaaaagctactcaaccagtcagccctcatctataaaaaaacgggttaagcatagagcatgcaaagtgtgtgggaagttgcctgccccagatgcgttcactaagttagctaccactgattttatttaaattatagaacggataagtgaatatgactgcagttatgagaaaaagccataacatccttttctttttttttctgaataactatttgagcacaaactaatatcttgttccagatattacatagtggtggacagcctggaaggcaggatattataagggcttaatttaaagtcatctcagtcaagtaaattaacatattctaataacttcctacatcatagaaataagcctgaagctgttccagaatgtgtaggctgaggtgaggaggcagcccaggaggaaactagataaagtgtaaacaaattcaaagattataggcagttaatggaatggtgagaatgagattgtatcttcaatttacagggacatcatgagataatttaggtaaattagacagttaaaaactatgtccagataacgggaaacatactggattactgttattatcccaagttttcttttctattgttcagcagcatctacacagtaatcatcaaagaatgtagctgtgtgtataatttgcaagaagacctaaaattttctttattgcaaagacaacctgattgcctcactatctaaaaggaacaactaacataaattatagctagaaaattgcctcactaatgtagtcccaaattaacctctgtaaatactttcatatgttcaggcatcaccagagacataattctaaaaacatttaaatgtattactgcaacccaactagtggatgaaaatatgttgtttggcctggtattagaaaagctgaaaagtctttcaagtattgtcatcactcttactattcattatctttacatatctctctttaaatggatgtgttatatccagtgtctttctactcacttctagtaaagaatgatcatgcaaaaattttaaaatataaagaataaagatttcaatagccatagctctaagtatcaatgttttccttcaagactttttatgcatctttatcttaaaattgctcatgttccaaaaggggtataaaattgcgtctaaatctgtaatatcttttcctaaaccatgatatgaactattaatattttaaaccaagtttgtgtgtgtggggggggggtgtttttagcatattaggacaagttagtaatcgagcaagtattctgcttttatgttatagcaatttgttttgtgtgtaagtgctcctaaaacaagcatcactcttttgtagaatacggttttagattataaatatgcccaaaggctcagcaaagggaatctgactataaatttagcagaaataataaatgtactagtttccactgctttcccagaaaatcagaatgtctcctttttaatgttactggattcatgtgtgctcagaagcaggccaaagcaccttaactgtttcttgttttctccttcctcttttccttctttttcttcttcttcatctttttttggtgggggagggtaacaggggtaaaaatattgcctgaatatgcgtttctctagaagggaaattaaactgctatttaacttgatccgatcattccagtcttgaattgtttcttctcttctgttgctatattttaggttcagagttcaattagcaaaattatagtttcgtttttcccctggtgagtgtcttttaaacaaaatgatttaagcaagaaactgctttgtgagtgattacatttatctcagcatgcattctatttctctctggtttggccaattagagatataacaaaggcctacgacttctatcacatctacaaactatactgtttggtgttacattaaaacctcaaacctaatctctaaataacttaatctctaaatactggaatctctaaagagttcaactctctgtatactacttatagatatgagatccatctaatttaaaagacggagtttatgaatattagttcccttaggctactgtgactacttccctaggagacactgtgcttagtttaatgataaattttaaaaatgaaaatgaatatattcatgaatatcagatgttataaggtcaacaattgatttgacttggaaagaaattgattttattccgatttaatgacttttgtgcccttttagtcttaaaatattatttctatcattaaataatagtggtaacagtgaatagttccctcactaatgtgtattatgatgaattggaaacaaaatttttaaaaatgttttcattattatttatgatttgtatgtgttttaaatccatccctttatttttttatattgttgttctgatgaaaattccagacttggatgacatgattggaagtttaaactgaacataccctaattttcttttcttttcttttttatttcattgttttcaaatcaaccttattttaaactccctcttacacagagacacactacacaatacagtgttagagcagaaaataaattatttacaaaaatcatttagagtaaaatcacatttttatttcaacaaatatatcagattaattgtatctttatgatcatttgttgctgtcagtctattcatactgggaaaactgtcacattaaaaatcctcaaaatagttttagcacaggtcaaatcttattttgctaagcccctgagctcttcgaagaggctgaccttatgcattgacctcttccccagctaccctggtctcttctctccagaatgccttgctacatgctctggcctcaaagctacttttttccccgctcacattaactctaggtgaacatttaatgatatcacctttttagccaacgatgctctgcagaaaccatgtagcttctctgacaagtagacttagagtccctgccccaaataggacctcataccattttcctgatgcttactgacaaggaagaggatccagatgagggtacattttgggtatccttcttattattcataaaattgccaataatggtcaatcttctaacatctccaagcttcatgtctcagataatcattcaaacattggatggcaaagaggtcgtcgatgtcaagcttattggcaaacaagtggtgcttgcacagcatccatttcaagtcaccagctctgaaaatgcacaccaagtgcacgtggtccccatcgtagggtgggtagggagcatcctcagaaacatcaccctccaagtactgccacttgacaaacctggcgactgcatgcgtgtcagacaagtcatacttatggcttgtagagagtgagccggggacttcaggaatactctggatggtggctcagagatgctcatcagggctgtatgtgtcttgtgctcactccataaacttttggatttttttaatcctgaagtacataccccacatactccctactgaccacaaaataggcacagcctgaacaaagaagtgtttcaagtggaggaggcattttaacattccctgtgtttgtcagctttccaaaaacctcatactgctttttccacctttctcctttattggatagcatcctctccatttcgaggttgttttctcccattaacaacttgatcttattaacaacattatgttatcattgctatgttttagcaaagagactggcggcattttgcccatggcctagagatttgtggaactttgaacttgagagagatgatttaggatatctggtggaagaaatttctaagcagcaaagcaatcaagagttgacttgggtgctgttaaaggcatttggttttatcaaaggaccagactttataaaactttagaaaatttgcagtgatacaatgcaatagaaaaaaaatcccattttctggggagaaatttaaaccagctgcagaaatttgcatatgtcacaaggagtcaaatatgaatccccaagacaatggggaaaatgtttccagggcatgtcagaggtcttcactgcagcccctcccatcacaggcctgaaggcctaggaggaataagtggttttgtgggccaggcccagggtccctgtgctgtgtgcagcctacagactaaatgccctgagtcccaactgctccagccatggctgaaaggggccaatatagagcttgggctgtggcttcagacagtgcaagtctcaagccttggcagctttgggaacctctgcctagatttcagaggatatttggaaatgtctgaatgcccaggcagaagtttgctgcagaggtttccatacatcctctgaaatctaggcagaggttcccaaagctcaattcttgacttttctgcactggcaggctcaaaaccacatggaagttgccaaggcttgaggcttgctagggcaatgtggaaggaaaatgtggggtcagggccccacacagagtacctactgggacactgcctagtggaactgtgagaagagggccaccatcctccagacaccagaataaaagatccactgacagcttacacatgagcctggaaaaactgcagacactcaatgacagcccgtgaaggcagctgggctcttaatctgataggttttcctttatatgttacctgatgcttttgcctcatagctcttaagtttctttgctttgcctgaccacatttttaacttttcttaccaaatcctggctaaaaaaaaattacagcctgaaaacatttctatgaaaaaataggggtaagggaagagttctaacaagaacttttatctcctgaactcgcctatcttttcatcataatctttctgagaacattgtaactcacggcacattttatgagagtaagggtagaggtagtatgtatgtgcagattaaagattaaaaaaaacaatatgtttgtctaccctctggccccaaatcaaataccctcatatgtcagactttgggagcatcctgtataatcctcctgttgctcccaaagaatacttatgccctcaccatcattagctcagtgttgatgttttatattattttatcctgtatgtatgttttcctaaatttataaccatatgaattcaccttaatatagatgacatactattttatctatgcttttttggcctttcttttcatcacctgcatgtggcaatgcatccacagtgacatatgcagcaataattcatttatgaatatgtcaaaattaattcatccctttgtatgttaatggtcatttgggtcatttctacttttttcctcccacttaaaataatgctgtaaactttcttgtatatgcttcctggtgagtgtatgagtaatttcattactggatagcatgggatctattaattcaactttaccaaataatcctaaattgttcccacaggagtacctgagagcctccactgcccaacatctttagtattatttgtcataatcaatttctaaaatgtatatattagtgagaaacattattgtcaaaccatgtcatgtttttaatttgcatttccttaattatcaatgtcatttctttgtaagtataattactatgtaacacattaggcaaagaattactgagcatactactgaatcctgagtcaaaaaagtttactgcaattgtatcatgttttcatgaaagatgggatggtcaaaacgtcatctgaatttgtcaaactagaggcaaaggagctgggggtttgtactcttgaatgtggttatggactttggccagcactatagggggattgatataaaccctcacatgtttctggctctctattcaggcaatgaaacccctgctgctaaagggtcatctaccatagaagagtaacaactgggccagtagagagaaaagcgcactttgaagcaagcagagaggtacgcagaaatagtaacaaatttcagggcactcatctacacagagtaccaacagcatcctctctaggagaatcttggtagtttggtaaacggaaaaggggttcttaccaaagtgttcaacttagaaggatttctcaatagctatctttaaggactgttctatacccagttgtcagcaatgtgttgaccagtcacatcagtgaagacatagaaactatgtatatcagatatgaagataatttcaaactaggaaaataacaaacacaaaatgagtcaaattaagttttaaaatgctgttaataggcatgattagcagacatgaagaagacaaatttaaaatattttatttatattttaaaattcacttatttacatacagaaaagagaaccaatttagaaattgatagttttttattgaccacatgcctaggtaagttaacgactatggtgaatttgctaaaataagataatgaaataacataatcctttaatggaaggaaaccgtcttaatcaatttagatatgttctgtttgtaacacatgtagaggttatttgccttggaatgccatgatttttaagagataatgtaaaacaaaagtcagaacaaaaaggaacatgaggatgaagatgggattttgaaaggagaataaaagtcacagatctgggggatattgaatctggaaaagagatttttaagaaagaacactcatccatagtttcctaaaacttttcacaggcttttttcttaaaatgaaatcaataaagataatatagtgtcttcattgtgaaatttaacaagtataataaatcaaacaccctatgcaactaatttattattcatgaaataaactatgattagctcctataaaagaaacaaatgtatctcttcccaatcagaattgcctctttctgaataaagtgaatcttagtatttactttttccccctggttctgcactaatgtatccatcaaactattatctagttgcttttttttgcttttgaatttttttaaggggaatcatctatattgtttgcggaatttatttatttatttatttatttatttattatttttgagacggagtcttgctctgtcgccaggctggagtgcagtggcacgatctctgctcactgcaacctccacctcctgtgttcaagggattctcctgcctcagcctcccaagtagctgggactacaggcatgcattatcacacccagctaacttttgtacttttagcagagacggggtttcaccatgttgatcaggctggcctcaaactcctgacctcaggtgatccatctgcctcggcttcccgaagtgctgggattataggtgtgagccactgctcctggaaggaatttattttttttaattctgtgtttttaagatttttattttagtgaaactataatttattcatttttattgtttgccatttaaaaaatataacacaatttaactatgtatattactatggattagcatttgagttgttttgaatttttttgtgtgttacaaacaatgctgcaattgatatttctgtgcatatgtgcattgaattctttagcatatatttctagaaatagtaatggcaggtcatctcactttggttttctgctggctgtgatatttctcttagctcatttcttccttctttttatgttctgattactttttgtcattccatcctttctttctctataagttataggctcttactatctattgaaataggtagcctaaaaataaaatacatatactgaacttatcatagcttactgtgttcatcgtcatttttacccttctgacaggcatcacaaattaccttgaactctttaacaccatttctttcactcttttgccttacaagatactgccataatatttatcttaaaaaaatttactactaaaaaaaaccttgtaaggataaattattactgtttaataagctagctttcagttcagttacatttatcactcacttcctttaaacatcttagacctctctcctattcagtataattttacttgcctaaattattttcaaaagttagaatcttctggtagaatatacttctgttattgttttttctgaaagtaacgttgtttttgaaagagtttgacatgtacggaattctacattagagaatattttcttccagcaccctgcctatttaattccactatgtcttccattgttgctgctggggtgtaaaagatcagcgtaaccgccacttgcttgaagaaactctcttttcttgctatttaaaagattttctttttgtctttgatttcctgcagtttcacaatgatttctttaggcatagagctcttttttttacctatactgtttgagatttgtggagcttcacgaatctatggatctgtatctttaaacacttcaggacaatttttagtaatgatattgtaaacactgcctgtgccttattcttccctcctcttatcttcttcgggaaaatcccctccctactcaaatcacatgttacatattctcattctaatctctatgtctcttaactttgtcaacattcaatgtttttgtctctctgtgttcatttttgatactttcttctgaaggatctttcagtttaccaactgtcttgtcaatcaggaaaaacctgcccttaaacccgtccagtgacattttactacattttttttttaaagtttaattttgttattttcagagctgcttttttacttttttggagctttatggtttctaggtcgttctttcaaaattgcccttagaattatttattttaaaacttgatcttttggcttaagattgacttggcaataggaacaattttacactgttggtgggactgttaactagttcaaccattgtggaagacagtgtggcgattcctcagggatctagaactagaaataccatgtgactcagcaatcccattactgggtatatacccaaaggaatatatatcatgctgctataaagacacatgcacacgtatgtttattgtggcactattcagaatagcaaagacttggaaccaacccaaatgtccaacaatgatagactggattaagaaaatgtggcacatatataccatggaatactatgcagccataaaaaatgatgagttcatgtcctttgtagggacatggatgaagctggaaaccatcattctcagcaaactcgcaaggacaaaaaaccaaacaccgcatgctctcactcacaggtgggaattgaacaatgagaacacttggacacgggaaggggaacatcacacactggggcctgttgtggggtggggggagtgaggagggatagcattaggagacatacctaatgtaaatgatgagttaatgggtgcagcacaccaacatggcacatgtatacatatgtaactaacctgcacattgtgcacatgtaccctagaacttaaagtataataaaatatatatatatataaataaaaataaaacttgaagtaaaatatttctgcaaaagagatatggggatttagaaaaaattattgaaaatcaaatgatatcctataattacataaagatgaataaacattttgaagcttgctctgctgaatttttctcattttctccttcacaccagttttcacaatttttaatcctgatttgaaatatattttttactgtatcaatggggttatagattcactgaattccactgtgtttgtccatttggaggctctggaaggagctaacagaatgcaatggtttgaaggtggaaacataatccccaatgcaacagagtttagaggaggattttttttttttttttttttttggagaagacagagttttgctcttcttgctcaggctggagtgcaatggtgtggtctcgggtcactgcaacctccgcctcctgggttcaagtgattctcgtatctcagccttccaagtagctgagattataccacgcctggctaatttttgtatttttaatagagatggggtttcaccatgttgaccaggctggtctcgaactcctgacctcaggcgatctgcccgtcttggcctcccaaagtgctgggattacagtcgtgagccattgcgcacagcctagaagtggacttttaagaggtaattagatcgtgagggctctgttctcatgaatggattaatgctgttattgcaggagtgggttagttacataggagtatgatggggtattcacttgcccctttcactttccaccatggaaaggtgcagaaagaaggtcctcactagatccagtcacctcgaccttggccttcccagaacaccataagaataaacctccgttctttataattacctagtctctggagttcttttatagcagcacaaaatggacaaatacagaagacaagatgagagtgagaagaaactattcatgttcctgggtctttcatttaatttcatcaagggctagctgtgtcactcggatgaaggccaaccctcctgttcaacagcctatgctacagctatagtgtctaggatatgctggcagctaaattatttgcctcattagaccaagtggtgataccagctcccttactgcaagtcactaacactgcactagtatgtgttggttgaccttacctctacacatacctttataacaactaacaactgtccctttattaaacttaccaataatctgttcctctttactaaccattttctgttgagaccccgaattatatggacctagaatggcacattacttttctatgaatcaacattcaatagatagatactaaagcattttatagagaacttttttggtggagatatatatatatatatacatatatagcacacatatataaatccacatatatattgtgtgtgatatatataatatatatagatttatatatatattatccaccaaatatatccatattatatatataatctccatacatatatatgtgtgtctatatacctaccaaatatatccatattatatatatacacacatatatatgtgtgtatacaattttatcatatgcaataaatacatacatgtatatgtatatatgtgtgtatatatacataatattttactcaaggaccatttattctattaggttaaattataaatatacataattacaattagttgccaaactaatgtgtagaaatggaatagacaggaaattgtaatacttaaaacacaatgttaaaaattaacaaatctaaatcacatactaaatatcatgttaaagcacaggaggaataatgtaaacttgaaattttaggccacatagactagtaaattggaagtcattttatgttaaacatgaatagaagagacaaagatatatttcttaattaattttcatacgccatttgtagagttagcaaaatttgccactgaagttaccgagcaatacgacctgcaagggtagaacataaatgaggcagatctgggcctgaggtactggtttgggattaatttgcataggttaatggttgaagttgcaacatgagtaatatccgtacaataaactgttaagagaattgccacaaatacatatttttgggaaaaaaacattatttatgagcaggagaaacaaatatccagtcaataaaatagataaaaagaaatgtaagggatttaattagataagaataatgctatcagctcactgtcaaatctactaatctgctggtaccttactcacactctctgtcttctctcctgtcacagtgtgttaaatgctcctgctcccacccaaacccagtcctttatattctggaccacattcctttttactgccctgaataagccctgcccctgcagttatcacctttttctcttgcattgtaattttttcttttctttgtaagatcactcttataggctataaccacgccattatactatctttaaaaaatagttcacctgatataacagccctgtgttagatttgattatatttttcatacaagtctttcatacctttctctagattttgtggtgtatatttcccagccctgttcatattgggaacaggcttggctgttcccaatatgggcttggctgcatcattgattgcctgatggaatgtcattggatgtgacatgagcagaggcttgatgatcacttctgttattttttctgctctcttgaattcctacaatgtgcatgagaagcacagaagacatgtaactgctggcccttcagcctgtgccctagaatgaagacacgaggaacaaaactggacccaactgtaagcctggagtgtcatcaggtcaagaccaatccagtggagatcagccaaacagagccaatcttcaaacaagggagcataaaaatcaatgtttgatgttgtaatccatcaagattttgaggcccatggctcctcaagctaaacctgtcacgttgttctctattcttgctttcacttcactttccttttttgttgagaattatgtccatgtcatttcatgaaacttgttacgttgaggtaatcaaagattgctagtctgacaaatcctgacaaatctgaaggtcactccttagccttcttttaatgcatttaacatatttgtccacttcctccttagaacacttttcctcggcttctggaacatcccactcacgtgattctcctccttcactgtcacttatttttagttttcctctttctcttcctggcatttcagtgttagagcacctgaagatgtggttctcagttcttttttcctttccatatatactcacatttctcttctgtacataacttacatcctagagtattttatgtcatctcctgatattacctatcatttttttgtaatgactaacaaatttatatctaatgtaagcctctcctttgggttctaacccactattatccaacttcacttgagattctaacagaatcctcaaatttaccatacgcttcattatttaagacaaaggcagcatactatgtaagacgtcgatatatgggagcctgaggttggtatatatgggagctctttgtactatctcgacaattttctgtaaatctgagactattataaaataaaaatattatgttttaaaatatgagaccccttttggataatgtacctaaatgataatttgacttaacagtggtagggaatgcagttacattagtcttcaggtagcagaataggccatctcgttaaatatgcactctttctctcttttgagtgacagaatctaaagatcatgagcctcaaaaatgaaagcaaaaagaaaaagagagaacatttttaaaagtacaaaccttatacacctagtatatctatattggtatgaattatacaatgacacatggaattaccacttgatatatcctatgattaaaaaaacatgtaaagtctggatcttttaattattgtgatcttctttcacaaaataagcaaatatttaatataaaactgattatacagttgaaattgctaatcactgcattacagagatttttctttcctcattaaatactctttagtaatttttaagaaatccaacataaacaaaggtaaagcttaatttctaaaattcattccaactagtaagaattcaaaagatctaatatacttatttatgtgacaagaatgcaaattaaattactgttgtcttattctaaaaacaatatttgcaggttgttttcaatagcaattaaaccctgttttaattttagtatggcatctccatttgctccgagtattacaccccagtcagggcctatttgcaggtctgttctattgcacaggctgtatgtttcctcctattttctttctctgtttcaactaagtctcccttttgtctcatacatttctcttgacactaaagctatgtattttatgctattggcggcttgtcctgaagatagttgtaaaatctgtctttttccaattatgagaggtgttccataaattctttggggaatattcattttgagatgtgcgcctgtaactcccattaatgttgcccatttaaacttgatttattgctttccttttctgtctaagtgactccagcctccccgttaatgcagtttgtttataatctccaaactcccccttacctaaatgcagtctctcacaaatgctttgcatgtaggtcatttattaaattgtaaaccaaagtaatataaaatcaactagttttttgaaaggctgaattttattcttttttggatgcctcctgccatgatataaaatacaatatttgagcttggtcaactgagaaagagtaaccttgcactaaaataagcctagctataaaaataacttgcttggattgatcaatgaaacaatgacctgaaaaaattaatatcacagaaattatagactagataatattttttaaaatggcatgtttgtaattttacagttgaggttgtattactagtctgtaaatccatttatagctgtgaatatgtagttgaaatattgtaaatacatattctcctgaaagtagccagtctgtaaaacaagttcctgtttttttatcatttcatctcattttcttcaacttttattttccaacttccaaaatgcctcatactactaagttgactcattcagtatcttagtttccagaacatcactgccctattggagtcactgtccccagctgtccccaagtcataccaaagagtttcagttctctttcagttgagttttccataacacatatagttttatagatattgtatattattatctatgtgcacatacatcatggaccttgtcatcacccaggatatacagtttttaaaactgtatgttggcattacattttctttactgccctatgattaatgttctagctaaactttgtcctttgatgaactattctcccaggttattgcttccttgagatatcatttaacaagttatttggcttgaatcttgtgaccaccatgtgaaccctaagtcatgccttttactatcagcttgcatttatttgctactttaatgttttaccatagtcatgcagtcaatataaaccttgggtacccctaagcatttcacttcttggattctgcaataggtagctcatagacaggctgcaaggctccagtgcatgtagatttacagctttcccaggaaacttagttacatttatgaattaaaaataaaatctctgatcaactcatctgggcctttttctcttctgaataatcactgttgtgaacataattctcaagctcctctttccacaggctgtactttcggcatgttgcccagccttctccttcaccaaagtgcaaacagtaatgttttcttctttcctctcttctctcaaaactaaatttcatctgcactttctcttcctgccagggtcaggtgaaactacccccatctatacccaaggttgccatcttctccttcttctagaatcatacaaaattagtttacttatctcttgtgcttttagtttttctaaattatgtctcctcttccttcgttttctctttctcctcctattgccataaattcataaaatatttttcagtgtttttagtatttttaaacctttctctagcatgccttcctttagtatcgccaggtttaatgaaaaagacaattcacctttattgcttcatttttaaacagctctccccctccaccccccaccacctccacccaatccactgcaatttgatgattgcagtcaccattttaccagtcttgaaaatgttgatggtggccaggcatggtagctcacgcgtgtaatcccagcactttgggagcggatcacctgagatcaggtgttcacgaccagcctgtccaacatggtgaaaccctgtctctactaaaaatacaaaaattagccaggtgtggtggcatgcgcctgtagtcccagctactagggaggcagaggtaggagaatcgctggaacccaggaggcggaggttgcaatgagccgagatctcacgactgcactgtagcctgagtgacagagagagactccatctcaaaaaagaaaaaaaaaaaaaaaaggaaaaggaaaagaaaatgttgatggcatttaacatgcaagattcagcgatcttgtactaaccctcattggtttaaagtttgcacttgattttataatgatctcaatccctttctatgggacaccgtctactcttgatttctgagacatgagtacatttgatgtgcctccaagcattctgtctctctctctctctcaaccatgttaacaaatcctaaatttgtatatttggcctaatttttctcctgagttacagagctatatttctaatatttgctaaaattaattctaataagggaccaaaaccctaaggttccaaaacaaaactatcactgattagctacccagaaacgttaccttctttctcctgttttccctgttttacttaatctttagagtaataatgtattcttctttttgttacctttcaaattttcttatccttccaattttacatctcaactctctgctctcatttattttcctagtacaggtcctctcatctcatgttttaaaaaattacatgactgtattttaattatctctttttgtaacatttaaaaaattagttacaactattttggttgaaaatggtcaaaacctaactccaagtggttattaaaaataaaagaatagtaaataccagtaaggaccaaatgactgaaaactcagaagacattttagctttaggcatgactagctccaagtgtacagataatatatgcaggtatttgttcctctttatgcttcctgtttgcttacctttttgttgcctacaataagggttcttactctttgttctcataatgctgcttttagctacattctatcagtatgatcacgggataaatataaaatgtctattaactgatagttacaaataactgattatctatatatacttgatttactatttgccttattaaagagatgaaaggaaggaatgcttgaattggccaggtctgagatacaagcccattcaacaatgagaagggtgttcaaacccatgtggtctaaaagactgagactaaagagggcctgatacccaaaaaggaaaatgcttgacaagctaaataacagatccctgttatattctaatgcacaaatctgatatttggcaggtagagccctaaattttgagcctggcattaaggcccttcacatactccccgcttcctagctttcaacagcacaatcttagccacactgggacttgggcttctcaaagacagcatgcctgtgatgggtatggctcacattgttccctgaaaacccccttgtgttctccattgaatggcagtgcctcctctatcctacaaagtggagcccatatcctattttgctgtctttctccaaagagacgtactcatctccatccaggtgggaattagttcctacagtgaacatagtagcaaacgccctacaccgacctccctatatccttcctttgctgcttgaagtagggatcatatattgcttgccttttgatccccagccttaggcataatgctgagaagaatatacttggaagaattcctgacatagagtataagctcagtaaatatttgttaactcaagtctctacaaacagctgaactagcgcaagaagtagctgaaatgagcattttaacttatggatgccaatttgggttggaaacaactatgtatttatattaacttaaactttatggggacgaaatgatttgtttattgcatcttgatatttgaagttcatttcaggaacatactgctgaggggaaaaaatacaaggactggctgttctctgttcaccaaatgtttcagaaatttagtgcaaaatgtatgcttctattagccttccttcaattagtgattcatagctatcttggatttacttctcagtgtaacactcggcacagttttcagttattcagaacataataatgtccccaaacattaaataattatttccaccatcttttacacaaacagctttgttctccctaattttaactgatgctcaaactctcaaacaaatgtggcctttaaattttaatggaagtccatacaaaaaaagacataaaatgatatactattaaatataaacatatttaaacaaaattgttattcctttatacactatattttatatggtgttggttctctctgatgctggaaattcatctttatgatcaattaatgcaagatgtaaaattgaatatagtacttgacttatgaacccagaaaacactaagagcatatctgacccatcctgtgcatctattcacaggtcatagccaagtcaaacacagacacaaagttattttggcatatgatttcaaggaaaatgcctggaattgcaataactattctattacaaaaattgatatgcaaggtcatgatatgcctgagaacaatttgatcattatagtaatgtttacatttacgtattcattcattcaaagacatctagataaatagggaggctaaataagagctatataagtatggttatttcatattcactgtaaatttttgctagaaagtaaactcattaagggaatgaaccatttctcttccacacatctcctatgcctaacccaacacctaacacatacaagaggttggttggttggttgtagttattgtaacagtagtcttcatcttcaatatccaccactacatttaaactgtgaatcccataccctacaaattcaataattgttagtaacaagaaaaatgtttctgaaaagccaggcatttgggccgggcaccgtggctcacacctgtaatcctagcactttgggaggccagaggcgggtggatcacaaggtcaggagctcgagaccatcctggctaacacggtgaaaccccgtctctactaaaaataaataaataaataaaaataaataaaaaaaattaaaaaaattagcctggcgtggtggtgggcacctgtagtcccagctactcaggaggctgaggtaggagaatggcacgaacccaggaggcagagcttgcagtgagccgagatcacgccactgcactccagcctgggcgacagagcgtgactccgtctcaaaaaaaataaaaaaataaaaaataaaaataataataataaataaaaagccaggcatggtggctcatgtctgtaatcccagcattctgggaggccgagactggatggatcacctgaggccaggattttaagaccagcctggccaacatgaggaaaccccatctctacgaaaaatacaaaaaaaattagctgggtgtggtggcggacagctataatcccagctactctggaggctgaggcaggagaatctcttgaacccaggaggcagaggctgtagtgagccaagatggcgccactgcactccagcctgggcaacaagagtgaaactccatctcaaagaaaaaaaatatatacacaaaaacaatctgtctcagtagagaaagaaaataaaatctgaaagttaggatgtgaatgagcaaaatgtgctggatacaggaaaaagataatctgagttcatcaaatgactcaggattgactaataatgttggccagaaaccatgactggtatttaaaagtccagggaagtgtgattcattgcctcactgactttttcttatttaatattttaacacatgatcttagcaaacctgggattcagtgttaacagtgtgtggaatttactaatttacaggcttctgttttcaataactactctcatcttaccagtcatctatcacgagcatctcttcttctgaaacaatagatcagacatgtcatctgtaatttatatatatcttccaccagaactgttactcttatttcagttgacaagagttatctgcttattgcaaaactttggtacaattaaaaccacattgaaatggatgaaatatccagggccaaagcctgttaatttaggataaaacacgggcctctatttttaccaatttcattatgattatgatcctcaccaaggttggagaatcgctggattactctttctattaaaataaatttaaacaaaagaaaataaaataacaggcacctctctctccacccaattaatcaagttcaggtaaaaattctttgtcctaaaaacttacatatccagcaaccaaacttgccctctgttcagcaatactctcccatttttacatattttcttcctcattatattacatatttccacagtttaaacagtttggataaaaatataacaactaatttttttaaagaaattcagcttaaattaactaatttgaaatatgtaacttgtagataaataagctacagctttcaaattttaaccaggctccacatatcatatgcacagatgagaagtttgtgctttaataggtcaggctttcttacagtacatgaatgagaaacctaactccactgcataccttatatctaaatctttgcatctctgtttcctctgcctggactcatcttccttccccaccagatcattttatgactgattcctcattattcatacctcaactcaaaagattgattatcttcagagcatttattaatatctgaaatttcctaatctgtttgtttcacttatattttgttcatctcttatctccagagtatttgttgtcaaacatctagaagtgtgccttacctataacaggtgctcaataaatatttattaaataaataagcaaatacaaggctaaatgagtaaaaaaatgtatgaatgctttgtctattaggagttatctttcataattaatgtggacttccataatattgttcaagtattttaatgtgcaggtattcaagtaaattggtattttatctcaaatatagaaaattatatatgtcttccattaaagtaactttacaaaataaaaatatactacaaaatatcaaagatataggtaatatttgatgagttaattgaatcaattggtcaggaatggaaaatattctgaagaactgtctctactcccaatcagttgactcattttagcactaaactgaaaattagaagacctgaattctaattgtatcaataatctaaactaagtttgtggtttgggtttgtataaaactaagtgctcagatgatgtaatgctgaagttccatttccatttcaactttaagattctgtgaatgaaatggaaatgagaaggtaaagataacttcagcattctccagtaaatacaaaaataaacatattgatatggttaggctgtgtccttacccaaatctcaccttgaattgtaataattcccatgtgtcaagggcaggaccaaatgaaggtgattggatcatgggggcagtttcccgagtgctgttctcctgataataagtgagttcgcatgagatctgatggttttataaggagttttctccttcactcggcgctcactctctatcctgcagccctgtgatgaggtgccttccaccatgattacaagtttcatgaggcctccccagacatctggatctgtgagtcaattaaacctctttcctttataaattacccagtttggggtatttcttcatagcagcatgataacaaactaatacacatatgttgcccaaagaattaataaatcctcagagtttttacaaaactgataaagcttgcttataatctacattctgtaagaattatagtaaagcctcttgtttgttttacactttggttacaatttagaatttatttaataatttacaaagtactttcacctacattatcttaattgatgctggcaactatacacatatgcacacagccctgtgtatgatcagagatggtatcattcctaccatccccctccttgtatctcccaaaataaggtaatcaatgtttctagaagtaagtggttccctgacatgtgcacagctggaagtcattggcatttttgactgagtcagtattctaagtgataatattgctattacctcctgcatgctggatctgtttgcagccgtattgcatgccttattagctctcacttgtgtttaaacatggtcgccaaaaatcagagccttatgtttgatgcctttctcatgagatgtaggcccacacatccaacagcctgctagatattgccaattgcatatcctacacctatatatggttcagcatctctgaacatgtctctcttaaagcagttcttcaatcctgtcccctgatacagaaaattgcactattcattattcagcggtctgaactaaaacctcagaagtcttccttgacagaagaatactgggctggtgataagattcgggaataggcaacactggtagtaaaaaataccaaagtgactacttgagggagtggaaaatacaacaaaaggaatagcctaggtgactttacattcactgggcttaaatctagcctagaaataatgccctctggccactgccccagtgcattcttatagtgcacgctgataaatcatagtaaaaatatatcctcccttttgaaacttgcctacagttcttatcattgaagttttatgtccttggatatagaaggtattttcattttcaccaactctgtaaaaaaaaaaactacttctggattatataaatactatgaaaatgtatcagtttagagtcaaacaccaatggtattatatgaaatatttgatggaactatcctataaggaagcttccaatttagacaaggtgaacgttagtttattatttaagtagatattagtaaatatacttatttatgtatcaaattgaaagatgtgtataatttccttatgaataatatatttataatgcacatcatcttttgcctttaatctgcaaagatatcctaataaattcatatattgtacatcctttgctcaaagaagaacactttggaaaatggccattgctgtgattattgtggatttatgtagcttccagccacatactgcatgtttgtttctggctaaaatctattttttctaatgagcacactattaaaatacttaaaatattattcacagattgtctcaatggggaaaaaaagacatgcagactctggagataaacacctccagttaaatctgggctctggggttatacctgtgtgctgttgggcaggtccttttacttgctttatttgcatgatgggggtgatagcatacaggcacctgttgtataagattattataagcattaaataagttactatatgtgaagcatttgaaacagcatctggcacacaatgctattcgtgtctcctcttagttttgatgttgctgttacatatccctgaatactattgtccagttccttccatttgattccactctgccctgaaaggtaactactgtactaaattccatttaaaattttgtgttcatttgtagagttttagtacgtatgtatctctagttttagcaagtatatgtgtatttattacattttaagatctttatggagctttactgtatataaaattggtgctttgctgtactgtaataatgcttttttctacccaatactggttctaatgttatctatagtgttgcatagagttgttatttattcttttttatatccctatgctaccttatgtgtaactatactagaaattaattttccctcctcttataaatatgtatttggtattattgatttttgaataatttttaataatgccagatttttcctttggtactatttagtatagtttatctttttttcacctgtctactgtcatcctttacgtaattttacatatataatcgaatggaataagctgagggtccattttggcttgacatatttggaaaacacaccccaaaaaatgtgtgacttacagtaattcaagtatttcaattctagtagattcagtacaatgacaattatatgtttaataggcaaagtcttccctttaataaaataaagcatgtagaactgttaataacacctatgatgtggttatttatatttaacacttgtaaatgaagctattatcagggtagaactggccactgaagaatttttattgcacacttgacattgtgccagaaatttttatgggcagatattgttaagtgatatatttcttttaatatatttgaacacatttaaactaacattaagaaaaacaaaccaacataaattttatttatttttttaaccatatgatcctatgttttcttaaaaattttaagttcaagggtacatgtgcagttttgttatacaggtaactcatgtcatgaaggtttgtggtacagattattttgtcaccgggtattaagcctagtacacattagttatcagaaaaccgaattccacatgttctcacttacaagtgggagctaaatgattagaatgcatggacacatagaaggaacaacagacactgggattagaaaaaaataacataaattttagtctaaatgagtgtgcagaactcatagaaaattaagaagtgacactaaagtacacatgtaataaactatgaaatagtagacagaaacaatctctcgtggcatgccaaggggttgaactaatcacacatcacagagcttcagtaaccaaaatattttacttagttttggagaaatttcctttcatctgaaaggaagatgattatctttagacagtcaattatttttaagttatcgactgggtactttctttacgtgtgtaatttaatccttacatctcccagatgcgatgttactccattttacagctgtgaaaaatcaaatgaatctagaggccctagatgaacctttcaaaggggtagattttaggaaacaaggatggggtgcaaatgcaggatgatttcactgcagtctcattttcacctttgaaaggaagaaactggatatactacactgaagaacagtgctgtctctattactagaagctttctcaaaaatttagatggcaatcatacaacaattggataatcagtatacaagacatgtaagacacattcaaagggaataactatatatgaaaatcaaccattaagtaaagatttaaagtacttattttccttttaatattagcaattgaatgagatggtcatttaaaataattatttccaattattaaagaattcataatttactgatgcatatcaaaataattagctgtcaattagctgtcagaaaagagaaaagcttgtgaaattctgtaaaagggcgagacttctctcacctatgacttccttggattatgttgattcaataaatgccacggagttttattcaaccaagaatttatgcctctcattactaccaagtgacagactcagtgtttggcttaatcttgatattctattgagtttaaccacgtgaaataaaataaacctggcatttcagaataatccagcaattaaggaaaactatcattagcttataaataactaaaacaagtacaaacaaaaggaaagcaagtaagtacaaaatgaagcttgcttgttgttttatcatttcctccaggttcaaggtaatcttgtcaactattcattgttttcctaaagtaataatcaagcctcgtatagaatgaaaccataaaattcatgcagaagattcaagaaaagacatgagtgagagaatactgtaaataaataattgtcaattaggaattaatatagaatactatatatttcccacaaaacatactcttccttatgagatgacaggtgatacactcttatgtcaataactatgcattacagttacttctagctaacaccatgtttcacttatgatacactatattatatttggcattttgtgatgccagttcctttgggattacaaaaaataataccctcattaacagaattataaatatttgaatgctgtgccaacatttaactcatatctgccaatcaaaaagggaaaatgttctttattgattggaaaatggatcttgtttgaagataattgactctgagtctttcattgacataataccacctccagaagaaacatacactcaacttagaaaacaaagcttagatgtaagaggctgatcactttctccttactcaagcacagttcctattgactagatgaatattctgtctgcccatgaattaaaggattatagatcatctagtccattttggaagtttaaaaatgtctttaaataagaagcttacccagaaacagggcacaagaaatacagaaaaccataaatctctcatagaaaaagatgtggatggggtaatcaacaaaacagcaactattgaaaaaaaataaaaataaatgcatgcataaataagtattttaccacactaaaatagttactgctaagatgttggtaaaaatgagatgttgagtttgggaaatgttaagtttcagataagcaaccaatacaacatccaagtaaaaatgtccagtggcagtagattaaaagaatctgctatttagtattgaggtagagagtggtagcatacagccatacctacatatatgtacacacacgtagctgaagaagagaagcctggtgctgaagcaccaggggattacagccctaaatatcagggaaataagacgtggcagtaatgaaaactgagaaacaataagaagtgaggtaaaagataggcaagtgtggttactcagaaggcaaggaaagaaatggtccaagggggagggagaaatctactctttaaatattcttggaggtcaaataatttgatctcagaacggaccttgtggtttacgacaggacttcaataaaaccagattgggggagttataggtatgaaaataggattttatagggttcaaaagagaaaaagagatgaaccattatagatattaggtatggacatcacttttaaggagctttcctgtaaaatggaaaaagaattgaattgttggtccaaagagaattggcttcaccaagagtgatttcatgctaatgggaataatccagaagaggagtgatgctagtgaggccagagagagagaagcatatgcaaacatgaggtctgtagtgggcgacagccaagggaatctagttcacaggtggagggtctggtctctcttaggaacacagacaattcactatagcaatgagatggaaggaagaatatgtcagccatgtttcagaatataggaaatccagagtgtgtggactggacacagagtaacatccatccaggctactgtgaaaatgacaatgatcataaagttattgttaggtggtaagttttcacaggtagtaaatatcagctatttctggggggtggggtattgaggcatatgctatttattgggttctcccatgcccagcacttgtgactatcagaacagaattgacagagttatgttcatgatcacaaagctgtgattcttaacaccaaacattccttatccagaactgagaaacagtaaactgtcccaagccacacatgcagctacagagaatcttgacctttcagaaatgactgaggctcacctttctcagatgagcaatcagctcactttaatagtctaggcatcaatcaatacactttaaaagggaaggatattatcccctcccttaaagtcttaagagagaaatcagcatcactaaaactaaagtgtcacaaatgtataaaataaagtattcagtgaaaatattgcatctaaaaaaaccttcattaaagataaaagcaccaaccaacatgctctcatgttgtgggccaaggggtctgctgccttggcctgtagtcctctggggagccatgtggcagagaggtctgggcactgttgtgctcacccacctggtgacacagttgcaaatgtaacagaaggcacactttgggctctcacttgctccaaagtaagagagatatgccagcaatgaaaactgagaaataatgaaatactcccacatccaagatggccattgaccctagagggcaccccttcaccatcagctctggtcagtgacactcatgggagtggctgcaatgagacttccctctctcttctgggctccttgatcacccacaggtgatggttaattttatgtatcaacttggacattgtttttggatgagattagcatttaaatcagtgatctttcagtaaagactaccctctataatttgataattttatgggcttcattcagtcagttgaaggtctgaatagaaggaaaagttgtgcctacgggagcaagaagaaagcatccatcaggctggctttggacctcagctgtactgtgcactccgaggcgtggagcctgcctgtccacactgcagatttggactttccagtcttcttaattgcatgagccaatgtttcataataaatctctttctctatatacattctattagttctacttctctggaggatcctgactgaagcacctatgagaagctgaagggccttccatcagtccctcatgagaggcagagaaggaaaatgtctgtagcctaagggtaatgttctcagacgatagcacaacctcactccctgccccttctcccctgaactcaaagctgaagggctcccttagaattctgtttcccttcctcattcccacctcccacctctgaaggttgggctaatcccaagagacaagtggggaagtgtggtggccaacatgaaggcctggtccagggtctgctgacctcaggtgcatcccatccccagctgggcacatggagggcacaccgacagcttgtcccttattccccacaggccttgcctgtgtaggggaaagtcaggccatcgctccaccagcccataggctgctagctatagctgcacttgggctctttcctgcacagctctagcagtactttggtgtgcttgttttccatcttgctcttgggcattcggaagcaaaggagccagcccatgaggtccttgtgcaggcaagcattagccatgggtcatctgcatctccatctccagttgtgctcttaaccagtaggctgacctgcaagagcagcatctctgttggggtggccatgggcaagtgctgctgagctgtagggcaactagtagagcatttccagctcaaaaaccagctggatactgtcctccattattgtccagaggcagaaggaagggcacctctgtggcctcaaagttgaggaaggaaccccaccactggccccaagccatcagcagtcaggcaagcagcttgttgttcctgttccacatccttagtcccagcatccaggagtaccagatctttgaatttagggacaggatctggccctcctggtcatacactcacaggattcagttgatcatgtgctgtgaagcaacatgagatgttcaggagctctgtgtacctgtagtaccaactccctgtgccatctcatgggtgtcactgctttctaggatgtagccacaactgtactgatatggtttagctccgtgtccccacaaaaatctcaccttgaattgtaataatccccacatgtcaaggggattatcctagtggagataattgaatcatgggagcagttttctgctatgctgttctcatgatagtgagtgagttctcacgagatctgatggttttataaagggctccctccttcactccacactcattctctctcctgcagccctgtgaagaggtgccttctgtcatgactgtaagtttcatgaggcctccccagccatgtggatctgtgagtcaattaaacctctttcctttataaattacccagtcttgggcagttctttatatcagcatgaaaatggactaatacattaaattggtaccaggagagtggggcactgctataaagatacccaaaaatatggaagcaactttggaactgagtaacaggtagaatttggaacagtttgggtgtctcaaaaggagacaggaagatgtgggaatgttttgaacttcctagaggcttgttgaatagttttgaccaaaatgccaataataatatggacaatgaagcccaggctgaggtggtctcagatggagattaggaatttcttggaaactggagaaaagataactcttgctttgctttagcaaacaggctagtggctttttgcccctaccctaaagatctgtggaactttgaacttgagagagataatttagtgtatctgatgaaagaaatttctaagcagcaaagctttcaagaggaagaagagcataaacgtttggaaaatttgctgtctgaccgtgaggtagaaaagaaaaacctattttctggggagaaattcaagctgtctgcagaaatttgcataagtaatgaggagctgaatgttaatcaccaaaacaatgaggaatatgtctctagggcatgtcagagaccttcgcagcagctccttccatcacaggctgtattagtccatttcacactgctgataaagacatacccaacactgggaagaaaaagagttttaattggacttacagttccacatgcccggggaggcctcagaatcatggcaagaggcaaaaggcactgcttccatagcagcagcaagagaaaatgaggaagaagcaaaagcggagacccctgataaatccatcagattgtctgaaacttactcactatcacgagactagcatggaaacgaatggcccccatgattcaattacctccccatgggtccctcccacaacacgtgggcattctggaagatacaattcaagttgagatttggtggggacacagctaaccatatcacaggcccggaggcctaggagggaaaaatggtttcatgggctgggcccaggaccttctgctgtgtgcagcctccagacttggtgcactgcatcctagctgctccagctatggctcaaagaggccaacgtacagctcaggccattgcttcagagggtgcaagccccaagccttggcagcttccatgtggtgttgagcctaagggtgcatagaagtcaagaattggggtttgaaaaccttcacctagatttcagtggatgtatgggaacacctggaagtccaggcagaaattttctgcaagggaagagccctcatggagaacctccgctagagtagtgcagaagggaaatgtggggttggagccccacacagagtccccaactgaggcattgcctagtggagctatgagaagtgagccaccatcctccagaccccagaatggtagatccactgaaagcttgcaccatgtgcctgtaaaagctgcagacactcaatgccagcccataaaagcagccaggaggtggtgaggggggctattccctgcaaagccacagggttggagctgcccaaggctgtgggagcacacctcttgcatcagcaatgacctggatataagacatggagtgaaaggagattattttgtaactttaatgtttaatgaccactctattggacttcagaattggatggggcctgtatcctcttcattttgatcgatttctcccatttggaacaggtgcatttacccaatgcctgtaccctgttgtatctaggaagtaactaacttgcttttgattttacaggctcataggtggaagggacttgccttgtctcagataagctattggccttggacttctgggaagttaagactttaggggactgttgcaagggcatgattgtgttttgaaatgtgaggacatgagattttggaagggccaaaggtaaaatgatatggtttggctctgtgtccccacacaaatctcactttgaattgtaacaattcccatgtgtcatgggtgggagcatgtggagataactggatcagggagcagtttcccccattctgtgcttgtgatagtgagtgagttttcgtgagatctgatggttttataagtggcttcctctttattcagcactcattttctctcctgaagaggtgccttccaccatgattctaagtttcctgaggcctccccagccacgtggaactgtgagtcaattaaatctctttcctttataaatttcccagtctcaggcagttctttatagtggtgtgaggacagactaatacacataccaaagcagggaacaagggaacctggaagggcattgctacatgaccacaatggatagccaggccttccaaatcctgaaggaaccacccagattgtgtgcatgcatgtgttgaggtaaggggcatattgggagtgggtgaccccctattttgagaatgcatccatctaccctttactttctccaaggcatcaaatcggcttttttataatggtctttagagtctcatctcagtaaggaatgcaatggaacccaatgtaatccaggccctctcaactacttgtttatacttatgtacataatgtattttaatgtgtcactcatgtcactgcttaagctgggaaagcactttttctttggcatcctagggaatctctactaatatatatgttctctctttgtattctttcagcactcatcacacacttacaacactcactatataatctgaagtttctggcctaagtgtttgcctttcctagtaggatctaagaatagctattatgtcttaagtatctttatatctccaattcttagctcagtgctcagaatataaatgttcacaaattcctgcaaaattgttcatgtgtaaaaatatatatgtatgcagtcacacatatacagagaagagaaatgctcattctaagcaactgaaatcaattcctttcaagaagagaactgcctttgtttagaaaaatgctttgataagctgttttttaatgcatggtttgatattaagggtaggaagaaaaaaacgtatagctaattacttcaactctaaaaaaacatgaaggaaattccttaagtcttcggtaaagtgtgtcatctactcaatgctgtctgtttgtatttttgattgttgtttattccattctgtgttagagtaagtcaaataaagtagcaaaattaaatgtagttaaaagaggtaaagcccatgctagtgtataagctgatttacaaactgattaacacattagtgaaagatatttgaaaacaagtgagcttccccagttccacctgtgttagacattgattgctgcttactaatttcattttctcttctgcctgggcaaattgctaaactacaactgcaaacactccctatatagttgttcatgtgactaagttctatacaaaataatggagtttccaaacctgttttgttcaatggaaacttctcatggtgactatatattctccttgcttttactgatgacttgatacagacaagcaaagaaaacttgaaaagtatgcaaaaagctacaagatggaaggagactaggttcttatatcatgtcttggaagataggctcttaccaaatggaacatccattttggacttcagatgagcatgaagtaaatttttattccattgagtcttcacatatttataatatttaggaagtttagcagatttctgcattaatgcatataaataaaatattcaattaacatgcaaaaataaaaccgatctagtaaaaatgtattagattctgcagatgtaggataatgcagtttttatattacttccatacttcagttatgtcaataattctcagttggttttctcttatactttgtagaatctcaaaaaatctgatacatgttgattcaagtgaaaagaataaagcttcctatttactgtggtaaatactgaataaaatctctctcatttttataattgtattcagctcaattatgaaacattagattcttaatcttctattttaatatcttattttactcttcattgtagtcttcacatatttttgctatgctaatatatcaaatatacatttattaaactttacttaaaaatatctaattatccttcaatattaaagaagataaatattttgatcactttctatatatgttggttatggtggaaaataattgtataaacaatatcatattaatattacaattctacatgatatactctttgatagatgaggatgtatacgaggcattaataactaatttgcccaacatgacactgaattcaaacatactactatgacttcatccccaaactgttactttaatctgtggtattcatcagtattattatcttcaactactgtattacgcatatcatcactggaatttttattgtcctcctaacttatgctatatgctcatgatgtgaaaacctatatttttatcctagatatttcttgtatatttcagacacatatttatttcttctagatattagtatatggaggaaattatggcacttctgacttatcccaaaactgaaccaattttatacacacttaaactttcccctctttctacacttaaacttcagtcaattgaaaaaccatttattttgacaattaagtcatagacttgatgaacactctgaattcattcttctgttttgctccccatattcagtaagtaagcaaatttagtcaattctggctcttagatccttcttagcatcaccctgttatcttggtctttgtatggatcagggtgacagtgaacaacaaatggttctcccagtctctaagtttgagaagtttaacaaagggaaaggtttagggaaaccagcaggaacaatgcagtacccctgggctattgatgttagagtagcctttagcctgtctcagcttgaaagatagagagcagtaaccagaaaccagagtattattcatatagagatggtgctatttatcaagagatacagtctttggaaagaataaggccaaataaataattacactcagctgactgcatgcctatcacccagtctcctgctcctatgtcctgttggctgaacccagaatctaattggaaactagagaacaacagagtgcagttggtttagctcagccttcaagggcaaagattaggacacagaagagtgcagagtggatctggaggggcaaatggaagatgagcctttgtttggattctcatcatcccttttcctagcttctaccctatcctctaatttgctttccaatttaaaccaatgtattctttcaaaatagggaatttgatttttcctcttcatggcattgaattctgaatggaattcgggcatattcaaagataattaaaaacatttggtaatgtataaaatactttaatatttggcccttacttattggttatatgcctcactcatggtctaaagacttgctaatttaaatagccatgtttttataaatgatctttcaatacgctggtgagctctctttcttccttcaataacttgctcaaaatttatttatcagtggaacctccattagttttcttcaaaaaataatgctcatcatttacacttctgtaaatctttatacaggttaacacttgtcttaggtagtgtaaacatgtgtatacatatctggggaagctatactttttgtgctgtggatttggaaacactgtttatctttgtgcagatatcttatatttactacataatatcactttagaaatatgatggttggataatactaggaaaagaaagattttgtggcaatgacggatgattctctatctttctaaatatcttaattttacttaacaaatttatgtctcccttttattattttctttttatcatcgaattatgttatttgagatgtagatgcagatataaatatgatctggtggagcctcctcattccgtactgtaaagataaggtgctgtgaatgtcaatgtgatgcatcatttggtatttaaattgacagttaactcagtatttttgactgtctggtgtgttctccactacatcttattatctaactagatctctttcctttttagcccttctcccctgcttatgtgtgagatttttcagtgaaactcagtaacattcatagccttttctggactaattcagggcataaaattaactcctcaaccctaacatagttcctaaagattgtatttaaaggattaggtgaccaaaatattggccagattaagacagaggaataacttggaagaagtgaaatttgaaaaatctacagataatgaagatggagtgtagcagagcacaaatgtttccttattcactttatctggaaattctgccgtatcattcatattcctgaatatgaggtgtaggtgaggtaaagaagaagtgagtgataagcatcttaatgtgatgacatccataaaatctacatgtcacatttcatccaagagcagattttccatttgaattatgaacctctgcaaataggagacagaaatggaaaacctggaacatttatcactctgggccctggcagattgaaatgtgatgacttcaaaaaaaagtaagttttggttaagttctgaacagaattatcagaaaaagagaagataatttttataaatgtagtgaatacaaatatagatattgactttaatgtgtccttatttaatcttatgatatgtacagaaatatacgtaaatattatttttagatgattgtaatcttgtgcaactgtacagtgggcatactctgcaggctttcggagctacattgaaagtcaaaatgttcaagtgccctgacaaagttgtgatgatttatgagacacgactctctttcagtacagtgtaagtaagccagtgctttaacctatatatttgaaaatattcagtacagattttcgactgccaaaacatctttacgtgctgtttccaaagtgttatgtatgtatttatgcacatcgtgacttgttccagaaaggattaaatgtgaccaaaatacatacacggcaaaataaaatctaacttggcaaggaagagagtgaatgcagtgctgagtgatatagagaagcgattgctttgattgggggtaaaagaagatgttggctaaatatcttcttttatttcactgggaatcatgtgtatcacgtttatgaaaataaatagattcccaaatgctagattgtagctaaaaaaatgtttaagttaacaacttttattagatttattttatatttttcatttcaattacaaaatgaatatatttcctgcttaaaagaaagtctaaagcagacatatatgaagtgacagtctggctcctgtcttcttcttcacatattttgctatgcacatatatctcattttttaaagtacaaaatttacttataaagtacatggaatcattttatgaagtataaaatatagagcaagagtcaatatagacgctcttagtagacatggaagatcagatttcatttatgtatttgacgcacatttattacatatctatgataaaccaagctctcatttggacttgttgcaaaacaatgagggcgagatatcaacacatcctgccttctgagaagtgatggctaaatgggaaaagcagacatacattattcagatgcacacaaaactatacaattgcacgctctgggtaaatgccttgcaggagaattgtggacaggaataaagctagggaacctcacctacctgaaggatcaggaaatgtttccctctttgttgttatcttgagctgagctatcatgaatgagcagataaactggataaagaagttgcaggattgcaatggtcgtaaggtgctcatgtggaaagagatgagttaatttgtggaaacacaattggaaaaagactagttaatttaaggaaatataaaacatgtcaacgtgtttcaagtgtgaaggacagcattatgaaaaggagttgacatagatatagcaaaggaccaaatcatgcagcatgagatagtgtggtgggggcttttggtgtttccatctccttttccaactaatccattacagtattttccccttatccatggggaatatgttccaatatccccagtggatgcctaaaatcttggatagcactgaaccctatacatatgtactatgcattaatttcttttttattcttcacaatttcacagatagaccattcacactgtcgtactgtgacagttaatctgatcacagagacggttaccaagcaactcatgggtagggaggtttgacagcatggatacactggacaaagggaagattcatgtcatccagggtggggaagagtgtgtcggtgtaagatttcatcaagctactcagaacaacttaaaatgcaaaaattatttactctggaattttccatttaacatttttggatcatgattgaccatgggtaacaaactacagaaatcataactgcagataagggtgtagtactgtatagaacttcatttagataagatgtaaaaatgagactctaatcacgtgtaatgacaacaattccagggcttcttattgcttttcttttgtttgattaagtcctcacattaaagtcttggatgtgtctcaagtaaggtaatcacagttgttattttttcaaccattattactcactgaaataatatattttttattctttccttctgttaggctcagatgaaatgctgctatgtggtactaaattgttactctctctacctaaaggaaataattaatagaatataaaaagttaccaataacatttctcactttaatatttggaaatattgtgaaaagcaagttttacagttctgggaaattttaggtcctagcagggagtttataaatggaggctgctcttcaagatccctgtcaaatgaaacttgtatctttgtaagatttaaagggaaagtgaggccaacaaaacaaaagccaaggaaagcaaaataaatcaaaataagctaaccagagaggaaacaaaacacaattagaggtaattattttgtttatttctgtattctaaaaatttgtaaatgaaaataatttttccttttcagtacaagctacactgccaattaatcaaagagtctcatgcatgaggagaatttcttctttacagaaggataccagataatgaatgtatggtgaatggcagggttgggaataaatgtgtaagctttgagggggtagatcatccacagacactgaaatctttgggtaaaggattaatggagaaccaaatattcccatgctatctaactatcaccctatatattatttgccttttgagaggcaaggctttaagaaagatagatctgcttctcactgccttaaactgatgattcgtcctggcaacattaggataggaggaccagaattttgagtgcttggtgatttgcaataatattcagtgcacagtttcacccataagataaaattgtcaaagacatataaactctattgagtcaaacatctacctgtcaactgtactgttcatttcaacaagtcaatgtcatggaaaataaaggagagagagagaattaggagacatagcaaaaaatgtaatctgtaattctcaattgtttcttctttgaaggaagcatatatacaaataggtatgagaaaagctatgaattaggtagcaatagaaaattagtattaagtgctaaaatataactgtaaaatgcaggaaaccattctcatttttagatgtgtgaatttgagtatttgagggtaaaatatcaagatatatatgattgcatttaaaattccttaggaaaaatttatgaagtatatccagcaaacatttggaaattatttgaaatatacctatatatagtttctacatttatttctctgcttttctctgttggaggtatttaaaaattaaatacatacatacacaaaattaaacatgtacatgcatgtgtgtatacatacatataatctccaaagcatatcaacagtaaaactacttgatatgatgaaaagaaagaaagtaggaaaggggagggtaaaggagggaggggatggatggtgagtgctatgatctgaatgtctgtgtccttctaaaattcttatgttgaaacctaacccccaatgtgatggtattaggaggtaggacacttgagagttggttagatcacgaaggcagagcctttgtgaatggaatttgtgccaattttcacttttttttttcttaccatggggtccccctctgcctctcatgctgaagtgtagtggtgtgatcacagctcactgtaaccttgaactcctgggctcaagtaatcctcctgcctcaacttcctgagtagccgggactagaggtgtgtgccaccacagacagctaattttttgtgtttttaattttttttgtacagacaaggtctcattatgttacccaggctggtctcaaacccctggtttcaagtgaggctcccacctagcctcctaaagtgctgggattaaagaaatgagccaccatgcctggctggattaacacccttaagaaagaggccccagagagctgccttgtgccttccacaatgcagtaacatagaaaaaaggtgccacttaggaatgaggaactgtgccctcaccagatatggaattggcctgcaccttgatgttagacttcccagcctctgagaaataaatttttgttgtttacagtgacccaatctataagattctatataacagcctaaatgaattaagaaggataggaaagggagggtaataaagcagaggggagatcatatgtttaggaaaaacttcacattgccttaaaatatctagctttattcatgaggtttccatccataaatgttaagtatctttggattcaaagtctgtccattacaaaaatgtccatgcaaatttcaaatttgtgcctatgttttaactatttctcaatcctgttaaacattctcagctccagttattttcagaacttccagttttcaatttcttaacctgatattgactaacatccaggttctacatggtacctgattctgctcttgttttcttccatctgaacatagaaactaacttgttttgtgcaaagagaataatggagagaagtaacttattccaatccaattataatataacttgaaaacccagttgtaatatgagttttctaaagacttctgctgcccaatggtatgattttacacccacaggaaatccatcttattatttcccataaattgctataagcagaacttagaggtaataacaataactaatattcataaacaattgatattattgatgttaaactgaatacataagataaattatgcccatttgacagatgcagaaactgagaatcggaagtcaaccagtctctccagtttgctataaagaatctgagctagtttttttttcagcttttaatgcctccaaaattaatgcacttttcttcatgacatagactctttttaagacaatatttagtttgcagatgtcaaaattataaattgtttttcattcaaataatgactgcaatatgatttccaggacacacatgaatccactgtgagatacagcattttactttttctctgctatgaccacaagttgagaattgctacattttcaggctactgtgggcatttatcagcatgtttccagatgcctgggcaccagggctagggatcctctaggatcaacattacaaggacctacagtagctttaatcagatatacgcaatggcagcaattgccgatgtagtcttgggttcacacttgggagctcaaagaagcttctgtcaatacccagggtatactttagaaagctcttgttgcactgtgcctgaactttggattgtgtgctgaccttaattagcagcaatactgaacactgagctcgttactgtctgaatatcaccctaagtattgagaaagtcttacatttcctgtatatctaagtcaggtgtcagtaactgaggatatattcttgcctctataaattattcaaaggtgtgttttaaaaatatcttgggcatgaaattctaaagtccttctgatttggtttggctgtgtcttcatgctaatctcatctggaatataatctcccataattcccatgtgtcatgggagggacctagtaggaggtaattgaatcatgggggtgggtatttccatgctgctctcatgatagtgagtaagtctcacgagatctgatggttttataaagggaggtttctctaggcaaactcccttgcctgctgccatgtcagacgtccctttgctttttcttcatcttcctccatcattgtgagacctccccagccatgtggaactgtgagttcattaaacccctttcctctataaattacccagtctcaagtatgtctttattagtagcataagaacagatgaatacaccttcttaccttctattatttatttttcctatttgtgtgagccccatttctaatagtaggctcagaacagttccatttatatccatgaggacttttgttcatttgttttggtccctatatctttccatactatactgcttttggggtgaacaaaggtcgtgtattttacttggtgaatatttccagaaaactcagcataattattttaaaaagaggcacaatcctgtgagaacttatctgagccaattgccaggaccacacagcaagttctgttactttgatccaaaaggaggtcagttcctgctgattttatagtaaactagtaaacactgactagagtcctgactatatgggctttttaatttaacttttatgatattgtctctgaattctgaatacatatttctggttataattttgtaactcgtattacctgagatttgtgcaatccttttgttggttttttgaaatcttttatttttttaaatctattttatgataagacataaaactcatttgccttgtctaaaaatatcaaaatggtaacctattttctataattctcatgaaaacctgagctcccattctccttctgaatgaggcttctcttgatacattgagccctactgcaagttaattttatattttctaaacaaaaaaaaaaagtctccactgtttactggtactatgcttcccccagcgaatgtgtacaggattgcttatcaacattgtaaattcatccttgcttgtattgtatgatgtacaagtaaggcatgatgtgtaagcaagaaagcattttttagtctcagaaactcagtgtcaattaaaattattattttttgctttattgtttacattcaaaatgaaaaaaatccttttcatgtggtcatttctcaatacagatattgaatgcctttaagtagagagctcaggaaattatcattttacctccaatgatattttaaaactttgtcaatatcttggtcaataaaaaagctagtttttgtttatgttttgttcatttttgcttttaatcatagctaagtttagaaaaatgaaatcaatgtgtattgtcagaatgcaagtcacaaataagagttttcatttcttcagtatggaaaactggatacccccaatggccactccacatgaaattaaatattaaatattgaaatataagaaatgactcttaaatgtatggtgaagttctaatgacagaatggtgatgaagaattgtagtaagaaaaataatgaagggaaaataaagagagttggtgtataatggttataattttaatttattaggaaggtacaacagttctaaatgtgtttgaagttaatcatagtctgaaaatagaggtgactcacaaacaaaacactacacatggaaaagaattataatatatggaagagattagtgcactctctgaccaattgtttgagcaaaaataccattaaaaaataaagatatagaaaatagaaaaagcaaaaattaagaacttgatgtacttatagttcatatatttctttcttcctattttagggttcattattctgtatatgcccagtagatcatgcgtgagatcaataataaatgatcaaatgctaggctgcctgtgtcatagaattagtgtcatatagaccacattactgaaacataatctaattatggtagaaaaatgtcattcatttggacattaaatcacacagataaaataaacatctaaacacttgttgtgaaaagaaaacattataatggatattccaaaatatttctaggtgataaaatttgtaaaaccataaaagttttagatgcgacaaatgaaatgcattcatttcctttgctgctgtaagaaaattaccataaacttagcatcttcaacaacagaaatgccttcacagagttctggagatcagaattctgaaattggctttaataaaatagaagcaaagtatttgcggacttgcatttacttctagaggttctaagagaacatctttttccttgactttgccagtttctagagaccacctgtattacttggcttctagcctctttgttcatcttcaaagccagcagcatagcatctaccaatctctccgagtctgcttctgtctttcacttatagcacctttgcccttagactgggccaaccaggaaattctgaaagatctttccagcacgagttctgtaagctaatcaatcacacctgtgaagttccttttgttgtgtaagaatgtattcacaggtaggaggcattaggatatgcacatattttgggtgctgttgttctgcctagcaagaacaatattcaaaggactattagacttataaatgccttatactagaaggtaaaaaagcctcaaagttagtgaactgagcttccaacctgaaaaatcttagaaaaaaattctcagaataaaacaaagtaaattagtggggatgaattactagtaaaaaatattataaaagaaattataacagcaaagaaagctcaacaatggtaaatatttctctatatatactaataaaatggataattctctggcaatattaatcaagaaaataagaaatgtgttcattgataacattagaaataataaatactacagttgttggagtttatgccaataaacaaacttataacactaaatttgaaattttaaatgccatttatatatttctcaaatatccttaccaaaattgactgaatattaattataaattgtgaatgattctatagctggtaaataaaaaaaatcgataattcagtgccacccccactgtaaaaacacaaaaaactaggctctggtacaatcattttcaatggaattttaccaaatatttaatgtttaaataatctgtcttacataataattctatagaaaagaaaaagagtgattaatcccctagtcattagctgtgttaggtttaaaaataaaaattgatacacatttcttaagaaagctaaactgtaggcaaatctcagccaattatacatttattaaggtttttatatctattacaaatcaatctgaaaatatatttggaaaaatattaaggaaattagcaaaagctaaaaaatgatgagatgatggacttactagacaaagttataaataagctgttataaataagctattactaatatgtccaaagaactaaagagaacttgaaaatggctgactagatgcaaccgagaggaacatcccctactgaaaaatagggacatcaggaagattggcatgtcttcagagagaaggcactgagagtggaaaaagggaagacgcagacactggactaaatgaggaggaagctgggaaccctgcacagggcagcaaaacactgggacctgctcctgattcccagtgactccccagatacatgcaataaaaaaatgataaagaggatatcaccaccgatcccacagaaatacaaactaccatcagagaatactataaacatctcaactcaaataaactagaaaatctagaagaaatggatgaattcctggacacatacaccctcccaagaataaaccaggaagaagttgaatccctgaatagaccaataacaggctctgaaattgaggcaataattagtagcctaccaccaaaaaaagtccaggaccagatggattcacaactgaattctaccagaggtacaaggaggagttggtaccattccctctgaaactattccgatcaatagaaaagagggaatcctccctaattcattttatgaggccagcatcatcctgataccaaagcctggcagaggcacaacaaaaaaagagaattttagaccaatatccctgatgaacatcgatgcaaaaatcctcaataaaatactggcaaaccaaatccagcagcacatcaaaaagcttatccatcatgatcaagtgggcttcatccctgggatgcaagactggttcaacatacgcaaatcaataaacgtaatcagcatataaacagaaccaaagacaaaaaccacatgattatctcaatagatgcagaaaaggccttcaacaaaattcaacagccattcatgctaaaaactctcaataaattaggtattgatgggacgtatctcaaaacaataagagctatttatgacaaacccacagccaatatcatactgaatgggcaaaaactggaagcattccctttgaaaactggcacaagacaaggctctctcaccactcctattcaacatagtgttgcaagttctggtcagggcaatcaggcaggagaaagaaataaaagtatccagttaggaaaagaggaagtcaaattgtccctgtttgcagatggtatgattgtatatttagaaaaccccacagtctcaacccaaaatctccttaagctgataagcaaattcagcaaagtctcaggatagaaaatcaatgtgcaaaaatcacaagcattcctatacaccaataacagacaaacagagagccaaatcatgagtgaactcccattcacaattgcttcaaagagaatcaaatacctaggaatccaacttacaagggacatgaaggacctcttcaaggagaactacaaaccactgctcaatgaaataaaagaggacacaaacaaatggaagaacattccatgctcataaataggaagaatcaatatcatgaaaatggccatactgcccaaggtaatttatagattcaataccatacccatcaagctaccaatgactttcttcacagaattggaaaaaactactttaaagttcatatggaaccaaaaaagagcccgcattgccaagacaatcctaagccaaaagaacaaagttgaaggtatcacgctacctgacttcaaattatactacaaggctacagtaaacaaaacagcatggtactggtaccaaaacagagatgtagaccaatggaacagaacagagccctcagaaataataccacacatctacaaccatctgatctttgacaaacctgacaaaaccaagaaatggggaaaggattccctatttaataaatggtactgggaaaactggctagccatatgtagaaagctgaaactggatcccttccttacaccttatacaaaaattcaagatggattaaagacttaaatgttagacctaaaaccataaaaaccctagaagaaaacctaggcaataccattcaggacgtaggcatgggcaagtatttcatgtctaaaacaccaaaagcaaaggtaacgaaagccaaaattgacaaatgggatctaattaaactaaagagctgcacagcagaagaaactaccatcggagtgaacaggcaacctacagaatgggagaaaatttttgcaatctactcatctgacaaagggctaatatccagaatctacaaagaactcaaacaaatttacaagaaaaaaacaaacaacctccatcaaaatgtggatgaaggatatgaacagacacttctcaaaagaagacatttatgtagccaacagacacatgaaaaaatgctcatcatcactggccatcagagaaatgcaaatcaaaaccacaacgagataccatctcacaccagttagaatggcgatcattaaaaagtcaggaaacaataggtgctggagaggatgtggagaaacaggaacacttttacacagttggtgggattgtaaactagttcaactattgtggaagacagtgtggcgattcctcaaggatctagaactagaaataccatttgacacagcaattccattactgggtatatacccaaaggattataaatcatgctgctataaagacacatgcacacgtatgtttattgtggcactattcacaatagcaaagacttggaaccaacccaaatgtccatcaatgatagactggattaagaaaatgtggcacatatacaccatggaatactatgcagccataaaaaagggtgagttcatgtcctttgtagggacacggatgaagctagaaactatcattctcagcaaactatcacaatgacaaaaaaccaaacaccacatgttctcactcacaggtgggaaatgaacaatgagaacacttggacacaggaaggggaacatcacacaccggggcctgtcttgggttgtggggagcggggagggatagaattaggagatatacctaatataaatgatgagtttatgcaggacaccaacatggcacatgtatacatatataacaaacctgcacattgtgcacatgtaccctagaacttaaagtataataatgaatatatgaataaataaataagttcaatgataggaaaaaaaagaaagaggcaagttgaacatgtgaggagtggccaacactaaccacagacctctggaattctggtgcacaacccacgatcccatggacacttaagctagcaggaagagttggttgggaaggtggcaggggaaggatgccagcctgtatggagcccaaagaatttggttcaggaagggttgtagtggagtatggccagggaggctcatcctccaaggcttgccaagctcctttagctggctttagcttttgggtagtgttagacctggacagagcatggccgtcttgcccaggggataaggcctgtcctatctgagtggccccctgtctgctggcctttcctggggccccaacctgcccacgcatgcttgcagggcatatttgaatgcccaagcagggtgcttcctggaggccctcatcatagctcctttcctggcagaccacacctgaccatcagagaggtcagcaaactgacctttgttgactcaaccagcccactttcagcatcccccccacagtagccttccccttttgccttgccggcacacacttgcccactttcttgaaatcccatcactttgtcagtatacacacttgggtggaccttgcctcccctcctccaatggcatgtgtgcaccctgctcccccactgtactggcagtgtcagtgcatgccgccatccagatgtcaccaccaccagcatgctaaccccatggaggcacaggcagccagccatggtgttcccgccactactaccagtacaagtgcatgcatacatgttggcaccctaccccccccaacatgtgggcactctgcctcaccattgttgcaggcataagcatgtgcatgaaggcctctgccccattcctgccagtgccctgcccccagctgacagagcgcaccctgatgcatcactgcagcttctgacacatgcgggcaaacacagattccactgccaccacccctacagagcattttggccagcacacctcatcagaatgttggggctagtggactggaatcatctcaacctcttaaatgcagtaggttcataactttgagcagttagggaataaagctggggcctggtaccagatcccagtgatagagcacatagcccaagagtgcagagctgaggcttagccccctgaaatcttccagaatcaaagctagttgacctaacatcccttataccagaatcaaacccctaagggcatcaaagaagataccagcaagaaaactaaataaaaagaacagaaatatcaaagagtaaaggaataacagtctatacagataataaagaaccagcacaagaactctggcaactcaaaaagccagaatgtcttcttacctctgaatgaccacactagctcccccagcaatggttcttacacaggctgaaatggctaaaatgacagacatagaattcagaatatggatgggaatgaagatcattgagattcaggagaaagttgaagcccaatttaaagaatctgaggaatatgataaaatgatacaggaatgaaaagacaaaataactatttttaagaaagaaccaaactgatgtgagagaacttaaaaaaaacactgtaagaatttcataatacaattgcaagtattaacagcagaatagaccatgtagaggaaagaatcttggagcttagacactggttgtccaaattaactcagtcaaacaaaaacgaacaagaaaaacaaaacctctgagaaatgtgggattatgtaaagagacaatatctacgactcattggtatccctaaaagagagggagatgaagcaaacaacttgaaaaacatatttgaggatattacccacaaatatttcccaaacttcactagagaagccaatatgcaaattcagcaaatccagagaacctctgtgaaatactatacaggatgattatccccaagacacgtagtcatcagattctccaaggtcgatataaaagaaaaatatattaaaaacagccagagcaaagggcaatgtcacctacaaaaggaacccatcaggctaacatcagatgtttcagcagaaatcttacaatccaggagggattgtgtgcctatattcactattattaaaaaaaaaaaaagaaactctgatcaaggatttcatatccagccaaactaagttttataaatgaaatagaaataagatcctttacagacaagcaaatgttaggagaattccttgccactttacaagaggtccttaagggtgtgcaaaacaggaaaatgaaagaccattaccaaccaccacaaaaacacacttaagtacgtagaccattgacacaataaagcaactacaccattaagtatgcataataaccagataactacttactgacaggtccaattctgcacatatcaatattacccttgaatgtgaatgagctaaatgtcccaattaaaagacacagaggggcaagttggataaagaagcaagacccaactgtatgttgtcttcaagacacccatctcacatgcaattgacacccacaggctaaaagtaaaaggatggaggaaaatcttccaagaaaatggaaaacagaaaaaaaaagtaaggattaatattttaatttcagacataacagactttaatccaacaaagattaaattaaaaagaaaaaacacaaagaagggtattacataatggtaaagggctcaactcaacaagaagacttaactatcctaaatatacatatgcacccaacaaaggagcaccaagattcataaaagcaagttcttacaaatctatgaagaaacttaggtaaccacaaaataataatgagagacttcaacactccacagacattattagatcaaccatcaaggcataaaactagatattcaggactcaaactcgacacttgaccatatagacctaacagacatctaaagaactctccatccaaaacaacagaatatacattcttcttgtctgcgcatgaactatgctataaagttgactacacaatcagctgcaaaacaattctcagcaaattcaaaaaaaccaaaatcatacctaccacacttttgtaccacatgcaataaaaatacacatcaatactaaggagattgctcaaaaccataccattacatggaaattaaacaatctgctcctgaatgacttttgcataaacaatgaaattaagccagtaatgaataagttctttgaaactaatgacaacaaagacacaacataccaggatctctgggacacagccaaggcagtgttaacagggaagtttatagcgctaaacaccagtgtcataaagttagaaagatctcaaatgaacaacataacattacacttagagaagctagagaaacaagaataaaccaatgtcaaagctagcagaggacaagaaatatccaaaatcaaatctgaactgaaggaaattgagatgtaaaaaacttacaaaagatcgatgaatccagaagttgatgttttgaaagaataaataagattgatagactgctagctagactaataaagaaaaaagagagaatatccaaatgaatacaatcagaaatgacaatggggacattaccactgacccctcagaaataaaaaaaaaaaatctctcagacactatcatgaaaaactctatgcacataaactagaaaatctacaagaaatggaaaagaatctggaagcataaactcccaagattgaacctggaataaatttaaatcttgaacagaaaaataatgagttacaaaagtgaatcagtaataaaaaggctgccaaccaggaaaaggccagtactagatggatgcacagccaggttattccagacatataaaaagagctggtatcatttctactaaaactatttcaaaagactgaatcagaggatctcctaccctaactcattctctgaggtcaccatctttctgataccaaaacctgacagagacacacacgcataaacacaaacacacacaaaaactgcaggccaaaattcttgatgaacatagaagaaaaattctcaacaaaatactagcaaactgaatccagcagaacatcaaaatcgaatccacctagattaagtaggcttcattctggaatgcaagattttttcaacatattcaaatctataaatctgatttattacataaacagaactaaaaacaaaaccacacgatcatctcaatagatatagaaaatgcttatgataagattcgacataccttcatgttaacaaccttcaaccaactgggcattgaaagaacatactttacaataattagattcatctatggcaaacccacagccaacatcataatgaatgagcaaaaggtggaagcattactcttgagaactggaacaagacaaggatacccacccttactactattgtttaatgtagtactggaaatcctagtcagagtaattaggtaagagaaagaaataaatggcatccaaataggaagggaagtcacactagctgtgtctgcagacaacataatattttagctagaaaaccccatagtctctgcctaaaagctcctaggtctgataaaaaaacctcagcaaaatttcagaatacaaaatcaatatacaaaaattagtaggtttctgtacaccaaaaatgtccatgctgagtgccaaatcaagaacacaatcgtatttacaataatcaaaataaaataaaatacctaggaatacagctaagcaggaaggtgaaagatctctacaatgagaattataacacactgctcaaagaaatcagagataatacaaacaaatggaaaaacattcagtgctcatggataggtagaagcaatattgttaaaatggccatactctccaaagcaatttacacatttgttgatattcctatgaaactaccaacatcattcatcacagaattagaaaaaaagaaactattctaaaattcatatggaaccaaaaaagggcccaaatagccaaagcaatcctaagtaaaaggaacaaaactggaggtatcatattaccccacttgaacaaaactggaggtaccacattatccaacttcgaactaagctaaaactattctaaaacaaaacagcatggtactggtatgaaaacagtcatatagacccacggaactgaatagagaactaataaataaaatctccacctacaagcatctgatcttcaacggttggccaaaacaagcaacggtgaaagaactacctattcaataagtgctactgggataattggctagctatatgcagaagattgaaactggaccactttcttatgccacatacaaaaatcagctcaagacaggttaaaaaacttaaaacctgtaactatcaaaatccttgaagatattctaggaaatgccattctggacataggccctgtcaaagatttcatgacaaagatcccaaaagctattgcaacaaaaataagaatttaaaaatgagatttaagtaaactaaagaggttctgcacaacaaaggaaactatcaagagagtaaacagacaacctatagaatggaagaaaatatttgcaaattatgcatccaacaaaggtatagtgtccagaatctataaggaacttaaacaaattagcaagcaaaaaaacaaacaatcccatgaaattgtgggaaaagtgcatggacagacacctctgaaaagaagatacatgcagacatcgagcatatgaaaaaatgctgaacattacttaattagagaaatgaaaatcaaaacaacaatgagataccagctcacaccagttagaatggttattactaaaaagtcaaaaaataacagacgctattgaggttttagagaaaagggaatgcttatacactgctggtgggaatgtagattagtttagccattgtggaaagcagtttggcaactcctcaaagaacttaaaacagaattaccattcgactcagcaatcccaatattgggtatatacccaaaggaagataaataattctgtcataaagacacatgcatgtatatgcgtactgcagcactattcacaatattagagacacagaatcaacctaaatgtttatcattgctagactggataaataaaaagtggtttatatacaccatagaatactttgcagccttaaaaaaaatgagattatgtcatttgcagcaacatggatggagctggaggccattatcttaagtgaaccggtgcagggacagaaacccaaatactgcaggttctcacttgcaagtgggacctaaacatcgagtatccatggacacaaatgtattagcgcattctcacattgctacaaggaactcctgagactgggtaacttataaaaagaagaggtttaaatgtctcattgttctgcaggctgtataggaagcatgattctggcatctgcttctggcattctgcttcttgcctcaggaaacttaacaatcctggtggaaggcaaaggtagagccagcactttacatgactggagcaggacaaagagaggaatcgagaggtgctaaacacatttaaataaccagatcttgtgagaactctatcacaagacagcaccaaggggtcggtgttaaaccatttatgaaggatgtaaccccacgatccaatcacctcccaccaggccctacctgcaacaatggggattgcaatttgacatgtgatctaggtggagacacaaatccaaataacatcaacaaagaagggaacaccagacatcaggatgtagcagagggtagaggttgggaggagggtgaggatcttaaaactacctgttgggagtgtgcttattacctgggtgacaaaataatctgtacaccaaacccccatggcacacaatttgcctgtataacaaacctacacatacacctctgatactaaaaaagcagaatgccagaagcagatgccagaatcatgcttcctatacagcctgcagaacaatgagacatttaaacctcttctttttataagttacccagtctcaggagttccttgtagcaatgtgagaatgcgctaatacattaaataaatacaaataaattaagtaattaaaaaaagaactgaaaaattgtttaaactttttaaaaaatctttatagataatgtatcaccaaatacagagcaacaataaagagatatgaattatttaaacaaaagaggggtgaaataaaattctggaattaagaagaataataattacattaaaattcactgaagatgttcaaaagttatttggagctggcagaagaaagaatccatgaacatgaagataggacagttgagataatccataataatatgcagaaagaaaaataactgtaaaggtgaacagcacctcagagatttgtagggcaccatcaactgtactaacaaacgcataataggaatctcagcttgtaaggagagagagaaataaataatatgtggatacattatggctgaaaacatcctaaatgtgatgaaaaatattaatctctgccaccaagactcttgataaattcaaaataggataaactcaaagagatccacccctagatatagacacatcatattcaagctgctgaaagccaaaactaaaagaagaacctcaaaagcagaaaaaaaaagaacaaaaacaaagcaggataaatataaattctaaactggtcacatacagggaatcctcaatgaaattaacagctgactttccatcagaaacaatggatgccaggaggcagtcttaaaacacactcaaagggaatgaaacagtcaaccaacaatgttatatccagtaaaatgaacctttcaaaataaaaaacaaattaagaaattattaaattaaaaaagagagttcattgctagtagaatacccacaaaaaccatctaatgggagtcattcaattttaaattaaaagtcactgaataataacatgaataaacaaaagataataaagaatcaggtgaaggcaaaggtaataactcaggtaaggcaactataaaagttatatgaaagtgaatataaaagtgcaatggattcttgtttatatatcttttcttctcatattattttaaaatattatataatgcaatggttataaacttatttgaataatgtgatggttagttttatatgtcaactttactgggtcacaggattctcagctggttaaacattatctctgagtgtgtctatgagggtgcatctagaggacactaacatttgaattggtggacagagtaaagtagatggacctctccagttgtggtgggcctcatcccatttcttcagggctcaaatagaatgaaaaggtggaggaatgttaaactaatggccagactgtttgaggtatgacagtgatcttctcctgctctgagaactcctgattctcaggccttcaaatctaggctagaatctgtataatcttctctctggttctcaggctttgaaccagctttcctggatctccagctcacagaaggcagattctgggacttctcaacttctacaattgcatgaaccaatagcttataagaaacctctttatatattcagtagaagatacacatctcctattaattctctttatctacagagctacgactaatacggatgggattataatatattagcacgtaaatgaacaattataatgtataagaagaggaaaggaaaggaccatattgctataaagcttttgtatagtattgaaatgaagtttacaagatttgaacaagattattctaaattaagatggtagtgataatccgtaggcaaaccactaagacaattaacttaaaaacaataaaattgaatcaaaatgatatactagaatttatatatttagcataaaaggcagtaatgagaaatataaaaataaacacatgaaaatatagactatagactataaatagcaacaagacaaaagtaattacattatatgttaattgattaaaacttccaaccaaaagcagagaggcagaaattaacagatttaagaaatgatcctactatatgttgtatgttctctacaaaagataaaaattaggttgcaagacacaaataggttcaaagtaaccaaatggaaaaaagtaccaggtcaacaataaccaaaagagcaaaagagtaatagtggttatactaataaagacaaaatatcctttaagacaaaaattgttatggagacaaatatgaacatattataatgataacattttcaatgcatcagaaaaacacaagtattatgaatgtatttggtgttacaacacaacttgttaatacatgaagcaaaaatgggcataaatcaaaggaaaaatatacaattcaagatcaccgctgaatactttcatatcccactttcagtaatggatgtatcaatgtgcaaaaatcaattgaatactagcaatgaataatctgaaaatgtaattaagaacatttaatttacagtaaaattaagaaaaaataaattccttgggaataaacttatcaaaataagtgaaatattcattcactgtgaaattcaaaatataatttaattatattacagaggacataagtaaatctaaagttgtctcttcatcatagatcagatgatttgttattgttaagatgacaatactccccaaattgaaccacatatttaacacaatctctaccaaaatcacagttggatttttttttttttggcagaaattgtcaagatgatcacataatgcaaggaacttagaatagacaaaacctcttgagaaggagaaacaaatttagaggattcacatttccaatttcacaatttacttcttagtgcagtaatcaagacagcatggtctaagcataagaatagacatagagaacaaaggaataaaattgagagtctagaaataagcccatacttttatgtttatccaattttgacaagattgccaagaaaattcaatggggacacaattttcttttcgacagtgagtgctgggacgaacagatacacacatgcaaaagaatgaagtcagacttcattctcaacctagattcaagaattcatacaaaatttatcatggacaaaatagaagagctaaaattataaacttataaaagaaaggtaggattaaatctctgtgagcctgaattaggcaatggtttcttagataggacaccaaaacctaagaaacaaaaaaagttggtaatttggatttcaccaatgataaaacttttgtgtttcaaaggacatcatgaagtaagtgaaaagtcaacccacagaatggaagaaaatgtcttcaaattatatatctgaaaaggagattttatctagaataaatatacaaatattttccagtctgggcgcggtggctcaagcctgtaataccagcactttaggaggctgaggcaggcggatcacgaggtcaggagatcgaaaccggcctgaccaacatggtgaaacctcgtctctactgaaaatacaaaaattagctgggcgtagtggcatgcgcctgtaatcccagctactcaggaggatgaggcaggagaactgcttgaacccggaaggctgaagttgcagtcagaggagattgtgcccactgctccagcctgggccacagaatgagactccatctcaaaaaataaaataaaataaaataaaaaattccaactcaataataaaaagaaatattatacagtaatattatataaaattaagaaaatcattaagaaaactaagaaaaggattaccaaataatgttagtagacatttatccaaagaaaatatataaattatcaataagcatatgaaaatgtgctcaacatcattaattaggtaaccccaatcaaaaccacaatgagataccattgcactcattaagatggctataattcaaaaagaaaaataataaacagtggtggagttatacatgtccagtgggaatataaaataatgtagttgttttgaaaaatggtttgaagttttctcagcttcttaaacatagttgcctatcatataaccaattattttcacccctaagtgtacatgcaagagacatgcaaacatatgtccaaacaaaaacttgaagtgaatattcatattggcattatttataataattaaaatgtggaaactacccaaatgtctggaaacttatgagtagataaatgcaatattgtatatccaaacaatggcgtattctttagtaataaaaatgaagtattattaatatatgcctcagtatagatgtacaatgaaaatgttatactaagtgaaagaagctagttatttaaaaaatgacacgttgttgaagtagatctatataaaaatgtctagaataggcaaatctataagaagataaataattgtgaatgacaatgtctgagggagggtcaatggggaatgatggctaatggttactttggcagaggaaagggtgatgaaaatatttttaacttagtttttgcttacggttgtacaactgtgtatatactaaaaaccattacattttatactttaactggttgaagccattttatggcttgtgaattatatctcaataaaatgtcttaaaaagtaaataagtaaatgcagtggtactctgtggaacattgaagaggacaagttgtatacaggggaacagttggatgaacaggtcagtaatttcatatcggttttatttaggctgttgatgttaggatggtaatggtgattttaagaaaagacttaatgttatctatagtacatgactagctgtggggatgaagttcactaaggtggttaccccaatagctctgatagtttttaatgctactctgacaggcagaaatcatacattcattaataaacacattagtaaatcctttaatgtattatattcatacatacaatttcagctatatacacaaaatatattctttagcttttcagcaatattaaaatcgcacaatgtaaggctacaattattccaaaagagcccttaaaacatttttactactggtaataagtcagcttttctgtaaagttataccctatggaaaacatgtgaagaaaattctctgtgctaacctcatctccaggcaatagtaactatccacttccctttcagcagctacaaggtaaccctgaaaagtccttccttacacgggtgatgatcactttaaagaaaggagaaaaggaaaaagaaactaaaacattttctctaacaagcaccagatgctacaaagtgctgcataagcacaggacaaaagtactccttttcacaggcagggaataaaatacagtaaattgcccagacagaacagcaaaatggcgcagattgcgcttcctctcttaggatcatcagatgattagggagcatggtctcattagagtctcttggaacaaattgacaaactggtgtgttttccttcatttagtggacataaacgttgtttatcttcctaaatgcaatggttaaaagtctcaatcatcaaagcatattgagtgtatcaatgaaaatttattcctctttggtcagttactatgaaattcagtgagaaaaaaataagttagtaatgtctacttatagtagagattctgtatagtacaacttcttcagcttcaaattgttactgctattgttgctgtttctttttcttggcaattcatctgacaggaaattttacattttaagcaagaagaacccaagaatgaaccaaaatatagggctcagattaattcactcatacaagcacacacacaataacaataatcataaatcattgatcatttcctatgtgttaagttctggattgagaacagccaatacaacactcatctagaaactgagagtttaatgagggaactcatgtattagacttctctagagggacaggaatattaggatagatgtatatatgaactggagttaattaaggagttttgactcaaaggatcacaaggtgaagtcccacaataggccagtctgcaaactgaggagcaagaaagccaggcagcatcccaaaacctcaaaagtagggaagctgacagtgcaccttcagtctgtggccaaaggcccaagagcctctggcaaaccactggtgtaggtcccagagtccgaaagctgaaaaacttggagtctgatgtttgagggcggcaagcatccagcacgggagaaagatggaggctggaagagtcagctggtctagtccttccaagttcccccgcctgctttcattctagctgtctgaagctgattatatggtgcccacccagattgagggtgggtctgcctctcccagtccactgactccaatgttaatctcctttggcaacaccctcacagacacccccaggaacaatactttgcatcctccaattcaaacaagttgacactaagtgttaaccgtcatagctcaatacataaataaaataacataccttgatggtagaggtatgctcaggagttacacaaggacaggctgtgagcactttctctgtcaggagtggtcgtcaggtaagaatgcctggagaatgtaatcccagcacttcgggaggccgaggtaggcatatcacgaggtcaggagattgagaccatcctggctaacaaggtgaaaccccgtctctattaaaaatacaaaaaaattagccgggcgtgatggcgggcgcctgtagtcccagctactctggaggctgaggcaggagaatggcgtgaacccgggaggcggagcttgcagtgagccgagatcccgccagggcactccagcgtgggcgtcagagtgagagtccgcctcaaaaaaaaaaaaaaaaaaaaaaaaaaaaaaaaaaaaaagaatgcctggagaagcagacgttttggctaaattgccagtgaactgaatagtagttagctatgaagaggattagtggaaaggatacttcagggactgaggatagcatgaagcaaattagaaggctgtgaagtagtgtcgtgtgtgtggagaggaattacaagcaatccagaatcatggcacggagcagagaggagtgcaagcagtaaaggttaagctaattcaaacttccaagttatatagagctatataagctaagtcctagttccaatattttcaataaccactaatgtggctgggcaagtttttaaatctttctgggatgatatttaagcttttcttcttcttttttttttttttttttcaaattttcattaattgatctgcaaatctttatctgcaattggccgtcttgacactgaccacagccaacatgaggcaattgccgactgctctaaactgaattggaaccaagagggacccagactcttggttgggccatcaagagttctgaacgtgctagtttacgagacttggaaataacatttttactttccagtttccaaaggcttaagtccttgtaaaggagcaaatcgttttatttttacctggtaaactcagtttgctgattctctccccactaattagccccattctgcttaggtctctggtgctcaggatgagtgcctcagagtagaacatgaaacatttttaatatgatccaccccaatacagttgaatcagaaattcaagagggagtgctcaaaacacatactgtttcaggcccgagtgacttacagtcaacctattaatcaggaagatttaactgaggactgtcttttatgtaatttctgcaaataaaatcttttgtttctctttattcattcttttcagaaaaaaataatgaatttaacaaatacattgaataacaaccatatgcagggagaggagcagagagaaaaaataaacaataaagaaagtggtaacaaaatatccctaattttgatgatttgcagccaacagtcatgcagtgaaaccatatcttcatttctctgatatggatccactctattaaattttgccctgaagttcatgatagttttgccagcctccatgacaaattttcttttgctcaccttcattgagagagacgatattacttttttgcttcagctcatggtgagaaccaatgtgatagtatatacaaaatacctttgaaaatagcaagtgatttcagaaaatctaacactattttgtcatgtattactttaataatcttaaaacacatatctcctatatttctgtttcctataggatatgtccaaacttcttaacacaatcctactctgtttacgttatcttgtttttctaattctcctctacttctttgccctaatcgcaccaaagcacccataattatttgatcatgatatctacatcattggctcattcccattcatataatttaacatctaattttttggctgctgctgaatttccactggtccagttgtcatgttctctgggagctgtgtttttattttcttcatatagcattaattgtccctttcttataataccaccaacctgaaaaaatatcatatgactttttaaaacttttcctttaccttacaaacctacatcttctcaatgagcacaacatgcaaaacccatcactttccaatgtatatcattatccacgcattgttatgtcttgcttggaaaatggaagagtttccctgcttattctctggtcactattcatacgattctctaccagccaccaaaatcatctttggaaaatacaagccaatcattttattccctattttaaagtattttaagagcctccacttgaagttgtattaacattttcaagctttctgatgtgccttctgccaacttcccccacttcacttcaccctcacctgctatattagttagggttctctagagagattgaccaatacgatagatagacacatacgtacatacatagatgtagacacatgagaggatatttagggaaattgactcacttgattatggaggctgagaagtcctacaaaaggctgtctgcaaactgaagcccctgggatgctgcgggtgtggcttagtccaattccaaaggtctcagaaccggggaagctgatggtgtgcctttcagtccaaggccaaagtcctgagaatcagaatgggtttgagggggtactagtgcaaaccctaaagtcttggagttctgacatccgaggatggagaataagattgtctcagctccaatagagagagaggaaatcacattttctctgccttttttgtctatttggggccccaagtggttgatggtgcctgtcctcatagagagcagatcttccccacttggtctgctgaatcacacaccaatctcctccagagtcaccctcacaggcccacccagagcagcactttaccggttcgctagctattccttaactcaagtttacacctaaaactgaccatcatacctgctctgcccaagccacacagaatcccttctttgaatatgctggattttttcttgccttaggccctttgcactaaccaaggcttctgctagggtgctctgctcactgatcgttacttggccaactctttcttgctattcaaatatcaatgagtggcttatactaaaaagatatcttaaaatttttatgtttatttcctcacactaaaatataatccctggagagggcctttctcaggcttctttattgctatatttctagtgtcttgaataatgcctaataatgaagcaactcaatgcatgtttttggtgagtgaatggatgttagttgtttatatagcaatttcccctgctaggctgggaacaaatgtggcctccatttttgtaggccaagctcaatgcacagaaactgagatgcaatgagatctcaaatatttgccaggtaaatatttaagtaaattcactgtttataagacgaaaagacaatgtagcacttaggaatatacatcagtaatagagtggaataatgccaataatagagcagaataatttcaaatacttttcgacagaagtgatcatttgtagttctacttcccctcattcataactaaaataatatatgaaaattatgtaagttaacattctgggtagcaagattagctgtcttgagctaaattatatagagacatttgatgtccttaggctactagaataacacaatttgctcattggcataaggataaattatttgaggcagtttctttagaagtcatgaactctaagtctttctgcttcatttggtctgattggctgtgattcataaatattcccttccccataaccttgagatgacattcatttgaaaaagagttaaatggtattaggggtgaagtccatggccttgatattaaagaaaggtagctgggccataaaagaataaattgtattacacttacggagcccagttaatcttatgactgatcatgatagttatgaaaatcagaatgccagaaatctaagtcgaggccatagggagtttaacaaaaatacatagtcgacaatttgaccattttgttatattttattttttaaaaattggaataaatgtagatactaagatttacataatcagagtaacacctttataggatcactatgaaacatcgatttactaaagttttcaaagttaaagtgaaacaattatataaacattagtatagataaaaatctatagataataattctacattgaaagggataatttaatggttacacgcaattcaatttcgtccttactttactattctggtttttgtctctagaattgacttgacttttcgttactgtgcaagtgaatggggttctcattggaatttatgtccaggatgctccataattcccagaggtaataatgaaaaaaataaatcactttacttcacaatgtgcctatgaagcttttgtattgatgcttaaatcaaatcaaagtaaggtcacagagatacctgactctcctagcattaaaataaaaagtgcaagctatattgaaagagactgcaaatatttaataacattaaggcttcgtgaaatagatctagcatttaatgggaactcccaatcgttttctcagcccataagtctgtattgtaataatttcaattgtttgctctgggtagtcagctggtttcacattaatgtcgacttactattgtgatttactttctttaggtcccaactgagctcctgaaatttgtgtgatttgcctatcattgattacaaagaaagtttctgtttgcttcaaacatgatatttctatgaataaataaaatagctcatatgaagggaaaatagaattactttaaatctattctagcctctttcataaacacactttttggatactaatatgtgaatatacaagaattctcagttctatttggcaagaaatttttggcaatatcacgcctacaacttactcagcatattcttggtgatgttgtaaacaaacaagttaaagctaaactcttgccaaaagaatttaaagttgagcacattaagcagtctaagaattgaaatagcttacataaacttgtaaaagaaaacacaggcacagctcattttattgcgcttttggattttaaggtatctttttttttttttttttttttttttttccacaaattgatggtttgtggcagccctgcattgagcaagtctatcagtaccatttttccaacggcatgtgcttacttcatgttcatctgtcacatttggtaattctcataatgtttcaaacattttcactatgatattatctattattgtgatctatgatcaatgacctttgaggttactattgtgattggtttgggggttgtatgaacagtgaccacataagatgatgaacttaattaataaatgtctgttctctgtctgctcttctccctgttctaaccacaagccattccctgtccttcttcctctcctcggtgctccgtattccctgagacacagcaatactgaaattgagccaattaacaacccttaaatggcctttacatgttcaagtgaaaagtcccacaactctcacttaaatcaaaagctaaaaatggtgaagcatagtgaagaaggcttgccgaaagctgagacagtctgctaggaccctcgcaataacagtgagcaaagttgtgaatgcaaaagaaaagttattgaaaaaatttaaaatgctactctagtgaacacatgagtaataagaatgcaaaacagccttattgctaatacggaaaaaatttcagtgagttagattgaagatcaaaccagctacaacattctcttaagccaaagtttaatccagagcaaggcccaaactctaactctcttcaattctatgaaggttgagagaagtgagaagctatagaaaaaagacagataaataaaaatttttaaaaaatgaagctagcacaggttggttcatgaggtttgagaagagaagccctcttcataacatgaaagtgcaagataaggcagtaagtgcttatatagaagctgcagtatgttatccaaaaaatttagctatactagatgacagattttcaatgtagatgaactagcctgctggtggaagaagatgccttttaggattttaatagaaaggaaaagtcaaagcctggattcagagcttcaaaggacagggtgactctcttgttggaggttaatgcagctggtgactaaattgaagccagtgatcatttactattctgaaaatcctagggcctttaagaactattttaattctactctgtgctctataaatggaacaacaaagccgagatgacagctcatctgtttacagcctgatttactaaatattttaagcccattgttgagaactgttgctcagaaaacaagatatttttccaaaatattactgctgatacacaaggacattaatgctgtttctatgcttgctaagtcagcatttattctgcagcccatagttcaagagtaatcttcactttcaagtagtattatttaagaaatacattttgtaaagcaatagttgccatagacagtgattattctaatggatctgggcaaaatcaattgaaaaccttttggaaaagattcaccattctaaatgccatcaagaatattcatgatccatgaaaagaggtcaaaatatcaacatcaacaggagtttagaagaaattaattccaactcttctgtatgactttgaggggttcaagacttccgtggaggaagtaactgcagatgtggtagaaactgcaagaaaactgtaattagaagtgaagctgaatgtggggctagattgctgaaatctgctgataaaacttgaacagataaagagttgctttttatggattagcaaataaaatggtttcttgtgaaggaatctacttctggtaaagatgctatgaacattggtgaaatcacaatacaggagttagaatagttcataaacttagtggacaaagcaatagtcaagtttgagaagattgatttcaatttggaaaaaattcgaatttagatcaaatttcatcaaatagcatcatatgctacagaggaatctttcatgaaaggaagagttgatcaatgtggccaactttattgttttcttattttaacaaattgccacagccagctttcagcaatcaccactttgatcagtcagcatccatcaacaatgagtcaagaacctctaccaacaaaaagatcacaactcattgaaggtttagatgctcattagcatttatattacatatatattgtatgtacatttttagacataatactattgcatacataataaattacagtataatataaacataattttatctgtgggaaacaaaaaggatttttttgtgctcaccttattgggatatttgttttatttcagtggtctggatctgatctctcaatatttctgaaatatgcctatgaatccaataaataaacaaactaaaaaagactcctggatataaaggaaacaataggctgccctaccaaaaaagacacattttgggacaaagtcaaggagatgatgcacttatctttatagactcattgataataagaaaatataatgaattacagaagtagaaacattttacctaaattaaggacccctccttcttgacttttctttcagagaagaggaatggttaagtggaaatcaactactggaaaaccatctatcaattaatcaatcaatcatgctgtcatttcttataagtgccctaaaaattaaatggtggatcagcactcaggcatgaattggttatgttttcaattactgaagaagcaccaaatgaacaaaagaaaatttctgaattataatcatcctctgacaatgtaactaagggaactcaatattcatttgtgcctcacctttctccttcctgaaggagaggattaactatttgatttaaaaagtatgtcccaaacataacactaaaatttatggaaataattgtttttctctttagattcccaacacagtggcaataaacaaagcaaatattagtgcaagattatagataaaaacaacaacaacaccaacaatgaaatgcttacacatggggctcagatcacaggaacaattagtgagaagaatgcaggacaattcaaatcttccaatttctagttagattactttataccacactaacatttaagaaacaccatttatttgccaactgcattgagagaacactgcttatgaaattacaaaagcacccataacctaggttagtttatgttcttaatcaaaaatataaattttgaaaactagtcacacatttaatttgatatttcaaataagtgatcacttagaagtaaagaaactcattttcttatatggctcataaactactctagttttctttttaattaagccaagagatgattccaaaaattatttcaagtgaaagaagcattactgggggatagtttcataatgtgaacaatataaagacccacattcactctaagcatgcaaaattggatagaaacctagatttctgagccaaagtgcctaatatagaaccttagttcaacacatcccacaatgtgcaactcactttggacaagttagttgtcttctctgtatctcaggttctttagcaggaaagggaggaaggtaatggtgttaccttaggtaggtaaggactggctcattgttaaaattcattaatggtacatagtattaatatttaaattctataacactttccagcataaaatatttttattttattctctatatattataatttagttctatattagtaagcttggtatgccataacaaaatacagaacaacataaatttatttctcatgtttctggaggctgggaagttcaacatcaagttgacagtatgttctgtttctgctgagggctctcttccttgcttataggtgatttccttctcgctgtgtcctcactggtcacagagagagaaagcactctgttttttccttctcctcttgtaaggactttgatctcatagaattagttttccatccttatgacttcatttaactttaataacctcttaaaggccatatttcaaatatagtcacactagagcttaggacttcaacatatgaattttaggggacacaatagcaagttcctactaatttttctattgcagatattagtttttactctgattacaatatttatttttgaactatgtcaaaactaatattccattaaaattcacttttatgcaatccctgaactcacatttccatggaaagtatcaatattgtcttataaatgtttcctttcttccaagttgaaagtgagctaacagtaatatatatgtttttgaaaaatatactttaagtacattgcaatatcttattaatcagcttttggaacggttgttactaactgtgaattcttaactaaatatttgtgaattgccagtaattcactttgttatgatttagagtggttcttaataagcttattttacctgccaaccttacatatatacagaagataaattttgacaaaggctgatgcaagttttttttgatcctccaaaagcactccctccacaagcgttggcaattccaacacatctaatttgaatattttctatgcaagtcttcatacagtgattgcttcagccactttttaatcatcccactctcttctactatttcatagagtacagccttgacatcctcaagaccacagaacagtatctactactataatttacagattgagtagataagttcttatataattctttgccaactgctttcttatacctaaataggtattgaagaaactggacagatctgactgagcaacttcactcaaccccaatgtctgttttgaaattctcttgagctcactgtattgggcttaggaaaatatggttgcagtattttctaggagatatctaagttctctaccgatatcccttccatgacccttcctacctgtttttcacatacacgcaggtttaaataaaacttaaaagttaaatatatttcttatagacacaggtacagatatatgatttggatcaaacatatgttcattatattcacaggcagtttataatttggagttgtttctttaggacctgattttatgtaccatttaatagattgcttattatttatgcaatcacaaagggtaaatcttaacaactttttttcaccactttctcaaagtgacataaatgacaacatattcatgatattttttctcagtttaagcagagaattatttttcttgccaattactttaagcttaacaaaatatctactgtgaacaggataagatggacaaatgtgataatattggaatttagtctgcaaaactgtagttcaaagaaatgctaattatgaatatatgacattttaaaatatccaaagtgaaaaatgtactgaattacaaagtatgtgtagagggataaaatcaagctggttaatgaaaacagatgtagagaaatgatactgtcaaaaaaggtaggagggtgaaatgaggactaaggtcttggatgtgaagtctctgtaataaaaatattatctgccttttattaactgcctgaaatgtaccaggcactctgccaggcttgtgaatacaatatttccattgtttgcaacagcgattattatgaataggctttgttatttacccttacttttccttttgtgaactgtgtgagctaatgaaaacttaggtgacttgcccaaggctaggcagaactctgactcagatgaatgctttcctttccaaggccatatttctttctatgcattgtggtaccacacacaggagagtgggagagcaagagactcatatttttcacatactaatgcaaggggaacactaggcaagaagagaagaggacagcagaaagaacagagttgagttttatttaagtgactgtcaatttagcatttggaaaacataggatttcaaagataagaaatgctataccgcattaggtaatttgacatttggtggcataatgtgatacgagctttcttaaacaaacaaaaatgcctatccttatttgaaaatgagatggcaatgccaaggtataaagactggcatacactttgcattgctaatagtatgagttttctataatcgcttcagaaaagcttttttgcatgagctagtaaatctaaaggggaatcatatgataaaatccagatatccattattagagaacctcaattctatacaaaaaacatgcacaacattcacaacaccatctatggcagcactgcttgatgtgtaaagttacatatatatataaaattatagagattaacaaatacaaattatatgcttacacattcatttattttaccgaatagttatatgtatatttttgtgcacatgtgcatgggtgtctatataacataaatgtctaaattaaatgggtgcaaaattaaatcataaaataatacacttagtctggctgtaattatgtaaaggctaaaaccagaaaaaggaaacaaattattgcttgaggatacatatgcctatataacaaaattgtaaataagtgctagaaaatgattagtaaaacattcatgattagtggctatcatagagagtggacagagaggcaaaatctttgggaagatgcacacaggaaacttcagagggagggtttgtttcatttcctaagcttggtgatagatataggcttgctcttcttagttttattttttgtttagttatggaaaccatatctagtctttgaccacttagttagtgattgcattgtataaacaaacaataaagcagtacttggaaatattagagatttaaactgtgtccttagagagtaaccacagttccctttgtaagggcaagtgtctattaattctttactcccttagcaatgttctttcaacacaaaatcatatgtacacacttgcaagagaataattagaaagagaacataattgctgtaggcatttagaagttagaaggaaaagaattctctgctcattatgcactgcactgtgtctaccacggtggtttgagcctgttaacccctttcatcttgtgcacttcatccatgagaaagagataacaagtgcaaaatgatattgggtaatgaagcatcactctctgcatgctacccatcacagggacacgtgtacaacatcaatatcagaaactactaagaagggaaatggcaggctcttatctgccactgcaagtgggtttacaagcagaactagcattttgacattagcctatttgatggggaatctttacactgtgtggtgggagtctttcttggaaacaaacgagaggcgataactgttaatatccatgttgtaggtttttattgttactattcctattaatattagtagttagtgtatttccatgtttaatatcagaaaagtctttcttgagcagagatttccaattataagataacttactcaaagtataggtagagggaattagtccatttatatcatcaagaggccccatatccaaaatatattttaaagtcacagccagcttgcctgtttgaccttaacttaaatgttaccttctcagacttctctagctactttataaatgcaaactacctcttccctccccaaacccacacttctatatccattctctgctctatttttcttctatttaaaatatcagatggctgatatattagtccattttcacactgctctaaagaactccccaagattgggcaatttaaaaaggaagggggaggcttaatagactcacagttcagcatggctggggaggcctcaggaaacttacagtgatgtcagaaggtgaagcagaagtaaggaaacttcttcacaaggtgatagaaaggataatgaatgcaggagaactaccaaacacctataaaaccatcagatgtcatgagaatttactcactatcatgagaccagcatgggggaaaccacttccatgatcaaattaccaccacctggtctctctcccttgacacatggggattatgaggattacaattcaagataagatttgggtggagacacaaagcctaaccatatcagctaaggagtagttgataggatggtggttttttttttttcagagtaataaaatgttctaaaattgattgtcatgatggatgcacaaagatgcccaaatctgaataaaaagccaatgaattgtacgcttttcaatggttgaattttatggtctgtgaattatatcttaatatatctgttttttaaaaaaagattataaaggagcaaatcttttcaagttctaagttccaagttctagggaatcacaggaaaacccccctcggacactgaagcattagaattgtaaaaataaataccaagtagacctacaacagtggaagtgagatacagtccaaatgtgatagatggttaaaacgtaggttcagaataattactgaatacttctaggatagaattcatacatatagtaaccatgaaatggaaaaagattaaaatgtgaagtatggtcaagattatgaagacaggctataacagacattttgggtcaagagggtaacagtgtaacagtgtagtgaggacttagggggaacagattaattaattcattatgtaaatgatctcctgcacagcacttaagagacaatactaacatatgaccacagagcacaatggtaatcaacactaggggtttccagagttaaaattacatgtgatatatttaaaaaggagccttgttcttgacattctgtagccctctgttatcaaggacttagcatgtcaccagaagcatcaatcaaaattgattacatactctagaaccaggtcttgaatgacagggtactgttttcagtagcttcatttcagatcgattccatttgaacaacttcaaacaattacattaaatgtcctttagttatttccttgtttactattttccataatttcattttggccttaacccctaaatgcattgaagaatgcagttacaattaaattttatcagatttaatttttagactttatatgtcaattgcagagcagatatcaaatatagacttttacaagtacaaattagaaaaaatcatttaattagtcaaaatatttgaaatgtacaagaaattctcacaagtgtatgtgtttgcaagaaataattagataaacttcttcagaggggaaaaaggatttcaagggagttagatagtaaaagatgatcatctgcaaagaaacagtaagaaatttgaatctccatagaagcctctctatgtgaaagcattgagactggttatttcatggtagaagagataacattgattggctaaataactgtatgcccaaataaacaaaagagtggaatcacatattaaatattttatgggggaacactaaacacttgtaatatactcactttctgtaagcccataaacatccaccaaatgggacttaatcaaagataccagaaagagtgatatgtcttagtcatatagcccatttattaatatatcctatcaataataagtagcattgtcataatcatcatcattctcttcaccacagcttggcatggctattcccttctctaaatacatttattacctgggtcaccttgcccagacccatgactttaaacaactcctaaatgtggttcctaattaataccttcagccttgagctcttcattaagtaacagatttatatagtcatttctccttttaacatcttcacttaagtgaaacataggaagataaatattaaatgcttgattacactgctcttccaaacagccctgctcttcctaaggcccacgacggagccatcgtttgtgtactagctcagatcaaaaaggaaaaaaaaaaaacagaattgctgttgggttctattttttccacaaatgccacaatatatctaccagtgagttctgttggctctacctttataatgtattctgactctcatatcatacctgctgcatgcaaatcctttgcttccattgtcatctcacccctggggtacagcaatagtctcctaacatagcggcccactggtaatgcagcctgagccagaattactgtttaaaaatgcaaattagatcttgtcagaagcctgcttctaatcctccaatagcttcccataacatcctctggataaaatccaaaattcataccgtggtccacacgtagctatgtgatcatgtcgcattctacttattgaagcttttggcccattttacacatggtatttcattcagatattgctttttcttcaagtctccgagcttatccctaccctagtgtcatcatctactaaatacatacatacataaaatctctcctgggcacttttatctattctcatggcttgaaatgttataaatatttcccttccttccttccttccttccctgtccttcccattccttctcccttccccttccttccttccttccctgtccttcccgttccttctcccttccccttcctttcttccttccttccttccctgtccttcccgttccttctcccttccccttcctttctttcttccttccttccctcccttccttcctttcttctttctttctttctttcttttctttctttctttctttttgtttctttgtttctttgtttctttctttctttctctttcttgctttctttcttttacgtatttctttctttctttcttctttcctttttgacagagtctcgctcttgtcacccaggctggagtgcaatggtgcaatctcagctcactgcaacctctgactcccaggttcaagcgattctcctgcctcagcctcccaagtagctgggattacaggcacctgcctccaccgccggctaattgtggtatttttagtagagacagggtttcacaatgttagccaggctggtctcgaactcctaaccttagatgatctgcctgcctcggcctcccaaagtgctgggattacaggcatgagccaccacatccggcctcgatgtattctttctagattttttgtttgtttgcttgttttttttttgttgttgttgttgttttgagacagtttcgctcttgttgcctaggctggagtgcaatgtctccatctcggctcactgcaacccctgcgtccgggttcaagcggttctcttgcctcagcctcccaagtacctttacaggcatgcaccaccaagctgggctaatttttgtatttttagtagagatggtgtttctccatgttggtcaggctggtctcgaactcccgacctcaggtgatctgcctgcctcagcctctcaacgtgctgggaatacaggcatgagccactgtgccgtgcctctttctaagcttttatttctatctgatacctctcagaatccagaccacaatattcagttttctaataggcaaccgtccttaaaagctctaaaaatctaacttatctaccctcacttcccttatcgtgacaaaaattctttgtttttatttactggaacttccattaatccagatgcttatgtcaattgaccctatcaatcatgaagcattgtgaattttaactcataaatacatcttaactcaatctagctctttccattttaactggcaatgccctggactgactcaatattatctcttgtttagacgatggcaacatcttcctcactggtactcctacccaagatctgctatcatccaagccatgcaatatgatcattctaaaaggcaatgcagatactgtaactttcttgtgaaagaagcttcggtgtcctcctttacattcacttccttctttaaaaaaatcaaatacacttagcatagcactcaaaatattcattatttaatacatgattacttcacttgtaatctccacaccatcttctattaatatcttgatatactgtattatctacatttctacaagcaagcaagatccattttgcatttgtatatgttgccttttctttgaagaaggacctacaattttaaattattcctgcatttagaacataacattattttaaatacccttttttgtgggttacatgatcaccatgatctgcctggaggacaatgaatgcccttttgcagggaagttagagtgcctgcattcccttttagaataattacattgggatttgcctttgtttatgctgtcgcatctctcaccacaattcccttcctccagccacactgatatctttaaacatgctccccatatgggaatcagaattttaactaagtctgaccataagtgtgtattcttcatatgacttaattaaacttaattacttctatacagaacattatagtgatgatgaatatatcaatcatggagacacagagcatcactttagaagtctctcaagtgttgctgtggtggaagagaagtcaaacaaatgccgatttgggactaccactgagacctcaatcaaagtaaaatttatttatttatttttgttgttaaatgttggggcttagtgtaagccctcttctgagggatttgtatatatatgtgattattttcgtagtccatggctcttttagattttatggattttttgtgataaggtggttatatttcaagagtttgttacattataataatcaaattgttacattttacacacatgttctgcattattttgtgctaagattctggattttataaggtcttgcaatttggaggcaagaaagctggttcagattgaatatttatctttaaaaaggtgttcaagccactcactttaaaaatatgcaaaagacatgaatagacatttacaattgaaaatttccaaatggctagtaagaatatgaatatgtgacttacatcattgaaacatcaagagaacacaaattaagacaaaaaggagatatcactgtatgagcatagacatagtggagatacaaattatttaaaatggcagtcaacatcaaatgttaggaaatatatgagtggctgtaacttgaacaaattgatagtggatatgtaaattgatttaaaaaaatttcttagtgaaaatatttggcagtgtctaccaaagttaatcatatgtctaccttgtggacttagtaatttcactcttagtacaaactcaggagtattactcatgtatgtgccacaaaaagacatattaaaatgtccataaatgttttctttataattatcaaaactagaaacaataaaaaatatccattaatagtagacagaataaatacatttttatcttctttgtgtgtgtgttggagagagagaaagagagagacagggccttgctctgttgctcaggctggagtgtgtgacacgaacacagctcagtgcagccttgacctcctgggttcatgtgatcctcctgcctcagcctcctgagtagctgggatcataggcacgagattcttccacctcagtctcccaaaatgctggctttacaggtatgagccaccatgcctgcccacatttttatattcagaaatgatgcattactacctagggttaaaataattgaactatttctagatgaaacaatgtagattaaactattaagtgaaattgccagagaaaaaagatgatgttctcaggattctatttacgtgaaatgcacaaacgtgacaaaaaacaaaatcataatagtggtattgggaggaaggggatgtgtaagcattgattggaaatgggtacgaggatgcttcgcttcagagatgtagtagctcttgtcgcaatctggaggctgattatgtgagtatatacttagacaaaaatcatcagggcttcatttaggatatatgcaatttattatttataaattaaactttgataatattttacattaaaacaaaacaaaacaaaacaaaaaacaaagctcttctaaggcacagaaatcattggtttttcttacgacacacaatttacattacttactactgaagccctccgtggcttccagttaattaccacaggtgcatgaatttttattactctattattcacagtattatgatttagctagtccacatttttagaactaatttgatagggaaatatttctatggtgacatttatcactaacaaatgaattataattcaaaatttatacctaattctttataacagaatttcccaaagtataaactcacgtgctttcaaaataaggcaaatttaaaatgaggcggaaagaaaataataatttgggcatgaagagtaatgacaattgaagtaaaagaaagtaagaagctttatgtccaatttttcttttaacttctccatcaagtacaatccataaagtacaataacatttctatttaaaagagaggacattgattaaacataactcagaagagtatgtattacttacaaattagaaaagcaatcaataaaagctcatgatggctaaggagttaaacaaagatgcggcttcattaaatatattcaaatctcctggtctgaaaatgaaaataacaaagaaaacacctagtatttcagtgtagtgatagcttttgcatatgaatcacctgatctgtcactgagttaagtagtaatttgtgggcaaagtttttgttttatgaattatgctagttttccatggctatcataacaaattaccataagcctggtgacaacaatgcaaatttattgtctaaacattctggaggggaaaagaccaaaatggatcttacagtgttcatataaaatacccatatatacacaattctacacctgtaaattaggtgttttgaacgactgtgataaagcaaacataacttatctgtatattcattctgcatacataattttagtttataattctaatgtataaaggtatatattttcttctatgctatgtgcataaaagttgatctattatagatatttatttaaattaaatttaaattacaagtctgactaaaagggagcttgataagaaatcacctctattagaagaagggcttttattctggaacaaataaagaattcctcaccaatcctacattttactttttgcttgtcttgggggtaatacaaaggcaacaaataaaataatcccagctgatcattgtctgaagaaagaagacaccctcctacataagaaataaccatcacgtttcaagaggtcgagtgactctttatcgcccaacctcttaataaaattccttccatgctctgtcaagatctggtgaataagtcagaggcagagataaaccaaacaaaatcttgcaatgtagcaaaagtgagaactgcttttctccataaattaggtacatttcactgaaggaaatagtcttccatcatactactactttcgtcaaggcaaaggcttatagggggggatgtattttatttttcatttagagttcaacagtacaaatttatctctatcaataaaattgtcaattgcagtaacaagtaaatttatctagctgttttagtacccaatgggaccattttcatgttaaggcctggaattaaaacagcagtagaaataaaaacaagatgatggatttaaagaaagatctaaatctgttgaattttctttgtgtccattaagaaacagatgttttccatatgttgaatagaagaaacctcagccacattttaattatattgtttgaagtagaagtttgatagtatttatacatggaaaataaaaaaaacagggtttgggaatgtgattttgtacctagtcttcccctgctgcttagagaaattacctctatctcgaagcttggattactatatgcagttaggagatataatacctgtctcagtgttgtatgaaaaatatttagcaaataaaataatactgtgataatgtggattttatatagtgttaatgaaatcaatttttatacttgggaaatttttcctgttagatttggtatctatttgcatacattatatgaatcactcagctagaatcaaagtcatacctatgtactgtgcacatatatataattctttataatttaaaaaataaacaaaaacattgcttgaatggagaaaaacacttgaataccactttatcactttgagcattttcatcaaatgctaacatttgagtgcaatttgttttatcatagtttttttctctctctctcgtgcatacatacacacatatacatatataggtacacacacatctgatccctgtatatatacacacatacatatgtctatacacatacacacagttttatagaattactaaaatttaagttgcagccatttttctcttttatttctaagtatttcaatgaattttctaaaaatagaattattttatatcaacaaaatggatttatgaaaatcaggaaatttaacatatatagaatatgactatctaagtcaaaatcaatattgaaattttatcatatgttcaatcatgttcttataatactttattactggctaggatctagtccagtataaatgtgaaaaaaatgcattggagttgaatgcattcacatttcatttctttcatgctttcaaggaaaataattaaaatattaaatacatttttgaaagcattgaaaagcatggagatatttggagtttattttataaccactcacaccaaaactggatgaacaaagcaagcatgtatttatatgcaaacacacatatgctagaaacccaaaacacactcaaaatatattctgggaattttctctatttcaaggttactctaactacaacttggcttagacccagttagttatgactatgcattggttattaaatgatagtgcatgctatataacaggacaagaatttatatgcctcactacattaaaattccaacgtgaagagattaatacctgactgacaataattactacgtttaatctctcttatcggtctgtgttgaaaattatacatattagctccactacatattcaccaagtttgtcctcctggactcgagggatcctctcgtctcagcccccggagtagctgtgactacaggcatgcatcaccacgcccagctaatttttcattttttaatctttgtaaagatgaagtctcaccatgttgcacaggctggtcttgaagttctgggctcaagtaatctccctgcctccacctcccaaaatgctgggattacaggcatgagccactgcctggcccagggttttattcatgactttaattttgaaacatattttgtgcttcatttactcaataatttaaatacaatatttccatctagatattttttaattgtgagtttttaaagaattcatgatttgcaatgattttagcccttaaaaattaaatataatattgatgtagtaataactatttaacattcattgattaaaaacactttgctttttcagggtgagaacaaacccacaaacaaaaaacaaacagctcaaagttttcattagattaaggacttgaggaatctgagatgggtaactttctaaattctttgtaattacatctctgtagatcttgcattagaatgtggatttcggcttcccagtagagcctgatacttctaatgtgcaattagaggaagcaaagaaaccttatttatacaaatagaaagctaatgagatggtacaatcaatgagaatacttgatcatttcagagcttcaaccacagagtcttccaccacttaatctaacacctaacaaagaattagctgcagccaagtgaatatcctgaacaaaattagcttctctcttgtttgtctttatgatctgggttgaatacaagaacctcattatcagtgcctagcccttttgaaaaatcctttgttttgttttctttaaataatttagcaggaattattctatttagcactactccaatgcagacgttttagaaaattctcaaataaacatattctttctgcgtacagagactattttttaggaaatattatatttcattgtaaattattgaccttaaaaaggtaaactttttattagtaagctttttaaccttaaaatttatttcagatagattttgcttttaagtttcttaccttaaaatttttcaatggtaagatttttaccataaaaataatcctgaaagattttgctttacatatgccctagtcatcaatttaagattgttaaataaatttcagaaatcatgtaacaccattcctcaatttacagatcaaagaaacaagatatttaggccactctgccatttactgtaagaaagctggccagaaattagattcgtagactcttaggacaggctcttccacaaaagcatgctacctcccctcacatctttccctaaacacaattactagtattagtaaattgcttgaatgtatacaaataagaaataagcatttttaaaaattatatttaataagaatcattaattcacaattaaagggtgaatataccataattctttgtttctttgtttctacacatgagtttatttagattgatcctttgtataggttttgaaaaaacttgaaaagcaccacagaatcaagtgtgcactgaactctaagtagcaacatgactagagaactcgcagtgaggatactacctaatcataccaaaaagttccattattgtctgcagtatgcactcctctggtttaagaaatgagatattaccttttaaatattaaaacttatgttcaaggaatgtgaaacctaaaccattatttttacctagaaggaaattttcatttaggctcagggaaaatcagaccccaaggaagttatggcatatatataacaaagtttaattgagaaaagataaattcaggtctaggaagtggagtggaggctgcctggacaacttcatatgaaagaatcatgcagataaaggaaactgggaaatgtggtttggtagcaatggaagatgcagtcaaggagtcatacggaacaaaaaggaagatggacattaacacatatgcaatgagtcccatcaaaagaaacagcaacagattttggccaacactttgttaaaaaataagccaaactgccataaacaggaaaaataaacacaatcacttatctacattaacacttcatttgtatggcaacggcataaagccaggatataaatagattacttgaatgctgtcaattagtagtaagccttaaaaaatttttttgatgaaatttgttgtcagctgttgcattccctaaagatgtagttctggcacaggattttaacatcgtttcagtgggaagtatttgctaatatattgcaagtggcttgctgggcaaagaagggaaaacaaccctgattgctgacaatatttacataattataactagtcagccagtcactcctccccaacagtgaaggctgaggttctaaaactctttgcaagggcaaggaaaacaacaacaactcattttctctgctctaaattttaccaattatagatccctctcccattaataaataacatggagtttataataatattaactatcctaacatatttgtaaacctggctttaggggtttactctgtaaatctagccagagaaattataaatatagaaatgttttatgcaaatatatgctcatttcaactttatgataatgaaaagctgaagataaaactaaaccaaaaattgtagcatatttaaactatgagaaccagttaaaagacaaatgtaagaaatgaaaggaaatgatgtctctcaaaggatcataaatattccagataccttttatctaatcatttatcttgtgcaacaaaatctcacatcatgctcccgaggaggactaccttagtattagtcattccattttacaaatgaagcagctagttctcacagcaatcaaagataaaaatcattcaaccaggagtgatggaaaaccgtttatagcctaaaaacccacacatcattatttttgcagtttactttcatattgctgaatattgtttatcatctatttaaacatcctttatgttgccataggctattatgaaaaatagaaaataattcacatactttagtttgtaaattactctttacaaacaaaagtacttatcttgaaaatgacttcagtgcctcatgtgagctgaatgtaataatgcttcattacattttaataaacttggctgatttaaaatattcagtaaaatgacagtttatcacccactttaatgtcataaaatctttgtagctttctttaaactttagtacatagttctgttaaagtgttcatttcatttatgcagatttttggatgatacataatgagccatgatataagaattattttacaataacaattatatataaaatctcaaagtaattgattagttactctttttggtcaaattttgacttttttaaccactttttttttaactaagggaatttctttcacatggctttatgaacttgtataagtcacacaaatttcctggtgttagatatttttatttttgaaaaggaggtagaactctagtacataaagtccttttattatgcagattaccgtgtattaacataatggtaaaagatatttaaatataattcaaatatttaatggattatcaaatgtcaacaataggtcttttgttttgaattcacataatacatctctaacatacacagcatgactgtagcatttgtttcgtaaacaagaagcaattattaataacagagatagcaatgttgtattagtccatctgaatactgttatacagaattgcccgatactgggtaatttataaaggaaagaggtttaaatgactcacattcagcatggctggggatacctcaggaaacttactatctaggaagaaggtgaaggggaagcaaggtacctttttcacaaggcagcaggaaggagaagtgccaagcgaaggggagaaaagccccttttaaactatcagatcttgcgagaattcactcactgtcacgagaagagcatggggaaaactgcccctgtgattcaattatctccacctgatctcacccttgactcgtagggattatggggattgcaattcaaggtgagctttgggtgaggacacaaagcctaactatatcaaatgtttataagcaaatactgtatatttcttacaatactagtagtaatagtaattaggtgtttcctgtgttcacttaaattctctgttaaaccatcacaataactacgtaaggttgttatacccattctacatatgggaaaatcaagtaacggacaggttaagtaatttgtccaaggttatagacgtagatttcaaaaccaggcagctcaaatcagtattgtacacatactactatgaattcagcaacaatttattatatttcatttgaatttgaatttgatttcaatgtagcaaaatgtctctgctacattgaaatgccaatataattcaaataatagttttaggttttgtttgtttatttgttttatgaatggggtctcactatattgcccaggagtgcagtggctattcacaggcatgatcataaattactatggtctcaaactcctggactcaagtaatcctccctcctcagcctcttgagtatctggaattataggtgtgcaccaatgtgctcagcagaacagtgtttttgaactcaaaatccttcagtgaaactatggacaatagtatagaatcgctaaaaataaaccatggcctgcttcccatcaccatcttctaccagcacagctcctggcctcacaaagaggatgcctttgtatgttctcaatatattgattgtatatgttttcatcaagcatctcataggaatgcaattttctagctgaaattttttttcccaaaatctatgggagaaggatttaagagacttaaggggagcaaaaactggaggaaagtgaattatatcaaataggatgcagatggcatactaatcacagaaggaaaacaaagtaataatattgcagagaaagaaatatctaatgagcttcacagttgtttgtgtgtgccatgctatatacatggttttccacttattacagaatcattcttgagagcatttctaatgtttaaaccttcctcatcttagtaaaaactttcttatattcttattgaatatcttcttttcagatacatctccctcggcctccatcccactgataaatgacttcttcacatgaaggcaactttttaattcaaattcctgaatttcataaacatattttactttatttcattcatcttccatctttattggtagctgttgaccatccaaattatttcctttccacaaactatttgtctctggcccaacagtgctatctttcagaaagccctttcccagtcttcactcctttttcttcttccaagcagttatttaatgttgagatttctcatggtgaaatgttgaagctatttctttttttttcttatgcaatctccttaggtaatagcatcttcccacttgactcaatgttaaacctccagcccagacgctttctgcctcatatatccaattgcatacttcacattcctactccgatgtcttaaagatacctcaagggcaacatctcaagaataaccccatatcaatcctgccaaacatgttatttattcactcttatttacctcagtaaatggacccaattccaatgcagttgacaaatctcacacttgagactaatttgaacacccttttttaagtcaccacctatgtctaatctattctcacagtctggcaattttatgtttgtgtaagattatgggatttctgtatctctctatctttttttttttttttttttgtttttgagacggagtctgtctctgacgcccaggctggagtgcagtggcacgatctcggctcactgcaagctccgcctcccgggttcacgccattctcctgcctcagcctcccgagtagctgggactacaggcgcccgccactacgcccggctaatttttgtatttttttagtagagacggggtttcaccgtgttagccagggtggtctcgatctcctgacctcgtgatccgcccacctcggcctcccaaagtgctgggattacaggcttgagccaccgcgcccggccctctctatcttaccagtcccattcttagctaacatcaaccattttttaattaacctactgcaagagtcccgtaatttggttctttcttaattgattcttacttaccttcaatgtattcaacaaacgccaccaagggtgacatttttatgacattgtgtccataaaaactacctataatccttcaatggcaaattaatattatgtgcattatagctgtatatatgtgtatgcaaactaaattgatgttttataaaagttataaaaacaatctgtggttttctctagttcttaaagagagaaaatagaatgcataatataacctataagaccttgcatattttgttcttatatctgactctaactccctctgaacttctaccccaatttgcgctttggctaatatccattctgttcagtggctttgctatgcccctcctctattcctatatcaggatccttgcacacattagtccttctacacagaatgtgtaagaggtacttaagaattaagtaatgagcactttctttgtgaacacagacttttgcatttgtgaattcagaataaattatggtccccaaatttcttcttttttcttctttaatttctgcattctagtctttgtgtgttgagagctgaaagttataaccacctaattatttagtgtccagctcttggtagagatggtagtccctctctgcagctggttgtcccgtcatttcctcagatctcagcagagatggtagctccttcttgctagacaggtcaccccagtgagtgtccagctctccacagacagggtagaatattagaattgtattctaagtcaaatcagtgacttgggtgaggggctcaatgtgagactctttggaaatcaaatttacaccataaatagtatggaatgagcagcctgctggcctgggcactggacctcctttggtctacttcctgacactggaggctgtgtgtgttcagacttatttattctgatttgcactactatggattctgctttaaaagtctaagtgatactaaacaattaggtggttataaatagttaccttcttagctggatgagtgctaggatgtccagaatgaatagatttttatccagccctccagtgtaatggttaaaagcttcatggaattttaagaatctattcacttatttgctctgaagatttgaagtatgttgtaaggataaatatgccccatgtctgatttacatattgacaataatcactgccagtaattcacttcatttgctttggcttttattcccacttaaatgtacctttaggtcgtatcaagaaattggaaataaatgtgcttaatatcaaagtgatgatttcactctttgtattataaggagggaaaaaacatttagatcatataaagaaaagaaaaacataattcctcaaatcatccatgattttataaaagccataatggctcagcaaatatgaaaacaccactttgtcattttttcaataaaaattgaacatttccctctgtattcctcatttaaattgtgctacttagtctttctaatttattttattatcagcttatactttttattatagaaaaaggaaatcttctaatctttctaactctagttctataattaaagttttataaaaatctcattgaagaaacaatgtccactatttgggtgatgggtacactagaagcccaaccccaccatacacatgtaataagtaacaaaaaagcacatgtgcacctgaatctaaaataaaaaattaaaaggaattactttctctttttttaaatctcttttgttatgtggtcataatgtgttttccattgcttataatagaatacctgaaactggataaagaaaaggaatttatttctcataattatggaggctgagaagtccaaggttgaggatctgcatctggtgggggccttcctgctgatggagactctctgcagagttctgaggtggtgcagggcatcatgtggtgagggtggttgagtgtgctagtttggatctctcttcctcttcttttaaagtcatcagtctctctcttatggtaacccattaatccagtaacccattaatctgtgaatgtgagcagagccttcatgatttaacccaacctctcaatactgccacattggggaataagtttcaacatgagctttgaaagggacattcaaatcatagcagctgtgtctgttgatttatctgtctttttctattggtcatctcagctgtatctccacccttttatctcttctcctccctcctcctctcctcttttttcaactcctctctctttatctctcttggtctctctcttctctctctctctctcttatagtttgattttgtattcaggtttaagttacctccatatttttcaatactgcaagtatttactttcacttgaggcaccaggattcattactggtataggtcttcaaatgtgttatcataacacttgctcttttcctctggctgatgaaaataaaattacatttttttttcctttagccatttttcatcaaaaatccattctcaaatacagcatactaatatactttctccttaaacagatctgtggatgggtcaaaacacagttaattttgcagcctgtaatatgaaacttcaacccaggaactgttgctagaagaataaagaaaaattgtttattttctcatttgaagctgaaggaaacactaacagttttaaaagattaaacatacatatccaaattcaaaattagagatactgtaagtgtagaactggccagcgagatgacttctgggaaaagagaaagaatatgtatttgtggcagacacagctagttgcccatccaatacatattctccccttcttgcttaataaggaaggacaggcgtggtaacatatgcaaccaaaaggctacgtttcctggcttttcttgcaactaaaggtggccatgtgacctagatttgaccaatgaaatgtaagcagaagtcactgggtcttgttctgtctaaatggcagacttggtctgcatgaacttttgtcatttgtcccttgtatcacctgcagatatatggcaatgaagatttcataccgtggaactaactttaaggaaaaactttgctggtccttcattttaatgtgtagcccagcaccaaaactggatcaccacacacttccaaatttctgcttatatgagcaaaatacattctctattgtttcagcaactgtgatttctgtttcatgttatgagcagctgagcttatttctaactttcagtaattatgctatggcacagaaataggtcaaaactatgaagtagtgagtagactgtacattataaatctggttatatcacttccataatattttcatgcattgattttcactcttaattaagccatttttcttagtctttttttattatgaccaccagccaaaatgtatgtaacaggagttaagcaaaaggaaaaaaggttgaaaagaaaggagacattggtgggtggccctgatagaaaagtccaggagtgcttttctaagatgccatactttaagactttaatcaagatgtagacccagcagctttttgtttatttgtttgtttgtttgttttagagagagagacttgctatgttgttgcccaggctggtctcaaactcctggcctcaagcattcccactacctcagcctcccaaagcactgggattacaagtgtgatccaccatgcccagacccagtagttctttaaagcctgttttcatcggaataagattttatgattacaaaagtatcatatttttaaataacattaagaatatagagataagaataaaacagaaagctgcctctaccacctgcagataaccactgttctcttcttagattataaattccttctagctcacttctatatatttctatatattataatgtgccatttaaaaataccaataacatttaatagtggaaattacttaatcatattgatatataccacaggaggttattaaactcttatattttcagaaattacatgctttactggctatttctataataaatattactaaggcagagttcataagtatttccttggtataaattccatgtgaactatacatattttaaaggtttttatatattttaaaaataaactctagactttttatttgcactttcctcagtaacgtaggtgtttggttcctcccatttttcatttcagcagattaggtgtcgttcaaaatgaaaattgccaatcttactaataaaatgtaatctttattttgcatcgtagcaggttttattttttttcttttaaaaattcttctggtcaccttccactacaggaattataatactgaaatgcatatctaaaattaatgtacttatttctctattagttaagatagggttactactataatatgaaatatatgtgtgcatatatatatatatataatgacaaaactataacagaactttagtttttattcacaaataatttcttttttataactttactgaggaaaaattgatacaaataagtgcatatatttaatgtatacaatttcactagtttggacatactaatacacccatgacaccaccaccataatcaatgtaataaacacattcaacattcctcaaaatttccttttatctctttgctctgtgtgtgtgtgtagagtagtaaccttcccttgagatctaactgcttaaatttttaagtgtacaaggctgtattgcactatgctgaacagcagatctccagaactaatttgttctaaacaccaaatatacagacagtagatggaaaatacagtaggtcagagattctcaccctcagtactactggcacttggaatagggtattctttcttgtggggatagtcctgcttagtgtaaaatatttagcagcatcactgacttctactaaatgcaagtagtttactccccaacatgaaaatccaaaatttctttggatgttgccatgtatcccacagggaacaaaattgctggaacaagtggttccagcaattgggaaccacttggacagaagaaagtgtttataggccaagattggaaacagtgcttatcattcagcttagaatccactggctaaaattcagccatgcagccacatcaacataaagagatgctgggaaagataagccaactgtgaacaaagggaacagtggaaaagtggccaataacaaatactctaggcaactattacacaactttattacttttctcattttttttttcctttttgggggtggggtaactgttgacatttcttaggaatagaaacatattttctgctttgttttaattttgccagaatcattacctcagtcacctttaaaggctccacctaaaatactttctctatattataccatctttactgaagcatttatatatatgaaatatatataaatatacgtaaaatatatataataaatatatatatttattctttatatataatataaataattatatataatatattattatatataaatatatattattttatatataaatatatatttattatatatattatatatatgtataggatatttatataggaagtgccatctctttgtctcccaacaaacaaagctagcaaatcaactactgttgagttttaaaattttcatgctatcaactgttggccattaatctgcatattatcataaccaagagtataaatgtagggctttggtttgaatgtgtcctccagaggtttgtgtgctggaaagttaattgctgttgtaatagtattaagaggtaggattgtaaagagatgattaggccaggatgactttgctctcatgaagggattaatgccattatggggagttggttagttatcttgggactagatttacgataagaggatgaatccaacttgatgttctctttttgtctcctgtgcttgcttccaccatccacccttctgccatgggatgattctccctggatgctgtccccatgctcttggacttctcagcctccagaattgtgagcaaaatagacttattttctttataaattacctagtctgtggtattttgttaaagcatcagaaaattaaataagataggtggataaagtttctcagtcacatgttggaagccagatgcatgagaatggaaatgatccaatcaaagtcaagtttaaattggcagtgtttgaattttgcatattcctctattctcttattgaaatacaatgtaattgtatgttctatttctaagcatatgaataaagtctaaatttattttcctagttatttaagtgttcaaataccttgcatcatattttatgcctaatgtcattgctgagcgctgcctaaactccttacctttaatttcttaattgctgtaatctctatctttctgatttggggcatttttcttttcattttttttctcttttggatctttcatatttaatatactccttgtaacaaaagtcaattatcagtactccaactcttattgtgatacctccagtctttctgaagtcataagtgtatttacagtgcattatgaaacacataattgattttatactgtcagttggatgattactttttaagaacatttcatagagtttgcattaaaacaaacttgattattttttaaacaaacatgattatattgttcccaaatgcctattacaattttaagtagagtaaccacttttggcaaaacaaaggttcttcctggaatacttaatgaatataaactatttgcacttaattattttcttggtttgtaaaagattgtggtcttaaatagcttgtcctggttaatatacttcctgtgctgttgcttgcttgattaatgttaactttgcatcttttcatttcttcattgtataatggtaaattttgtatcctggagcaatcttaacacagattttttattaatgtacttttaattaaattgattttactacaataataggtcttgcatagtttttgcttatttctaatgataaggatatttacctaagctcactagttctcctcataccacagataattaagtgtatttatatgtggtgccttcaaaaataatttatgtaagtgaatatgaactcagtcttcagagttcttgcatcacctccctatcaatgaacttgagtgcttactcataaagataattttaaagattaatggtaataaggaaaaatagttactgtatacttacattctagtgaaactgatgacaaaaaggtcaattacattttagataactctaaatagtacacttaattgagcaagtaagttcacaaaaaataaagaaaaatctaagatcttttagagtagaatctccttatgcaataccaagtctgtgacaacacgtctaggtaacagatgactattttgagaagttttctccttgtagaggcactacaaaaataacagaacaattctgtgtgcttataagatccagaactgttataagggccagaacacacagaggcccttatctgtagactagtaaaagcttatttccttgtaataaaatagtcttaatgctaaaattcaaataagacttcatatggtttggctatgcctccacccaaatctcatcttgaattctgatgttgtgggagggatctggtgggaggtaattgaatcataggggcaggtcttttccgtgctgttctcattatagtgaataagtcttgggagatctgatgattttaaaaagaggagtttcccttcacaagctctcttctcttgtctgccaccatgtgagacatacctttcactttctgccatgattgtgaggcctcctcagccatgtggaacggtaagtccattaaacctctttcttttgtaaattgcccagtctcacgtatgtctttatcagcagcatgaaaatagactaatatagtatactggcaccaggagtggggtgctgctgaaaagatacctgaaaatgtggaagtgactttagaactgggtaacaggcagaagttggaacagtttggagggctcagaagaagagagaaaaatgtgggaaagtttggaactccctagagacttgttgaatggctttgacaaaaattctgataacgatatggacaaagagttccaggctgaggtggtctcagatggagattaggaacttgttgggaactggagcaaaggtgacttttgttatgttttagcaaacagactggtagcattttgcccctgccctagagatttgtggaactttgaagttgagagacatgatttagggtatctggcagaagaaatttctcagcagcaaagcattcaagaggtgacttgggtgctgttaaaggcattctgttttaaaagggaaacagagcataaaagtttggaaaatttgcagcctgacaatgctatagaaaagaaaatcccattttctgaggagaaattcaagctggatacagaaatttgcataagtaacaaggagtcaagtgttaatcaccaagacaatggggaaaatgtctccaggttatgttaacagaagagacctttgaggaagcccttcccgtcacaggcccagaagtttaggaggaaaacatggtttcgtgggccaggcccagttttcctgtgctgggcgcagtctagggacttggtgtcttgcttcccagctgttccagccatgactaaaagggccaacgtatagagcttgggctgttgcttcagagggtggaagccccaagccttggcagcttccaagtggtgttgagcctgtgggtgcacagaagtcaagaattgaggtttgggaacatctgcctagatttcagaggatgtatggaaatgcctgaatgcccaagaagacatttgctgcagggctggggccctcatggaggagcaactaacttgcttttgattctacaggctcatagacagaagggacttgccttgtctcagatgagactttggactgtggacttttgagttaatgctgaaatgagttaagactctaggggactattgggaaggcataattggtttttaaatgtgagaacatgagatttaggaggggccaggggagtttccctgcacaagctctcttcttttgtctgccaccatgtgagacatgcctttcaccttccaccatgattgtggagcctccccagccatgtggaactcttaagtccattaaacctctttttttgtaaattgcccagtcttaggtatgtctttatcagcagtgtgaaaatgaactaatacaaactttaaatacatatttgtatatatttatacttttgtatctcatatatatatatatatacttttgtttatatgctttggggatattgaaactgaagtattttaattttactggattttacattttataactttagaaatatcttcagatccattaaggaacacagaaagcagtaaagcagtataggatatcaaaagcactgagaaaactaatttaaaaataactatttacatgaattattttacacaaacttgaattgataattattctcaaattcacacactaataaaataatacattcctcatcagtactagtcgtttttattctcattgttgtaacagtaagcatgcaattttctaatatttgataaataaggtaatgcaatatggccaataaatattattgaggcaaaagtcaccagaaaattaaactactgtaagcaatatgtttgctattgacaggaaattattagtttacagccctaaatatcctgtcatgaattttgcttatggcacaaagtagcttttgttcagagaccttataactctaattttccacttatttgcaggactttttgattgccttttatgtgctccaccagccgtaggccatgggccatatcagtttgcttaacatctattacctgagcagcatcttacccagatttgtcacacagagcgtgcttactcaataaagaacatcttattgaatgaggattctggtcagacacatgctgtttttaacatcaacatttcaacaaaggcatgtaattctaatgtattgtcaagtattcttgtaagtactaaaaatatagagaagataatacagaatatcttcaaattaagaccttgctccagaccctaggtggtaagcaagccacataagtattcacagtgtggtaagttctacaatggataagtgcatattatgttttatatcacagatttaatatttttctttgaaaaaatatggagaataaaaatgcatgacttctttgagggggaaaacaactaaattctattagtagttaagtgtatatttttgttctaataattacaaatagtagtatttctctcattgagagactagactgcatcagtggtatgcttagcaatacaatctgtttcatatcctaatatagattagacaatcaatatatcttagtttcttctactttaataattttgaagtgtctccagacactagttaaaaatagaaattctgacaaaaaaagtgcataaatggcagctgagtgctgctggctgatacaaacacaaaagcacaaattagattggatgacacatatatattgatttgtgcattggttttattgatgccactgaccctgacccctaatcataaatgcctgaaccaaaagttcacacactctgtctcaaggtaagtgccttagtctgattaggctagtataagagaataccttagattggataatttgtaagcaccagaaatttattgcgcacagttacagagcctgggaagtcaaagatcaagaagtcaacagacgtcttgatttcaaaatgtaaaattttgaaattcagtatttgctgatgacccattcctcagagacagcgctttccagttgtccttaaatggtcaaaggatcaaaccagtttcctcaagcctcacttataagggcactaatcccattcatgagagcagagtcctcatgaccaaatcacctctcaaagccctcacctcctaatattatcacaatggggattgaatgtcaacatatgaatttttgacgagacacaaacattcagaacatggcactaggatagagactggaaaaactttaatggaggcacacagataataagggagagagcaggataaagatggcctatgaagctgttcctcccaaaggctgcttgtataactctcccttcattcttgtaaactgcctgcacattattgtttgtcttagtttgggatgcccacaattccatagactgagtggcttagacaattcaaattccttcacactctgggaagtctgagatcagggtgccaacgtggttaggttctagtgaaggacctcttcctggtgatgtcctcagatgatctttgttggaagtagagagtgtgtgtatgtctccctttttataagaacaataatccatcatgaggtccccaaacttgtgacctcatctaaacctaaataccagaaggctcacctcctataccatcctcatgggggggggggttaggattttaatgtaaaattttgggaaagatgcaaaaataatctataacattgtttctccagttagtcacaatcagtaggtattttgactgaatcttgaacgaatctacaaatttagaaaaatcctcaagaaaccgacatttactgtaaaaaaatattaaattgtttcttagatgctaaactcttagtgtgcacaggagcatgttctatacacacaatttttctttggagtgtttgtagcaaacactgaatagcttcatagagaagctgttactgctactgtcaaaaaccacagaaataataaacttaacaatatcaatacaaatacaaaaatttcaaaattaaaagtatttttaagattgaaacaatttcatcttcttcactcttcaattctacaaatcatatgaatcaaggattcataaagaatgaatgaatggtatataatgagagcattgcttctattctctgaaagcattcaaaacatgcccattctagtggtgctggaagaattaaaattaaaccagaaaatgtactttgcggccaccttaaaaatctttgtttttattacttagtaatagaaggcagtaatctaaaagtaaaactctaaagtgttttttcttgtacagcatttgaacttctttagtactagatattttcaaataaagaaggaaagaacaacaaaaattctaataatgtacttgtatattttcatcatttaggaattgcaaagattatgatcttatttatttacctttactacatcagcttgaaagctctctccttacctcgtttgattcttaatcactttgaatacatgtaaggcttgagttttagagatctatatctttaaaggtagctatatgaaatgaatgcattattttatattaaacagtcattttccattaaactaagaaatcgatatgttcctgttaaacttccaagttcatggagtacagttgaggttatccatgggacgttcagacaaggcatatgcacattaatcaccagctgcatgttgcaattaaaattcataactacagtaccttaaaacatacgcctctaggcatactaaaagcacatggccatcattcatttcctaatgaatacaatgatgtcaccattcttatcaccactaaacttccaggtataattttaggaaattagaagacaataagtatactgatgaagaaaagtggaaaatttgcaaatccaaattagagtatgtgttcattcctaacctgatgaaatctcacactttcaaaagaggaatgtcacagacaataaagaaatctccttttctttcttcctctaaagaggatgcattttgaagaaacttagtgttctttcactacatagttataataataagaatgatgtcaacctttaatttgtcttttccaaaaattttaattagaaagaaaaaaaatgccttgtgaccagggaccagttgttatgtagattatttaccacactgaatttctaaacactaattgaatattattattaacagtgatgtgtcctattggcagaggacagatctcctgggcatattacttggatagtagaaatattgtccatatattatttaattcacattttaatttaattgatgatgataacaactagaaatcatggaggtttattatgaatcatcatttgcccttctattccttcattagtccagatgggaatttattatgtacatgctactatctggaaaatattacataaagatgttgccagaggtaaaattatgaagacttatctacctaacatgtaagaaatagaacaaagagactctttctgttaaactgtttacacttaaagtaaaatctttttctgcgtttgctatgtagaggtctgatataacaccagatcacatgtctgtacacgttctgagcattcattgcctcatctattctacaagaacactgaactagcaagcaagctccttgaggaacaaacagtaaacagatagcaacagtgtcctttgatgagtgccatcttggaaggatataaacaatacagttgtagtcacccaacctagggggaagggagaaggggcaggatgggcaacaaagattgtttctctattggcttggcttctggagttggagagacctgaatgtgcctgcctcattaactaactgtatggccttggtaaacagcttactctttctctattaccttcacttgaactggaaatggtcatattaaatatctcacagttgtgaaaaagtaatgaatgaaatacatgaattccacttagcttactgactcagggagtgcaaaagaaaccctgttgctattaatattgttgtaattatttttgatcttttgtattattattaataataatacattgtatcttctcttttgatttttacaaaactaacaggtaatatccaactcacgtattttattccatttaagaggtaaagaaaggtgctcatagcatgttgatgacttgcccgaagacacaagctggaaaatgacagggtctagaataaaatcgagttgcttaactctgtttcctgctctgtaataaccgtagctgaaccaggttatagtgtgagttcttgacaaccatatttgtattatatggatgactatgttgattgcttcagcaattcctacaaaacacattgggcagccacatagagtttctggggttaaataatacgtactactaactgttcatctatatcttattcacaatctctctcttctccattgatttctggaatggagcatttactaatcttcatccagtgttgctctggaaagtttcatcttgagattgcatcattatacattcagtatataccaaataccttactccttcactgattcacaagtattttaacactctgatatttaggaagcatgactacttcacattcattagatttttaaaatatatttttaaaagtttgaggtgtatatttcattacacaagtgcaaatatatgtttctgggctatgcattcaagtagaaggtatctaagaagtctactaattttaattaattacctcatggttaaaacccttgaattattttcaaatagaaaataaccaaaattttattttaaaagaaagaatgccatgaaattatacgtttttgtacagcaataactagttatgtaaaatcattaagctcctgggtattggggggtgtgtgtgtgtgtgtgtgtgtgtgtgtgtgtgtgtattagataagtgcccaggagcagtttttttttctaactattgaaggttaatttctgaatatgggcatgagagggtaaacttcattcttagccatgtttcatttttttcctaacctaagaaagaaaaacctggtagtgtgaaagcattttgctaagttccatgcctgagtagtatattgtcaggtaattagtggagatcattgcattgcatgctgggtggaataagggctgcaagatcgggatctgtcacatcgcttcacttgtaatgaatttctgaaataatttttaaggatgctgcatattaaactataaaaggagcaatttgtgaatgttttagagctagcaactgattttaacttttaaaattatctaaatgattctgaacattcgtcccttccaaagatctataagtaaaggaatacaaatgtatttccaaaagtgtcactatatataaaaaagatctgaaacattgtgattgtttcaaatttttagaaatctggtaatttcttacgctaggtttcacattggatttattagatagaattaggagattgtttgtttttgttgaattttgtacaaattcaaccttaatgcatatttcactatgaaatagaggcagaatttacttataatagttatctttcagtttggtttctgtatctgacagtatgacatgaaatccatcaaacagtaaaacagaaggaaaaaaaaatctctaagcatatacattcatggaaacataaatcaaactgcaaaccctacagtgttaagaaaatatgaatctcttttcccagtaatggaatcaccttgaattccttaaatcaatagttcactgaacctgaagaacaattttcaagccctggcacatatgtaatctggtttacgcaatgtgctagaacttgttcaataggagaacttagttcagctgttagaataaaaatgtctttacaatacagactgcttaagcacaagatactagtgaacatcaaaatttcagaatattgctgttatcacatcaatatttgtggacattgcctagatacttaataatttgggaagaaatgaatagtgctagtaaaacttttaaaaagcattataaataaaatcttcattacatttaaaagttaaataagtcttattaatatatgtatgattgtttttcactttaagccaaagggtagacaggatacaacatacacggtagtggtctcttatatggtaacttgtatacaacagagattctatttaaaattttaagtgtatattacaggcttcctagaactcagactattctaaaacttaataggaactagttatcttttgaaaccatttacaagcttaactccaaagaaatattttttgtctgtctaaagtggaattataagcagtcctctaaaaccctaatttttctatacttttgaaagtttttaactggaatattaattttgaagaaaaagtggttcattgagtacacttaggtaaagaatgagttttccctgtagttccattactctcattaaaaccttcctcccctcagaaaaaaaaagcaaaacaaaacaaaaaactattactaacttgtcattgatattaaagaataaattaacaattttgctatcttccaaagttaagaagaaaaattcacagccatgcctaatatcacccagtgagatgatccataaacaaagattttctgtaaaaatgtaactgaggaactcacattggcttctctatttttctacagttttcaaactgtaatgaattttttattatcattcatttaattccatgtaggtttattcttgctgataacatgatctattgttctctgagccctgctgagattgccatttcttaaacagacagcacttattggaaattaaacctctactaatgtattataattattacttgagggtaatttgctgctccagcagggagtcacagccaatgtgatggtaacgtttcttccagagagctgttaatatttcttctatgctgaaatcccacataatggatcttgcctaaggctgattaatgatttcagagctggaacagtgatttgtagctaaatcagtcctcaccggaggagattcagggttatttcagtcaatactgttaaataagtgtaaacagtaacttcagtaacacacatgtaatctagtaggtaagaaagagtagcaataaaaggaagtaaataatgataatgctgcagtttcttcatttcatttatgcttataacagatatatgcttataacagggaagaaacacactgcagtgtcatcaaacccatggaattatttcactgcaacacatttttttctgcattgaaaaagcaatttctcaaacaagtaaaagcaaattgagctaagtgcctaaaataaatcagcatctttccctcctttctttcctttatatcacctttttcgctaaagaagaaattggacaaataacttgtaatgaaacttgggcaagagaaatttcaagtatggaaaaaggtttcgtttagcattatactctacaagcacacagagttccaacattgtccatgctgtccaagctccagggatttcatcttcacctgaaatgaggcagggcatagacatcacaagaagtaaccttgagatttccttgcccagaggcatacatgaggaatgtatagaatcaagactctctagtcactgaatttaattcttctttgttaacgtaaagtcaatatcaataaaaaggcagtgatataactgcagttaaggacaatgttacagacctcaaagtgcatctttcaacttgtatttcacaagggagtcctatctcccatgatccagagatctttaaacattgtgatgtgcattgtttgtctgaggcccttggctttttaaaaaatactctttaaatcattttttttcctaatttttgagggtacatagtaggtgtataaatttatgggacacacgagacattttgattcaggcatgcaatgcacagttatcacatcatggagaatggggtatccatccctcaagcatttatcctttgagttacaaacaattcaattacattctttaagttattttataatatacaattaagttgttattgaatatagtcacccctggattttgactatcaaatttaattaaaaagcagcttctgactaatactgtaagaaaaagaaatatttgtgagttaaaaggtgaggatctagatatacactgattgtgagcacagccattcaaatgattgtgaagtcaaagtgagaactgcgtatgccattaccagctaaataacataattccaggtaaagcataaaagatgggctgtcacgtattcttaggttttcaaacgcgtaggagaatctagactcagagaaatctctcaaagaaatgtcaatgcattttgtaaaatgaaactagagctatagcaattggtgttaaatttctgcaaattatacccagcttcctttctacttgcaacatcgttgtatactaaacagctcttccccacacatctctcacacacacacttgtgcatatacacacagatcacttgagtcaatggtttttattcttcaatcagaatcagtacaaaagcacatcttaacctttacttaaatcaatacaaaacagtgtcccaattaatagaaccagacatgacacatgagttttgttgttgttgtttttttcctccaataggctcagaaagtcaagtgcaaaggggaaaatttctccctttgataataaaaatagttttttggcagaccttcaataaagacctctacgtacattttatggaggtgatttaaagtcaaaattcttgagttcatagcccatcagtttttgtttttagtagctttattaagatacaattcatatatcatttgcctattaacgtgtacaattatttgtacaaatattcactgtcatgaaaccattcctataatccaattttagactatttcgtcacctcaacccatattcatactttatttttttttgagatggagtctcgccctgtcgcccagtctggagttcagtggtgcggtcttggctcattgcagcctccacctcctgggttcaagtgattgtcttgtctcagcctcccaagtagctgggactacaggcatatgccaccatgcccggctaatttttgtatttttagtagaaatggggtttcactacgtcggccaggatggtctcgatctcctgacctcgtgatccacctgccttggcctcccaaagtgctgggattacaggcgtgagtcactgcgcccagcgccatatccatactcttaatccacacctcctttcactcagtactgagcaaccattaatttgttttctgtttctatccatttgcctatcctggatatttcatagaaatagaataacaccgtatgtggtcttttctggctggtttatttcacttactgtgttttcaaggttcatcaatgtcgtaacatgcatcattctttcttttttattgccaaataacatctaattttgtggatagaacacatcgtgtttatccattcatcagttggtggacatttgggttgtttccactctttcagtattatgattaatgccattacgaacatgtgtgtacaagttcgtatggacatatgtttttatttttcatatatatgcttaggagtagaattgctgggtcatactgtagtaattatagttggcatattgaagaaccgctaaactactttccaaagcggcaaggttatattacattttcataaacaatatatgaggactccacctttttccacattcttatccacatctgttactgtccttctttttgattataactactgtagtggatatgaagtggtattacattgtgatttttatttgcatttccttaaagacaaatgatatggaatgtctttttatgtgcttattgggcattttggtttttttataaatatatatatattttcacccagtttcaattttttgtcttatttctgagttgtaaaacttctttttatattctagatacatgtcctttatcatgtatttgatttaaaaatattttctcccatactatgggttgtctttcactttagggatgatgtcttttgatgcacaaatacttttgattttgataaagtacaatttacctaaattttatttggtcatttcatttggtgtcatgttcaagaagtcttcgcctaactaaaggtcatgaagatttactgctgcattttattctaagaattttgtagttttagctctcaaatgttgctcataatgcattttgactttttttttgaatattatgaggaaggagtgcaacttcatattttacatgtggatatccagatgtctcagcaacatttcttgaagagtttttaatactgaaccatgtaattgcctcttctaagcctctgtctcttaatcagtaggatgggggtgatggataaaagtgcctcgttcactgagttgttttcaagattaaattaaattcaataatacacataaaatgtctaacattgttttaatacatagtacttgcactttagctcttaacagatctctacaggttatcataacctatttctaacccaagggttgtctgctcactataacgcttgctgtcatggaaaatattctgttgttaaaaatactctctttttccttatccctctgcctcaaaagttgtccctgtatgaatttctcacttagctaccactgaaatacctgatgaggtaattcatacttaaaaatgaaaaatgggccaggtgcggtggctcatgcctgtaatcccagcacttcgggaggctaaggcgcgtggatcacgacgtcagaagatcgagaccactctgaccaatatggtgaaaccccgtctgtactaaaaatacaaaaattagctgggcatgatggcctgtgcctgtaatcccagcctctcgggaggttgaggcaggaaaatcgtttgaaccagggagtcggaggttgcagtgagccgagattgagccactgtactgcagcctggcaatagagtgaaactccgtctaaaaaaaaaagaaagaaataaaaaaatgaaaaatgataaaataattttattctttaacagaattatgttgttattatgttgagacaaatatagcactgtaaaattcctccacacttttttgttttgttttttttgagacagggtctcactctgttgcccagactgcaatgcagtggcatgatctcgtttcacagcaaccttagcttcctgggctcaagtgatccttctgcctcagcctctcaagtagctgggactacaggcacaagccaccaatgcccaggacatatatattttaaatttttttgtagcgatggggattttccatgttgcccagaccggtcttgagctcctgagctcaagtgacccacctgcctcagcctcccagagttctgggattacaggcgtgagccactgtgcctggctcatgctccacacatattttaagtttgctttataatcctgtgttatcatttattcatttgtatattaaaggcttccaaatgatgtgtcctctattaacataaaaaagattatctgaatatagtaaaatgttgatttattaacaactatgtaatcaaaaagaacagcaaatacagaaggaggtgttaatcacaaaataagctctgtctctttcatagtcttgctaagtttcatgtctctggtaggatattgtgcatttttgaaagatgccttgagatggccaattctgtaagccaaggaaagtctatgagaatagaaagcaccgagaatttataattagcttcatgtactgcatttgtaagttaccagctgtgtgactgacaggactcttttcccctacatagtcccgtttcattgtgtgcgagtaacaactggcgtccaggagattcatgagaattaaatgagatagtataagtggaatgctgtcaagatgtaaggcattagataaaatatattagatagtcacaagttaattccagcttgggaaagaaaaattgggataatttagaataaaatcgttatttgccaatgtaaacatataattattttaacatgtttaaagcattttaataagtcatgtgggtataatgataaaggagaatataattgcagaattacgtgactattcaaattattttcacatcttttgaatttaaaaaatagtaaattatttgagctagaaatttctcgcttccactttacatttgtctagtgcagatttttagatccattggccaactaatagtggatcccgcagcgatggaacatttctattatattcttttctctgtaacgaataataccatctggcaacctgagtgtttttctcatcattacaagtcagaggagtgtgtaattatctcactgaaaggaaacttctgaagaaaagcaaatgtaagaaacattcttgttgcactggatgaaaaaatgtgccaaaaataataggatgttgtataactttatataaagctacaaaaaataaacacaaataaacattatcaaagaaagcatcatgctgtatattatgaattactgatatctcatatatttgaggcttttgacatagaggttagaactctgtgactgagaatctcactcttgaattaattaggaagagagtattttgaatgatagcaaaatggccaattaatgtttatttaataatttttgagcaggcgttaaatgattggtttcaaagtgcaataatatagtctgctttgtaactagagctgtgaaaaatattcacagcctgaattaaaaggagaaatgttaagaagaggaaagggattgtctaaatagcagtataaaaatctctgtaattatgttaacatcatggacaatctgtagtattctagtatatatgaagaatacctatcttctctccaggatatttcaattacttggaaactgtcctggtttcaaacttttggaattgtagatattctgttgtgggcacataagatggaaagagggaatagatggataaagcatggcgtgatgagagctgttgggcttaatttgcaccaacattgtcataatgcttttggccctcagctaacagtagaaacgtgtatgccacattataatggatacactggaaaaagtcctgttcttagaacccttacaaggatgacatatgtagaataggtacacaatatacagggtacatctttgaagacttttcccaaagctacagtgaaagtgttacaaatagcaaaataaaaatgagtaaaattggaagatccttccccacagtaagtgcaaatacataactaggaagttgacccatatttttttgtttcaaaagtatttattcctatatattgcaagaacttagtaaaacaggaaaaaaaggagaaaaaagcttaaattgattgggataatagatgaagatcaagctagacaggtttgtgtcaaaaatcttagtttttaaatattcattttgattgaaataatattaaattttaaaaaactattcacagataaggagctgagttggaagtgatgaagtttagggtcttgtatcaaagtagaaatacattgtgatcttgacacaatatgacagagatgagtggacaaagtcatgggtacaaataattataataaaatttattttgtgaaattctataatttagctataaaatacatgaaagaagaggaaatttttaaccccaaatttgaattttggaagataaacagcacagagatgatggtatttcacctggttttcaaagatagttagatttagacggctatgagaaaggaggaattacttttctgaaagtggattgaaagaaataaaaattgcatgtgacttgaatttttttccttgtttcagtaagaaggcactcacaaacagaaatatgaagaattaccaaagcactattaatggaagtcaatttattgcacaaaactgtgttgtataccatgaaacatctttttgtttgtctttttgctttccttggttttagtgaatcttctaaattaaatcttcttcctgataataactcaaagataaaacagggtatgggaattttaagtgatcttcaacattatctattcacagtactgtatccagtaggataatttttaatggccatccaagttttattacacacttcagctaaaaaggaatccataatattttaaaggagccaatggtataattgaaaagctgtaatggttagcaagtatttcattaaatttacttattccctgactcaatctaaatctatcttctggagatacagataaaattattatatatcacatgacagcaagtatataaagtcaaggagagaaggaggatataacataaggaacagaacagtgtggcaggaagataaatgagctgaaaaatacaatgatagacattctgataacctttttgtaagttcaggaaaatcccttaacttttcttttgtgccacttgcacaaatcacttagtccctctgtgcttgttacttacctttaggggtattataaaattctaatttctgattaaaaatcactagctgggtattttgttaatcattctcattatttaagattttattattctcttataaacagactcagtcttttcactatttctcatgagacagttttcaggtcatgcaccatcctttatctcctccatgggacaccatggttaatgtctctcagactgggatgtccataaccaaacccaataccacagatggaccgatccatgcaatgagttttatttccttttagctagatatgatattttgttaaaaccacttagcatttacctatgttttttaaaaatatttttttccttagcaattgctcatctataacttgcaggaaattcaataaaatcataaagtgttttaaagtcacagttgtgtagctaaacatgtaacacttcaagcagaaatataaaactatacatgtatttcttgcatagaactgaaaaaagcctgtgcttcaattgggcattccttattttttacattccttacttcttgtcaatcttggaaccatgttaactatgagctagatgatattactattagttaacttgatacatcatctagctcatagttcactatcctttactccaagatccagtgagaagttgctccgcagctggagaaattggagatttgggactaggaccatggctctgcaatttactacctatgtgatctcaattcattcaaaccctggtttacttctgctaaaaattgcatcataatacctaactgaaaggtttgagtatacagaaaacacatcttaaacttttaatgtaatgatttccatttcacaaagtccaagaggttctcacaaatctttcctcaaatcttaggcatcaggctttaaaccttttcaaacaagatcatctgggcctataatgcctccagtggaagccatttgcaatcttttgagattcactttttcctacaaggcaaaatggaagcatcactttccctgactgtagtagtgccatttggcttaccctatcccccacactaattgtcacccttttcttaaaatctagcagagtttcttacacactgtaaatgttcattaaatattagtaaaaatgataaatagaagaacagaaaaaaagaaggataaatagaaaggaagagaaaaggtaagaggaaagaaatacatgtttttcttttcctcccacttcactttaactctcccattaacataattacctacatggtgatatagtttggatatttgtcccctccacatctcatgttgcaatctgatccccaatgttagaggtggtacttgatgtgaggtgtttgggtcatggggtcgaatctctcatgaataaattagtgcagtagtagcggtggtaatgagtcagttcttgctctattagttcctacaataactgattgttgaaaagagtctgacagctccctccatcagctccccttcctcttccaccatgaactgaagcagtctggggcccttaacagatgcagatggtggtgtccgggcttctcatacaggctacagagctatgagccaagtaaacttcttttttgaaaataaattatccagcctcgggtattccttagagtaacgcaaatgtactaacccatgtggcatttcaactacatgcctccatggcttcttcacatcatggatcatgggccatttaaggtaggccttttgtttaattcatgtctatcagttcaatgattaccaccatggtgagcgggaatgttaggtgcaatatattaaagaggggaaaaaaaaaaggaatgcagatcaaacatatgctcctgtagaaggattttaaagttcaattagtttagttcttccttgggctacaaatgggactgggataacagcattcaaggtatcagctgacaatgcatgctacagcatgatgacagtgttcttttgatgaagttgtcacacaacatgaaaaaaagcaacaaaattattagagaatccttgtatgattccagtgattgctttattttctttcctgcatgttcaaattacatttgtaaaattgcattcaagaccagagttaagcttacctttttttttcctgaataaaccattgcctcccatttgttttttcctgccatttctaacattcttttctttattctcatgatgaacaaacagatatttcacaacagattttctattaaagttggtttgaggtttgaattcacaccaaacactaaatattattattcccttttgacttactccatgctttgttttctttttaatttctttttttttttttcttgacatggtgttttgctatgttgcctgggttggtcttgaattcctaggctcaagccatcttcctgcttcagcatccagagtagctgggatgacaagcacacacaacctcttgcagccatgctttgttttcttctcagaatttgcactacctctgaacatgtcttatgacggttctatttaattggcaagggaaaagtcattttgtctttattcatttattcttcaaattctcatatggcaccgtattgcaagccatatgcagtgctaagtgcggggtagacagcattgagcaaaaaaagaagcctcactgccttggcagcttgtgagagtgtgtggggactggcgggggtgtggacagggaaacttctcatccagccaaagtggtcatggggaccaataaaggaggaagtaagagagaaggggacttagattggggctttataccatctttctaaagtaaagaaataacccattttgtgtgccttttcttttaaaaataacaatgatttttgaaaatttgaaaaaaaattagaaaatgaacattattcgtaatgttgtactcataaacccagtatccagcttgattcattcaaacattgtttacagagataatgtatatacatttctatgtatatgaattatacaacataatatatgtgttttatttaataggatatcatattcttcatgctctataatttaccaattgaaatgtttattgaatttatatatatatatgtattatctgtctgcatatacaaatgaggagtatttactttcttataaaatccatttttagactatgaatttgatggctgcagaattgtacactgattcatgacttatctattccattattttgaaatatttagttatttcatcaatttaaaaaaaaaattatttatttatttatttgtttattgagagaaaggatttcactctgttgcccaggctggagtgcagtggtgtgttcatagctcattgcagccttaaactacagggctcaagctatcttcctgtctcagcctccaaagtagctggactacaggcacacgctaccatacccagctaattttaaattttttttgtagagatggggtcttgcttggttgcccaggctgacctctttcatcaatataaaacaataatatgatagatattttaatcttaggatccatgtcaaacttaaaattactggataagagagaagaaacactcttaaatcatcaacttaaaataacaaattgcttttgagaatgatcacattttctttacaatctccatacatgatttttctacttagaaatccttctacattccaaaatctaataaaatccttcacttgattatgctgttgatagtctcaaatctatactaatattttttaattgttatgttaacttaggtgagaatttctcttcaattgctctcaaataatcaactgcttaatacaattgccaaatactctattgtttttctatttgtttaggccacatttgttatgtgattattctgtttctagaactggtttcttataaatttttttacaagagtatttctatttctgtatttttttatttagttaattgaagagttactttttaaaggtaatgttaaactttaagttatgttttaaaattagaataattttatatttgcaggatagtgcagttttcttccaccccttgtacacgtctttcaatttccttttaaattaatgttttaagttactatggcatatatatatacacacacacatatatgtatacacacacacatatatatacatatatatgtatataattttactttaggttctggattacatgtgcagaatgtgcaggtttgttacataagtatacatgtgccatggtgatttgctagacctatcaacccatcatctaggttttaagccccgcatgcattaggtatttgtcctaatgctctccctccccttgcccccaacccaccgacggtcctggtgtgtgatgttcccctccctgtgtccatctgtcctcgttgttcaactcccacttatgagtgataaaatgtggtgtttggttttctgttcctgtgttagtttgctgacaatgatggtttccagcttcatccatgtccctgcaaaggacatgaactcattcttttttatggctgcatagtatcccatggtgtatatgtgccacatttatttattaatgatagattatatcattaatggtcatttgggttggttccaagtcttactattgtaaatagtgctacaataaacatacgtttgtatgtgtacttacagcagaatgagttgtaatcctttgggtatatacccagtattgggattgctgggtcaaatgttatttctgattctagatccttgagaaatcaccacaaatatgtagaccgatggaacagagacatcagaaataacaccacaagtctacaatcatctgatcttcaacaaacctgacaaaaacaagcaatggggaaaggattccctatttaataaatggtgctgggaaaaccggctagcatatgcagaaaacagacatattttaaaattatttataatacagtgttaaatctttattattctaaattttctagtttcttcttgacaatctttgggtattctttctaataaaacatagcaatttttttattgtcactttcaattgaaattgcttggaatttagagattaaatcttggcatttgcataacatttttaatgacatctcagaatttagtatactatattcaagttttctttgttgatctttagaaagattttatatttttcttactgtgtgctctgtgcatttcttggcagaatttctttccctattttttcaagtctgaaattatgaattaaatttatctatttactattctaattagccatcattttatgaacactcattttttattcaacaatcttaaccaacactggttcttttcagttgagttttaaattagataaacctgtctgtaaatagtatttgtctcttaatcccaccagaataggttttagtgtccatccttaaaaacattatttttcagctgggcgcggtggctcatgcctgtaatccctgcactttgggaggctgaggcaggcggattgcaaggtcaggagatcgagaccatcctggctaacacaatgaaacccacgtctctactgaaaaatacaaaaaaattagccgggcgtggtggcgggcacctgtagtcccagctactcaggaggctaaggcaggagaatggggtgaacctgggaggcggagcttacagtgagccgagatggcgccactgcactccagcctgggcgacagagtgagactccgtctcaaaaaaaaaaaaaaaaaaaaattttcttttattttacttttctccccatctgcatcaacttaaaataccatattgactttaatgtgaaaacagaaatgttcaatttttgtaaggaatggatattaaattctgtcaaatacctttttagtattaatacatgtttttaatacacttttaaaaagactaatatatattttttcaatattttaattttgtacattcatcagaatattgctcagtgggtgttttttattcacataaccataggtagcttaacatatttgttaataagaaaataagcttccttttaaggtgtagctttctagcagctagaatggcttctgaagatgtttcttctttcacaccaatacatacttcagtatgcattttaacagtattgctatgtcatctcagtgtttttaaaatagttacacttacagtgctttatggaatattctctacaatattgcaaggctgggatgcctggaattccatttctattgaaacaattaagctagcaggaaagcctagaggccagaaccttggtctctagcactgaaaccaagtatgtaatgttcaagaaaaaaaaaaaatcttaaaaagaactcctaccgtgtaacccagattgaagttatttaagaaaatctttcattaatcctggaccataagttctgagcccatggttagattcacagcgcatttcactaggggaatccctttagagcacgattataaaaactgtcatttgatgacacatcatgctaccatagtctttttcccctcccatgaaacagtaaagcagatgatattaaattatagagaagggatgatttcaggtgacagagtaaagggatttgatacagagatgttgcaggtgaggttcagagtgaaacattgttttatataaaagaaaacagccagccgggcgcggtgcctcacacctgtaatcccagcactttgggaggccgaggcgggtggatcacgaggtcaggagatcaagaccatcctggctaacacggtggaaccccgtctctactaaaaaatagaaaaaattagccaggcgtggtggcgggcccctgtggtcccagctactcgggaggctgagacgggagaatggcgtgaacccgggaggcggagcttgcagtgagccgagatagcaccactgcactccagcgtgggcgacagagcgagactctgtctcaaaaaaaaaaaaaaaaaagaaagaaaacatatgtatattctgaagagcacatgtttttatctattcaattatccactctgaagtattttccaaatactttggcaaagcacattgttatggactaaattgtgtccccttaaaatgtatatgttgaagcccaaatccattgtgaatttatctgtagatagagcctttaagaaggtagttaggttataaaggtggggccctaatctcatataactggtattctcataagaaaagaaagagatacctgagagccctctctgcatgtgcacgaagaagaggccctgagaagacacatggagtaggtggctgtctccaagccaggaagagagacatcaccagaaaccagtctttgatcttggacctctcacccccaggactggaagaaagtaaatttctactgtgaaagtcacctatcctgaggtgttttgttatagcagcctgagctaatacaattgaactcattttatattttagagactattcagataggttacattcccttaatgcccgcataaaggcagggcttttttttttttttttgagatggagtttctatctcgttgcccaggctggagtgcaatggcacaatctcagctcactgcaacctctgcctcctgggttcaagcaattctcctgcctcagcctcccaagtagctgggattacaggcatgcatcaccacacttggctaatttttgtaattttagtagagatggggttcaccatgttggtcaggctggtttcaaactcctgacctcaagtaatccgcccacctcggcctcccaaaatgctgggattacaggagtgagccaccgtgtctggccaaaggccagctttttactaggaaaacaaagctctactgatttatagaatcccagactcacttagtcattgaagctcgttaaagcctgaaagtacttagggaagtttatatggaagatcacaacatgtctttttcatgaatgactgacaggatgaatttccctaggcatgtcaatcacagaagttttaattgatgccattctcaactactgtgcatgttgttgaaaagcattacatttagctgcattcaatccccagatatatatatatatatatatatatatatatatatatatatatatatatatatatatatagtgtgtgtgtgtgtgtgtgtgtgtgtgtgtgtgtgaaagagaaagagaagataatttgacaattattagaagtttggcagttcaacaataaaaactaaataattctcatgaacatgctttatggtgggaaaatggtgatgagttttctccgtatacaattaggtgtagtttctctatgtagttgtgataccaatatttctttgtgtttgatgtgcatttcttatcaagacagaaaaattgtgtattctgtgaacagaatgcataagaatttactgatctgaaaagtaatttggtgaattacctctacaacagtcatgcaagcaaggaagaaataaaatgctataagcacttacatagttcttatcatgtgaatcaaaacctaaaagtgtaaccaaacgagatgattcagtcttatttacacatctgatgtgctttttctttaacacaaaagggttctaacattgaccactatcatctgtcttttagaacttatttcttattagtgatttaatatttaaaaatctttaatgttgtggtttaacttaaaatataggttcatataggaaaacttctttttagaacaattatttagaaatgataccaatacatgtttgttaacacgattaactacaaagtgggatttcatgtgaatgaatttcccaagggtactgagatttactaatgtatcgaaatatcagaaaggctttgatacacaaaagctctaaattatacgtgaacattagcatcgaaataaaagcatagtcagacagtagtgccccctggagaagacctgttgtattgtaagcagtgccttatggaagcaatggatggctcagtacctttctaggatctggtcccaagaagggtaccacacatgattttccgagatacacaaatatcatcaataaaacaagaattaatacatattaaccaaactcacaaatgtacatgtaaatataaggcagaaggtgttataagacataaaattacttctattttagaaagaatattctcttcctataagtacattgaactgaaaagccacatgacaatcagaagattgcctaatgagctaaaatttaattcaaaatagggatagttcggtgaatcatattaatgcctattgctattagattatgttaatatcatgcatccacagccaggaacgatggcgcacacctgtaatcccagcactttgagaggccgaggcaggcagattgtttgaggccaggagtttgagaccagcctggtcaataaggtaaaagcccgtgtctacaaaaattagctgcatatgttggcgcatgcctgtaatctcagctatgtcaagaggctgaagctggagaattgcttgaacccaggaggcagaggttgcaatgagccgagattgtaccactgcactccagcctgggtgaaaaagtgagactctgtctcaaaaaaaaaaatattaacctggatagtgctaatgacatgctgacaaattaaaactctccaagagataccctccagacccttccctattaacaaatttattttccttttccacttcaaacatcctgtggacaaatgttctgtgttgaatgttgcaggttgcccactgaacatcttctgtcacatcctcatcacctatgagaactctgtgtttaagaatcttcccctcaccacatgggcatgtgtcaaggcatggctgcctatagtcccaggtcaaataaggcctgatgtattactttacctcttgccaatgatcactccaaaccttgttatgttatttaactctggcctatgaaatgcatgatgaaatatgtataataacttttggcaaagtttcttatcgcctaagcagaaaccgtgataagaaaatgttttctattccttttgagtattgttgaatctgtatatcctagggaagaattgctacactggttgtcttactaaaccaccttcttactatcctaaggagagagtcaatactggtggtaagacacagagaaatgaaaatcacctagatcactgatgatattcagttattgaatccattaattctaatgcctctctatatctgaatgaccaggtaaatgagatataaagtagtccttaactttgagccaatttaaagtggtgtttatattacatctgaaaagactttttaataaatagagagttgtaagatattcttagaacacctccccattttcttgctagtttctacttaagagaaatatagctgggatttcttccttttcctctgattactcttcctttattttaccagtttatctatcttcaaagctcagtcactgacccacttccttttcctgtttatactctttgattgttaatctgatctgatcttaaggcttggattctatccgtatgccccaaacttgcaaatttatttctctaacaaggccaccttagaggctcctttggccagctgcctacttcacatattcatttgtaggtttgataatcacctcaaagtgaacataaacaattaatctactattactctctaagttctcccatatcagcaaattgcaccctcattgatttataatcaatgaatagctctgtctccaaacataacctgaattatcctaatgttctccaactccacagtcttgaaatgctacaacctttactgtaaacaccatcattgaatccctattctacagcaataagattaaaaaaaaagattgtcacttctcatattaaaaatttcaggacttcttgtcctgaaaacaaaattgaacttcttataatatcaaggaaaatccttcataagctggttttgcccatctttcttattgcaactaacactatgttcattctccctaagtaagatctagctctctggatctcctttagatccccaatatctttcatgtcctaaagcattgccttttattactggttttagatcaatttgggaggaaccttctactcccatattttacctaccaggcttcttcatatcatttcaatctcagttcaaacactatcttctgaaaaccttttccctcactactcaatctaaacaatttcccttcctggttctccacaacattacccacccaactttgtaaatggtttcaaatattctgggttgacaggaaaatgttgtgcttttgttagagcttgatgggcaatgctgtttaaaatatcagctcaatcatatgacattcccatctttcctaaaatccctgctttatttctttccatttaatagactgacatttgatataacaaaaatttattacctgttcaaaacccaagactaaacacaagacttccagctacttgacaactataattgttgttgttttattcagtgttacatcatcattgtctagaggcgtctggaacaatcatgaatgataaagataacagtatctatcgtaggatgaatgagttagcatgaggccaggggttgccttacactaactactcattgtgtattgaatattattatactagtcattcattctatgcaacctaagtggaaagactcccagctccattccttagttaggaggaggcctagacccactaacaatggtaaggggtgtgtttagaaagttcatatttcgtcacccatatacaggtaggaaccactgatacaaggcagattctgataatctctcaccaatcagattgtaatccctgctttgttatggtcaagtttttctgctgctcagccacctccttctctggtgttttctcttctctacactcatgcaatacatacagtcgttcaatgtcctaagaaagtctcctcttctcttggaatctcttcctctctcttccccttctccttgatctattttgactttttatgtagctggtaaggatgtgataccttcttatagttatgaatgggctaagaagaaagtgaatatagatattttttcccctccagctcggtcatgtcttcccatctagtctatcaaatctctttattctgcacatcagaatacaagcttgataacaataataaaaaaaacccttcactttcctttgctgttcttactactgggatactttgaacagtttgaatctcatatggtttgcatgagagaccctggtcctttgatctgctattatcaaataatgctccaaattgcatcatcttttcccgaaaaccttaccactttttacaatagttacattttgttaagtaaataaactaacttttctgcaataagcagtctttttcctctcatttctccttccctgattcaaccaaactggccaaggaataaagatgaattttactgtatctctcctctcaatgtttcattaccctgctcataaatctttagcaacattctatttgctgcaggataacctcccacatctttgacatttattaccatgtatctgtgtatactctaatccttaccaacatttccaaaactttattttccctcagttgttaaaaaagcaccccgttcaagtcaaggggatctttgtgctataaaacaatagaccttgtgctatctttttgtgtgtcttcagatatcctttcctcaactacagaccacatcatgcttatttatctaaactatcagctgaaatatcattttttctccctttctgagcaacatagccttacttgaattttcttttctctgaatttgatttgcactaacatcctacaccatctgtatgacattttcccatgataacttttttaagtgaatttgttttttgaatctttgttaatatcaacttttttaaaacagcattttaagatgcttagcacctttttcccccaaaatgagtgagtgtctaagtaaaaagttgaatcagctcctgaaattataaaacaagatgtcatattaatagtgttaactccacataatagttcagtgttaagaaaaatgtggcaaaaaaattaagtattctctgcattctttgaaccctatcttccctttttattttccaatgcagttaatttggaattcttactatacattgatgtgtcaaaatgagtattgtgaaagagaaattatagaattgaaaaccatagaaaagacaataaaactttaaataaaatgtaattttaataagaaatgttggagctggtttttcatcctaaatgtctctactgcctttcttcacaaagaaaataaaggcaatgactgtattatgtatacatgctgttttttattaaaactcttggacaaatagttaaggttaacataatagacgtatttggagtgactgtgccatgtaaaacaacctcctttctttgataactgtccactcaccaaaggcggggacatctaattggttctcaaacattttttggggggttccatgtgctcttcacattcatgacttgggtttacatttgatgtttacattattttcaccagaaaatcagaaatatttttcacagacaattaaattgtaaaagttttgcagctgaggatttctacacatggaacttttttgtggctatcttatcctatatatacagagaggcagcgaaaggcagcagcaggagaagctggagagagaggatgctaagatgtgtagagcagtggggacagtgatgtctagctaacaggtgccaccaccataaagtccttaaaatagtcctgttttcttgtagtaaaacccatttgcataatccagtgcaagtgactttctgttatttgcaatcaaatttttttttagctaagcaaaaactattttaaaatactcctgagggaaatttcataaaatattagggttatatcactagagttctaaaagtccagtaaagtattcacaagcaagaaactgggaaatagtaaactttacaattttatacaacaaagtattataatgtttggcagctgataaaaaatctgttgaaatatttacaagaagtaataataattatagaaaatctagaactacctaaactgacggggaatagtttggaaaaagttagaaataacatcttaccattattgataagattatctacatctattatgttctttagagaactataaacctcaattttttaggcagatgtcaaaactatattatcatacgtgtggtatttatgctgtggctttcactttttggaaacttgaattgttgaggaacccattatgatttgttttcttttgcctcacatattatggtttgaattaagaaattccaccttccttatacaatgtataaaaaacataatgttagaaataaagggaagtcctcttcttagctcatacaaaaaattctaattgaatgaattataaatcatctttgtatactgcatggatctgaatatatatatgcatatatatacacacacgcatatataatgtgcgtgtttgtggggggagtggagttacatatttctcagtcatatttccccacccagtcatatatatatatatacacacacacacacacacacacacacacacacagtgtagagatacgtgtgtgtgtatcttgcattggttctttgaatttgtaacttacatttcctcaaaatatagaaggaggaattgagatgcagagagcttacatttccttgctcaggactacagagtcaatgaatggttaatcaccaaggatattaacaaggtctgtcaaacatactgttttttcataacaaatccaaaatcgtgtcatctaaccctcagctcctgattcttgagattttggtagtaatgcaaactgtctagtttccatttcacaatattaattcaaagtaaactttttgcaaaaataatggtttcattaagaaatcaacacacatgcacacacacacacacacacacacacacacaaacacacaccaatgcaccatttaggcacatatgtatttcccaaattataaaatgggaattattaaaacccttacaatattatagtatttttgggaggaaaaaataaagagcactcctcaaattcagtaaatggtgtggctaaaaaataaagctatgtatgccaccaagggagaagataattacattttttttccttttaatatacactgagggataaggagatataatacaatgaaaaaaagcattaccacatggtttggtatttaatcattgcttttatgtgtttgttaataagactaaaaatgatgatgatttcttcagcatttttttcatattctaatggtatacttatacaaatgctatatatatatacaaaatgctataataaggtgaatggaaagatgttcctattatattaggtttactttcattgttccttgaataactgtcataaaacatgatatgacatatgttatttatgtcatttaattttggagaggtttcagagagtgagtaaatgtatttgcacaattggtatctcaaagcattaaatgagttttgggcagaagaaatcactttacagataaaatgtagttggctctcatcacttatttctaacagttttaactaaattagtaggtttcccctggcaggtactaacatccatcccattcaatatctacatattttggatctattttaatatgtagatagagtgtaatcttaaatgcttctgtttataacttacaattattcccttgattatctttctaaaaagaacatgcatgcttatgtttttccattttagtatttataaacatatctatataaggattcataaatcataattcattcataaatcattatgaaacatatacacaaactaaaaagaaagccaatcatgtatcacagattttaccttgataaataatatgaatgttttggtatgttacatttatttttataatttatttgttttatttcattttatattccaaattcaatttaaatgttggcttttctcttaaattctcctgggcatttgaataatgttacatatctcaattagagagtatataatatttaactattttaatgtatcatagtttagttagctcttaatccacaaattaatatctgttttgaatatattactactataaatattgctagaatgaacatctttgtatatcaatttgcattacattaaatttccatatttgaattactgagaaaaagttgttgggattttaaatgctgttcatagatatctaagccagtaaaaccatggtttaaaattgtttaaataaatggtctcataatatccttttctttttcacactattctgaaaaagggggaaaatctcattgtaatatcccattacattcttcctaagaaaataaatttacacccaaacaagacaggctcatttcagaaataactcccacatctaaggattcaagtgcagacagtcttttctgctgctatcacatttttcttcagcagggtcccatttgaactgatcagtcatctggactctcattgtggatgcaccattgtgaactggccttattacaacctaatcacaccccacccacattacacagcagagtgattcaagaagacacaacattaagcctactaaatatgcataaatcccttcaattaaaactctgcaggattgttttcatgttgaacatacagactaattgttaatatcctttaactgtgctaatgtaatcatttgtgcaaattaaatccgtctttgtaaatttttctgggaaattttcactgtgtgataactaataggaaggaaatgtcttctatattgaaatgataattaacttttaactatgatttcacccttattttaacatttactctgtcctttaatgtcatgttttagtcaggaatgtctactgactttcatctaaagtgtatgcagtaagctcattgaaggaagaaatggtgtatttgtctttgaactatcatcagtgtcatttatgataatagcaacaagcaaacaatataaacaaaacaacaaaagcatcacattgagagggtccttagaaaatgtactgatttggtgaggaaatacatatttttaatatttattaaaaacagttggctgctccattaagacatatggaatattttgtctatttactctggctcaaatctgaaatcaaatatactcatcctttcaaaaatacaaaatcagaaggtgggcttgaattttacattttgtgctacacatatttgatgctaaaactttttttttctaaggtaaaattagtaacacatttatttgggggagtatttttaaatcttatgtgtatggcaggcactaaactagcctccaaaaacatatgctatttctgagaaactgtagttctttgaaaaataagagtttttcttcagtttctaatcggctctataacattgatacagtaaagccaaatccattcttaatgaaatgatttgaaggctgtcctaaaatatattgaggtggcagtgaatttctagatatgctaacacatagccctcttgtaaataaacatattaatatcttagaaaacttgcactgaaatgcaaaaatatattatcaagactctttccttcgctttgtcatttaagtagattattctctcattatttcatgtactaaacacacacatatgcatttacagttcactctgtattaagcactttggtgagtattggagatacaaagttcgctccaacacacagggtccctttatttacagtacgcttactcaacacaaacatatgtacaaagagacacaaactctcccaaaccggcataaatataaaataacaattcttctaaagtctttgcagttgtgctgagaaattctagtagggatttgataaagaaagggaggtcagagagtttgtcttgcaaaaggattgaccacactgagtttggagaaatgtgtaaaaggggtggatggagtaaaaggaaaagcctcctgagacaaagggtatggtgtgcatgcaaacacaccagggtaaaagaaagcaggacaattttcaaacaagtgtagttagagcacagagagaagatagcctagcatgtggtgggggccgtgggtgtgcggctggagttatttaggctggatttgataatgtaatctctcaaaatctatatgaaatgcatttttagagcttattaaagacacagaccacagatattgagggtgaaataaataaaatagaaaaatgaatataagataaatgtagaactagttttcctaaatttagaaaattatttgcttttatcagagaatcgcaaaagcactagcagaagcaaagtgaagcatccatgagcgggaagttagatgccaccggccactgaaagcgccgccaccctgtggtcactgttcttgattcagaacaaggggcttgcactcctgacagaaagagcacagggggcaggtctttggcaccaacaaacaggagcttgaactgggacctaaaaagaaagagggatgctcaaatatagaaatgtggatgggggtgacattttcctaccgacaccaaaaaaatcaagacagttgcagtctcccgcaggacctgtagggtgacgggaagagagagagtggccacaaattctgagaactgctaaatgcaagtcagttctatgagatctgggagacaaaaaatataggaaattgtaatgcaaacaaataataaccggaaaaagatgaaatatttccattgaaaagctatatttgttacaaggtggtacatgacagaaatatgcagaagatttgtgtgtatgcacctaaaaaatagcctgaaaatgtgtacagcaaaaattggtatgattacagggagcaattgagccatccttgatcttagaagatttaacaactcatctgtcagcaattttgcaatcaaacagaaaaatatatatataattttaaatttctgccagtataactgtacagttaacaagcttcatctaatgtgtatttctgcactaaataattagcaaatgtatattcttctgttgtatacatgggctatttataaaaattaatcttaaatcataatcttaaatcaaccaagttcaaataatcaacgtacagaaccaccttcaccgaatacaatagatgttaagttaaaaatgagtagcccatcaaaaaatgaacacccatgtgatgttgacagattactgttggagtaaagtattcataaagtttaaaatgtaatttattctgaccaacattgagagctcagatgattgaacctatggtacagactgaaagttctgtgtctatgattggaatttatttttcttttccttctagacagccacactggagtagagtccatactgcctggttctcttgcacaaaggtgtgattatgtgtaggttttctggcaagtaggaacatggtgtaggtgttaccttagaccatgaagatatgagtcatagcctagcaaagaaaatgcaacaaaataaaggtagctcaggtttctaaccattctgaaacaaaatccttgctttattaaattgcttaagcctagactgctacatcaaagcaaaatcaccctctatttcctataatttatattatgttgtgtctttatttcacagccaactttatttcctaagtacagaaatcaaattgatttcaaaaatacaaagtgaccaacaggtacctcaagctacttgttttgactttgcaaactttatatgtttcatagttttcacttctaaatatacagttaggagaaattaaatatatttaggtttatttctaagtgttggctaaaacaaaatttcattcatcagcatttggaattgtccactacatgtgtgctgttcagattataaaacagaaaaaagtacacggcagctggtgtagtagcttagacagtaatggctgttgacaaccgaggtacacaataatttttagaatgaagtttctaccatgtgcaaatgagttggtttttgaaaagttgcttcataatattatttatctcagcctcctgagggtaaggatttttgcttaatctatagagtatgataatggtatgttctaacttcagatgcaattgaatattaggaatttgcaaaagagaaagcactaccagaaaggaggcagtcaatttcttgcagtctcccatcccagaattagagaatattaaaagtctacttcacaattagttggtcttttgcttattctagttgacagcctcagtggagagggcatggtacttgtggtcagaagagctgtgcctatctagattctgcagcttaaaattatctgctcctgacgtcatacaaaaatagattcgtgatgaccttataggattcttgtgagggttcaaaatatatttggaagttattggcacaattatttgtatatgtcatttgcttgttatgtaatgtattgtctggtcactatgcctcaagtaggaatgtcttgtgccaattagactattaatgcctagaattaagagatttcatcttaaattgttatatttattccttagtacattacgcagtgtttttatcctagtacttaatcaaaactttgtaaaattgggaaaatctagaaaaaaacagtgaatgataaagaacaaaacatataataaaggagataagagaatagaaaagtgtaaacagatgtcatagcatcatatgcaatacaacaggtcgaagtaaagtaatgggaatatattgagatcttgggtgttcatattttgctgaaatggattctagatatcaaaccaaggtggataagtaagtggataaacaaaacagcaaggagttaatatgaagtcacagggcatagacatagttctagagattgcttaccactccatatgaaatgtgtgatatgacaattttttagaagattcagcacaccatacacaaaatacccaggcataacaaagggtattgctaagaaacaaaggtcatcattggaaaacaaacagcaattatagttttacttgtttttgttcttaagtatcctgcaagttcactgacaaccaggtcttgtcataaataattgaaataatatggcactatgtttagagttaagaattcccagtaaataattctgtaccaaatgaagtacaggatttaccatatacatattcataggaaattttttattgcttttctgaaacaatctatcaatttacttgattctttagggaaaaataaaacatgttgtgaaataacaaaggagaaattaagagttgattgactgattttcaaaaaacacttgaactaaatgtgttaaaattagagaagtaataactttgttctctctgaaaggaattcttgagggcattcattacaaaatcaagttcataatgtatccaagccttaaagtaactcacaactgttgaatagaaagctaccctttaaggtccacattttctaatatttactttgttagcattcaggatacttcttgagcccaaattaaatttattacataaatgtttatgcacatgtctattcctacattaatatccatatctacatcacctaacacagtgtagcacacacagtaaatgctcagtaagtggtgttataggtatcgttatacctataacatcatcacattgttatacctgtaacaatacctaaaacataatttgaaataatgcttccttctttttcataaatatgggtaaaaatgacatttgaaaatggaaaatacaattacttttttaaatatgctttgacataaaaaagtgatctcaaacacttctgctcccaaatcagtatattcattggtactaataaaagtttgttttattatttagagttccataactttataaattccttttaattttattaaaaatataagatacattttacaagttcctcagcatcaaaacctctccccttttaaatctactctaatcaatagaggccttttggctagaatagatgttcctggatcatttctataggataacctgatgaaactctccatgattctattttcagctctcatttcctcattactcctactttataatcataatgatatgaaaataactaattgttttaattggtttctctgttgtagacattgttctgaaagcttaacttatatttattattttttgtccttacaacaaccttatgaagtacacattaaaggctctttttttacagatggagatattaaaatacaataaagtttatgttatttgctaaatgtcacaaaatgtataagaggtgaagctaggatgtgtacaaaagaagctctggctctccagaaatcattttcccaacaaataaaaaatatactgcctctccaataccatacagaactttggaaggaatgaatattgcccatttagatagtttgacacctcctatacaagttagttttaaaatttccactaaattaaataatataatcagcaatccactttgtaatgagctctacgatagtggccaggcatgtatacaccaggaaactgggcaaacttggcatacatcagagaatacttaacgattatcaagtttcagagatagactggattaaaatccctcctctgtcatttactttccatatgatcttatgctaattctttttttttttttttttttttttttttgaggtggagtcttgctctcccgcccatctggagtgcagtggtacgatctcggctcactgcaacctacgcctcccaggttcaagcaattctcttgcctcagcctcccaagtagctgggactacaggcacaaaccaccatgccccactgatttttttgtatttttagtagagacggggtttcactatgttggccaggatggtctcaatctcttgacctcatgatctgcccaccttggcctccgaaactgctgggattacaggcatgagccaccgcacccggccgaccttaggctaattctttagccttcttgtcttagtttcctcatgtgtaaaataaggacagtaatattcatgtctcagggttgttgtgaggcttgagtctacttatgaaaaatgctggaaaaatgtgtgacacaatacacactgcgtaagtgttttcaataaattatcgattagagatatgtataaggagattgtggcataatagatatgtaacataataaataggtagatagatacatagatacatacactggttgtagatgggagggtgtgtgtatgtgtgtgtgtgcctgtgttattaaacacattattttatttcagtgcttagtcttataacatcctactgctaatgtaacccagaattcaccttatcctgacttttaaaactcaaactttcaaaactcacatattccatgtcttctagaaaatctaatgctattaccaatgtatcactgagtttaaagttatactatattcccatcctcatccatagctctacatcagttttcttaggtattaattcaatgttaaggccaaattaccttgttgtccttgtcctatttcacgttatgttgtttcagacataaaattctctctcttttatttttactcctcaatcacctcactaacaacttataattttatattacaattgtctgtttctaaaatgttctgacccattccatcaactggagagctaatattcaagcaaaattgcttctcctcttgattgccttcctcctccctagtttttgtattttctaatgcagagcgatttgggcacttgattctaactaggctgtcagttaacccgtgacgtctgaacttaaccttttttcataggatgtagaagcaaactttctaaatagagtggttcatgtatgatgggagagtttctcattagcttgaaggtggatatgacctaggaatgcatacctgctccatggagctagtataactcttttcatttgatcaccagcctctttcagcgattactggcctataattatgttagtgacctattgcaagtaaaataattagataaatatgctctgctatctgatggcaggtcatgaggagcccatttaagaaaacagttatatcttttattctagatatggatagaagggggaaaagaaaagagggaaaaaggttaattctaacttaaaactgggataattcataaatattcatatgaccctgccctaataaaaacctcattactaccacatcagacagctaatttatcccaataggcccgcctaatattgcaataatagtaaaattagacgttctgcagtaatcatattgagatttgtttagttcagaaaacctgttccaagaaaaatgtgcaaagcagaatgatcttttccatgccatttaaaattgaattctggggcttaacaacgtactttgttggtattttttgaatgcttgaacagatgtaaaactccttttttgatggaacactttttagatggaatactggtgcatctcgcagaacgtctttcccaggctggaatactggtgcatctctcagaacgtctttcccaggcataagagaattgtatttctgcttaagtaaagtacaagtatgtttctaaactttcagttatcaaccttaactttgccatcctgcacatctgtcatctagagtgcctgaattcctctttaatcagtagcacaggcactcaatgcttgtcaaaattgtaccttaagatcacagggttatttggcacatctaatattaatcagtaaatctgagaatcatgttaattatccatctctttagttactctgaaaaatgtaatttgactatattacctcagctgtctaagcatattttaatggattataatttgatattagttattcagcttattaaagaacaatctaagtcagtcccatctgaaggcagcatctgcctctttaataaaaacctatttgaaagcgttagtttttatttcacttgctcactgattcatcagccacttattgtgctgctactcagtaccaaatactgtgattgatgtttgagcagcagatggaaagggtgatgagtacctgtctcagggttcaaaatggagcacaatagcaaatacatagaaatacatgcatatttgggaggccaaggcgggtggatcacaaggtcaggagttcgagaccagcctgaccaacatggtgatcccgtctctattaaaaatacaaaaattagccaggcgtggtgtcaggagccagtaatcccagctactcaggaggctgaggcaggagaatcgcttgaacccaggaggcagaggttgtagtgaaccaagatcgcgccattgcactccagcctgagctacagagtgagatcccatctaaaaaaaaaaaaaaagaaaaaaaagaaaaaagaaaagaaagaaatatatacatatggctaagcacgttgggttacgcctgtaatcctagcactttgggaggccttggtgtgcggatcacttgaggtcaggagttcaagatgagcctggcccacatggtgaaactccatctctaataaaaatacaaaaattagccgagtgtgatggtgcgtgcctgtaatctcagctacttgggaagctgaggcaggagaattgcttgaacctgggaggcagagattgcagtgagcggagattgtgccactgccctccagcctgggtgacagagcaagactctgtctcaaaaacaaacaaacaaacaaaaaacatacatataactcaatggacagcactgaaacaacagaagactagaagtaaacccaaaatattaacagaatcagtgtgaagagaggagcagagcctttactggatggttggtgaagggcaagatgagaatacaatcgtatactgcatctggatatttccattaacactgaggcacatacgatggtgtggtcccatgagattataaaggaactgaaaaactatcacctagtgacattgctgctgtcataacttgctgcaacgtactactcatgtgtttgtgaggatgctggtgtgaacaaatctactgtgctgccagtcacataaaattctcacacatacagttatgtataataataataattctatcattggtttttgtatttattatacttatcattattttagtgtgtgctccttaagcctattgagattaaaaattacctgaaaacttaaaaaaaaaaaaacaaaaaataaatgaacagtctcaggtccttcgggaggtatccagaaggcatcgtcatcatgggagatgacagctttattggccctgaagaccttccagtgggacaagatgtggagataaaaaacagtgatattgatgatcctgaccctgtgtaggcctaggctaacatgtctgcttgtgtattcatttttaacaaaaagttttaaaaagtaaacatcaaataaatttgaaaaagaaaaaaagattatagaataaggatataaagaaaggaataaaatatagaaaagaatgtataataaggatataaaggatatcatatttttgtatagctgtacaatgtgtttgtgttttaagctaagtgctattacaagagccaaaaagttaaaaatattaaaatgtttgtaaagtggagtagttataggaagctaaagttaatttattactgaagaaaaatgtttttgataaatttagtgtagcccaagcagtgttgataaagtctacagtagtgtccacgaatgtcctaggccctcacattcacccacctctcactcactgactcacccagagcaacttccagtactgcaagctccattcatggtatatgccctatacaggtgaacctttttttttaatcttttacctcacttttactgtgtcatttcaatgtttaaatacacaaaaatatttaccatgtgttacagttgcctgcagtatttagcacagtaaaatcctgcatagatcagtaacgtaggagcaacagactataccatataacctaggtgtgtagtaggctgtaccacttaggtttgtgaaaatccattctttgatgttcagtcaatgacaaaacttcctaaggacacgtttctcagaacatatacctctcattaagtgatggcatatctgtataggcaagtggagtatattttctacagtagaaaggatacacaaatgtgacccaaaatgccaggcaagtttagaagtggtgggtcgatatccaataagaagaaaaacatgttttctggagttcatttcttaaggagttgtctgtgtttggaatgaatacttagactatgtagtaaggtgtgtgtgtttgaggatgggagaggtaaacttctatttgttctaagaatacatgttctttacagttagtgtattgttgcctgaggtttgcaattgggggaccacttcctgccaagattagagagaaataagaaaatgctcaaatattttcttatttcagacagaccttgtgtcctgatcttgcctaaaaactaatatctacatccacaaagaaaaaaaaagcatcttctgtagctagaattctgttttaattgagataattttctgtcttttggcctgtgtgtttaatttgtaagtacagcccgagaatcagctaatgctttcatattctgtgtgcctcatgcattttaagaatgcccattttagctaatacatgtttattaaatacacattcattgtgaaaattactcaaattcatcaaatgctcaattatcatttcctgaaaagaacatcagtttaggtattgagaaagtaatgtaaatatccagttatagaatttagattacagaaagctatactttgtgccttagcctgaaaaaattcaatggcaaacactgggttgaaaaatcatactactctttccatccacccccactcccacacctcttaaagtgggaactctagtaatttatgaatggtacatgctttacataaatgtgaaaaaggtgcctgacatctagtgacacatgtactgggaatgaaagggaaatatctcatgatcgttgtttccatgtcactgagctttggcttaaggaataacggttgatgaaaacaaaccaagtaaaggtattagaaatattatcaacttcttaagttaaatttctgggccactgggtaagatccttactgagagagagagccctgttaagaatatttttgcccagggacattgcccactgtgtagtataacactgtgaagtatggtgggagctcagggtcactcgatatcagtcttgacctccagagacaatggagactcaaagtattggtctgaatctccaggaagggctgcaaactaaaggccagcgaggcaggcatgaggggatcaaactgcagtaagaactgaagacactaaaacctccagtgagcattctagggggcattcctctgtgtattgccatgcattgtggccaaaagatgctaaacccatctgtgactccaagagggagaatgactggaagctctgcatgtggatctctctgggactttgccctgtgtgtctctttccttcgctgattttgagtcttttcactatcataaaactgtaattgtaaatatagagcttttactgaggttctgtgggttattctagtgaattatcccacccgatggtggttgtgaggagccccaaattgatagccagctagtctgaggtagaagtggtcctggagacacccagtttatggctgctatctgaagtgagggcagtcttgtggggatggttccctcagcctttgcagtttggcttaagtcgttgtggacactaaaaggcattgttatctatatcatatttataaacttatgctaagagttggcatccctgcttgttacaaagtatagtgctaaatgtataatggtatgtaaagccttgattggtagttgtaaacaaataacaatcaaaaatgaaaatataactagattgatctaatcagaatcatggaatagatggttacggtgatggtagaacccttcaacattcttcctgagagaatagcaaatgtggaaaagatagccttccatcctttgcatttgcctagtgaagtaaagttaatgtggtcatgaggacgtgaatgcatgtgactgcaaatgtgtgtctagtggcatttcttgggccaggtgcatggttcagagaatgagggagcacatcaaaaatatttaataggaatgtcctgggattatgaaacattcctccatgtgggccataatttctggatatgctttgctaagtgcaggaggcagcaaggtattagatgtcattttgggggtagaggaggctacagggcagggaaaataatcataatttatagatcctaaaatactgttccttatttcacttacaatgtttagtggactctacatggtttccaaaaagatctttgattcttccctttgctataattggaaatattagcttggacatgttacttggtctctctgttagagtaggcagatagccagaagcgagcaggaaagggagcccctggggaaagaagtcttcacagcagcttctttgcttcctccaaccctccttgaagacacttggggccatgcaatatgtgtttgtcttttcaaccaaaaaactgctgcctcagcactaggattcacaaaaacacaacacacacacacacacacacacagaagaaaacagcatagaaaatatctttgtgacactgatatggtttggctacatgtccccactcaaatcttatctcaaattgtaacccctatgtgttgaaggagggacccggtgggaggtgattgaatcgtggggggcagtttcctttttgtgatagtaagtgagttctcacaattttgtctttgtgatagtaagtgagttctcacaatatccgatggttttttaaggggcttttccccctttgcttactctttcctatcactttgtgaagaagacacttgcttctccttcaccttgcgccatgattgtaagtttcctgatgcctccccatccctgcagaactgtgagtcaagtaaacttcttttctttataaattaccctgtctcaggcagttctgtatagcagcgtgaaaatgaactaatatcggaaattggtgctgcagagagtgggggcactgctataaagataacctgaaatgtggaagtgagtttggaactgggtaacagtcagaggttggaacagtttggagggctcagaaaaagacagaaagatgtgggaagtttggaacttcctagggtcctggaggactcagaagacaggaagatgtgggaaagtttggagcttcctagagacttgttgaatggttttgaccaaaatgctgttagtgatatggacaatgaagtctggctgaggtggttgcagatgaaaatgaggaactcattgggaagtggaacaaaggtcacccttgctatggtttagcaaagagactggtggcattttgcccttgctgtagacatctgcggaactttgaacttgggagagattatctgaaattggaatttatgtttaaaggggaagaagagtgtaaaagtttggaaaatgttcagcctaaccatgtggtagaaaagaaaaacctattttctgtggagaaattcaagccagctgaagaagtttgcataagtaacaaggaactgaatgttaatagccaagacaatggggaaaatgtctccagggcatgtcagagatcttttgtgtcagctcctcccatcacaggcctgaaggcctaggaggaaatagtggtttcatgagcccggcccagggccccactgctgctctgtgcagcctaggaacttagtgccctgtgccccagctgctccagctccagctgtggctaaaaggggccaaggtggagtggatcaaggccatgggagcctacctcttgcatcagcatgccctgggatgtgagacatgaagtcaaaggagattattttggagctttaagattgaatgactgtcctgctctatttcggatttgcatggggcttatagcccctttgttttggccaatttctcccatttggaatggcagcatttacttaatgcctgtaccctcattgtatcttggaagtaactaacttgcttttaatttttttataggcttctaagtggaagggacttgccttgtctcaggtgagactttggactatggactttcgagttaatattgaaatgagttgagactttggaggactgttgagaaggcatgattggttttgaaatgtaaggacatgagatttgagagggaccagggacagaatgatatggtttgtctctgttttcccacccaaatctcatcttgaattgtaatccccatgtgttgagggagggacatggtggaaggtgattggatcatgggggcagctttttccaatgctgttgtcatgatagagagtgagttttcatgatatctgttgattttataaagggctcttcctctttagcttactctctttcctgctgccttgtgaagaaggtgcttgcttctccttctccttctgccatgattgtaagtttcctgatgcctccccagccatgcagaactgtgagtcaattaaacctctttataaattacccagccttaggcagtcccttacagcagtgtgaaaatggactagtacagacacttctaaattggctcccccaggttttgctgacatatgtcaccttttctctttggctacaccctcaggtgtctcctctaacctttgtgacaattgtaacatggattacagaacctacctgatcaagctgtagttatttgtttccctactgtttgttgagtttctagaaaacactaacatctcttatgcaaccctataccccaagcagcaagcatattgcctggcatgcagtcagcatgcttctgctccagttaagtagcctgaaacacagaaaatcagagtatgtggtggtgttttgcttattgtctagcaagttacaaccaagtcccttgcagagttatatcacaaagccacgttgtggcactctatttaaaaactactatatggagcagggacttaaacaataaagaaagattttcccttaagttatacagttaaaattcataatgactctcccttatatattcaattataactatgataaataactatgataaaatgtgcataatgatataaatctcatgtcagggcagaatcaagagcctacaattgatttaaatactcacaagttcaagtgatatagatgaattttgcaatgtcaaattaggtaaaataaatctacccagatgtcttgccaaatatgcgtacacatagttgcagccttcagctacatcatacatatgtccccttgaaacagatgtatatccatattcactcaggaaattgtgtgtgcttgcatatcaaatataaaagaagaatgaatgtgcagatgaaaataactgctctctaaaggaaaactctaaaattggtgctaaatttgtgtttctgtccatatgtgtttatgcaccttgagttgtatgtgagcaaagtgtgtaattctgctgttcctattcctgttgcatcattgaggcacagaatttatgtaaaatatcaccctaaatgaagcttcatttcactggaggcattcctttaaatatagcaggtaaacactgaaaagcactttgtggttgaggagcaatataactcaatatgtctacacaggaaatcagaaaatataatgctactgtaaaaaatgtaattgctaattcttttctttaaaagggttataaggctttcattttatagtccttttcttcttacaaatgcaaggcatgctcattttagaaaatttcacaaattcacagaggtacaaaaggtagaaaggggttggaagaaaaaataaactcacttcttcacacatccctcattcaaatacacatcaccatgtcagttttacacaaagcgtttatacgttttactttgtatgaaaagtacaaagtataacataagattttccagactatagaagtctttatgcatttctgtaatgtgcccaatgtaacagaagacagaggatgagttaaaagtgttaacattaaattttggcttgatagtagatagagcaatatctataataatattaaatgtaaagcagcagtttagtcaagagctaagagttaagattgctgtgaaggcattagagacagacaacacaaaaacattccccttattctagacagagctctaaagcttgggatacctcctggcacaatcatcattctagaagtctagaaccttcataacctttagtgttgattctaaattttgagacaataattttaagaaaagctagtttattttcccctcctgttttctaaagatttattcagataattacaagtggagaaggagaaggaggtaacttaatatttaactatgtatttggcactaataagtgatggtgtcactaatttccaatggtttcttgatgtacagtttctggaaacaacatctgacagagatggaagatagtaatcgcacactcagctcatagggttataataacacacaaacatttcacatactgtgtaatggaaactcttctgctgtcctcttaattctctcaacaacttgattaatacgtgataccgttttctcagttttacaattgagcaaactgaggcacagaaagattatgttaaattcttagcgtcacataggtagcaattgcaaaagatgggctgtcaacttaggtaccctggaattggggttggaatttataatcactgaagcagagtttagaattatctatcattaacatactacttcactttttcccctaaacttgtattttgatgtcattaaatttttttaaagatattatttttaatttttaaaattttttaatttcaattgtttttggggtacaggtgagtttgtgttaatgggtaagtcatttagtgttgatttctgagattttagtgcactcatcacctgagcagtgtacactgtatgcagtatgtagtcatttattcctcatcacttttccaacctttcccccgagtctccaaagtgcattatatcattcttatgccttggcatactcatagcttagctcccactaataagtgagaccatatgacatttagttttccattcctgagttacttcacttagaataatcacctccagctccatttcagttgctgcaaaagacattatttcattcatttttatggctgagtagtattccatggtgtatatataccacattttctttatccatttgttggtttataggcacttaggttggttccatatcttttcaattgtgaattgtgctgctctaagcatgtgtgtgcatgtgttaaagatattgttttaaatgatggcataatgttccatcttttaaaaatattataactgatctaataatttctctatttttagattgtttccactttcttgctatcatcattatggctgtgaatatactggaataaatatcttgttactaagttaataacttttaatttaaaaaatttctatataaattaaaaaaatagtttccaaaacagttttaccaataatattttcatcaggaacctatgagaacactcagaacaccacgtttccagtaataggaaatattatcaacttaattttactgtgttgggactttgctatctttgaggtgattcttatagactttatgcatcaactttcatgtttatttctatgaactggaatatagtaaaacatgagaaaaatccggatttgagtgtgattctggcaaattttagctctatgacatcacacctaaattctctctgtgcttcagttttcttgtctacctgttctctttaatttagtggtttgtgtttttataaaggatgaaataaaatattatgtgaacgtatttcatcatgtataaagtataatctaaatttatgatagtagctattgataatatatacaatggatgagccatatttttcccctatgggggaaacagaaagtgctgagaaccttgatactgtttattatagtattgaagttaatctagctcaatctcttttattctttaactctgatctagtcattcagcatgaattgaatataacaatcagctaaatctacaatacacgtgtcttagcctatttgggctgctgtaacaaaatatcatagactaagtatcttataagcaacagaaatttattttggtggacgagaagaggcaggtccttcaagccatttttttttatatatataaggacactaatctcacttttgagggccccatcctcatgatctaatcatatcccaagggccctacctcctaatactgccacactgtggattaggtttcaacatatgaattttttagggacaaaaacattcagactatagcagcacatttccaaagaaagtgacattagtagatgcatattcttttaaggtcatgagacaaacaccagaaactaaattgaggtccatagaattttatcctcatgtaaaacataaatatatgttttataacttacactccgacatgatcttttccacttttatttttaaatgaacattatttttcaagcagctttagttttacagcaaaatttaggggagaatacagagttttctgtccccactatcaagattttgcaccagagtggcacatacgttgcaactgatgaacctacattgacacatcattatcaatctgtagtttatattaaggccccttcttgttatatattttatgtgttatgacaaatgtacaatgacacatattcatcatgataatatcatacagagtatttccactaccttcgaaatgctctgttctccatgtattcattcatccctgcccctaaaccttagcaaccattgatcctttgattgtcttcatagtttttccttttctggaatgtcatatggttggaattatatgttatatggccttttcagattggcttatttcacttagaaatatgcctttaagtttcctccctgtctttttgttgcctgatagctcattcctttttagtgctaaataataattcatcgtctagatgtatttttatctattcattcacctactgaaagacatattgattacctaggtaaattccaagaagtgtgattgctggatagtatagtaaacatatgtttcattttttaagaaactgctaaactctcctccaaagtggctgtgtcataatgtatttcctccagcaatgaaagagagctcctattgcttcacattccaggcagcatttgttgttgttactgttttatattttggccattgttataagtgtgtagtgtcacatgatgtttttacaacagaacatatatcagagtttacaatagctctatgcttatcacaatacaattgaacctgttcttgaaaagcctgagtattcttagagagctttcttcctggacaaaaaaataatctcagaccttcattatagaagtaatacaaacaggacctatagtgattgctagagcagtggattatatattcaaataaaaaccaaaagaatacttatatattgttttactttataaacactcttattctcttaaaatatgtaatattactctagtattatgtacttctgtcctttagcgtccttaaggcatttttcagatactatttaaacaattattacaatcagatgaaatgaattaatgggagatattatgtccaatctgtatataataggagtacaaggcatttgtttattagctgaattatgaacataaatttttcactctgacctttattgggtgtgtgactaagaattaactgggaacttgcaatatagaaaagccaattaacaggagcttgaataggtctatcatgaatgtttctaccagcactaagtataatcagacaaaacgttaagtaggatatcaatttcttacatatttgactgttaattagtctgcatttgtattttttcttattaaatatttttaaaagaagattgggaggacaaccctttttactccttctatcttattattaacttttaaaaagtacaatttagtgggtttttttggtattgtaactcatcttgctagaaaagacaagaaaattatacctctagtaatcatatccatacttcacatactatttcactatttatatatgacattgttgtttatatagtcattactcgtttagatttgcatatttagcatttcatttctctttgtcacttctagatctttgcaatatactctagagttcctttaggagaatagtatttattagtgtggcttcatggtaataaattcctttttcttctgcctgaaaatgttttgatttcacttttattcttggaggatattttaggtaaaggaattctaggttgactttttttttaatcgtttatttcatcacattgaagatgttccatagtctctggcttctattgtttctttttttgaagtcatctttcagttgttcccttgagtgtagtgtatcatttttcttatggaggttttcgtttattttacttttgttatctgcattctgacactgctgtgtttagctgtgaatttccttgaatttatttcactgaaaagttgttgagttttttcaatttagaaattgttgttgcctccatttctaataaattttagtcaaaattttccaaatttaactacttcaccatttgttatcttattataatgtgagatttcaattaaatatgttatctcttctaatattactgtcaatatatattaaatctcttgcaattttttatccttttatttcctcccatcattaattatttcttcattttatctatttactttaaaagctattgattgaattcttaatttcagctattttttttcccagttctagtatttccatgtggcagattttgaattctgacatgtaacttttgattttctgaatcactgccaaaatttttaatcttgtcatttaacttctcttgagtagatgaggtagttattttaaattctatgatgattctacttacaaggagataaatagaatctgagtctgtttctgtgatcttgtttcttccggtagtcattcacgttgttttatctcctcaattgctttatctatttatatttcgtgctggatatttcattcataaaactctgtagtaataccttgaggacttaaaataatattaaattattcaaggaaaaaaattctgtttgcttctcctaggcatccacaggtactggccatctgggaaacctttgatacattatttgagaactgcaggattactgtcattgtgggaaagataaatattttgggatgctgaagtctaagatgcggcaaatccagtgtctgttaggagtcagcctcctaatttgcatatggctgtcttcttgctgtgttctcacgtggcggagagcagagagagagaggaagcaagctctctcatatttcatctcataaggtcactaattctagcttgagccctccaccgtcatgacctaattacccacacacagccccacatcctagtaccataccattgatgcttagggtttgaatagatcagttctgaggggacaaaagcatgcaatccataacagcctcctagtctcctctggattagcaaatgtctccaaggtaaaagcattcccacatgctggattacttcagaattttagaccagcagttcctcattaccatgttagcctctgtattaatgaatgttctatgactgttgcaacaacaattgatcccaaacttagcagctcagaataacaatatatatatttttaacagtttctgtgggtcagaaatcaaggcagatcatggcaggatttttctcagggtctcataaagacaaaattaaggtggcaacaggggcgtggttctcatctcagtttcaggatcctttccaaattccctgttgaggaaagctatttccttcttatctgttcgatggctccctgtaacttcaagccatccagggcatgatgaatccctcttcatgcttcaaatctctgaattcctcttcagcttctgcttttaagggctcatgttattacattgcactacctgggtaagccaggatgatctccctattttaagaccaactgtttagtgatcttaattatatctggaaggtccctgtgactgtaacaaatgcatgggtatgatagcatacttgccagcccaggaattaaggcatagaatcatcttggggactgtacttctaccacattcaccagtgcatctaggaaggatttgtttctctttaatattttttcagttttttggtgtttacagctgaagcattagactgaatacttattctgtcactactggaagtagaaatcctcttagtagaattttagtttatgattaaaagtttgtcttgtagttttctcttcttgtccagcacagcaggtaagaatgccagcctatgtgattggctaaattcagtttcaggtttccactgacttctatacggctctctgcaatgttcttcatttagttctggttctgtctttatctattaatttgaagtgacattacctaccatattgaattattatgaggattaaatgaacatatacaaaattattcagagcactaaaacttctacagtaaatgtaagttttcagaatgttagttattattaatcagactttagtataatgtgtttatattacaaaaaactacaattaaacaggaaagcaagctatttacctgtgtttttatctctaaggaaaatacatcttttgaaatattggacctcattttatatttctgatatcaattctgccagtaagttacaactagatatttaaataaaatgaaaacaacaacaacgacaacaacaacaaaaacccagcaatgacatcagtgaaattaactcattttatccttctttagtcttgacttttatgacattctggagtagatatttagaaaataatttaagaggataagacccaatcatgtccaaaacaaattgttttgccccgagatcagtttttcatgagctatatttgttttgtttttccagtccataaaaatactttcaaaaaatatctcagcagtaggcagtagacaatgtcagaaaaaagtaatctgagtcctagagctacatattcagcagatatcattgcagcttttaccttaaacattgttgaacatgtttgaattcaagttaaaatataatgtttcagtacattcacaccttctgtcaaagaacagtgtcacaaataattatgaagaactcagaaaacagcacaaaaggccatctgtgagatctgaacagatgtagctgttcaaatcctttgttcacattgaagttgggaactctcaagttttaacaattggtgtttagatgtgtagaaaccaacaatggaaaaaaaatcaattgtaggaaaaatgatttttttaatttgggttatttaaaagttctttttcctattatacataatttattccttttatacataaaaatgattccctgtaagaaaaataaaactacaatagacacaataaaagattaaaacagaagaaatagcaaccattagaaattcctttatgtcgctaatcagatttaacactttgtattagacataacccaattgaaagattagaaagatgttgttgctaagaataaggacgtgctgtctcctaaatcaagtgttcagatgtgtttactcttcttcattttcatcaaaagcatcctttaagactgtggccttaagctttaccacactttggacttcttagaagatattgtttaaaatcctctgtctgactttaccacaattaatcagaatctttggagataagacccaattattattcaggtttcacttatttggttatcacttcccaagtgattctcatatgcaatcaagtttaagaaccagtgttttaagagctattgtgagctaggtataggtggtgtttgaaataaaagtttatgtaaaaaaggaaataagcccaaaaataactatggatgttatggattataaaattagtaagtgtactattgtcattaaaacattagcgttttcataaaagttgatgtatattaaattacctacttttcatttcctatatgaagtcatatatagaactcaatcacttaatgaaagttaaaatgtgaaaattagtagatacacatctttcatttactataagacaaaagactaaaatgtttgagttggagaattaatggaggtaacctagttaactttctacaaaatctcaattgcattcttcaatatcctttttaatgaatatttgatctctcagcatttcaagtttacttatggaagtataggcaatattgttggaaatgtttaattcttggaatatcctcctttacagtgaatttacatgtccttctaaattgtcacagttggacctctttttgccttctggatcactttgcaacaagagaattgttctctaaacatctttcagtttttcatacaaaactatggcatgacttagctaaaaaataaattcctcttaaataattaaaattgcatagttgaattgcttaaacatgaacttagtaataacctaaattaaagggaagccaagacatttgcctaaatacatagcaacaataatgaaggaaaacaaaaagaaaccctgagagaaactaagggttgaactgtttctcccaaacttcgtatgctgaagtcttcttctgtttgctacagctgcaataacaaagcaccacagacttggtgttttaagcaacagaaatatattttctcacaattctggagactagaagtctgaggtcaacatatttggcagggttggcacagttggtttctgtgcaggtctgttttcttggcttatagctgccagttttctcctggcatcttcacacggtcttccctctgtatatatctttgtcctaatctccacttcttataagtgtaccaaacatacatgtttatggtccactctaatgacctaattcaaacttaatcaccattttcaagaccttgtgtccaaatattgtcacattctgagttactaggtgtttcgacttcaacatatggatttgagagggagacaattcagtctatatatacatatgtgaatgtgtgtgtatatatatatatatacacacacacacacacacacacacacacacataaaaattccaaacccctactatcccagagtatgccattcactgaaaatagagttagttgctgcagatgcagtggttaagttagaggaaggacttagtccactccaatgtgaacagtgtcctcctataaataataatgaatacagatacacacaaggagaatgctgagtgaagacaaatgcagagatcaaagttgtacatcatctataagccaaggaatgccagcttgccagcaaactgccagaagctagtagagaagtatggggcagattcttctttgcagtcctcaaaaggaatcaaccctgctgataccttggtcacagacttcctgccccagaactgtgagacaataaatgtccattgctctaagccacccagtttgtggtactgatacagcagccccagaaaactaatatacccacttttagaacagtctttcaacactgataaaaatttaaaaactagttttattttttataaaatgaatacttaagcatttgatgagcaaatcatctgaaataatgtgtgtgattaggtgtatcatgccaaaacaagagtcattgagaaatgactgaagttatccctatgaagaatccagaacagataatgaacacaataataaatacaaattggccttaaatgaactttcaaattaaggttaaaattactttattcctatctgagttattcacagagctctcctgaataagtaaaaaataatttgtcaccaggatttacttaattagcttcatcacaatgttaattaaatatttttaaaaataaaatgtggtatgactttcttaatatttagcttacatacagttataatcctaagcatatttcaaaaactacgttaaaaaaggagcaaaattcaaaaaatatgcatttatatgaagtgatcttttatcgaaattaaactgtcattttctttgtgaatctttttttttttttagtttagcatattcattttatgtgtcatactgtgattcatttctcccaccaagttttcttcttttaacatctatgaacactgtgttggttgatttatatgcgcccatgatgtcatatttttgccaatataaaattttaaattgatgtgcatcaatttccatgtaaagtcagcctctcttcttccctcataagcccaagtccgtgaaatgaacaatacatgttgtagcctgggcaaaagcacaaatgaaataaaaatatcgttataaggtattcttgttatttattaaagtgaggggggttccttcctggacagggttgactttactcgactagttagattggtagaagaaactgaggcatacttattttagcctcttctttcttcatttccagattggccagcttgcagagaaggcgtattctagttgctatcctataaccaaatagagagtctgcccagacttacagttgtgaagactggggaagtgttgggacagccagtcaacaatatccccctaggtttcccatcctccagccaggattgaacagatccagagttaagtctctgcagacctgggtgtggtatcttgccccctatgtcgactagctgtgtgactttaggaaagtttttaaaatacattgtgtcttagtttcttcaaatgtaaaatggatctgattctataatctccttcttccagcttctgcacaatagacatgtgctaacacacattaaatgcttagaaattgtatgtattcaagaacagtattcactattattgatcgccaactgattgccttctatgttctgtccgtaattgttcagaatttggctatagcagatagtagtatcatttgttgacatctgattcccaacatttttagagcaacaacataataaaaaaaatgcaaaaaagttacaaaaattatggctatccctcaaggatatattttcagaaactactgggaaaccctaatctagagaaagaaaatgaaactaaatataaacccattcctatgtttatagcatttttcacattatctaattaagtgtaataaaaccatggctatagtcattaatttagggaagggctatagttcaagggctggctggtttaaagacttatttttgaaactctacagcatactttatacccaacttcttctccaaacactggtaactcattgctttaggatgcaggaatcaatctctgccattaccatgaaaaagaatgattctctcactaatgagttgaatttccccctctaagacacccatgcaccggtcttgagatggggtctacgataatgttcttagtagcagtattcacaagaaccgttgtaaacctgtttcctaaaatataaaatggaaatgagtaagatagccacaacataacattgttatgaccccaacatgagaaatttatgtaaatttatcaataagacaatgagtgcagataagtgttctgtaaagattagacattgttccttcaaaaacagtctcatttataattatggaatattattccttcttggccatctatgctcagtttaaggattcaattcagcttatagcagaaaatggactttaggtcagttacatcagtatctgaattgctgaatctgcaatttataagttgtgtgaccttgaagaaatatgtgatctcttctgaattccagcttcttcatttatcaaagatgttactgccacctatcgcaactacctcaacataatacaaacctatgtgatatgtgtagccgtacattaaatgtgtggctataggagcagtattgttactttattgcctcattcttctttcctgattacatacaaataatatatgtgagtttttatgagaaactagccatttaatgatacagggttacccttcagaaggtcttacttgaaaatttatgaaatacacacacatatatacacagatgtttaagaagccttgggagaaaaattatatttacatataaaatataaatttatagggaaaatgtgctgcttaaagtatactacatcctaaaatgtgctattatatactatgccatggtatattataattaaagtatataaatccaccccgaatgtcatctttcaagttttagttcctaaagtagttttctatacatgtgtgtgcacacacacaaactttagcatgccaaacaacttatttttacacattatatcagaaaacaaatctcgttagaacttctaaatgaattggaattgatccatctattcctgtaaaaaatagggtaaagttaagtgattttaacacatccatgattgaaaattgtattctcttagtttaattgaaaaatgagtgcttactcaaaaaatgagtgtttactcatgtgtcatcttgggctttggtgtatcaacatacttgttggagttattgaaaattaatctggagaagtgtctatacgaaaagttataagatagtctttaagagattaataacagaagcactagaccaggatcaatgactacgtctctgacacaaatattattttggaataattccaacataaatataattcatattctgattttctattatctaacaattatttgaccatgtcacttaaattacctaaagtatttaaacattttgagctcagactccttacctaaaaactagaataaagttttagtccaaatcatcgttatagagatttaaaatgtcattttgtatgcaagaataaaaacatttgttatttcctccatcctaactcacattaacaaattttaaaccattaattaattagtgtatactttaaaattgagatatacataacttcctccagttagatattttagtataattacataatttgtgtatatagatgaatgtgtatatatgtatttttttaagtaatatgagatagttcattggctgaatactgcaaaatcctttttgtgttatttgcaaaagatatttgcaagaaaggtaattgtatttagttttgctgttgcctttgctttttttaagattcaaatttttaacaaaaatatatgctgttaatagcattctttatatgcacacacatctgtgatgttattggaagtaaagtatgttgtctgttagagtcagcgtttttttttacttgaaaatttattttaattgagggatacgttttcaaaaaaaatgctatgaatatttttccttgttatagtttagtcagcattttcacatatgtatcagatagattaggaaaaaactggcaatacaacctgaaggctgaaagtttaaacacacacacacacacacaaaaagcctagaaatacagaagtcatagttgtcatagcaacataatctggctacattcacattatcctttttctcaccagaaatattttcaaagctccatagagttgctccaactggaatgggaatgtagtctgtgtgcatttaattgagaactttaagccactgttaatacagtccatagtaaccagaagcaatactttatttgaaatttaattcagagagtataatcatttaggtggattcctagtaattttatcgttatgaaataatgtatagttaagactaggcttttgcttctattcagaagatatagagagaaagcatcccatagtaatattttaaaatcctcccaaggttttactaaatctgcttcctgttatttcccagtggcttttcactgatgtttataataaagctgcaggtgctagatatcttcttgtaccacgaaattttgtgtgtattattctatatctttaatctgaatataggcatgattctttgaatcttttgattcccctattttcacttcaagatacatcataaaatgaataatatgtttaaatgaatcccatagtctgatccctacctgatgttttgctagaaaataaataataataacaaaaaaacttctactttggagaacatcaatatgaagctcaaaataatatatttagtttcatttcagaaacactttttttagctttctttactgatttaactgattaaaagtattagtgtaattaatcaccaaacgagcacgtatttgcgtaataaaaattataacgtgagaaaaatagttaataagacttagctgaaagaaatagaaatagaaattactaacaaaaaatataatataaatgagagtgagcttcagtgacttaaaaggagctgcatctctaccttaaaaaacatctaagacagaatcgacaaacttatgacattttaagcctaagtatttaacaaatatgatgtgaaatggtcaaaatgtaataactgttcaaaatattaaatttgcctagaacttttggtgggaaacagacatattctttgtatattttaatgaaaattattgatcgaatagtgcagaatacatggattcatttagcaattcataattatacaaatgtcaagcaacaatgtaattttctctctccatattcagtgtaaagttattggaaagcctttgtccagttcttcataaaatgagacacttttgagagtggggtaaggggtgtaaatttcgttagttatgattatctgggaagaagtggcacagttcctggagggtctgaaaattgtacagcaaggacatggtacattgggtgaggccaagtgagagcccagtcagagttgataatataaaaccttgagtagctggaaactgtttagagctggagaatgctacagaggggccacagcaaggatcttgtccaaggttattagcagaatctatctccatgactctcagggctgtctcgtggagcagacgttacattataaaaatcatttaggaatcataaagtctatggtaatggtctaattttactaatatttgctttgctctagttttgatccattgttgtttcctgtggtcagagacacatgctttaggaaatttcagggaaaaggtattatcttaaacctagagtgcagccaaattgacaatgtctgctttgtccataagcaagatgaccatttctcagatttgactctactacgttgatattgttacatgtaaataactgacccaatggtgacgaagagcaagctagttaccttgtatacaggagaaaattcagtattgtgatagacattagttcatgtgttaagctttgtaggggatttggagattggtaatccttcaaattatgaaaaatatacaaaaatacctaacttcaaggggacatgtttaaaaatgtcataattcatataaaaacaatatatttcttttaccacaaatatgctaaaatattgggaaaaaataaatatttcaataaaaccatgaaattacacaatcatagggacttatattaatatgttaattacttcaaaggcacacaggaaaagaaataagctaccaattgacattagacttctgccagagctttgtgtgtttgattttaatacaataatagcatcacctcttcctggttctaatttattttctcaactctacaagaataataataacatttcatattaaacaactgacatatttaatgaattttggtaaagctctgtaccaatttataaactaattttggtgtgccctttttatgtttaacatgaaaaactatacattaatttcattattccatatatgtcttttaaaataaagaaaatcacgattaaaactaaagctcaaatgtcactaaagaaagaaaattcaaggtagttatcatgttaatttggtttcaatgagaattttcatgtgtaattgtatttttaaatcactttcataaaagacatacattcaatgtgtaaaaaggaaagaaatcatgaaaatgaatgtattagggcctatctaattttgtatatagtgaaataaacatatatacaacatttttgaatttaaaaattttacttttttttacttacattaaagaaaaaactctgacactcacaatactacgtaaaatatatgtcaatgaatgttgtccacttttctccccctctggacaaatgttacatttaagaacctattttatcatcttataagtaaatattttaggagaagactaaaatattcccagtatttctaaacagtgaaaacagaaacaaaataagcacaagatttctgtacagtagtctaccttattgttgttttgtaagaacacttaacataagacctatcgtcttacaaaattttaagtataaacctgcagtatcattggctataggtactatgctgtagaacaaatctccggaagttatttattatgcataactgaaactttgtaccatttaaccatcacccctccatttcctcccagcccctggcaacccacatccttctttcagctgcttttcaaccctctgttatgaagtatttaacattagtgtgaactagtacaatggagtcatgtacccttagaatctaaacctgattccaacacttacttgctttgtgaccttaagtaatttccttaaaccattagcttccaggtatataaaatggggtacattatgttactataccttgcttgatgtaaggcagaataaatgacattaaattaaacctcttgctcaaggactaatgtattacaagatgtcaaattcaaatgaaacttgtgatttctaaattagaatgttacataatttgatttggggcaaacaggaataagttcttacataattgaatttaatattattttcagtttcttgtaagagaaaaagtttccttgttggtatgaacactccttacattgcagtgtagtcttacgtatttggaaattgaacactgtatttaacaggaaaagaagctcctgattccttagttttataccatttactttacataacgtggatcttactagctctctttataggggattttctttgcttgaattactttactaatttgttcagcattaaccacttttcctacatgatcgagaaattgttcttttatagacacatgatcatgtatttatgctaaacatatcttctccagttatagattcattaggtaaaaaaaaaaaagttcaactctaattgtcttagggtgagttaaaaggctactgcttatgattcccactatatctacggtaatgattgttaaaagtcacttttaaatatttgatgtttaaaatgtgtgtttcaagacaacttattagcatcttcattgtaaatataaaataaattattatgagtatttttaggactgatatatttacaacttattctaaatgaggaaaagacataaaaaaacagaatcatgtacattttggaatctgttattgattccttccatagatgttttaaaacttaatctccctgaacttgtgttggggaaaggcttaaatgaacaattttgtgattccaagaatacttgtatactaccattccatgagctaagattacctatagaactgaataaaaacttaaatgataaacttgcaaattcttgtgagaaaggcaatatgtcttgaaaagtaatgcattaaatgaacattgagatattgttaaacatccctattaacaaaaccaaaatataagaatagtattttttagaaacaataggggatttcaagtgccttctctattctaatttgaaaatatcgcacagtgtgacaccaaagtagaagagaatttagaaaatgattcacactgatatctagtgtaactcaggagatatttattacaaaaggttatttctgaaaattaaccattgttttgcttggactgaatcatcctctctaaaggtaagtctacttgaaggaaaatttttagatgactttcaatgaagaggagcagttttcatgaaacatacccacaaaatcaggtccagggattgtctttgagaaaatcttctgtttgaaaatctgtgatgaacattgtagattctttgcttttacatttattaattttaacatgcatgtttctagagatttgaggttaagttttaatgaaacaagtatgctatttcccatatttgctatttttattattagcattatatccgttaggatgcttttggtaggaaacctcagaatatttcaaaccaaactggtttaaatggtaagttttgttgttgttgttgttgtttttaattctgaagtatgtctagaggtagggtgggctccaagattggaggttgcctttcagcctccatcatctcatgcaaaatgtgaaaagtctttgctttttaagttagcctccctcagtattgtaagatggatccagcagatggaagagtaatattcacatctgtatgtgtctccttaggagcaatgacaattttctaaaagctctctcagcattcttccttctatactacatggtcaagcattggatcagaaactcagtgatacactaatctctaacaagtgcaagggtttaccaccatttgggttggaatagatactgtggattgaatcataaagacctccatacagagaatttcttatgatgaacaaaatgctttagaaagcttaagaacaacagacgaggggcagtggctcatgcctgtaatcccagcactttgggaggcagagacaggtggatcacctgaggtcaggagttcgagaccagcgtggtcaatatggtgaaaccctgtctctactaaaaatacaaaaggtagctgggcatgatggcaggtgcctgtagtcccagctactcagggaggctgaggcaggagaatcacttgaacgtgggaagtggaggttgcagtgagctgagattgtgccactgtactccagcctgggtgacagagcaagactccatttcaaaaaaaaagaagaaagaaagaaagaaaggaagagagagagaaagaaagagagaaaggaaagaaaagaaaagaaaagaccttccaagaagaaaaacaagaacaaggggtttattgtcactgcaatcaagatcctgaggaccagaggagtctgagtatgagctgccctctgtcttaaggaacaagaaaaccaagggagaatagcaataagacaaaaaagcgaaataagaccacatggcttgctctaaaaagaaagctggtgaagaatcagactggacctaatctttagaaagcctgtggaaataccttcaaaaaatagtagacgaaaaatgggttactctgctatgtatctgcctaggatagccaaatcagacaatctacaaaactttctccaccaggaggtctccattttctacctttgacattcagaatcaactaatcataatatgctgcctgaattaattaacagacatatatcaataaatatcaatacatatatttaggatctattgcacaattgaacaagtacatttatatattatatatattatattattttactatgttatatattaatttcaaatagatataaacacatatatatattcatatacacaggtatatttgcattccactatgtggtggttaattttatgtgtcaacttgactgggccacagggtgcctagatagttggtcaaacattaatccatgtatttccgtgaaagtgttttggatgagattaacatttaaatggaaagactgggtgagcagattgtcatttctaatgtggttaggcctcattcaatcagttgaaagcctgaatagaaccaaaaggctaaccctccctcaaagcaagagacatttcctcctgctcaactgtatcaaaccaaaatattagctctttccagtacttcagcttgtcagtcttcagactgaaacttacgtgagttctcctggttctgaggccttcagactcagaggaactctgagttcctcaactctcctggtctccagctctccagcttgctcactcatactgcaaatcttgggacttctcagcatccataatagcatggagattatatatatatatatatatatgtatatatatgtatatgtatatatatgtatatgtatatatgcacatcttattggattcatttctctggagaactctgatgaatgcatgctattaagcataaaatcttaggggagaatgctcctggctgggggaagcagtattgacactataaattggaagaaaaatgatgacatggaaatggtcaaatgtgtttatcttctgtgagagacaaaaagctattcctttcaggatgtagtcatccagatttttagcattctcatttgtaagactgtctgtacaggtgaatatttttggaagacaaattactaaaggtcattatacatgaaatgttttactgatcattttacttatagttcccaggagttacacatgttaaaatattaacttttatgacttatatattaaatgcatattaacttattaaagacagaaagacatttttaaaaatctttgtttggcatagcaatttttttctctacttcatgaaaaatatgtaacattcctgttaaaactgtcgaagtcttcaatggctgacattatttagcattaactacagttaagttcttacttatcagtctctggctacctaaaggttttttttttaatgtgatatgtcacattcagtagtttattaagtcaggtttctactgttgggcattttgttgtttgaaatacatttataatccttccttagaaatagaatttatggttcaaagagtatacatatttttaaatatttttaatgtaaaacaacaagttgccattccagaacatgtaacacctcctaacacaggcattatagaacagggtctctatgatcaaacccaagacaagcttcttattaacattttaaaactccagtataggccaggcgcggtggctcacgcctgtaatcccagcactttgggaggccgagacgggcggatcacgaggtcaggagatcaagaccatcctggctaacatggtgaaaccccgtctctactaaaaatacaaaaaattagccgggcatggtggcgggaacctgtagtcccagctactcgggaggctgaggcaggagaatggcatgaacctgggaggcagaggttgcagtgagctgagattgcgccactgcactccagcctgggcgacagagtgagactccgtctcaaaaaaaaacaaacaaaaaaaactccagtataatcatacaatgcgtaaatgtgaattgtttaattcatctcattgataatgaaaagtttatattttacattatttattttacaaataagtcatttttccttatttacatttagagcttttttataataaaataaatgaggttattgtatcactttaaaaggtatgtgtctcccaacaattttatagatagcaactgtagatttttgttgtttgtttaaatcttcaacaatcatctatctctctacacatcatgaggtaagcatttaacttttgcttttttcaaataatctggtaatcaattaaaaaaattgttaatgtggtgatattttaccaagaattgaactgttctctttatcatgatagagtgcccttaccagttgtgtgactctgggaaggctctgagacttttggtttctgcaacctcgtctgtaaatgggaataataatagtaaattcctaacagggtgggtaggagagttagttaatatatctatgtagaaaacttaaaaagaacctgacatataattaacactcaataattaactcggctagctaaatatatttatatattataaatattaaatatttataattgtcagatctgctggaattattgacttttcattggcctatctatagttataccacaatgaaacattcttgtttatgaaatgttccctaaatcataaagtcaggaaaatcacgtcattcttcaaatactacccattgctcttctatagattaaaattagtatcatggtactaagttttcaatcaaagagttaggcaaataaactaacaaataagcattccattgagatttttttttaattaaattgcattaaagatcaccttgggaagatttgccatgttttcaaatctaaatcttttacttaggaacattgaagttatataatctaaagatagcaataccatttgacccagcaatcctgttactgggtatatacacagaggaatataaatcattctattttgaagacacatgcatgtgtatgttcattgcaacgctattcacaatagcaaagtcactaagtcaacctaaaagcccatcaataatagactggataaagaaaatgtggcacatatacactatagaataccatgcagccataaaaaagaatgagatcacatcctttgcggagacatgaatggagctggaggccattatccttagcaaactaacagaggaacacaaaataaaataccacatgctctcacaattgggagctaaatgatgagaacacatggacacacagagcggaacgtatccactggggccttttggagagtggagggtgggaggaaggagagattcaggaaaaataactaatgggtacgaggcttaatacctgggtgataaattaatctgtacagcaaaccaccatgacacatgtttatctatgtaaaaggcctgcacgtgtaccccagaagtgaaaataaacattaaaaaataaaataaaatataatgcagtggttatttgtcattctacaactaacctgtattcttataatgacagagcaatttaaaaggtcaaaaatatttaccctatgtgagatataataataggtccatgtatgaaatataataattggttcatctgtcaattgaaaaaaatattttaatatttggtaattaatttctccaaagtattattagtatgggcatagcaagaagacaattggtatatatagaagttgtatctctgctgagtaccacctaaagtaggcatttaattgaaacacaggctggcactttacacatcatcctttgttaattggtctttggaggctgtttggaggtttccaattatcaatcccccaaatcccacaacaataacaacaattttaaaaaaagaaggtcaccttctcaccttctctttctactaatgagtagtgccaaaaagtgacagaaggaagagcaaatatcactgttttattatgtttctatctggtttatcagagatctgtttaaaaagctgtaaatatggacatggtataaacttagccaaagtagggtctttattgtgattgtttgtgtttggaaaatgaaaatcaacaccaagaaagagttagacattacaggcatgcatgcaaatatatgtatttctgacagtacgtttaggataaatgcaatatatttaaaaccacatgtaaatgattttgaaatataacagccataagtattacatttgaccattcttaattttcagtatttgtcactgcaatgtattaaattatttttattgtacatctgtaaagccagcacagtaacatattaaatcagcttgcaaaatgcatttggaaaattccatggtaagcttaaagaagaatatttagcttcagatgtttacatcagaatttttacacctcaaactatgactggaaaagacaaaagtatataatcattatgtggtagacacagatagtagcagcttcctaaacacagctgtacacagtgtcattgttagaaacttaatccaagataaaaactttaaaaattgagaatggtaaaagtataatgaggcattaggcaacttgaatttctcctctgtcttccaacatctactttcattttgatgtcctagttcatttcctcagtgcttctagatcttgaaagtgatgtgtactttaataaattgaatatgggtaaaaattagttacaactagaaatgtcatgccatgtaaataatttttatataagaaaaatggttaaacacttattatatgtttattttacagaaaggcttacctataatcaataacatgtgatttttaaaatgatggtaatattcaaacaaagaaaatgtccaaatgaattaatattgtactcatttggtatgtttccccatttataaacagtaaaagaccaggtgtagtggctcacacctgtaatctgagcagtttaggaggccaacatgggcagattgcttcagttaaggaattcaagaacagcctgggcaacaaagtgagaccctgtctgtacaaaaaaaaaaaaaaactacaaaaattggctgggtatggttctgtgtgcctgtagtccaagttactcatctgggaggtggaggttgcagtgcagtgagcctagattgcgctactaccctccaacctggtaacagagtgagacgctgccaaaaaaaaaaaaaaaaagagaagaaaagaaaaaaaagtagtaaataatgaaacaattaacttatagctaaagttgcatttgagttcttgttgcttatgatttcttcaataaaagcattaaaaatatgtgattcttaagaatgatttacgattcctagtgttttaaacttggcccttgcagcaaaatagaattaaaaatttcttatgaatctgagtattttatttttcaaaatgtattcaggaataaatggatagatagctataggaatagggtgtgcttgcacttttcaaattcttatattctggtaattcaagaaatgctatttgtctccatctaaataaatttgagtagagaagaattggttcccataaagagcacacattcactataatcactgaaagcaaaactgataaaatgccaaagtgaagatgtttgccactgagatggctttggaaaaataaaatgtttaaaactttttcaagagaataaactatttgaaaggtatatttaaataaaatatgtgtaaattgaaacaagacaaaaataagtattttttaaatggaacagctgagctgataagcataaattctattttctgtatacaactgaataaattgacttttagtgtcacactgttttaagtgaaatataggagctggtgctgaaacactttaatattggaagtggttacatataaaagaacttgatggaatacacaagacataaatgaatagactggatgtagcaaagtgctcccaaaatatagataatactggcagcacagaaaatgaagactcaagtaaaatatttgtgagacatgagtgaataaggaaaaaaaaaagataaagataaaagcagggtctcaaaacattgacctgctcagtatagaatactgtgtgaatgagaataaagatgtattttgttttcttctgggccctgtttccagaagcttaatgaaagacttaggctatcttttataattcaaaggaagaaaagcacacttttaagatctaaagaaacctctgtgtatagagtacaccaaggactcaatttcaagtatcatatccacagaaatgaaatcttaagataaatattagtagagactgtagcgattgtaatgatgtgacgacatttccatattaagtttattatggtaaatgccactcaccaaatctcttctttagaaatgctgtttcattacattttagtgagaacataaacaaaaacaagctttctcaatgttttagcgtaggggctgtttgacttcagttcatcagttattgactgccttcatgccaggctatttttgctggagtcacaatacctgtccttgaaactcactgggctgggagacaaagaagtatagtacaaaaggcctatgatagagacatcattgatgtgggaaggtgaggagaggtgtcgacttaggttttaaacacaatgctctcaatgcttttaggacaacttcaaggaggggctaattgtgcaatatttggccctggtgggcgtgttggagctgacaactgactgatgcattggcatatgagttgtaacgtgcaagcagaagttgaaagtatgatcagcagcaacagcatgagcacagcacagaggcctgagggcctggccctgaagcaaacaggttcaaagagagacctgtctgaagcgcaggtgagaaatgagtctgaaagggacatatggtcccaaggttagaaagcctattgtcttgaactactttgattcatagaatgctttactaaggtggggcaacattttatgttttgatgaagtataaaataacataattgaaacactgatgtttcctcaaattctctttagtttcaagtgaatgattttcatggacttgcagatttaaatgctacaagaacgggatcataaaaccaaagaagaaatgttataggtttcctacatagagacaaaataacttatatatttctaaaagtaaaatcaaattggtattactagcatgagtagaatacatgtagtaccccagagactccaaatagggaaggcaatggtattcaaatatctactacgtatgtcactattttttctatgaacacagagtgattgcttcattctgtgttcagagaaggcaaaattgatttctgatagaatttgaaaatggacagttagaagtggtcctgttccccttgcagatgttcaaaactgcagacttccctcctacaacctgcatgcgtcctactgtaaataggcagtacattctcattatatttgatacattacgttttcgtatgttagcattatttttgagttgcatagacacacacaaaatcacttaggcacacatacaatttttcaattcatatagctatcaacttcttccaccttcatttaccacctattccttaaccgtttagtcttggacatatggctctggtaagacatcattcctaatctagtgcactcaattttcctgtgcagaaaaacacatattatactaaagttacataggaaaatcttatagtagatatatttgatttatgttgaggaagtaaaatggaagaggcatggatttttttctttccctggagagattaggaaagtgaacaaagagaaaagctacttattctggaacatgaacaaagagagccacaggagatgacactaaaaaggaaaactgggttcgcatgctgtagagccttgaatatcatgttgagaaaattgggcttataactataggtaagggcaagccatttgcagtccataaaccttgggtgtaacttcatctattttctgtcacacaaaagtaactggattcaataggtaagaacaacgggcaaagaatgcaattagaaagccatggcagtagtccaagtaggaggaaataatattatcattatggtaatagcaatgtgaataaaactaaaggattaaaaatattacaaggtgtgagatatggtactggggatatcaagaagagccaaaacccagagagatattctgagtcaaaactggaaagctctgatggaccagtcgaatgtagggcagtgagagagatggaataatggaaaactacagtgtttagttttgggatactgatgacacagttaaatggagaattcagtttggaagtacattgaggaagtaaagtgaagaaaatgagttaggttttcaacaaaataatagtaaaatacctgcaagatactaagatgaagccatttgacacccggataggtggctctgtagctcagaagtcaggtcccaactcaacatacacatttgagtcaattaacattgagttggtatttaatgttaggaaatcatagtgaaaaaaaaaaaaggtaggggataggaaggtagggagagaaaaaatgagaacaaggtttacaaccctggaataagaagtaagaatttaaaataaatctttacatttcacaatgttgggaaaatgaatgacttactgaggtactgagaacagttgttaagtagatttggaatcacctgaataaaatgtattggaaaaggaaaagaagtaaagggagaggaaaaataaatggtttaatttgcaggaaaagtaacgtttgggtaataccttaaagaggcggcaagataggaggaaatgtaatttatttaagatgggacttatcgcatatctgaaaaagcacagtggtccctttttgagaataatggaataacatagaaattatcaaaaatagaattattaaactgtgatatatatatataatatacatatatatatatatatataatatctacaaagtatataatcttatctttccttgaagataaatctgagtccagatcttttggtcatgtgaacatactgctaaaaagtcttctatttccatgataattttttatagtaagttaattatcattattttccctagatgtcacataaaattgttgtgatattatataaagttagctgttagcgtctggagtatttctcatcattcttaaaatagacaacagtaataatatagaacattaatgtttctatatccatttaggaggtgtttgtaaaaagttccagttgataattcaaatgtagctgccgcaaaactgttgccacgtgttcactgatatttctgaagttatttggtttgggtatgttgccagctagcaaaacacatctaataatcttacttcacttcacagcaatttgttggtattttattctaaacatttatgataagatgctaccatacatatttatcatgtgtgagataataaagtgtcattatatgaatataaacattatataaccactgtttgaagactagtgctacataaacatctatttcggcagtattctcagagtatagccagcagatgctatactctattttttttgaagagtgatcagctacaagtctaaacaaagtgagctcacagatgccgtatagtttaattgctatcatttcagtgtggagatgttctagagaaaagtagcaaatctcatactagctattaaaaactaaatgtattatattactccaacatctgctatttattttgcttttgcttcatggcaggtacaattaatattgttttagtcatagatttataaaattttccccatgggtaatcccattatggaaaatgtttgcacttaaaaacccacagagattttttaaaacatttttaatatggaaaaattataagaaaaaaacccttaatgtacatgtattatattaattaatactagagtaacttcaataattaggctttcaaagaagccggaaagtatggaagctatactaacaatgagtttcatgaagcatgataccttttccttctgctctcatttgttgaatttagtggaactctacaccagaaactttccacatgttttcatttctcaaactatgtgcctgctctttgtgttaggttctggggatgcagtgatgaagaaagcagataggatacttcttttttttttttttttttttttttttttctttttttttttttttgagacggagtctcgctctgtcgcccagtctggagtgcagtggcgagatctcctctcactgcaagctccgcctcccgggttcacgccattctcctgcctcagcctccctagtagctgggactacaggcgcccgccactacgcccggctaattttttgtatttttttactagagacggggtttcaccgtttttagccgggatggtctcgatctcctgacctcgtgatccgcccgcctcggcctcccaaagtgctgggattacaggcgtgagccaccgcgcccggcaggatacttctttcttggagctcacattcctctgaagaagacagataaggcaagtaataaacaaacagctaaatgcatgagggttttgaacggtgttaaatgtcacaagaaaataaacaaagaagggaatagagacgtagggaaggcagcttcaatgcgaatgaccaagaaatagctctttgaagaggtgaaactttggccaagagcagactgatgagaaagagcgaggcatgttaagacctgggggtgcacatttcagcagaatacacataaatcataaaggctgtaagacattaacaagcttgataaactcaagaaacagaagtttattaagcttgctatgaaactggaatatattgagtgaggtagaagatgaggtggtgatgaaccctgtctctattaaaaatacaaaaaattagccgggcacggtggcgggcgcctgtagtcccagctactcgggaggctgaggcaggagaatggcgtgaacccgggaggcagagcttgcagtgatctgagatcgcgccattgcactttagcctgggagacagagcgagactgtgtcagaagaaaaaaaaaaaaggcagatgacatagggccttgtgggccttggtgaggagtttgggttttattctcaatgcaaaacaaagccactgaagcattctcagccgtgaggatctagtatgctttgaaagaaaaataaatattttttgactttatgtgttgtataaatggaaggggaagaagtatggaaagaatttaaactctcagttggaagcatattgcagggaatagatttcaaaaagacagaatgaaaagaagaaaaaatatttgagatatacaaacacacatacatatatatgtatatacatttgcggttgggcagaagatacacacttcagattaattctcttttggtcctctaaattttaacattgagaaacattactgtttccttagttcttaaaaattttccataacaatttgctttgctaacaaaaaccaaagaaataaaaatccctattatctaacttctgttgcaattattatgcctattccttcatttttcctcttaatgaaaaggggaacagctgcttactatcatccatattcttttcataaacttgaagtctgttattaagcagtccataagtttgtgatgtctaattcacatgtcatcatccaaattgactacttgaagtcaaaagcactgaaagggacttagtcatttaaatgaccaaaataacctggcaattatccattatcaaacctaaacaacgaacatcatattatgaaagaaattgaatcagtaaaaaataccagcaagcaacttgaatgcttttaaaaatttgactacaaaagtcattatgttgtgcaccagttgacaagagacgacactttcgtgttcttgccaaacaaaaacgaaaacaaaaaattataggagcctgttctaagtactggggtaacaaccctagacactgtctttggcttcacagagataacaggccagatgggcattgagacaagtgaacaggcagatggaaaacagcatggtgagtaatacagatggtgggaagaacagggtactatggcatctgctgtggaaagaagatagatctaggtgatggttaagtctaagacaaaggaggagtaaaatcatcaaggaaagcaggagagagggaaggaagtggaaagcagacaaaaaaaaaaaaaaaacaacagcagctgtagaagcctgagaagatgagagagtcaagtccttagagggactgaaagcagagacataacggcacaaaacgagatgggaaagtgacggagcaatacatgagtctgtaatgagtggtaagattttagatgttgattcttatttaatccttatgtgattttttgagataattctgccagcagcatggaaaacagcttggaaggaaaaaggctaaaatcaaagaaacgggttaggtgtttataggaggaagttatacatcaatatgaatattcaattttactgtcttattgagactgtctattagatgtgggaagaagaattgaacccatgggactcctctctgcagtgtaaaaaaattaaaattttatgcatttctcacagtctctaacccatatttttttctatgtcacttacaaacagtaattgatgcctttgttttcaaatgagatatttctggagtgataaatctggatctatggatcttacataaggtatctcctatcatttgctgatattgttgatactatatattctttaaattggttttatctattccattttttactagttttattcattacaagtttaatgtgtgacaaatctgaaatcaaagtattctaatataattttctaatatcactttttcataaagatacttattcatctcattgtcacattcactactttttattcaaaatgttatataattgttaaactgtatttgttgtttttatatcatgttagtttcctgtaactgatgggtcacatgaacttgtcagtggtaaattgttcagctttatgaggctaatacatgaagattataagaaaatctagggttcttagtcaatgtgtcacagtttgagtttgtatccaaataatagtttttacaatattttaactcatttactatcacgagcaaagtaatgcacattttttggtaaaaagttcttgaaggtaggaaagtgtatgaagaaaaataaagccaatatgtaagaattcatacaacacaattgcttttgttagaaaaaaacgatttacttaaggacaatgttgacatctttcttctcttgtgttaagctggtgacactctcaagatttatatttttaaactttacttgcccaaatatatacacagaaaatttggcaatattacatttctaaagttttaaaactttttatcttttcttgggtatatactcattcacatataggctgcaaacaataacaaggaagttaacactgtctaactattttaaaagtatctaaatcattagggtacacttttggataaacaagttagaactgtgaaaaatgggtacaatgtatctacaggggaaattttacatactttgcttttattataattttatttattgacctggactgttctactaaaccatccttaaaactcttgatgctgtaaatctcccctgaaaaattccttctttagaaatgacagatttgaaagtgctttgaagtaatggatcctaacttcaaggaccgaaaaaaaaaaaaaaaaaaaaagaaagaaagaaaagaaatggactgctttgctttgctgtgttctgctcagtctataacagtatactcacacatattaggtggtctatctatgtttgttgaacaaataaacaaataatgagttacaaaatactgattaaaacactagtatagcggttgtaacaaatccatcgtacactatatttgtaacattcaaagatacataagttccctttagaaacctttatttagttaggaatgacacacttcagtcagttttaaaacataaaaaatatttcatataaacttaatggttaattctctattccatcctaatttattcctattatttatctcatatttattcatgaattattattttaacatttgtgaagaatattaaaaagagaatatttcaaaagacttattttgttatccaaatcacaatttaccctcattatcaaatttctaactctaaaaaggattcttcataaaatgtgaaagcccaagaaatataaagcaaactctactacaaagcaaagactatcgctaagtctttcaactttacaaatttaattgttactggccggacgcggtggctcacacctgtaatcccagcactttgggagcctgaggcaggtggatcacgaggtcaggagttcaagaccagcctggccaagatggtgaaaccccgtctctactaaaaatacaaaacttagccaggcgtggtggcagatgcctgtaatcccaactactcaggaggctgagacagagaattgcttgaacccgggaggcggaggttgcagaaagccaagatcacactactgcactccagtctaggcaacagagaaagactccgtctcaaaaaaaaaaaaaaattaattgttactttgtacattgcattccttattcatgctagctgttttctaatatctaccctctacttcctcaatagggatttaggtgggcagcagcacttggttatttacaagttcaggatcctgtttataaagcaaggtagtgtgccttcttcttttccttgtttaatattctccatgtaacttttcttcttcctgtagatgtagataaaagctatctcttgaagatggtagagcacataccacccctggaatggtaacctctgaactgttacaccaaagatcttatttatggtgtttaaatgtttgcgttggtcacatgaaacataatatttaccttgcttaaacatttagggtttcactgttacagagtcagaattgactccaactaatacatttccttgattaagtaaaacttagtctgaggtgtctaggattattgttttcattaaagtaacaatatttcattttgatataaactagtaatggttagttatatatagtataaaatggtatatgggattatcagctcattttattattagttatttgcccatgctcaggtaaaagttctattattcagatgttttcattaaaagaaaaaaagattgttaacatacatggatacttaacaatacttctgttatcagcatttttaatccttcatgtgtctccaaagcatacaatgtaaaacaattcaattttaaaatgtataattcatttgcaagttttctgataatccttagtgaccttggattgtcagctttgtcctcctctcaataacaacttgtataagttagaagaaagaattggtcccaaaagaaatcccctaaatgaaataaattttaaaatcctttcatgcattacactgccaatcactgtggataatcccattcaagctacataattagtattctaaggtatggattcccacctgtaccatgtagtacaacatcatgaagtggggaggggtatagaaaggagaggctcccagcagacttttatgtgatagaatgtgggaatcaattttaattaattctgcctctttaaatctgtctgctctttaggaaagattgctatctgtctccagcactatggcgagataattaataggagcactgctggagactgatagtgcaggcggccgatacccatggcaggagctctcgtcatctaactgccacagaattgtgaaggtaaagaatctgcagaaaagtggaacattcatttttactaaataaatgcattatctatagcacacattatagagttttgttgttgttgttgttaatctaacatgtaacagaaataaaagagattgtttctaaaccactttaaactgttctggcaactaccttagacccttctggcgaagcatctctaaagaagaccattgacagccactatcagtagcagcagcagtgggcatgtgtcctcgcttgccaccccacaaaaaagcaaacaaacaaaaatcattcccagatgaaaactacgaagttgtaaactataaaagggaagattaaacattgtctgtgtgttctctaacatccatttgatttatagtttttttttttttccttttttgacagaagttggtcttatcccattttctcagcataaaaataacaattctcttataaggcagttttacgcagcattaacagagcaaagagtaaactttgtttgctttaataatactaaattgtaacatcatattttctatttgcaaatgtttgtccatctactggatgtataaatcttcgtagtgacaaaagtatgtttgatttatttataatggtcaatggaagggctatgaaattgtgtattaagctactatgagaaaagcggcatggctcaaataatcatctttatattcagcatgcttcaggcaatcactaatttttgagaaatctattgttctctagtttttcccaagtactcatttccaacctcattccatcaggtattctctgaggagtcttatccctatgacttgctcaaagcagatattgtctattttttttgtctattaagaaaataacaaaattttaaaaccaaataagatcttggctaagataccatatgaaaggtgaatacacacagacccaaacaagtccaaaagattgcctgtcataaagttaaaactggaatcagaactggcaacctggacttctgacttgtgattcaggatatatttcaccatctagactgctacgcagtctcagaaaaaaaaaacaaaaaaaaacttagattgatttcaaagaggccaccacacatgtattctttcttccaaagccttgttttattcttaccttattcttcaacctctagtatacacatatacagctcataattgaaatgatgtattttcctgtccttatgctaaacaattttaggaggtttttttcctgttttggggttaaaaagtactaaaattaggcaagatcatttagctgctttctttaggaaatacttgcttcttgaagacctcgaagcaactgaatagatctctcatcaggacttacagcttactcttcagtacttgcctgaataccatctcctctctagcccctcaatccacagttattataccattaactacctaatctgaactggctccttgaattgcatggctcgagttaaaacttctcgcatttattatgaaataatttttaaatgaaaccctataaatatcggtctattttttctcccttctgattaagactgtcatgatggtgttatcccactattagagttctccagataaatagaaacaataggatgtgaatttatatatacagagacatttattttaagaagttggctcatgcagttgtggatgctggatagtccgaaatctgcagggtaggtgggcaagctgggaactcagagaagaactgatgttgtgcttcaagttcaaggctgtctactggtagaattccccttatctagagggaggtcactctttttcttaaggtcttcaactgattggatgaggtccacccaccttgtggatggtaatctgcttcattcaaagtattcaatgttaatctcatctgaaaataccttcacagcaatatccggatgtgtttgattaaatatctgggatgtggtctagccaaactgacacatgaaattaaccattgcatcctttgtagcaatgaataaaataaattccattttactggaacaacaatttttctggtggcctttctgagaagttgacagctgacatgtttctaagcattaggtctatataaaactgataaagacaatacagtttgttggttaactatagaatctaaataggtgataagattcatgagaaaagtttcttctgttttgtgaattgtaatattctcagtgcctaaaacaattcctaacaaatagcaggtaccagtaggtatttgaaaaaagcgtaaatgggccgggcgcggtggctcccgcctgtaatcccatcactttgggaggccgaggcgggtggatcaaaaggtcaggagttcgagaccagcctggccaacatgatgaaacaccattgttactaaaaatacaaaaattagctgggcatggtggtggctgcctgtaatcccagctacttgggaggctgaggcaggagaattgtttgaacccgggaggcaaatgttgcagtgagctgagatcatgtcattgcactccagcctgggtgacaggataagactccgtctcaaaaaaaaaaaaaaaaaaaaaacaaaaaaaaaaaggtaaattaaaaaatcaatacgtcaaacattctgatgtattctttgtagagaagaagattatattttcaaaatgatatcttaaacagtgtagtgtgcaattgagtaactgaaattgaatgtgtaccagatatacaactgtggtatgatcctatacgtctgcaacacaaatatccagatccacaacatgcacaaaaaaaccccactttttttattgacaattattttgttccttatgggaaattaaattttaaaatactctccatcactcatgcaaatatcagttgtttgagcaatatgttttgcattcttatatcattttacaaacagagctcatacatgatgttatccctcagtcataactgtttttttgtcatagtttaaaatatttcctctcacttcttaatgaatgacacttcaaagatgcctgacttgtcacttgtatttattcacgtctttatcttgaaaagctccagtggacaaacctgagcataaaattgccacccagcttttcatgaagactgaagaagtattctgtttcatgatttatatcctgggttttatactaggagcaggttatattaaaaattatctcagatgggtcaatttcttttaaatctttatgaaagcatcttgaaagcaactcattcttatttcggctaagaacggaaaatgcctggagaagggaaacccttacaaagttatgtgaagggcatgcatgccacggtgtgccccccaggagttttcataatcacaagtaaatggttatccacaatattaagtgctacaggcccaagatataaatataagcagtaacgtctgctctttaacttatatatgccaaatctcctatgaagttaccaatcagaacaggttttactatttacacctaggtagaggtgcaaactaataaatattttactgtttgattcaagaaatttctggaaaccaatttattcccaagtgcttgctcatctggaaaagcaatttttctgtcagtttaattgacaccttaaatggtgatttaaaatatttgcaaattatttctattgttaaatttatgattaatctttaagaaaatgtataataaatcacaaaagaagaaagtagattttgtgcataaaaccgttaaaatacaaacaaaaccttgtgtcagacttagcatgtgttactgatatgtactttaatcttctacaaaatttcagtttgtaatttctcaaacacacacacacacacacacacacaatcacacacataacctagtgttataaaggtgccaatggtataaagaaagattatgaacttcaaagtcatagtttcccagagagaaaaaaattgtatattcagagatgtaaattgattcaggtaaaatacctagttagtagttaaactggcaatcaaagtctaaaacctaacctatacatcacccagttacgaaatgtatgtaatgtgtatatgtacaaactcacatgcatctatgtgtatatttgacctaaattattccaatatatatacataaagaaaatcaataatttttaaatgcatgagtcccatggagaagaagtaataataattataggagtaatctcttacccatagatctgtcccttggtgttacaaaataaaaaatctaattttatcttacacatttgttagttgttagatttaattctcagtcattcttaaaaaagtattaaaatattgtgatttgagttttattgtattttatttgctagaatagcattatttattaaaataacacaggcaagtaattcattttgtgttaatgattcttatttcttgaatggggcagaaagttatgtcatcagctttttttggaagacagtcatttataaccttgaaaactgtgatcagaccaattgaatccacatagctaaaggattgggactgagaactaagatcgttgggtcaaattgacttaatcatttgtttcagaacattcttttctgggaagataagagtataaactaataatttactgtttgcgtcaggaaattcctataaatacattcatcttgataaagagttaatttttctgagcaaacatgtcttgtattaggaccatggttatcttatctgagcaaacaatttgcttttcaaataacagtttagttatcacaacttgcttcaagatcttttctgcacacaaattctaaactgcgatgtcatgaactttacatacttccaaggagttccctgcttgtacatgtcctctttaagtcacttgagcccagaatcctgaacactgaaaattaaaaaaaaaatacatctattcttacatttatacttcgaataagaatttttcatgttgatgttctgccttgatgccatatgcctaataaacttagctttacttttttgaagaggtgttgttttggagagttaaaatttgacagtctactgacttttcataacggaacatcatggtaatttaagtgtgtctcaaaaaggaataaaagtctgagaaccacatctctagattttacctttctttatctacaaaataataaaaatctgtcttacattttatttaacatagtgggacagtatattattatgtgatacagttttccttgttcagataacaaaattgatcagaaactatcattatcacaatataaaagaaagcactgtttaccccctttcatgtgtgaagtaatgtgaaagaaaatgattatcatgtacataatttaattaacataactgagtattttttaaacaaatgaaggtcaactctgttaacagtattagatgtctgaaagcaaattcctacaaacacatgaaaaaagtagcaatggtctttgcacatgaggttcacgaactattctaagtatttgagcctctgacaatttgttcagttaatccattctcttctatatagtgacttgtttagccttttggtttctaacctataaaagtaagagtagaaaaccttaaagatggactcatgggctctttttcccatcatgcgaaaatgttcacttgctacagtgtttccaagtttaaataaagtttgatcatcttcattctaagcactgagtgatcatttcatttctaaatttaactgcatttattcaccaaatgaaatgcagtaaattttacttatacaatctaatatataaaaagaaaaaatggtgtttgtgaatgaataataattaagatatagaacttcaatcagttcccctatgcagtaattggctaaagtataaaatattttatatcagtttccttgaggctctctttggcttacaaaattgtggaatacatttttatactttatatgtaagagttttacaaagttatgatacaaaaccagtgaaagtttagtgtgtaaatacacgtgctttttacatttgtttttaaaataattttatctaattagaagactgaaagagtaacacatacaaaaaataatatactctttatacagattctttaattgttttgattttacctcaggtttttgcacttattcaatacccaatgcattttatactgaactatttaagaggatatttgagatattttatgcctgtatttctaatgttttagttatatttctcacataaaaccattctaccattattgaaaagaaaagcttttgtcatcaatatattattatagccaatctgtagttaaattcaattgttgtcttttccatatatatttccttcttcagaatgctgatataaattcatacttgattaattgaataaagaaacaaataactaaataaatacaaaagttcttccctaccatagaatcataaatatgcacaatgaaattagagggcaaatatataatgaagaacatggtattataaaatctcaaacaatttccacgtagattgcttattaattaaaaaggggaatatcatctctatagtgaaaatgttaaagattacattaataaacaatcaaagtgaacatcatcattcaagtgacaaactgccaccacatttctgcagatatgatgcctcaaaaggagaacaacatcacttccgcggcattcctgcgcaaaatgactaacctgaatctagtcatgagaaactgagaatctcaaattgtcagacaatctagaaaataatttgcctgtactcttcaaaaatatcaagatcatgaaagacaaagaaagtcggagaaattgtttcagattaagatacattaaagagataagacgacggaatgcattgagtcccagaaggagggattagcatatactgtgtttgcatatcataaaaactgacactgaggtaattctgcttgtctttttctcaagtcaaaagaaagaaccattaataaatacattacaaatacattagaatatccatgtcaatcaaaacttgaatgaaagaataactaatttattatttattcctgtgattaaacaatgtgcacgtttcaaaatatggtattaaaggaacatgtctctacttacctcatcacaaggtcttagacagcttcatgttcatcattattaaaggaagcccacacaaaaactgcacacccctagaaactgaagcagctgaattacactaacaataaaccaaggggtgaataaaagtgtctactaaatacaaaatttaagtataattctcaatgggtatgatggttgtagcagataatgatatgtctagtctactgtaatcattacttatgtaagaaattctttattgttattggagagagtcaatcacctggttgaatataaaaatatctctcttttggcctgtacaatccacagatttatagaagatttggaagacctggagtcccatactcttactagtatcttccagtatagattatttttaataaagtatagaagaattttcagattgattttttaacaatgtttaaatcaagtggtgcatacacttggatgtgaacacatcacatatcatgattttaatgtttaaaagcgtttttgtgatattccatcggtaacagattttttttcatctgttttgctattgcatgcctctcaaacttctgggtaataagaaatgtagaaaagtaaatttacaaaatttagaagcaaatatcatgtatttgcttttatgttctcagagtatatagagttccttaaagaagatacacagatcacaaaacattaagtaatactcagaaagtcaactgcattaaacattaaaataaaaaagtatttaatataatatgtaaaaaaatacgtacaaatctaaaatgaaatggttaatgaagttgaaaaatgtggacaaagaatataggaaggtaattttaaaagaaactaaaatggtcaataaacttctgaaaaagtgctaaatctcattggaattaagaaattgaaaatgaaaatcatgaggatacaatttaacatctaccataatggcaaaataatcatctgattttcaactattagaaagtatggagagcaattaaaaactcaaacaataattgtgagaatgtaaattggaataaacaatttagaaaataatttcaatatgcatttacttaaaatttgcataccactcacagaaaattctacttacagatatcttagaaaaatatttgcacaggtgcacaaagacatgcataagaacttttctcatagcttcatttagagttagaaaaaaattaaattaacaatagaatggataaataagtacctcaatataaacaatggaactgtgcagcagtgaaaacgcatgaaaccaagctgcatttatcaataagggtaaattattagattatattgaatgacaatgtcagatggcagaaagatacacagatgataactcccatttgaaaatttcattgtatttaaaacagtactttagaagtacattccagtggagaagagaaaaagagaccctggaacagacccttaagagacttcagcttaatatgtccagttggcccttccaactcctgtgggttccacatctgtgcattcaaccaacagcaactcaacaagacttggaaaaaagattgcatttgtaccgaacatgcagaaacttgttttcttgtcattgttccctaaacattatagtaccaattatttacattgcatttaccttgtattagatattatacataatttagagatgagttaaagtgtatgggaggatgtgcataggttatatgcaaatattacacaattttatctaaggaacttgaacatctgcagattttcgtattggcaggagatcttggaaccaattactcaatggatacagaggagtgacaacattattttataccttatggcaggtggtaggtacacagtaatcaattttttgtgattttttacatgtataagaaatttcagaacacacttatatacttttacactcattgcatgtatttgactatgattagaatgttggcaaaatagattatactgaatctaatgtttgtggatttaaaaatccaccttgtctaggattgattttatatttaacataatttatgtaaaatcatgatatcttttgaatactaaacaatctcatggtaaaaaaggcaaaatgaaaacccagttttctttagatctataaatgtttataagactgaaattagcttggactttgaatgttctttaattggatataaacattatattattaatcaatagtcatttcagattgactattttccttttgcacttcaacacagaaacattattttatgatatgatagtgcttactgttctgtttgcattttcaattgaacttggaaaataaactaaaacatgatgcaactattgagtccactgagtggtaaaatgaattaaacaaaactcaacccagtcataacagggctttttttttctgaaaagaaaggatgaacattttataatataataattacctgaatcaacagggcttatggtagctttggaatatttatttatggatttttaatgtagctatgctgcttatttctagaagctatgaagcaaaattaatagccctaattatacccagccacctgcagtgagtagtattaaacaaaattatacctacgagttctttcaaaatatattgtttaaaagcagggcaatgataatcaactatagttaaacaaaatattatttttgtcttatatcaaagctttatataaaaataataaattatacctgggggctttagaatttcctcatttttaaaggcagcatttcattttgatctcacattttcaatgcagaacataagcatttaaactatggtctatgattaaagagaagaaagtattttttatatgctgatcatatacaactcaatgtgattatgaagtctacagttataaattcagtgaaaaaaagacaaggaaaatttgatcatggtttttggaattattatctaagtatacttactacttctagaatatagtacagaaagatggtactcaaatcaattcctactcactacagctacttaatctcaggtgtgtttcccataaactacagaattcataacatctattttcttctataattttcagtcaaaatcacattagggaaggaaaaaatcttcaatttgatttttatgaaaactgtagttagataactctatcccatggaaactaaatatgtgttataatgtattccaaaataaatataactgactttgcattgaaaaaccccattcaaaaccattcagttatggagagtttattatattccaggaactgagccaagacacagggacacaattttgaaagaattgaaaacagccttaacacatctatgatctagatgggtttaaggtgtagaatgtgatttttttcatacattagtgatttttattagcacagttgtagagtaagtaaagttttgttttatgaaaaattaaaggtaattggaactcaaaacaccaatgtttcattaatgtgaaacaaagagaagatatatattcagttctttactctatcatcatctataaagagaagggaagtattaaaaaaatgaataagatttggacccatggtaactacctggtctctgccactgatttcctatttggtcatcaaaaaccacttatattctttgcacctcattttaaaaaattatctaggtataaactaaagaagataaactaaataatctgacatcctataattgtgggaaatttaaatcccagtataaaattaaacaagtatttcaagttaacacagctaattagatgttcctcttctaatatcattattttatagcaatattttaaaattacaatatttgaataactcgctaaagaattatatcctctcttcgcttaggttgttctgacattagccttcagtatgatctcctgcagaaaacaagcaagcaagcatacaacatgcacaacttaaagctttttcttaaaaagaagtttcccccagtgatggttactaagaggtgtcaacttgattgaattgagggatgcctagattgctgctaaaagattgtttctgggtatttctgtgatggtgttgccagaagaaattaacatttgagtcagtggactgggagagaaagacccacccttaatgtgggtgggcaccatccaatcagctgccagcgcggctagaacaaagcaggtagaagaagatgggatcagctggcttgctgagtcttgtggtttttatctttctccgtcctgtgctggatgcttcctgcccttggacatcagaccccaggttctttggcctttgggctcttggatttacaccagtggtttgcccagggctctctggccttctgccacaggctgaaggctgcactgttggcttccctacttttgaggcttttggacccagactgagccactactggctttctacctcctcagcttggagatagcctatcgtgggacttcgccctgtgattgtgtgagtcagttctccttaataaactccccttcatatatacatctatcctattagttctgtctctctggaaacccctaatacacccccatcctcctattagttctatattatcagcaaacttcttacacccatccctgcaaatgaagagacttggggatggatataatgggggagtggggtgggtaaccaaaacaatacaaatagtattttcttatgatattctatggaaatctaagttaggatttttgataatttggagtatagaaggagcacccagtaatctgtacacttactggctcatttaattaggcttatatataatccaaactcaaagccagtgtttctgaaaatgtttccttaaatagacaagatacacgcacggacacacatatgtacacacaaacaatgcaagtttttacaatatggttcatataaaataagctgcacttactgggttgcgctgacttttttttttcattttttctatcaggtaattcacaaagtaactcaccgagagatattcacatgtccccaggcgtgaacttttaaagcatcccattcttacacctgtgtattgtccaaaaactaattccaaaagagactttttcttcaactgataaacaggatttggagaaagaaatctgaaacctctacactaataagcatatactcattaggtctacagtaggacaacagattaaagaaaagcaaacaggattggcatacaggggaagaaaacatatacgaattctctgactcctctttttatcaatgtttttctttgattctgtcagcaactcctgtacattgcccataattgagaatctatatatttattttaggcttcagttggcaagaattgagttttttggtccattacaaccataaaaattcaaataaagtagaccaatatatccatatagcatacaatgttgatcagcctgctaatgctgacatatcattagattaaatacaaatattaaagctaatttatttgcttcctttggctacatggtatcatttaaagaaaagaaatgacttccaaaacatatacctatgaggtgcaattaataatatggtagcagctagttaacaagtttagaatgtattttccattgtattttgtagtgttattatcccatttaactatatgatcctagtttgttaatattacattttttagataattggtgagtaatatttgtgtttcttataaacatttattgtgcatccactataggtcacatgctttactcacattttagcattaaatatttcctataatcctaaagcacaatagtgataaagtgaaaatgtctctgttggtagcgattctgtaagggaaatatttgaaatttgtttgcactatagttgcaaaatgcatacactgtaccacgctaagttataatgtttatcaaaaattatctaagttcaaactcaacatagtaaatgataatacaatttaattcagactcatacattctaagataagagacaacaacctaaaagtaatacagatgaacgaattttatttaatgataagactactgactgttccaaaaagtccatggtttattttgtcaaatccttgagaagatagttctatgactcattctctgtccccaagagtataaatatcttacactaacaactcctcttttttgagaaaccaaatgtttcctaggtttttagtctcccttattgcagcaagtaataaaaccaatttgctgaatgtattcttagtggtctttggctgatgcacatgaacaattattagcatacaaattttatagaagaaggatataaaacctgaaagaagagaaggttcttaacaaaagcccattgtatcagatcttaaagaaacagttgaaataatctagtccacactttgattttacagatgagaaaactgataaaggatggggataaacatcatgatcaatgtacaattttttattactcctataactgaaaaaaatatttttatttattcctttagtctctattctttataaaagaaaatgctattgctacaagaaatataacaaaatataatcaatttgtaacagaagtaacaattatagtaaaaattattttaaattcatgcaaaattactttaatttctaattatttttctcacttacaaaatagccccttacaaaatatgtctatgtccttatcagagaatgaccagtttctttacagcctacggactcaagttgcaatattaactctgccctaggtaagctgcctgctggactactctgtagacttttgacctgccaacctttgcaattaggttagttcattccctaaaacctctctttgtgtatatgatatatataaacacacacgcacacatatatgttctattagttcttttttttctgaagaacattgacaactatagaggacataattaattaatcctagggacactcaaattaaacaggtaaatcaccccgatctaacataatttcaggtagtggtgaataggactctaggagagaaactaggtgttagggaatgatgtgtaatatggtgtggtagggtttctatattagataggagagcatgagaaattcaatttgaagaaatcatatttaagaagagaatacctgaaataaaaatggaactggccatgggaggttttgagagatcattcacaacatagagaacaacaagtacaaagtccatgagtcacgtgtactcgaggaacagcaagaaggccactgtgatttgacaagaaggtgtcctatgaagaaagaatgatgtcggttcaaagaaaaaagtagctactttctgaaaaaccacccagaatcacacctaacctcaaaagtggagtgaactaccagacaccaaggagttcatttgaaaatgaccaaataagggaagcaatgtgtagaaaagctgtggactcactcatttcaccgaggaataaaagaattaaccttcaaaatggggtgtcgttttcctattgtaatggaaaaataaatttaattcctgcttgtatctcacacgttttttttaaataaacaagttgcacatatttctgttataagctaaatttaaacttaactaagaaatgtaaaagtatatgagagcaaaattttacgcaaggtatgcagaaaccatgcctgatttgtatgcaggatccacagtcagtgtatttgtataagtttgtttgtctccatagttcacagcacaatcttaaaccacttcctttggtactaagaaggctgtttgatggtgactatgaaaatactagcacttagaaagaatcctaatgaaattaaagatgtggattttttaccatctcatatacaatagctacaaaaaaattaaaatacctagaaatacaacgaaccaaggaggtgaaagatctctacaaggagaactacgaaacactgttgaaagtaatcatggatgacacaaacaaatagaaaatactctatgttcattgattggaaaaatcaatatttttaaaatggccataatactcaaagtaatctacagatgcattgttattcctatcaaattaccaatataattcttcatagaattaggaatagctattataaaattcctatagaatcaaaaaagagcctgaattaccaaggcaatcctaagcaaaaagatcaaaaccagatatatgatattatctgacttcaaactatactataaatgtacagtaaccaaaacagcacggtactgggacaaaaacagacacatagaccaatggaacagaatagactgcccaaaaataaagctgcacacctagagccatctgatcttcaaaaaagttgtcaaaaacaagtaaagtgggaaaaaactctattcaatagatggtgctgggataactggctagccatatgcagaatgaaactggatctctcctttcaccatatataataactaactcaagatggattaaagatttaaatgtaagacttcaaactttaaaaacccttgaagaaaacctaggaaacaccattttgcacattggcttttgcaaaaacttcatgactattcctcaaaagcaattgcaataaaaacaaaaatagacaagtgggacctaaactaaagagcttctgcacagtaaaagaaattatcaacagaataaatagacaacctacagagtgggagaaaatactgaaaactgtgcacacaacaaaggtctgatatccagaatctataaggaatgtaaacagttcaataaacaaaacatatataaccctattaaaaatgagaaaaagacatggacacttcttggaagaagatatacaaacagccaacaaatatatgaaaaaataatcaacatcactatcagagaaatgcaaatcaaaactacaatgagataccatttccctccaatcaaaatggctagttattaaaatgtcaaaaaacaacatatactggtaaggctgtggagggaaaggaacactgttggtgggaatgtaaattagttcagcccctgtgaaaagcagtttggagatttctcaaggagtttgaaaaggaattaccattcaacccagcaatcctattacttggtatatatccatgcagatgtatgttcattgttatatattcatgcacatgtatgttcattgtagcactattcacaatagcaaagatgtggaatcaatctaggtgcctataaatggtagtttcaataaagaaaatgtgatacatataaaccatggaatactatgcagccataaaaacatgaaatcatgtcttttacagcaacatggatgcagctggaggccattatcctaagtgaattaaagcaggaacagaaaaccaaataccacatgttctcccttacaagtgggagctaaacattgggtacacacgtgacatggtttggctgtgtccccacctaaatctcatcttgaattcccatgtgttgtgggagggacccaatgggaggtaattgaatcatggggggcaagtctttcccatgctgttcttgtgatatttactaagtcccatgagatctgatggttttcaaaagaggagttcccctgaacaatcgctctctattcctgctgccatccacgcaagacatgacttgtttctccttgccttcaccattattttgaggcctccccagccacattgtgagttctccattaaacctctttttctgtataaattaaccagttttgggtatatctttatcagcagtgtgaaaacagactaatacaacatgaacataaagatgagaacaattaacactggggactattagagtggggagaaaaaagaggggcaaaggctgaacaactacctattgaattctatgctcactacctgggtgacaggatcgtttgcatctcaaatctcagtgtcacagaatgtacccatgtaacaaacctgcatatgtacctcctggttctaaaataaaagtcacaattataaacaaacaatgttttatatatttatataatatctatatatatgtgaaatacatatttcatatattagaatatatatattatataacacacacatatatgcacacacatacagctcatgggcaattatttctccaatgaattaaattcaaaaagcacaggtttttctcaacgtaagtgaaattttgacctagttgtgcttggatgcatcagcctggacagcaggaggtatgttataaccttaacatttatcattgttacacaggagttacaggttaaaagataccacggtcaaaactagatttgtgtcatttctgaaatcaatatatcactgacacaaaatcacagtccataacattaccttaggctcatagtggttcacaatgatatacttgaaaatctcatttcaggaacagagaagcctgggtctgtcatgccaaggtaacaaactaaaatttatcttttaaccaacgtaataaaatatcttcattttaatttggaaaattaaaatattaaataattacaggagtaattttatactaaaacaaatataattgggcaacaaaaaaaaactggataatattaacattggggtaaatgttataacttttccttttcggtgagattaacaacattgtgtagactgacttcatgagaagctctgtagaaagttggaaagagaaggtgaactgagatgtaaataaaatattttacatgtactatgaattacatatatatttatttattatatggtctcattattcttcatactaactgatatggtttgactgtgtccccgcccagctctcaattgaattgtatctcccagaattcccgtgtgttgtgggagggacccaggggggaggtaattgaattttgggggccggtctttcccatgctattcttgtgatagtgaataagtcccttgagatctgatgggtttatcaggggtttccacttttgcctcttcctcatttttctcttgctgccaccatgtaagaagtgccttttgcctctcgccatgattctgaggcctccccagccatgtggaactgtaagtccaattaaatctcttttgctttccagtctcaggtaggtctttgtcagcagcatgaatgcggactaatacacttacactgcatgttcaggaacggtcagcatgtacatggagtgaggatatttatctatttcttggacaggttaactaattacatagtaaacttgcacacccaccacaaataaacataataattataaagctctgggtactctaccactttacatgactatatttttgatcacttatgttatttaataattaattcaacacgatgtttagcacctactacttaagaaacactagtgtcacacgggattaaataaatgatccctgtccgtccttgagggagctcacagactttgtgcgtgtgtgtatgtgtgtgcatgtgtatagaattgcagaaggctgggatgggcaattatagtacaatatggtaatgcctatgataattgcgtacacagagctctataggcacagaaggaaatctgtgtaacaacactctgagatgaggaaggattttcagaaagaagtttattctaaatttagttagagaaacaggattcttctagaaaaaaataggaatgatctgggggttgtgagaaattttagaactgtgataaagacgagtgtatttaaaatcagttaagtaatttgtgatcagtgtgttaaatttggtatgtatcttactgttcagtttacaaccttatgtcagaatggttctttctttattatcaatattttcattgcccaaaacacaataaattaataagttctaagaagtaacatttggacatagtttcaggcaaagacacaccaccaattaagataagtttctaattagaaatatcatatagaacatgtttgaattatgtatcattctgttcccacaaccctaaacatgtatacaccaagtaaaaatgttgaagagttattgtcttccacacctccattttttaatatgcatgatttccacatttccaaggattctagtcttttatcattgtggtgtcctaaagttaggtgtgataactttatgtttaagagaagtttaggtgctagatagctatgagctaccccactactccccaaaacagaaaaaaaatctagtgaagaaataatgcagaaagaggaaaaatcttccaaagaatgattcccttctactccattctaccaaataccaccctcttccttctatggtgagtgacacaaatcttcattgcattacacttagtgtataatccatatttatttatttataaggtgttattcagttgatacattgttttggtgaagcttatttagttgttttaggttaggatagacataatttttctcataagagttactgaaatagtctttgacttcatgaattctaattttgggtctggattatttgggatgagtaagaataataacattattattattatgggatagatgtgtactagttaaacatgactttattaaaattactaggatccttgcattaaattttcagtgacaatgaataaaacatctttcatttggtttttggctctgtgtatgtatgtgtgtgtgtgcgcttgtgtgtgtgtgtttgtgttttctggtaaatgcctttttatgtttttcaccctttttctggtggcagaggttcaaggaaaggtgttcgtcattataaattttgattgcattctaggatgtaaaaaattatttctatgtaagttgcagctggttattttcccttttaatttgcttatgttgattttgccataaatatatcaatattttttttgagatggagtctcgctctatcaaccaggctggagtgcagtgctgtgatttaagctcactgcaaccttcacctcctgggttcaagcaattctcctcccccagcttcccgagtagttgggagtgtgccaccactccaagctaatttttgtattttttgtagggatgcggtttcacctgttggccaggctggcctcgaactcctgacctcaagtgatcagcccacctcagcctcccaaagtgctgggattacaagcatgggccatcatgcccggccagatattacatttttttgtttataagtctcatcatatatttagaaaaaaattcacagctataaaacttttaaaatgtggataatgttttcattcagtttgttgttgttgttgatgatgattaatgtagtttaggtgtttcagccttgtgggcttgctactatctcaatgctcccattaatcaacacattgtaaaagttactaacagagttcacaaaatggaggcctttcccatggggaatttctcttcatagtaaggaagaaagaaaatctacatttgctacaagtagatatataaaagaaagtgaggaaagagctgagacaattctatacatatctcccactgtttgagtcattctagtctactcttgaattattccaactctatgaaaaggggctcagcattcctccctcaacaaactatgagaactaataaaaattagaagtggattgaattatataaatataatgtgtttggcatcaataaagcaaaacatattcctaagtgacagtatttgtcaactttaaatttctcttatttctatttttattcaagaaaatacattatttttaatcagtatgtaggatcaatttcaaagattaaaaactttaatcattctctagacagcttttattttaacaaattttataattgaaataatttggttgaaatatagttttcttaaaaagaatgaaaattcaaaaactaaagtccttaagagtacattcctaaatctgtgggttttttggtcagttttttaacttaattgataatatgtctttcaactgttgagtggcttttaaactacaattttatatttagaataaaaaacactttttatacaaggaatatatctaccaagtaaaagatataaaggctgtccagaatttctcttcactaaaataatatagaaaatgtatgttttgatatttactaaaaaactattgtgcaattttaaggttcattttctgtttatttttatttttatttttaatgatgtatatttgcttcaatcctgaaggaagtttgtacaactaagtttttctctaccttgggatctaaatgttgctgctccttcggcaatagcactttgatgtttatcaaagcctactagttgagaaacacgaagcgaaaatgcagaaatggctgccttcaaactatttatatttaaatatgtttcagacatatgggaaaaatattttcactataaacaaatacatttcacaaaggacattttttatgtttgatgaggacttaaatggagattttggtcatgtgtacctagttatatacactaaaaaaaatgcatttaattgttttgtaaattctaagctacctattggatcagacaactttatcaaaacattagtaaatcattcacaaaacttaaaacaataaccccagttgatatagtttggctctgtgtccccaaccaaatctcatctagaaatttaatccccataatccccacatcgagggagggacctagtagaggtgattggatcatggaggcagtttccccatgccggtcttgtgatagtgagtgagttctcatgagatctgatgattttgtaagtgttttacagttcctcttttacatgcgttctaactcctgtccccatgtaagatgtgcctgttttctcttgagccatgattgtgagtttcctgaggcctcctcagccatgtggaactgcaagtcagttaaaccttttttctttatgaagtacccagtttcaggcagttctttatagcagtgtgagaaccaactaatacactggtaattggaaagagaaattaatttttcacctttatatccctagttcctcacacagaatttggttgatagtacacatttaatacattttaaataaattatgtataagttcatcttctttataacagtgtaaaaattgcttatgacaaattggtggctttggtttttaaaataagcaaactggtttttgctaatgctggcttttggcttttaaaatgtgtaatctagccaggcacagtggctcgtttttgcaatcccagcacttttggaggccaagggaggaggatcacttgaggccaggagttcaagaccagcctgagtaacataaccagacccagttgctaccaaaagaaacaaacaaataattagtcggtatggtggcacatgcctgtattcctgggtactcagaaggctgagatgggaggtttgcttgagtccaggatttcaaggctgcagtgagctattgtgttagtccagtctcaggctgctataaagaaatacgtgagattgggtaatttacaaagaaaagaagtttaattgactcatatttctgcatggctaggaaggcctcaggaaacttacaatcatggtggatggtgaaggggaagaaaggcaaccttcttcacagggcatcaggaaggagaagtacagagcaaaggagggaaagcttctcataaaaccatcagatcttgtgagaactcattcactatcgcaagaacagcatggggataactgcccccatgattcaattacctcccaccaggtccctctcacgatatgtggggattatgggacctacaattcaagatgagagttgggtgggaacacagccaaaccatatcagctataatcacaccactacactctggcgtaggtgacagaatgagaccctgtttctctcttttttttaagtgtgatctatagacaaatatttatttatgacttttataaaagaacttttccaaatacttgtggtataaatatttgctttagtagtctgtaaatagtaattttagcagtaataggaacagctcactgtcagctgaaacacaatcattactgacacaataggagtactggaggaaaagcaaacaccctataaccttacccattcctataagtcctctctcttcactataaatgtgacacactgatgaaaagaatgactatttgaatgaactgtgcatgatcaggataagtcagctgattatttcaaatccttgagttgttacatttttaaatatattttgaatcctctataaatataaagtgtgcattccaattttgtacgatgttattcaaagtgctgcactcaagaaaaaaatgaatcttgatttttctaagcaaagctttacagctcctaaccgtggcaagaagcttggtcaaatctaatctcattaatcatcccaaagattaaatatttttgcatggtctagaattgatacacattttcagtttcaaaaacaggaattgaaattggaaagtgcctggggcacaggataagtataatttatatgactgtgatgaggcttttgccgatgccccttttcttcttctttctgtctatttcatttctttggctctgcagttactaagccaacaacccccaagtctcctcccaccacaggactcttatttctcatttctccccttgcactgacctatcttcctgcattttagttccaacctagaactgaaaagctttgttagctgttattctcagcagtaatgggcagctttcctttggaagtaagtgactgcaattgccccctaataggttctgtactctttagtccagagtaactgaatctattaatttcccctgcttcttcggccagaatgcacttcccatgaaaggatggtgaggggagggatccaagcttctagggatactattgaatagcagacaagggattggaggaaatggtaaagataatttttcaagaaaattgttagaaaagaaattggtactcaagaccttgggagtccacctctttcaatagtgtgtcctgggtgtgagacatgcaaagaagatcactttggaactttaagatttaatgactgactttcttggtttccagcttacatggggactgtggcccctttgtttggccaatttctcccatttggaatgggaacattccccattacccaatgtctgtaccccacattgtattgttgaattaactaacttgtttttgatattacaggctcataggcagaagggactcaccttgtctcaaatgagactttggacttggacttttgggttaatgctgcaatgagttaagaccttgggggactgttgggaagacatgattggctttgaaatgtgaaaagaacatgagatttgggagggaacaggtgaagaataatatggtttggctctgtgttcccacccaaatatcatcgtgaattgtaatccccaggtgcccaaggtaggacccggtgggaagtgactggatcatgggggtggtttcccccgtgctgttctcatgatagtgaaagagttctcatgagatctgatggtttaaaagtagcagtttccccagcgttctctctctcctgctgccctgtgaagagggtacttgcttctcttttgctttccgtcataattgtaagtttcctgaggccttcccagccatgcaaaactgtgagtcaattaaacctcttttatttataaactacccagtcttaggtaatatctttacagaagtgtgaaaacagactaatagaataggtttctttgatccttgagattcttatctatgacctaggttaactattcattgacaatcataaatttgacttcagtttgatgatatcctccaagaaatttttgaaaaaggattatcatttgtctgcttgtttcttacctgcttttaattacatatcgtatgtggaaaccatgcacaggatttggtggagcagcatacctagaacatgcattagagggcatatgtcaagtcttcacaatgaaacaaacaaatcaatgatggaatattcattcacatacattaaataaaaactttcatttacttctaaatacttcctgctagcaacattcacttacatttaaaaagtattatatctggatctcctcatttttcaaggatgaaataaaagcaaagggatgtagatctaggtgccattttattgctttatataaattaaggaatgctgtgtggctaattcataatacaatgcaaagaataaattttggtaatttcaatatcatatgaaaatgactaggttttgcttttaggacctaggctcaaaactgaagccacattttggatctttttaatgttgtaacatatttataaatatgcacgtgccactttaaatgttgtatcagtagtaatgttcataaaataccatggaaaagatccactttgtttataaatacatgagacacactatcccagtgaattgcatcctgaggtaaaggcaaagctgtgagatgaatggtaatgagttcagctcagttccctcgacctttgcttagtttcacggctcacactggctttaataaacccggtagaaaatggagttagaatagactttgttaaaatcagataacttactgaaaattagttttctcaggtaggtgagttaaaaataatattatgaataaaggctttctagagttatacaactggcaactcacaacttcagggagtaaagtcagatgatttcattgcagaattatttgagaaaattttaagctcaaaatgattgtaacatatgatgctgttggacttgtgattagtttaatattagatatttaaacaaatgtgcccaatctgctaaacaaaagaagtagccagggtgaccagtcctagcccaaatgtaagacattttcaaattgtatatggggctgtgaaataatatgaagcaaatgacttcttaagtaccacaatttgacaatgagttggggctcaaagcgtcatgggagtaagcaagatatgtgcccacaatgagacctgaatcattttattattttatagcgattctcctccctgctttttttcccatcagaacaaggcaagtttgctcctgataaatctctccaaatgattttaaaatcagaaatatatatttatgcctcactcactggaagagtgtctctcatattttttgtgttggtctgagggcagtcctgattatttttctctatatatttatataaagaattaaacatttgtatttatatgtattaatcttactgtgtcatacattgccactatatataaaggttttcagcctaccattttttcataaaatataccatctagtttttgtaaaattttctcaaagactgatatgctttcctttttcatcttcctgtacaaataatgttatatcactagcagatttacagctatgatttagttacaatgtatagacttctttctaaagtttagtattcttgatagagtaaacctctgtcctgactccacaacttgaatttttagtttcttgctatactttgctactttctagttcacacttaacactctttcaccttccccttaactttctctactttatatatttcctaccttggacaatgactcatcttctgcactactttttccttcttcctcacccacccatccagattaaattggtcaccactaactgctactactttttccttcctaaattgttctcaaagtcctactaaaattgttctagttaaaacgatcatggcttgttacttggatggcaaactcatcaatctaccagttcatcctacttccctctacttgcttcttcttactagacccaatacagcctggtcccgttataaactccattattgtattttcctgcttgcaaaaagagtatgttttctatcccagagacattggcaggcagctattcctaattaaatttctgaaacgctgttttgaaatattaattgtaaagtataccttttatgtatggcaagtgataatgaggtttacattcacagtactgttgtagctattttaaaatttttccttatataagtttaaataaacttaaaacatttcaagtgaatagtaatatagtcacttgaaatacatctattaagcttgagaatcattgtctaatgggataaatttaatgatccttggcatagtgaagatagcttttaatatttgatttttgtgtacggcccctaacaaatcgaaggaaggaggttatgatgccttcttctgacggacacatctcctgtgtacatgcacgtgctcacagaggcacaccgattctcctcttacctttcctgatgctcgcccactctgagtctgtgatcaagtaaccttttttcttgcttcagggatgacttcttactttgtgaaatttttaatctcaagagtcattcagtgttattgcccctgattataaatttgattaatcttttacattgttatttattaagcagaagaccagtatgataagttgtgtacattcttgattctgatgtaaatcaatgttattaaaatttaattctgtgaaatctgaatgttctaccacctctggtaatgtctacctaatatttttctgacatttagattaactgaatttctgagaaaataattcttacccaattattacctattttctgttatgttttgttgttggtggttttttgttttatttatttatttgagacaaggtctcactctgtcatccattcttgaatgcagtggtgcaatcacagctcattgcagccttgcctcccaggttcaattgatcctctcacctcagcctccaagtagctgagactacaggcacatgtcactacacctggctaatttttgcaccttttgtagagatggggtttcgccatgttgccaaggctggttttgaactcctgaccccaagaaatctactcgtctcagcctcccaaagttctgggattacagttgtatgccaccatgcccagccttatttcctgttaatagctatttcttgaggaacccttacacactgttttagggggtgtaaattagttcaatcattggaaaagacgtggcaattcttcaaagatctaaagacagaaatatcatttgactcagcaatccctttactgggtatataaccaaagaaatataaattgttttatcacaaagaaacatacacatgtatgttcattggagcattattcacaatagcaaagacaaagactcaacttaaatgcctatcaatggaagactggataaagaaaatgtggcacgtatacaccatggaatactatacagccataaaaaagaatgatataatgtcctttgcaagaacatggatggagctggaggacatgatccttagcaaactaatgcaggaacagaaaaacaaatttttcatgttctcacttataagtgggagccaagtgatgagaacacatgggcacatagaggggaataacatataatagggccatttttgcagttgtgaatgtagacatactgtgtggggaagaagctaacacagaagacctgaagtggctactttcaaaagttccctttgtggggttggcccttggatagcagcctagaacttggctgtttttcacaagctgggctgctgaacacctcttttccttcctgaagtctgaaattccagtagttgtggctggtttttgcttctatgtgactgacttctaataaaaaccttggactcagacactcccaggcttttctgggtagaaacatggcacatgtgttattgtatagtgatgctaaaggaagaacctcatgatgtgtgacatcttcatttgtgtaatggggaagggggttgaggagaatagaggaagtctatgcctacattctttttttttcttttttctttctgtttttttttctttttgagatggtgtttcactcttattgcccaagtaggagtgtaatggcgtgatctcagcccactgcaacctccgccttctgggttcaagcaattcttctgcctcagcctcccaagtagctgggactacagatgcatgccaccacatctggctaattttttgtgtttttaatagaaacggggtttcaccatgttggccaggctggtctcgaactcctgacctcagatgatctgcccgcctcagcaaaaattcagccctcacacctttttgattaattaatttattaattttgactgtgagctatattttattaatactaagctatactcaattctttgagtactgtgggtcctccagcaattcactgaactcgtgcatgttcttaggacctctaaaacacacacacaccacacacacacacacacacaccccacagccaattcttatcttgattacttgcaaacaagaagatatttcctattctgttctctcctcttttattttcttccatttcattccactttcttctataacattctgtcctaattaattcccttttaattaagtccatacttaaactaaaggcacacttgtatcccactatgcaatttcatgatgcacttaatgtgactctattccaattagcctaccaagaagtcatcctaatttttctacctgatattggtcacatcatctgcagaaaagcacacagaatctttcccttttatgaatttttgtgctaatcagtgccaaaaaagacatggtgttaatgtattagtgattcattgctatacaatggatgactccgaaacttattggcttaaatattataaataatgttttaaaatatttatttttaataatgttttatttttaatagttttatttttaataaaataatgtttaaacatgtttattatttcatactttctaagggcgcctttggctcaggatctctcactgggctgcaatcatggtagtagctctcgctacaaacattttaaggttcaactgggaaattggcttatacatgcacatacggctgttagcaggtcctcactcgctggtttccagagtcatcagtctttgtcttaggccagttcgaaacatggcagctggcttccctcagtggggaagaaagcaaaagaaggcaagagagagaaaaaccaggtttttcttgtcatctaatcttagagatgacataccaacacttttgctgtattttgtatattagaaatgagtcagtaagttcagccacactcaagggatgagtgtcacacaagagaatgaataataggaagctaagtatttaatgccaactcagtgtgtgcctctcataactaggaagaaatgaaacaaatatgaggaagctaaaataattataaaatgttgacaggacatggtcatttctctcctgtattttattttcttttcataaatattatttgtgagtctcatctgcagtagtccttatttaaaaggctgactggtgactgactgtaacagttgtttattcttaaaagcagttgttaccttctaagtttattttaatgtgctataaatttatcctttattttatgctgtaattattttacttttgttacacaaaggcagatttatatgcacctttatttgctacatctttgtttgcttggatgagggtaagggtaaggggtaaggagagaaagacgaaggaaaagaggtgaaatcgaagaaaaaagattatcattattataattaaaatgcattgaatactcactatatgtcattccaataattctttataatataaaaatttatcataatatataaatatatgtggcatttcaagtactcttgatatatatgaaatatatattataatatataatacatgaaatatattaataaatacaatatgtaactgtaatataatgttcatgtgtaaatttataatataaaatatgatataacatttaattatgaaactataattatatatcattttatatatgtatagttatgtatttatataaaatatgttataatgtatatattttttcttttgaagaaggtaataatatttccatgctaaaataaggaacctgaagatggatgtggtgcagttcactctatcagaactcgaattttcactcaaagagtctagttgctgagtccacatttttcagtccatgatgtcttcgtatgtggatttgaacacagaatcatgcatataccatatttaaaactcaaatgatgcatatttcaaaaaaactttaaattagaaactacatcttgcgtgtgtatgtcaggaaatcaataagtattagtcaaatgaataaaggaatatcatagtttattttgagttttcttgaaattggcctaaaataaaaatataggttacaaagtagatagttgctttgtatatgtgagaaagaaaataaaaggaaaaaagagaaaaaaggaacaaatgttaaaaaaggaaaaaacaaaattttagagaattttagttttaacttgatattgtaattaatgtgtcaagatggatttttccaccaatagtatgtcacatattataagcagttaaagcacagcccagtgaaatgtttgaagttctggaattaaagtgacataataaagaacaaaaaaattgtaatatagagtatgatataattgcacatacccaaggaaaacaagatttgtaaaaacaaattaatcatgttcagcgtttaaaaatgtagcaatatataataaaacttattataagcatacagatgttaatgcgaatatttccatttggttaaaagagataaatttatagttatttcactaaagtctgcagggttctggaacaaaggaacttattgaatttaatatatttctcataaaagtgtctcacaagtattaatttcatgcttgacacaacttttcataggctttgtgattttatatctctgatttacaacaggctaggtttcctggttgataaattctcaaattaccaaaattttaaaactgaaaggagatttcttttttaaatataacaaggaagtttggttggttcagtatgaaatatgaactttgaagtgagttcattttaccaatgatgatgtaactataaatagttatatatttatttgtaagaataaaatataaattaaatataaaacagttttcttaagttactttttctgtccttttagtggcttcatttaaattacagtaaaatctcagacacaaaattatcaaggatttaggaataaagggataaaaatgacataaaagaaatatttttagaagaataggagtttctaaacttttagtaaacaggtaacatacagaatcagcctgcttttaagtcaagtgatgatgtggctcatgagaaaagtacatcttccgaaagaacttatattacaaataattctaaaactgttgtaaagtgattggtcagtttattgcaaagaatgaacaaaacgtgttttgttggacaggtggcatctagaagagaatagattttcatttaaaaagaaataacagaggggaaaaaaatgccaagttaaggtggcctagtgatagcaattatcaaaactaataatagcatcaatgagggttaagataaattaacttttcttaacatttgagaagaaagctagtacaaatcaacagttctcacaattctcaaagggtcttgtatttgccagactataaatagattagcccaaagccttacacttctaaaaagttcagtccttacaagttagaaggatacctagcaaaatgatcaatgtaactttcatcttatccgttggcttcatataatccctttgacacatgtggaataaaaatgaatccctcttctgtttggaaatctttcaaatatttgaagaaatctatattgagaaaatattacagatatattattatttatttatactatatatatactttttcataatattagccagatgtttgtggttgggaagtttgcaagaccaaagcaaatgtacccaaacatattttgtttcttgtgttttgtgaatacctaaattgatggagctgttacgtaaatatcagagactacatcccactgcttggtggcaaggattattgggattgagcaagaagggagtcatagactcatggcatcgtggttggcacagaacagtcatttatcttaggaatcaaaccactttctattgaaaagacacctatggcaaccataatggactaaacatgaaggacctttcaatcttcgatggtaccaagtaagcatcccaaattcttatatgaccttgtggaggccggagtcccagttaggcccaagattatacaggctgatggctgtatgtctgaattaattttagtcaaagaatataaagaacacaaagaacgtaacaaagagagtagcctctttgcacacttaatgtggaaacaatatatatcaattacatagcagttaaattctccggaagtttgttttctcaaaactctaaactccatttgaatcttcttgcccactagtcttcaaagcaggaagggtataagagcagaaatctagtgccagaagaaaaatagattgtaagcctgccaccaattaaaagattcttcacccacgtctaagttttcgcagatataaaacaaaagagtaatgatataaggcacaatttggagcacaaccatgaagtatctacaaataaagaacagaataaaagggaaataacactgccacctgataattcaatctatatttaatgccttaaaaaagaaatatgcgattccctttaatgtagaaagacattgttcaggctgatgagactatatggaacttaagtttgtcaattcttggactcttcattttgttccatagtaactgtattagtctgttctcacactgctataaagacatacctgagattgggtaattcataaagaaaaaggatttaattgaatcacagttctaaatgactggggaggcctcaggaaatttacaatcattgcaaaggtgaaggggaagcaaggcatgtcttacatgacaccaggcaagagagtaagtgaagaatgccagacactggaaaaccatcaaatctcatgagaacttactcactatcacaagaatagcaagggggaaatccgcctctgtgatccaatcacctcccacaaggcccctcccttgacatgttgggattacaattcaagatgagatttgggtgggcacacagagtcaaaccatatcagtaacatttctaaaattaacatacgtcttctctaattagtgaagtgtcagagttaactggagacatttcttattttagtcacataaacaatggtaatgcctttataagcacttttttgcagaaaggatatcatgaactagggcttttttttttttttttttgagatggagttttcactcttgtcacctgggctggagtgcagtcgcataatctcggctcactgtgacctccgcctcctgggttcaggcgattctcctgcctcagctgcccaagtagctgggattacaggtgcccgccatcacgccccactaatttttctatttttagtagagacagggtttcaccatgttggctgggctggtctcaaactcctgacctcaggtgatctgcctccgtcggcctcccaaagtgctgggactgcaggcgtgagccaccacgcccggcctgagctcccttttgattgcaatttggcttactgcatattactttgacagtggtaagataggttagcagaaaacagaaatgtctaacttcttatcagttttagtttttgttgcagtttgttttccaactcactattattaagatgtgtcatgccttcctgctttttggcatacacgtatatggtggtcatcactatgttataattgtaaagttacaactcaaaatccagctttacaaagccagataaaatctgggtaaaaattgggtaaagtctggctttgtaaatttggtgaatttgagtcggttctgaggaatgtgttcatttctgttgggttgatcaaatacaatctctgaccaagtgtggtcaggaaacgggagttgggtcatcagtgtaattttaccagcacaggctctggcacaattacactggatatctctcctggtgtcattcatagatatttcatcaccatcacctatcagattttatatatttatttagataaaggaaataatgtgcataaagcagttataaagtgtgaggtacctcctaggtcctcaagaacagtgattttcactttccaggttgtcattctctaaatttattcttatttgaccatgcaccccaaggtatggtacccagaaatgacaagacacttaggtgcctggcaatcacttcttcaatctagttactatatttccgttcatgaaatatatgatcccattagtttggttggagctacattacactattgattcatactgatttcactgccagggaaaacctgcaatctctccaacacacgctattcctaagtgatccaatctttcagagagttgtctttttagatttggggtcaaaaccttacatttatcagttttaaaagcttcttactggttttggcccttcactctttgttgtccaaatattatagattatttttctgctatacaaattatatactgtgccttcctgctttttggcatacacatatgtggtgattataactactttatagttttcaagttaccactttaactagttataactacagtgcacatgaatgaatttatgttctaaaggaatgtgctagaaccctcttaggctgacaccattgtatactgtctcttacgtggttttgaatccatacattttatcataaacttctacaattatatgtcttagtcaccaggagcttatgaataatgctttcatgaaaagcaacctactacatttatttgacctatttgtctaacattcttatttagcaagaggataagctgctatgatatagtcttaaaaatgtttgcataagtctcaggaacatcataaagcctgatctcatcatgtgcccgcactctttaactgttttttttttttcaatcccatttatggaaccaccatcagaaaaaaagtgtaaaaattacagaaattcctcctcaattcacaggcagtacatcctggcaataagtcttcttcacaatttgttatgcttcttaactactcctttctcattactattattgcattgatattagcaatctgcatgtcctataagaatcatcacaagttttctagctaatcttcatacctcctatgttgcatcatataaatactagctctacagtgtcactggaaggaatatgctgaaacactcagtctcactttccctagttgccttctacctctcaaaccccccacatctggcttgccatgatcaccaatattccaaaatgacaacggtactgaaaagctcatatgtcccagaaataaccacacggtttatgcattcatgttttccatttgccactccttccacctggaagggctgccttctccatctaatcagacttcagctcattcagaatcaattggacaaacagacaaggaggtggatgaccagttttgttagcagtgaaggaatatttgagtactagaaaagagtccactggattttgaatgcctgccatactcacagctccatcagaacaaaatagccaatataattctgcacactggttaatgtgctttgtgtcatgtgacctgccaactctgactacaacttaactggagcggagtctgggtccacagtcaaatatgtcatctgtacgatgatctgcttacctatgacatgagaaagctgttcagtaatgagaccagcaaggccagtcagattatctgttattttatttcgttttaaatgcaatattcacagaaaaggaccaagatttagagagaatagaaaaaaatagatacagaaaaacacaaacaaaggaatagtagactgaataatgccccaccctctccaatatacaaatgcagaggtgtccatgtcctaatccctgaaacctgtgaatatattatcttacatagcaaaagggattttgcagatgtgattaaagtaaggtactagcagtggagagatcaccctggattatcctagtggactccatggaatcacaagtgttctaataaaagaaagacaacagattcaaagtaagagaggaactatgagcatggaagcagagatggagatgatgttttgatgttatatatatacatatgtcatatatatatatatgtcaatatctgacttaattcatgtaacaatttggtgccaaaaaatgaaggtaatttcataaactcagaatttttttaaatgcatgtccatgttattgtatgattttgtatcacaccagttcaaacacctttctttacagttattcaaacaaggctcttttggaattatttcagtcatccctaatatgtcacctgccaaagaccttgaagctaaacaaacaaaaagacaaaatttcaaatgactaacttttagatgaattgagtaagaaatagtcattgtcaagagatgacgatgggagtgttaatctccagtaagatgttttgtcgaaatggttcttctcatatagcattcagaagtcagaaacttcaaaaataagggcagaacaagtgtacaatgaaagaaccttcttcagcttaagcctcccatagtcctaaacctgacataaggaaggcaaagcatctttcctgtaaattgaacagatctccagtatttctatctaattgagctttcagagattagattcctaatatatctcatgtatgtgtgtatatacacatatatatacacacttatatacatacatataatatatacacatacacatatataatatatacatatatattatacacacacacacacaaacacacatctcatcttggctctgcttgcattaattatggctgaagagttgaatacacatacaagtccaaaggtggaagcatacatacactgtatggtaactagcaagagcagactataaaagcaaaggctagtgagatcaacatttttagattccatatatggaatcatgtgtggaaatgagaaattatgataccaaaattggtatcaaaatagtagagtgagaagtgtgaattatctgaggaagtcagaactagattgtacattataaagtgagactgaggaccacctgtggaatttatttgaggaaatggataaggataacatataagtgttaagttagagccttctgtgcttagctagcttcatttaatataatgtcctctaggtttgtccatgttgtaaaaaattacatgagtttgttttttatggctaaacactattccattgtgtatatgaaccatattttttaaatctattcacttattgatggacaaaggttgattccacatcttggctattgtgaaaggtgttgcaataatatacaagtgctgatatctctttcgaataccgatttcattttctttggatatataccccattatgagattgctggaccatatggtagttctatttttaattttttgaggaacttccatactcttgtccataatggctttactaatttacattcccaccaacagtgcatgaattttgtttcttcatgtccttgacaacatttatcttgtctttttcataatatccattctaattggagtaaggtggtattttattgtggttttgatttgcatttcagttattagtaggatgctgaacatttttttcatattcctgttggccatttatatgtcttctgttgaaaaacttctgttcagattttttatctttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcttgacctcgtgatccgcccgcctcggcctcccaaagtgctgggattacaggcgtgagccaccgcgcccggcccagattttttatcttaaatactttgttcttcttcatgatttaatctcacataaaatagtaaggaattatatcataggaggaaaagcaagtttcataaaataatactatgatttaaaactgactctgtgtctaatctcacaacacattgcaaagagttaataatgggtggtcttatccatgtcaaaaatagaaagcaagggaagcctaatgaaaaatcaggggactatttgctgtagactgaatgtttgtgtcacgctcaaattcctatgttgaaattctaaccctttagtattcggaggggggcatttgggaggtaaatagattatgagggtggagcccccatgaatgggatcagtgcctttataaaaaaaaaaaaaaaaaaaaaaagatccagagagctctcttgcacttgctgccatgtgaagacacagcgagaagacaaccatctatgaaccagggaacaggccctcatcagacaccagagctgacagcaccttggactgctcagcctccagaatggtgagaagtaaattagtcttgtttgtaagctctgtagtccatggcattctgttatagctgcctgaacagactaagaaactattaggtggtatcctggtggcagtaggtacttttcttcagtcaagaagcccttgttctgtactaagtggcttctgactctagtaactaataattgcataagtgaagttaaggacttagatatattataaataaaataaactcctaaaagcagaacaagaaacaagagtaaaaaacaatagatatttgtcagtaaccagtaaaagaagttgggaataaccatctatgtagaaataaaagattctcagcaatacgtataatcagaaaagttccctttgccttaactattagagaattttactattttacctcatttaaattgtaaatctcaagttttttatttgaatacaatttctattaagaaataaaaatatctgacttaagattttgaattccttactatttgtgtgacttttagaaaatgtgggtttatattctctcctgtataaaatgccaataacaatagccctgactcatagtgttgcttttgaggaataaataacctaatgcgttttggtacagtaccatagttactgttatttcagtgttatttcttgttgaacagtgaacattttctcaccagctttgttttgtcaggaagccttaggcaaacttatgacaaaagaaaagaaattttttcgccttcctactctcccttattttggctgtaacttaacacttatatattattcttatcccctgcctcaaataaatcccacaggttgtcctcagtctcactttataatgtactatctagttctgacttcttcaggtaattcaaacttctcaatctaccattttgatatcaatttgtctatcctgacttctcatttcctctgaggtttatgacctgataaccaatttgataaaatgtcattggtaaatataggctacttaacaaaaactataatagtttaaatacatgaacttaccggactgcttaaaattcaaatgtatacagacacatatcatatatattttttaaattttacaaacagtgcagttttttattagaaataaatttaacatgtaatatgttcattattgttatcctaaaatttatgataaatatgtattttttcattctaatttctaatatggtaaatatcaccagatatattaaacacagtcacacttatttttatcatatgagtttccaaatcataatcgtgataaaatatctgatactagccctaacctaacaaaatgaactcaaaagcattcatatataatctaatgaaagatatatttagaattttacaagattatgcattggtagttttatatattacaaatgaatattcttacttaataatggaaaccctttatcaagtaattataagtatagtatgttttctaaatattttgtttattttttagtaaaaaatgtcatgatgattaaaacaaactgtctccatcaggtatggtggctcatgtctgtaatcccagcactttgggaggtggaggtagccagattgctttgagcccaggagtttgagatcagcctggccagcatgacaagaaaccccatctatactaaaaatacaaaaactagctgggtgtggcagtgcatacctgtggtttcaggtacttgggaggctgaagtgggaggatggcttgagcctgggagaaagaggttgaaatgagcagagatcatgctattgcacaccggcctgggtgacagagccagacccagtctcaaacaaacaaacaaacaaacaaacaaaaccacaaaacagaaactgtctccatatgtggaataattgaatcagtaccttaggcatattttttcctctctgtgtagaaaataaatttctaaggagaacagtatttagcacttgctaaagaatttaggatatatttataatataaagcgtatatatcatggaaacagaattacagaaacattaaaaatcatacagtaatgaaatatgttctttcttaaactgaataggctagttcataggttggtgatgtaaataaattctacataatttgtaatttctatcttcataatacatagcccttttcagtattttattaaaaatgtgtgtttttattaacttgttagagttaatggattggaaactaatacaccaaagtgagcagagaagaataactcttaattttcagccagtgatgatatttcagtgagagaacttttatatgtgacactttttaaaaatacgtgtgctctttaattgacttattgcagtttgaagtaactattttattgaaatctccaaaaggcaattatatgtatttatcataaagtactcagtactccccacattcatttaatgaatacttattgaacactttgaacactcacgttaagaaatatacacgtatacctacatatatacctacaatatacacaatatattgatatttacaacctacaaaacaacacacaaacatattaataagcataatttttgctcttaaagttttactactggaaaattagtaaaaattatacaaactagaagattgcctcataataaataaatattttctgttagaaaatctgaatgtaaatggagttttcagaactaaaaatatttgaatggattttattttcagatacagcacatacaagggcattacgtgataaatgctaggaaagaggtctggggaaaatggtttagtagccactgaggaggtagtagttaattcaactgagagtattcaaggaataaacattgccagatgagctacagacatgttttgtaaactgacataaatactattatgaatgcaatttcaattttgacttgtatattttcctgttgtcactagtgtggggctattacagcagcatgaggaacaacaaccataataataacaaacataatgttgctcaaactaactggtttcttggttaaaggagtttttttcttactgcttataactagaatcagttgaagtaagatttctcctgttgatctccatagataatgtttttataatagatattttttagggtagttttaggttcacagcaaaattgagaagaacagagagttcttacatacccgtttacccactagtcctacacgtgtacagtttcctccattatcaacatccccaaaaagagtggtacatttgttacaattgatgaactgcattgacacaatcaatgtttatagtttaccattagggttcactcttggtgttttacattctatgagttttgataaatatttaacatgtatctacaatcatagtgtcatacaaaccattttcactgccctaaaaatcctctgtataccaccttttcatacctctctcctaattgctgctggcaaccactgaactttttattgtctctgaaattttgccttctccagaatgttatatattctaagtcatataatatgtcaattttttagattgtcttattttatgtagcactttacatttagggttcctccttgtcttttcacggctcgatagattatattttttagcattgaatactattccattgtctgattgtactatagtttatttatccattcatccactgaaggatgtcctggttgcttctaagcatccataattatgaatagagccgccataaaaaaccatgtgctgctcgttctgtgaacataagctttcatctcctttgcataaataccaagaattatgattggatcatatggtaagagtaagtttagttttttaaggaactaccgcattgtcttccaaagtggctataccatttcgcattacctccagcaatgaagattagttcctgagtcttcatacattagccagaatttggtggagccagtgttctagattttgctccttctaacaggtgtgcagtggttccatagacttttaattgaaaagaattcagtacatcagaaaattaggcttcgtaggtagctctgcaagccaaaggtgttactagcaatgcagccttcatcagctaagcaaaatgccagttttgggacgccttgaaagagattttgtatgagctattaagggcatcaacttttaaaaagaggttttttgcctttttaagtcagtgaatattttaccatcttagattgcttttcaattatctttcgtttcctccagctgacgaatttgtcttttaacatcctacaatgttgtcgatataatgcttctatttttaatcttaacaaacttaacatttcactttctgattaaagtttatatttacaattaccttcactctgcttatcatatatatatatatatatatatatatatatatatatatatatatatatacactttgtttaatagggagaacacataagattttaaatgttatatctgtcttcaaaaagatgggtgtttcaaacactaatggcaactttgtttctgtcctgtatttatttttctctggtatcactatagtgtttaaatgtgcatttactttaattcagtttgcttgggccattttaaaatcaacttctaaaaaattgttattcatttactctatccttacttcctccttttcgttttcttgacatttgtattctgaggtttctattaaatgtatgtggaccatctaataccatccttaatatcccttatactttccatgtcactcttactaaattgcattacatggtgattgcctaaaattgtttctcccaatttactgatgctctctttgtctatgtctaattttgctgctcaaacagaatattaaattcgtattttttttttttttttttttgagacggagtctccctctgtcgcccaggctggagtgcagtggcacgatccaggctcactgcaagctctgcctcctgggttcacgccattctcctgcctcagcctcccgagtagctgggactacaggcgcccgccaccacacccggctattttttgtatttttagtagagatggggtttcaccatgttagccaggatggtctccatctcctgaccttgtgatccgcccgcctcagcctcccaaagtgctgggattacaggcgtgagctaccgtgcctggcccagaatattaaattctaatttctaagagttagtaattgtttcaaattgctttatagtaataaataattagacttctgtttgttgggtcaagagccctcagtcaccataggatattgtctcctatcctcatttgcttgtcattttaaattgcgaggcagtatttagacagatgtattctgcggaaattcctatttgccaggtcgaggcttgtattttcagagtgtcttttttaatgcttataataagcatcccaggaataccatcagttctggattaactttttgttaatttcacccaagtggctaccagaccaggtaagtagtgtaaatgacaaccccaaacacacaataggcacaaagccatagtttttatatccttaagataagcattttatttttttctctaagcaatctgttgagagccgagtttggaaatatatacacgtttaaaaaatttatttctacttcctatttttgtttaatatggaagatgattcaagggtaaaccttcatattcagcttgaaattcatcataaagacccaaagtcttgcacttaagtgggcattaaagcccacttaaccaagcctctaggttacaaagatgaatatttcctctcagctcctcactaaaggaagcccaacatcaactttcccacttaccatcttgcatggcttttatcaatgggaacatatttgctctgtctcaaagtcttttctgaactgaaaacagtattttgtgtaaaaagactgcgtttataaaagtttataataggcattattttcgtgttagtcttccacatctccaaaaatagaggttataatttaatcaagaaacatttttgcaaattttacttttgtcaactgtgctggaagggcctactactataattaaaaatatgcatcatgaattcagtaaaatttctaaaaaagggacaagcaaggaatttcttctctttttattactgaaattaccccaaagtagagtggctgaaactacaaggattactgatagatataaaatcattccaaaagaaataaaaataccattatcctactcttaattcctacaatacacaagtcataaaaaatcagactccaagtttttggtgcttaactgttgggagcttttaagcctcctccctcccatattttgcttcttcctgacatctggtcaaacggataagaaagctatgatgttctctcgtttagcatcagctggaagttcaaataatacaaaaaaaatacttcaccttggccgcactttttcatatctatagaaaatttattctcctttccctactctctcaaaccttttggaagtgtttggaagccttcctgctctccccagaaagcctcgttatgtaagtgatgagcgttttcaaatcctttcgtgtgttttgtatggtatcgtgacatcaaaacccaatctggggtagaagtctatatagtttctgtggggtggctgcaaaacagcagaatatttatttggtaaaacacagtttataagatgtaaatgatttttagagcattatttcaattactatgagtctatgtttttacaaaaaaaaaatcaagagctactgtttaaaacatatttaaataaaaaatgaaagacccgcttgcatattttgcacaatgaagaaatgtattaaagaatagaaatattaaaaggtattttgttataattttgaagttcacatgacatttcaagtttttttttacataacaaaggtattttttgtctatagtatttggcggccactaaatgggaaacagaataatgatagtgaagacaaggaaatataatatgattttctctacctttgaatttggatatgtacactgttcctatgtttaatatgacttctctccacatatattaataatgttccaaagtttttatcttccctcaaacctatttctcttttgttgaggaaaggataaataaagctgttaattctgcctgtgagagagagaaggatgggggggagattttatggaattggcttatgtgaatgtgggggctgctaaatccaagatctgtagggcagtcaacaagctggaaaccaagaaaggaggtgacgctgcagtcgtgagtctgaaattcaatgaatcgatcaggctgaaacctctggcagcatttgatgcctcagccttgaggtagaccaccttctctgggaaacccatttttgctcttaaagcctttaaatgattggatgagggctacacacattatcaatggtaatcttctttacttaaagtcaactgattgtatatcttaaccataccagaccaacaaaatacctttgcagcaacacatgattaattattgattacacaatcagtaccattactagtacaacctagacaagttgacacataaaccatcacagatggactaagattaggtactacataattatgaaattgtacgtacactactttaagagccattgagttttaacttcttgagtaaagtaatgcaaagcaaagtaactgtggtttttatcttttccctttgtttttaaaatcttactgaactttaaaggtcacctagaaactgttaaatatatcaagtatgggcaagaatatgaagcagaagggatgctgtacactgctggtgggaatgtaaaatgctataatgattttggaaaacaatttaatattatctgacacatttgaaaatgtgcaaatccatgatatagcaattttcacctctagagaatccttgcatatatatactgttttatatcattatgttgggagacaaaaggaattacagcaaatataaatgaaaaaatagatatacttatataataaaatacttacatacttatgtaataaaatactatgcaatatgaagttgaatgttctatagtttcctgcattgatgtggctgaactccaccaccagattatttgcagaatgaacccatttaaacaaaatttcttcaaaattacacataagagtgaaataaatacctcaaggaattaaaaaaataagaataataattacatctaaaagagaggattataattcaattgagaaatagtatatagaaagtgtaaaatgtattgattttctatcttaaacctgagtttgagtatatgtttgcttaatttgtgatccttattatgtatattacatattattattatatccttttgggtaaagttaatatatttcataatagtaatcatcaaacatttagcatttaagtttattttacaaaagctttttctttcttttcatcattattctttaagttctggggtacatgtgcagaacgtgcaggtttgttacataggtatgcacgtgccatggtagtttgctgcaaccatcaacccatcatctacattaggtatttctcctaatgctatccctcccctagtcccccacccctcgacaggccccggtgtgtgatgttcccctccctgtgtccatgtgttctcattgatcaactcccatttatgagtgagaacatgcggtgtttggttttctgttcttgtgttagtttgctgagaatgatggtttccagcttcatctgtgtctctgcaaaggacatgaactcatcccgttttatggctgcatagtattccttgatgtatatatggcacattttctttatccagtctaccattgatgagcgtttgagttggttccaagtctttgctattgtgaatagtgccacaataaacatacgtgtgcatgtgtctttatagcagcatgatttataatcctttggatatatacccagtaatgggattgctgggtcaaatggtatttctggttctagatccttgaggaatcgccacactgtcttccacaatggttgaactgatttacactcccatcaacagtgtaaaagggttcctatttccccacatcatctccagtgtctgttgttttctgactttataatgattgccattctttttttttttttttttttgagatggagtctcgctctgtggcccaggctggagtgcagtggcgcaatctcggctcactgcaagctccgcctcccgggttcacgccattctcctgcctcagcctcccgagtagctgggactacaggcgcccgccatcacgcccggctaatgttttttgtatttttagtagagacggggtttcaccgtgttagccaggatggtctcgatctcctgacctcgtgatccgcccgcctcggcctcccaaagtgctgggattacaagcatgagccaccgcgcccggcctaatgattgccattctaactggtgtgagatgttatctcattgtggttttgatttgcatttctctaatgaccagtgatgatgagctttttttcatatgtttgttggctgcaaaaatgtcttattttgagaattgtgtgttcatatcctttgcctactttttgatggggttgtttttttcttgtaaatttgtttaagttatttgtagattctggatattagccctttgtcagatggatagattgcaaaaattttctcccattctgtaagttgcctagtaactctgatgatagtttcttttgctgtgcagaagctctttagtttaattagattccatttgtcaattttggcttttgttgtcattacttttggtgttttagtcatgaagtctttgcccatgcctatgtcctgaatggtattgcctagattttcttgtagggtttttatggttttaggctttttcaagatatgtaagatgctaaagtagattttgactgaaaagggctaaacaaaattatatagagcaacataattctaattaggttagatatttacataattgtggcatgcatatgggaataatattatagtcattatgttggaattttcagtgattatctttcaaggatatgatgatagatggcatttatatattttattttctgcaatttcagtttcttttgaatgcatccttgcacatattactgtttatacatttttagactattaatccgtatatcatacccaattaaatctcatatataagacataataatagagggagcttctttcataaactacatgtttaaatcttaatagactaaaagatactactccagtatacagttatgtgctgcttaatgacagagatatattctgagaaatgtatcattaggcaatttcatcatcatggaaatatcatagaatttacttatgtgaacttagatggtatagcccactacatacctaggctatgtgttacagcctattgctcctaggctacaaacctgtacagcatgttactgtactgaatactgcagacaatactgtaatacaatggtaagtacttgtgtatataaacatacctaaacatagaaaaggcacagcaaaataagattaaaaattgcacacctgtatagaacactcaccatgaatggagcttgcagttcctgaagttgctctgggtgtcaggaatgaatgataagtaaatgtgaaggcctgagacattactgtacatgatgtagactttataaacactgtacacttatgggacattcaatttgtaaacagaaacaaaaaaaattaaatgtataaaaaataaagtaattgtgctatgacatcactggattataggatttttcagcttcattataatcttatgggaccactgtcctatatgcggaccttgttgaccaaaatattgttatgccatgcatgactgcatttacatgaaatgattttcaaagaactgatttacataaaagactacatacaattctttagtgtggtctatattatgtgaggaatcaatttgaacattattagaattaattacactcatgctatctactctatatttttccccattcaaatacttaatactctaatgatcacaattagatcagtgaatgcagaggtgaacaatgctagagaccaaactgctttacaacctagcttgtgacatactataataaactcaaatcatgcttgatgaataagaaagatgagtgatacccttacagtcctttttcagagaaaattttaaatgcttactttgttagagatgaaaaaatagtcaaatgagaatttaatggacgtactgtaaaaccaagtggcctgttttagtatagattttattacattttatggaactaggagtaaagacaacagcctgcaatttaactatttgttttaaatatcataaacttgcatagattttcttttcttttcttgtctttttttttttttttttttgagatggagtctcgctttgttgccagtctggagtgcagtggtgcgatctcagctcactgcaacttctgctcccgggttcaagcgaatctcctgcctcagcctgtagctgagactacaggcataccccaccacacctggttttttttttttttttttttttttttagtagaggtggggtttcaccatgttggccaggatgttctcaatctcttgaccttgtgatctgcctgcctcagcctcctgaagtgctgggattacaggggtgtgccaccacacccagccaacttacataaattttctaacagccaagtcttcagaaaatattctaccaccaggttgaggggcatatgcaatgttttgctaattcttttaaagcaagtagctgtattttgagatagtttataaaagaccagaaatgcctaaacaataatgtaagataaattattcaaagttcgttgaaggcaaaaaaaaaaactgtgtaataaaattaattctgatgagcctacagttacatcatttgagtattgagactgaggtgactaattttgagtgcagacttttaaatatatttaagaaattttagttatattttattcattaaggcatataaattgtcagttgctattttgagaaagttatcacaactttatctgtttctatcacgagttatgtggtagcagacaaaagtatatttttacttatgaatatagaataattttatgcttattctctgtcaagtctaacaatataatcctatataaaatataaaatatagggatcttataaagaacatattctagaaataaatataaataaataatatgatacattcctttcataaaatgcttttaaatatatgcttatctgtattttagaaatatatatcttcacacagtccaggctcaacctaaaatattaaataaagtcaaatatgggcaggcttatctggataagaatatataatatttaaaaaaataaattgatttatttagcagaccaaattttagaagctatagttctactttaccaacaagaaaaaatgttagagggaaatatttcattaaaaactgcagaaggtagatatcatttcaggattgattctgatactggaaaaaaacaaaacctctttttttaagccaaaaatactgcttctaaacactttaataacttggtgtattttaatagagtaagaggagaaaatatttctgtgaaattatcaataaaatatctactagttcaaatggtgtaaaatgttatatgaaaagtttacccaataaatatactaattcaagattaattcaagatagtctagaatgtatcctagcttaaactttacaccattgtattttagtattataaaactcatttatagtgatagattgaattaacacctatgttgtttttattttaaaacactatattttattctcctctttctctaaataacaaaaccaggggaaacaaaatgaggtttcttatttcccaaatcattagtttgtatttattcagtgacaacagtagaaaaaataatgttgaagtccaaaggaaattaactgcctttgggacaagttccagattttagtgatgagaagtttttaataatcattttagtattttattcaacaaagatataccgagcacaccaaaaatccacactaattctgagtatgcgtaagtggataaaacatagtcctaaacaataggaagtttaagggcaagtaatgaagataaaatgtagaaatgtgttgggtttgaattgccagttgttaaaagattgttcattacgtgtttctcacatcatttttttttaacttttatattccaagggacacttttattctcccagtgaacattaaagttgaaacaaacattcaatggatacctcaatttaataaggaaatggagttattcttagcagcattttaccctctaaaacctagagaaggagtgagagaagatggtagcaattagaaataaaaatgggccacgcacctgtaatcccagcactttggaaggctgagggggaagaatcgcttgatgtcagaagttagaaacaagtctggtaaacatactgagactccatctctgtcaaaaaataaaacaaaattaaccgggccagtggtatacgcatgtaggcatgtaccagctactcagaaggctgaagcagaggatcacttgagcccagaagtttgagagtgcagtgggctatgatcgtactctgtactccagcctgggcaacagagtaagaccttctctcaaaaaacaaaaacaaacaaatatatgtgtgtgtgtgtgtgtgtgtgtgtatacacatatatacttacatatatacatatatacttacatatatacatacatatgtacatacatacacatatagacatacacatatatacatatgtacatacataaatatatacatacatacacatatatacgtatatgtatacatacatatatacacacgtatatgtacatatgtatatatacatatacatatatacacatatatgcttccaaatatacatatatatatacacacacacatatatatttggatggacagtcatgaagtacgaaaactgggagagaggagagatcatctggatatagagaagaggaaagcgagggcaatagtcttgggatttcacagcggttaatcttctattcactattcttgatcatttgcaaatcccaacttagacaatatcataggccacagatgccctgtatggggattgtgagcagaaagagagaacctaggcccctaagcagattagacgatattcagtggcggaagttgctttgtgagctgagagactgatagtcataccacccttgttttcctacaggtgtgttacagtgatttgcccagtgataaaatagaggcatgtgtgaggaactcaactgaagcaaagatgtgagtggttactcctacctgatagagatgaaggatgtcagggatgacttaacaaaagaaaatgctttcactgtattttatgaatcgtttgagaaatgtttattttaaaaggaactattttactaaggcatggggattgggtaacgaattacatcaggtagtgcaggatcctggggctagtaaaagcaggattgtgtaaactttctgaaagggataagaggagagagaaacggctaaaactcagaagagggaaattatgaagtggctacttgaataagaccagtgacttctacagaagggatcacagaaaggaaaactccatacctattgtcaggcctctccctgaccacattcaatgaaaagatcgaagttagagaagacagctagggtgttcatagaggtcgaccttctgaaataacatggcagagaaaagtggacactggctctttaggggcaaataaaaaaacatctatgccaacctcctgtttttattgggctggattttaaaggaatctgaatctcaggtagactcagctttcatcaggataatgatgagcttaactgtggaactggacatataagattatgaaatcatgaaaatgtattctattctctgtaaattgtatgttttaggtgctttcaagcatagggattatacttaaaagctgaggctctccgctcagccttccaaagtgctgggattacaggtgctagtataaggattaagtataagaattagatgggaatatatattttttgagggaaggcataatacttatcattaagcctgagcctatacaggtgtgcactaccaccctgtccgtctcctctgcaaacacatatgctctactgtcccattagctatcatttataaaacacaaattccaaggtgagacaataaagaattctagttgggatagcagagcattaagccaagtacagggtcccttttgagggtgaggccctacataagtttacagattgcaaacctgtgaagctggccctgacagtatgtgacagtgtctgagtctgacaaggaaaaaagtaggtcttagaaatctgtgtatattctccaactaaaacctcatgtttgggggtgtgggaaaagtgcagcaaggattcaaagaactggaggtctcaagtaagctgaagaacaggctcataagggtctggcgaaaagaaaaacctaaactgattaaactttgtagtatttgactacagttcctatgtgagtcagatttagatgtcattatttcaaagagagtgtagtagaaggtgaagtcaaaaaatgatctgtgactagaggcaacggagggaaatacagcataatgaccactggtattcaagagatgtgtgcagttgaggaggttggaggactgaggaggaggtgaagaaatgatcgctgagatcaaggagacttgcagaaggggttaccatcaaggtttctggactgacctagctgggaactggtttaggaatagcaaataagacaacaattcaggagccacatttctttataaattcaggagtaggtccagctttcaaattcaggttgaggaaaaagatctcacgacctactgaaaaaaaatttgtataagattataaatgattaaatacagctactaggatgtaaataaaacctcttgattctatgatctgggagatctgggacaattattagcctatattatgaaggacaactagaggtgtagtatcttggacagattccaaattttaattatggccacgaggtgaagtgcaagtgttttgaaagagttgcaggtttactaaagtttaataataagtgctgtatcttgaaataccctacctatcatttagaacctgtgctatgaaaagtttttctttcgtctcattttatcaccatgaaaacttactttttcatctctgtggtgaaaaaatactaccatgctccatgatctcacatcctggtttccacacctttggtgatcccttctctttgagtgagggcagagtaaggattttgctttagatatagtacagcgaaggtgatgggatgtcatttctgtgataatgttacatacaattgtaagcaatatttctgaggagatttactctcccctgttggcctttgggaagctaaaagtcatctcggggtggctcacatggcaagaacctgagggcagactctaggcaactgctcaactgcaaaaaaactaaggccctaaaccaaagagcccacaaggaaatgaatgatgctgaccacattgtgaacttagaattggaatcttccctggtcgagcctcagatgaaaatgaagctctcaccaatatcttgattgcagctttctgacactctgcagcaaaggacccagctatgtcatgccctgactcctgacccacagaaactgtgaggcaataactttgtatttttttaacatgctaagtccatggtaacactgctaagggaaaataggcaataatgacaatctcagaatctcattttcctaaattatatgtttggcaaaagtctattttttcacattaaactgtttgcagagataaagaggaatacttgagtatttgttgatttagtcattgaaaataaagtatatctggaaatgaagacattttcttgtcttacataatctaggtacattaaatattataaatgcttggcccacagaaagtaccagatgggaatcaaaccagagattgccccatcagtcaacttgaaatgacaaaaataaacatatgttttagtcacatatttaaatgtcttgcctgcctcaccaagataatttgaaactaaaataaaatttttataacaactacatattaaatagacaaaaattttgtgcttgctatttcaatcattgtaggaacaaagataaaaacattacacaaagattaatcagcttgatgaatcctctgctttgaatggatatctctgctttgacattaataggacaattcataaatgccacgcacatgtcctaattcattgatctattatttagaaaataattttatatttcaatagatgtaaaatcaatctattcttaaagaataacttagggtgaatacaatctgaaaaaaagctctgaagttaatttttagttgtatttgtagctaagtataattatgttcagccatttcttcatctattgtgcttattaatatgttttcggaacatagctattaactgttttcagatattttttcacttggtgtaactacagagatgtcatatgtaatttgataagtctaattttaaaacataccatgtacaatgattaatagatcattgaaatatttaagtaaaataaagagtatgtataaatgagtggcatttgttaaaaaggagttttttcttaactataagtaacacgaaaactttgacaaattgtacataatcttctttcagatagcttcagaagagaaaataaaaagatgaagaaataaaatattagaaatgtcaagcttgtccgaaaatattaactgtgcacccagtgtttctggcatagaagagagggttcaacttttgcctaggaaggagaaaataaaagccatcccaagaaagatgggtattagatcctggaattagttggcgatgatcacatgcaactcttgttcagcaaagaggggacaagatgtaactcaccacaagtgaagcaggttgcacaaagaaaaaaaaatgtaatgcatatggttgaatttgggcatattttgtacagtagaagttaagtggattattctttcttttgatgctctcctatactcgtatctattacccgagaggcatggaaagtagagatgtaacaatgaacattacttatgaaatctctccctttgtgtagactacagtagagaaaggagatacaaatttcaacaagtaatggcaatgaagaataatgcatattagaaaagtggaaatggagagatctatagaaatagaatacatggaccgggcgcagtggctcacacctgtaatcccagcactttgggaggctgaggggggcggataacctgaggtcaggagttcgagactagcctggccaacatggtgaaaccccatctctactaaaaatacaaaaattagccgggcatggtggtgggcacctgtagtccatgctactcaggagactgagtaaggagaatcgcttgaacctgggagatacagtttgcagtgagctgagatcatgctgctgcactccagcttgggtgacagaaggagactccgtctcaaaaaaaaaaaaaaaataaataaataataaaaataaaaaaacatgaaaacatactaccggtgaaagagagcctctaaggggaaaatacatgtaaactgctacttgaaagagaaagaagaaattaagtgggttatagcattagaagaaaaattaattatgttctaggtttgaaaaaaaagaaggcaaattgtgaaatgtgttaaaagacttgaagaaagtactgtgtggctagagcttagggcagaaagggcaatggcaataccaccattatgaatgcagcgattttacttggttcttaccagaaccagaatttgtatagcataaaatcagctttattttcggggccaggcttcagcaagtaaacttttttcctctcttactaatattacttgaaagctatttccttatttgaaaatttgcttaaattataaaacttgaacgaggttgatttttacttctttgtgaaaagtggttctgttattatcaccaatgaacagaagaaagaattgaggcaccggaagttaatcaactttccagaggaatcctgacagattcaaaccaagggctagtccgtaaagcttacaggtctatttcttcctagactgccaaatttcttcctgcatctctataatatatctagctagatttcttcaatgcagagagcttccctaatcaatgagactgaaaaggcaaatgggaatatttcagcaagcatcccagtaaagatcaatttttcagtcttgacatgaaccatagaggaaagtatctacttttcttggatgactaagccaatttagctaccattgagtaaaaccatttacttgctgccctgcaaaagaagataatttaacatattaagtttccaaccacttttagcattgattaggtatgacccatgacaacaaattgggaacattttagctaatacagctatggcagagccttcattattagcctgagtcccagaatgaactcatttggtccaatctaacccacactttaagtcagtgggaggtaaatttctgtgtgtctatccactgatatttgggtagaggattttctctaacagcagcaaactcatataaaaaaccagcatatctttatgtatttgccacatacataggaaagaagtagatatgattagtgattcctgaggaaaacccttccataacaacttgaatcatttattttcttctgtcttctcaacattactacttagaacagcacacttttcaaattaaaattctctaactcacatctaaattgatctccctatacctctcaatagcctctccttagggtgatctctagataacgaaaatgctattactagtcgtaatatttctgttcaggtttccaaatgtattttattcatattagaaatgtattatataatgaagctccttttgtctcactttccgtatctaatcatcaaattattcaaagtgtggttttagtcattaagatatacaatgtagaaaatttgtcagaatcatgaatgtactttagtaaaaaattatgtttctcacattatttactacttaaaattgtttaaaaatgatattatttgaaagatcatatattttcttcaaattcatcagagacactgatagcatcaaactaaaaatttcaataatttgacttacaaatatttaaattacatgaaaaggtaattaaaacatctgttgattataaaaatatagatggcaaataattgccagttaaattttaatgtagtttgttgtatataattgtgtatttataactgataattatagttatacacatattcatttaatttctatactgagttatattgatttaattacttggctgatttatctttgactctattcaaaaatctatccaatcttgacttttaaatttgttcattgggaagaacagaaaaactatgcatcataatttcaatataattccttatttctattcaggccaataattatttgactaataggcaagagctgttaaaagtaaatggcttgatgcctttaagaatccccaatgcattctgtagggaggcaatactggcaatacaactctttttctttcaaagaagaattgtaaagtataaatttggtattctcaaatttttggattgttcatctgaattttattttaggcatgccgttagttatattccaagtaaaccctaaaatagattttgtggaccatgaaaagtgaaaagtattggagaataaaaagtggaagggttgtgtagtgtgtgggtcgtacttaaaaatagaatataaaaatcaaactgcagcaaagcatggcatacattcaacaatgccttgtaaagatcaggaagccagaccagaatcaagggccttctgcaaataccagttcgtcctgtccaacatggttgattttcaaatagagtagtcattgctgtcttggtgaggctttaagtacacactgcaaaggaagccatacaagacactacaaagtccagacctggcatctcttcctcattatctcacatcctagacagctctacttttctgtcagattttgctctatcatgcttttccctaccaaatggtttcatttgtttcacatggtgtattatacatcacagctttccctccacccactatctctgccattcattcattctcatcttcctccatccctttcacttgcctccaagaaattttcttataaaacagtgtgcttattttccctaggttttatatgtatgtatgtgtgtttgtgtgcaaatagtctgtttgtttattcttcaagatggtggcatgaagagggacaagcaatgacatcatttgacataaaggatgcttaaaaatctaaatatttaaaacaatgattctgcttaagtatgtcatactttaacttacaaaaattaagcatgtcaatgattttaatagttggagagagattaagcaaggctgaccaagtaagtatatctttctgccaccagagacttaatcacaggcaataggtaagtgaggtttcaaagtaccttggggttgtttctgaaatatgcctagaaaaggaaatccattggttgcttcaaagagctaacatattgctagttatttagtttcagtagttatgtatgcatactctgtcaactggatgtaaataatatgtgttttgtgtgcatactctgtcaactggatgtaaataatatgtgttttgtgagagaagagtttggtttcaaggtaattgtttatcatctatttttgtagtatggtagttcaggaacactgactgacccacttaataaaaataaatttaaaatttttgattaaaaaatctgaaaaatgaatcagtgtgttggagaaaaagttaaagaaccaaaggccaataactatgtggtatgtaagcataaaatcgaattagcattctccctgctgctattgctgacgcaggtaaacttaaatctgtttttcattgtcataggactaaaggaacaggtgacaaagtgatcctgctcaagatgaaaagtctgacaggcatgccatttttacaacagagaaaactgcaaattaactcaatacttgggacttagcagtgaatagtgtcttgagacatgaagctaagttaaaaatttaaaaaaaaaggaaaagaaatatatcttaaataggtaaacaaaggcacccttcatatatatttctacctaaagtaaagtgggcaactcaaaaaatcaacaattaagaatttatttaaaatattctgggctacaacttccattagacatccagaaaagaaatgcaaatttcctttggaaaaaagctatgcaaacacaaatctaagagaaatcatacatttaatgttgaaagatatacaagatcatagataaaaatatcagaaatacatatacacccacatcagaaaataaatgaccataagtgagctagcacaagagaataagacatgtaacaaatgtgaaattatcaaacgcaatacaaaatacatgcttaatgtttaaaaatataaaaatgaactcaaaatcagaataaatggtcatagaaaaaacagaaaaccaaaataaaattaagatatccagatacttaaatatatatttatatccagatagaagatatccagatatttaaatatatatatttatatccagatataagatatctagatatttaaatatatatttatatagatgtgtgtgtatgtatgtgtgtatatatatacacatatatatacatatacatatatatacatatacatatatatacatatacatatatatacatatatatacatatacatatatatacatatacattgagacctaaaaggcagtgggtttaatagcagttcatacatagctgaacagaaatttcattaaaaaaattactaaattatatccaatgcttcacagtaagaccaaaaaattaaaaatgaaaaaggttaaaaataattggagttccagaaattaatgggaataaaaaaacacaggcagagacaatatttgaaaagtagtgtcttaatttttcagaaatgataaacaacaccgatatggtttggttttgtccccaaccggatctcatcgtgagttctcatgtgttgtgggagggaaccagtgggaggtgatcaaatcatggggtctggtctttcctgtactgttctcatgatagtgaataagtctcatgagatctgatggtttttaaaatgggagctggttttttgaaaagatcaacaaaatcgatagaccgctagcaagactaataaagaagaaaagagagagaatcaaatagatgcaataaaaatgataaaggggatatcaccaccgatcccacagaaatacaaactaccatcagagaatactacaaacacctctacgcaaataaactagaaaatctagaagaaatggataaattcctcgacacatacatcctcccaagactaaaccaggaggaagttgaatccctgaatagaccaataacaggctctgaaattgtggcaataatcaataacttaccaatcaaaaaaagtccagaaccagatgaattcacagccgaattctaccagaggtacaaggaggaaccggtaccattccttctgaaactattccaatcaatagaaaaagagggaatcctccctaactcattttatgaggccagcatcatcctgataccaaagcctggcagagacacaaccaaaaaagagaattttagaccaatacccttgatgaacattgatacaaaaatcctcaataaaatactggcaaaccgaatccagcagcacatcaaaaagcttatccaccatgatcaagtgggcttcatccctgggatgcaaggctggttcaacatacgcaaatcaataaatgtaatccagcatataaacagaaccaaagacaaaaaccacatgattatctcaatagatgcagaaaaggcctttgacaaaattcaacaacgcttcatgctaaaaactctcaataaattaggtattgatgggatgtatctcaaaataataagagctatctatgacaaacccacagccaatatcatactgaataggcaaaaactgggagtattccctttgaaaaccggcacaagacagggatgccctctctcaccactcctattcaacatagtgttgcaagttctggccagggcaatcaggcaggaggaagaaataaagggtattcaattaggaaaagaggaagtcaaattgtccctgtttggagatgacatgattgtatatctagaaaaccccattgtctcagcccaaaatctcctttagctgataagcaactccagcaaagtctcaggatataaaatcaatgtacaaaaatcacaagcattcttatacaccaataacagacagagagccaaatcatgactgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcctgcattgccaagtcaatcctaagccaaaagaacaaagctggaggcatcacgctacctgacttcaaactatactacaaggctacagtaaccaaaacagtgtggtactggtaccaaaacagagatatagatcaatggaacagaacagagacctcagaaataatgctgcatatctacaactatctgatctttgacaaatctgacaaaaacaagcaatggggaaaggattccctatttaataaatggtgctgggaaaactggctagccatatgtagaaagctgaaactggatcccttccttacaccttatacaaaaattaattcaagatggattaaagacttacctgttaaacctaaaaccataaaaatcctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaattttcgcaacctactcatctgacaaagggctaatatccagaatctacaatgaattcaaagaaatttacaagaaaaaaacaaacaaccccatcaaaaagtgggcaaaggatatgaacagacatttctcaaaagaagacatttatgcagccaaaaaacacatgaaaaaatgctcatcatcacttgctatcagagaaatgtaaatcaaaaccacaatgagataccatctcacaccagtcagaatggcaatcattaaaaagtcaggaaacaacaggtgctggagaggatgtggagaaataggaacacttttacacagtttgtgggactgtgaagtagttcaaccattgtggaagtcagtgtcgccatttctcagggatctagaactggaaataccatttgacccagccatccgattcctgggtatatacccaaagaattataaatcatgctgctataaagatacatgcacatgtatgtttattgcagcactattcacaatagcaaagacttggaaccaacccaaatgtccaacaaggatagactggattaagaaaatgtggcacatatacacaatggaatactatgcagccataaaaaatgaagagttcatgtcctttgtagggacatggatgaaattggaaaccatcattctcagcaaactatcgcaaggacaaaaaaccaaacaccgcatgttctcactcataggtgggaattgaacaatgagaacacttggacacaggaaggggaacatcacactccggggactgttgtgaggtggggggaggggggagggatagcattaggagttacacctaatgctaaatgacgagttaatgggtgcagcgcaccagcatggcacatgtatacatatgtaacaaacctgcacattgtgcacatctatcctaaaacttaaagtataataataatttttaaaaaaatgggagttgccatgcacaatctctctctttgcctgctgccactcatgtaagacctcacttgctcctccatcatgattgtgaggcctccccagccatttggaactgtaagttcattaaacatctttcctttgtaaattgcccagtcttgggtatgtcttcattagccgcatgaaaacatactaatacaaatcctgatatggttaggctgtgtgtcgccaaccaaatctcttctcaaattgtaatccccaagtgttgagaaagggacctggcaggaggtgattggatcatgggggcagtttcccccatgctgttctcatgataatagggggagttctcaggagatctgatggttttataaatggcagtttccccagggctttttgctctctctttgccatgtaagacatgcctgcttccctttctgccatgattgtaagttttctgatgcttccccagccttgcagaactgtgcatcaattaaatctcttttctttataaactacccagtctcaggaagttctttatagcagtgtgagaacaaattaatacaaatactaactcaaataacccaaaggtgacataaatctcaatcaaaataaatggaaaccaatgcaaataaattcatataataatgataaagagataataactccaagaacataaatatatcccttgaaagagattgtaattagacttacatctgactaatcatagcatcaatggaaactagaagacaatggactaatattttcaattcatgtagagaaaatggtcaactaaagattgtatacaaagcaaaaatattctttaccagtagtaatggtgaaacaaagatattttcaagcacacagaaactgagtgtgtaactgtcaaaccctcccaaatataattctcaagcatatatttaagatgaaaaatggatgatccagatgaaatattttacatacaagaaaaaattattagcaattaagtttgcaaatatgggggaaatttctcacaaaatttgtatatgaaaagcatacacatacaaatgagtaagcatgtgaaagtgtttttataaatgtaaataacatataaataaataaaaatccaatatgatcagtagtgaggttgtctaaaaaccttgtatttctcaggaggaggataaacatatagaatgtctttagacattcataaatgtgcatgataaattaccaacataagcattaaatagtcagggatttttaaaaattctaaagtacagcaaccaaatctatcttaaaagaaataaataaaaagtaaagaagtagacatgaataaactttgcaaatatttaataaataaaaattacaaaataagatagagaaaaaaattcaaatatgtcagcagttacagtctaagattgtcagattgtattttaaacaacataacaacaatagcattagtttatgtttacaagatgcatatccaaaattaatatatatgtgtgtccaaaatttatatatatatgtttgtccaaaatttatatatctatagaaagttaaaggatacatatatttatatataaaagaaaatactaacaaaataatttgttgtgacattaataaattcaaaaaggcttgtgagaaaaactgtattaccaaagataaaaagggtcacagaataattatacaaagaaatagagatatctctacaatcacgcattcatttacccattcatttatttcttaatccattcacacaaaagctattattaatgtttactaggagccatgtgtagttctagacactgataatatagcaagaaacaaaattaaaaaataccctctgtctttttggtgtgggtatgtgtgtgtgtgtacatttgtacaaatgtacatatatatacttacacatatataattttttagaaaaaggagacaacaaattagatacattaaataatgtctgggaaagatttattaaatgtgggttaggcttacaattttagataggatggtagagtgagcaaggtaagtcttactgagtgagaagatgatatttaaataaagatccgaagaaagttagagtaagccaagcaaatatctgataaaaatatgttcttggaagagtaaatagcaaaaagcacaaaagccctgaattgggattttgtctggtttgattaagaaacagcaaaggctgcttggccaaatgtgagtgagtaagtaaaaacatggatcaatgactaaggggaagattagtagggaactagggcagagaaaaaagtcaggcaagggtagatcatgtggagtgttctaaaacattgtaagtcctctgtacacaattggcttgtactcagaatgcaatgtgaagccactggagagttttcagcagacttgtgtagtgatatgacccaactctcctattgggaagatcaaactaggagttgtgttaaagaccaaatactggtggcaaagggcagaagggagaaatttgcaaatacctagaaatagaatggtggtaacttgagtcagtgtagatgctgataattagtcagtctgcatatatattttaggacacatgtcattcactaattgatgaattagtggaataaccagtaagcatataagttctagcaagagtcaaagtaatctcatttccattggccagtgtactagaggacatagtcaactcaggaagtgatatggtttggctctctgagtccccacccaaatcttatcttgtagctgccataattctcatgtattgtgggacagacatggtggaagatgattgaattatggggctgggtctttcttgtgctgtttttatgatagtgaatggacctcatgagatctgatggttttaaaaatgggagttgccctgcacaagctcgttctttgcctgctgccattcatgtaagatgtgacttgctcctccttgccttccaccatgattttgagccacgtggaaatgtgacttctccattaaagctctttcctttgtaaatggcccagtttctggcatgtctttatcagcagcatgaaaatagataaatacagtaaattggtaccagtagagtagggcactgctgaaaaggtacacaaaaatgtggaagcgactttggaactgggtaacagacagagattggaacaatttggagggctcagaagaagacaggaaaatgtgggagagtttggaacttcctagagacttgttgaaaggctttgacacaaatgctgatagtgatgtgaataataaggtccaggctaaggtggtctcagatggagatgaagaacttgttgggaactggagcaaaggtaacttttactatgttttaacaaagagactggtggcattttgcccctgcccatagatttgttgaaatctgagattgagaaagatgatttagggtatctggagggagaaatttctaagcagcaaagcattcaagaggtgatttgggagctgttaaaggcattctgttttataaggaaagcagagcataaaagtttggaaaacttgcagtctgacaatgcaatagtaaagaaaatcccattttctgaggagaaattcaagctggatgcagaaatttgcataagtaacgaggagcagaatgtcaattcccaagacaatggggaaaatatctccagaacatgtaagagacctttgcagcagcccctcccgttacaggcccacaggtttaagaaaaaaagtggtttcctgggctgggcccagagtctccctgtgtgtgcagcctagggacttggtgctctgagtcccagcccctccagccatggctgaaatgggccaatgtagagctcgggctgtggctcctgagggtgcaagccttaagccatggcgtcttccatgtggtgttgagcctgcgagtacacagaattcaagacttgaggtctccgcctagatttcagatgtgtgaaaatgtcaggatgcccaggcataatagtacacctggcattaatctttgttgtaaatccaaataacttaaaactgaaataatatattggttaaggtaatagacatttttaagactataaagaaacatttataagactgtaaagaggtcctcatggagaacctctgctagggcagtgaagaagggaaacgggggtgggagcccccacaaagactccctactggggcaccacattgaagcacaaaacaagttatataatttgctgatagatacaggagccaggagtcaaacctaggtagtctgcccactgaggccaggctcttcatgttgacaacatcttgcctttcttaactgtacgtgtgcatctcagaatagtatacatggcattaatcattgatgtaaatccaaagaacttaaaactgaaatagtatattggttaaggtaatagacattttttaagactgtaaagaagtaagagaatgataacctcaaagttcacaatattaactgcctttaaagcaggaatgaagggatggaaactgcaatgagtgctcagggtacttcaaaattaataatactaattttattctgttcttctttgagttcttattcattgggcttagcatattgttaacaagcactcatttttgtctactaaatacttaataaaaattatttaaaaagtaaaataatatgggcatttgttctaaagttcctcatttatagaactgagaaagtcctataatctggagaagactaccgcatttggattatacggtttcattgtgggatccagaggcagaaataacttgtagcatatgaaaagggcaaataatctgattagaaaatacataacaattacatggcagcaggtggaaataagtgcaaacccttaccctaaatggatcaaaaggtttatggttcagtgaatctgagaagaaagaattgtctataaataatatcattataggttataggttatatatcagcaaaaaaatggaaagatattggggaaatatatttttaattaggtaattgtagactgaacaaatggtcttatcaaaatgatgctggttttggataaaaaaatttgataggcattactttaaaaatgtcactgggatctgccattgaccatattctatttaaatgctaatctacatatccaagttaaaggttatatacatacttctggttgacacgaagtaggaagggatagttaacaacctgaaataaattgaaaagcagatctcagtgactgaatccaataacagcgtgtggtggaaaagacctaagaataaagtccgctgaaggaataaatatttatagtgatcattaaactaatgtgacccaagagaaagttgtttggattataatatcttgcatggatggatatcatgattctcattgtattctgtgcgtgctagaaaatcaatggcttctccaagtacacagaaatacaggtaattttaggcagagcaatatgacaggaatgatgtacatgaagacttgttcgaagcattgattaagatgtcagggatggtgaacatgatagttgtatgtttatatatatattttcattcatatctccattcacttaacaggtattttattgattactcacatatgctaatggaaaagttattattttctatattttcctgggctcaaataaagaatagcaaaaaaagttagacaaagataattttcaatttttctgaaggtcaaagtggcagcctcaaaaggagtttgattctcattattgaataaactgaaggaagtttggtcaatttcataattcattttccatagaataacttctaataatagatgagttattggggaaaaatggaggcatactatagtgaggaaaatgacaaatttttaattcagacatgagtagatttaaattatgtttctgtcttatactaactggaggacttgggacaacttagttaactatctgcagtttaatattttttagagtcatgcaacctcaaaactttttgacactctataaatgctatctcatatactttacaatatcttgcaaatatttctatcaccctcaagatacacgatattttatagataagaaatctgaggtggctgttattttacattacctacacaagatactgaaaggatttgatggattgaattagtggtcccagttatttcatccattgtgtgaaaattacacaatcgcagtcttgtcttggtctactgataggaggagtgccacagtttaactgaggcttggctttaactgaggcttggctatgtgtcttgtttgcctaatgtgatattggcaaccttgaagagaacagacatgtgaaatgctcatattcactttggcgtggaccttttctatttctgttctcacaatgagatacttctaccccaagtagtcattgccacttatgcatccccagaataaatacattgacaatgaccttactcttgctgaccagagcctgagacaaagttgtccagcaaaggctactcttcatcagtggaaccacagttaactggtagacacacctgagcatgagaataaaagttggttgtggatggtctatgatacagcaatattatgacagtaggtgacttacagatgaacctgaaaaaccacagctttttaacgttagtggttttccttttgtatttatgtcagcataaaacatatgtaccagatattaggttatataatattttcattatatcacacatcactactaaaggctaaatgattttttaaaaggctaaatcaaagcctacttttgctataaaatgaatgtcttcctcaggcgatatcatcaaaaggatgaataaacctggctaattaatctatttcatggtaagaaaggtgaaacatgaatttccgtcatgtgaatcacaagacaaaattttcatctattctaaagatgggattagacaattaaattgtttaagaaaagttttgtttaatgtatttctaataggtatatgaaaataacatggttaatatttacatatttataaaaaccctaaaattagcaatttatgtatgtatacatgtatatatatgccaataataatttcattacagcatagttcatgaatattatcctgtactgtgaatgaaccctaatcagagtattgacttgagttatctggatattttttaaatgatgatattccccctaatgatctgttataattaatatatataattagaaaaaggaggcactttctgcttttgaagttctcccttattttcaaatcaaatagttacgtgctctcctttttatatagttttcttctgtgtgtgtacatatatatacatctttctatattttctgtttctaattattttctgattcctagaaagagataatgtatcatttttcaaattgcctttagaattgaatttcatgtaaaacatcatcaaatttgattttaaaatctaagtccaattattttattatattaacttaattttaatatattccattagagagaaagaaaattattcacttctctattaaatgtatgtgcactataattttctgaatcattattacataatatatatgattaatattaaacactgataacaaacttaaatatgctaaaaaatgaaacaacataaactcctcattaaccatatcaacataacttttcttaaatcagctattttatataatttatgaagcctatcttagatcagtttaggcataatttagtgcctattgtatcctatattctgagattcaaatattaaaagatgagagattcaagaataaatcagttcctactgattttctcaaatgttcatagtttaagttgagagacaaatcaataaaatgaataatatgaaataaggggaagcagagaaatatatatttctataaagaaaaaacttttttggaggatgaggagaactcaagaaaagttttctaagaaaacgattgagtagaatattcaaatataaatgtgaattagtgaaagagaattgagatgattctgagaaatgaaataggagagacaaaggaaggtaggggttttggagtttgtgtgtgtgtgtgtgtgtctgtgtgtgtgtgtgtgtgtgtgtgtatttcaaatgagcctggaaaagtacaagacagagcatggtgagtgttatgtctaggtctttaaactttataggaagtaaatggaggatgtcaagtgaagggatatggccagttcctcctggatagattacattagctatattccaaaatataaattataaaaacaaaaaccaggaagactaggctgtcactaattttgcagtaaaaattattaaatccagccgggtacggtgggtcacacctgtaatcccagcacattgggagcccgaggcgggtggatcacgaggtcaggagttcaagaccaacctggccgagatggtgaaaccccgtctcgactaaaaatacaaaaaaaattagctgggcgcggtggcgagcgcctgtaatccaagctactcaggaggctgaggcagagaattgcttgaagctgggaggtggaggttacagtatgccgagattgcaccaccgcactccagcctgggtgacaaagcaagactctgtcccccccaaaaaaaaaattaaatccacataaaataatagtaaatagaaatatttttgaaaggtacttagaattcaacttatctaatcttgattcggcaggtactggtgaagaagaaaaggtcaaagccacttccaagtcacagattttcatgactgaatgggagatgttattactgactagaataaaaataaaaaaagttataaatcatatctaaaaggatgggctttggcatcagaaacaactggcttctaactcagctattccacttaattagttttgtgaccttgacatcaaacttttttgagacttggcaccttcatatacagaatggaaaatgtagttgcttggaagattattggagcattaactgtgataatgtatgttaaagtacttagtatagtaccttacataaagtaaacatattaaaacgttagccaatatatctgtaaatattgggaggatgggagtaacggtgtcacaagtttgttctgtctcagcaaagtctgaagtttaagaaattggccacggctttaggtgcccattcaggaatactttgaatataagcgcttgttaaaattattagagtgttgattttgctcagagaaaatgtatggggtgagatacgcagagaggtctgggaattaggtttattatcaacgtgtcaatgagagacacccctgaagtaagccagaaagaaatagatatataaggataaagaagtattttaaaagtttaaatctaattataacacagatattctaaatatatttttcatatgggaagattttttaaaaaatattactgtttctttccttcactctgtaatttatttcagtctttgacaagtaggtggttttgtgggagactaggaacaactgtgagaaggagcaaacatttcaatcaccaacaaatatctttgatacaaatattatttttgctcttgcacttcagaggcccaataatgtccttactaaatcaatgataattatcctttcacacctgatatgcatcttcagcgccattcaggtgtttttatttaaatttttaaaatgagcatctttttaatcagcaaaaatttcattttcaaaattcaaaattttctcttaaaatatatattccccagccaagtgctctacagccagtgatgaatttaagttttgcatgcctaacttttttccttagtttagataactgcttttcaaggtttccccaggtagatatctagtggtttgaaatgcattttaacttttgatagaatctggacttaatgccacagtaaacggaatgtaaccaatagaatcaatacaaaaagatctggaatcttttctatgttctgacaatatcccaatgtgctgtgctgctagctcactggctggagaagagtacaaagaaagtaaggagaaaactgtattgatcatattctctacaggccagaacacagtgctggccacatagttgagattcagtgaagatgccttacagccacctgttttgtgaaatcaccaagaaggtttaaaatgcaaactatgcagaatgttgatgtgaaagtcatattacaattaaaaaagacacaccttttcattgctaaataattgatacaaacattgagtaccttactgctaattgcatagcaaaatattttcacttaactatcaagaacttgcaaaataagagtttgtacatatttggaatatagagttattttagaaaacacaggaaaactaggtcatggtttcttttctttgtttattcagtgtttttaattatttgaaaagctctctgtcggaatatattcttttcttttaggagcacataattggcaagttttttaaaataataatcataatgtataatattgtaacagtcatttgattaaatcaagatgtattacattataccagaatttcatcatctgtcttggaaaatctttttaattgaccaaatagccaacattatagcacatggttattttctaaatcaaacaaagccaccgggaggaaataaacttcccttagaaataaccactctatataagacatgcaacagtcctctttagctttgttttgaaccaaaggacatgaccctccattaactctgccctcaccatttccccatgagatagactagacagcatgactatcagatgttttagtgaataatccttgaccttcaacaactgaacacaaagtgtttttgttgtgtctattgcactttataattgcaaaattcttcattcattagctaaacctcttttcctctggaataggtgagtgttcagcatcagtaccacttctgctgtgccagttaggaaagtgagaaacagggtcaaatggccttttttcatgtcttatatttgacagccaggatgctgattttcaaagagcacagtgggaaaataaaataactgactaatttataataattatagaggagactggaaagaatgacaggatatttgcagagagatttaatgtacttaattaatttgacctcaacaccaacagaaaggtttgcaagtagagttctcctaggtgtgtagtatttaaggatgttaattttaatgagcacatttattataaaacgatgttttctttcactgtgattttaaaacaggtgtagtttaaaagctctctttttcaaacttattccctttcaacacaaagcaaagaaaaagttatggctctgaataaatgaggttacacttattttatggaaatcacacactcaggagatcaagtgtcttggaagccaattaatttattactaatattaaggggcatgtacttagaaatgtacttacaacatcaattatgttcaactatctatcataacaaattttactggcaaatgtatggtattccaatggatcatattttatacgctatttttaccaagaataagccatttgacatacacttctgaaaaaggaaagaaaagcaaaggaaaggaaataaggaagaaaacaagaggggataaaaaggaaagaagagaaggagaggtagaaaaaagagtgaggaaggagagtagagagggagatcaaaagagggggagataaataaaagtaagccactatggaatataagcttagcattttagcaaataaaaacgcatgaaatgtgctcataaaataaaaagctgtctaatcttgtaataaatttgcatttctatttagcaaaatactgcaatgagaaggatttcgaagatgtctcctgcaagaatttgtcagccttttgttaaaacatacacctcttttggaatactagatatgaacctatttgtcatatcatgattatttttatattaatgtctacactctgttcacatataacatttctgcttttttacaatctgctttggcctattctatcttcttgttctcgatttgcaaaaatattctggaaatgaaaaacagtcacattattgaaagatttgtaaaatatggaaaactaggatatcctaaaggaaatattgcagatgggaagcagcattgttatattgctatttcaaatgtgtcctccattaccattttcttgggcagttaattattttttgaacagtcttccacttttaggagtaaaaaatagaagtaaatattcatttttattctttgaatgggggctagatcaaggagaataatcttactaataagaagatgggtttatttagtgattattcattagtcatgattatctctccgtgaatcttagaatttttctatggtattattttaccagtaagctatttctgacaagggaattgtattttcactcagcattagaatcctccactaacaaacgattaatctcaccttcttgtattctatatttatttatttctcactcatccaaagtcaactgtgaatctgggcaaatctccagaaagctgtcctcaatgtgatggctcatcagttccaaaatcatctcctgtttccatacttggcatggccctgggaggaggactggacaataaagagccagcaattaacttctccttcagggaagtgattgtcctactgtgtcattttcacttagtaaactaagttagaggccagctaatttcaatgatgttggaaactgcaatcttcctttgttcccagagagagagcagctgagctattgttcaactgtagcaatgtctgcataggaagagtatggtatgaattctttccttcacaaccagttacatgaagggtgatctgtggaatacaaaatttcaaatagtgcaagaggatttggacaaggaatcaatgcctactctaaaaagaaataattatgtgacactaggcacagaaaatcctggtgcttttttttctttttttctttctttctcttttttttttttttttttgagacagagtctcgctctgttgtccaggctgaagtgcagtgatgcgatctcagctcaccacaacctcttcctcctgggttcaagtgatactcctgcctcagcctcctgagtagctgggactacagtcatgcaccaccattctcggctaatttttttttcttgtattttttgtagagacagggtttcactatgttagccaggctggtctcaaactcctgacctcctgatccacctacctcggccttccaaagtgctgggattacaggcatgagccactgcgcccagccagtcctgatgctttttaaggggctttttatgttttaacctccaatctttctacataacatggacaaaattttattgaaatgcctcttttccactgagtgcaagaaagccgtgtaaactaacaattgtgatgggctgttttgaattcaggtgtttattcaaaaaaaaattaaacaaagttgtaagtttcctgttataaaattgccgcaattccattacagcgaattctgaaaactaagggtaaccatgtaaataaagtgatccctacaatgaatactgtaactatttccaccatgtctttgggaaattcaaggctgtgaccaatccagaactcctgctttcattcattttctgaaatttcttatctgaacttcttcatgccaatggaactatcatttaatgagagatataaattgaagctaaagaagaatatcatataaagtcttatgtagacatgaactttgttcttttcaatactatacacataatgcttagagcaacagagtgtgacagtaaatattgatttagtgacctaatatataaatgaaagaaagacacaaaaaataatataatcttgggacatcaaattcactataaaataatcccaaataggcaggtatggtggcttatgcctgtaatcccagcactttgggaggctgagggaggaggatcgcttgagctcaggagttcgagaccagactgggcaacacagtagaccctgtttctacgaacaaaaattttaaaaaaattagctgggtgtggtcctagctcctctgaaggctgaggcaggaggattgcttgagcccagcacgttgaggctacagtgagccatgatcttgtcagtacacttcagcctgggcaacagggcaagatgctgtctcaaaaataaaaattaaaataaaataaaataatcctaaatacataaagaaaaaatcgtataattaaaaaaatgttattaggtccttcagactattgccatatgtcagataaacaatttgtattacacagaaacatatgtcaaaacaccaataggttgttgacattttagtcatgtaaaaatatgttattatgaagagagtaaaggatcacatcatacttttcaatgtacattctggatgaattgaagtgttgaacattttatgacatgttgctttatattatggcttgagttatactagaccatgaaattaaaacaggctgattaaatataattagataataaacattaaatagaatttacatggaaactatacttagctgttgagtcataatatgatcatggtagatagaagcctaattttgctatttctttgacgtggaagttaaacagttgaaagaagtgtgcttggaagccagtgtgtaaaggaatagacctactgctctgtcctatatatcaatttggtgaaacgggtagcatacttcacagattcctctacccgatggttgctgattgagaattgaccagaaatgcaatttcagcacaatttgaaggcagaagtgaaaaaataaccattattctccaaggtcattgtagggagatatttgatggaaagatccagagggggcaagtgggcccagcttgtccttgctttgccattttcttcattcagctcttaaccctgatgacggtcatgctgaaaaacagcagccttaagcactcatctctatttccttggctgtagacccgtagaagtagttgttcaaagggggcaacagcttcttgtagacctcttatgagcaccctatcatggtcccaccatcctagtggctgaatgtgcttggattcccagattttcttgccaactttgactggttcacctgcacccgtgcttcaggcagcaaagagagtggcttattctctctgatcctcagcctccaccttccagactctcacttcctcagcttacaactcatttgtgtaagtcattctaaaattgaatctcttgttctcataaaatttagaatgggctctatttccatgactgtagcataactaataaaactgattcactggttaattttattaatattgaaagaacaatagcaacacctccattaaaggcaggcaaagggggatttacctaaaggtaatattcatttcttaaaatgggtgtgtgagagtgtctgtgtgtgtgtgtgtgtgtgtgtgtgtgtgtgtgtgtattttgagatgaggtctcactctgttgtcaggttggagtgcagtggcatgatcttggctcactacaacctctgcctcctgggctcaagggatcctctctcccacctcagcctcctgagtagctaggactacaggcacacgccacaatgccaggctaatttttgtattttaatagagatgggatttcatcatgttacccaggctggtcttgaactcttggctcatgcaatccacccacctcagcctcccaaagtgctggtatgataggcatgagccactgtgcccagccttaaaatgtatagattagccttttaggcaaatttgtcacttaagataaaagtttttgttgttggtagtgtcggtgtttttgttaacacgattatgtctactcaatatatttgaaagtttcttattctttctattgctttcttgatgtagcatagatttttttgtaggacaagagttagaaaaattaaggggttaaatatcatgctacaacaaaaggggttaaatatcatacaacaacaaaatagatgaaaatatttacaatttatttaaatggatacaattcttatacttcataaacatcatttacatgtttcttatctctgtgcatgtgtatgcatgtgtgtccctatgctagtttacaatcaaaattacttgtctttttttttttttttttttgagatgaagtttcgctcttgttgcccaggctggctggagtgcaatggtgctatctcggctcactgcaacctctgcctcctgggttcaagcaattctgccacagcctcccgagtagctgggaatacaggcacccaccatcacgtctggctaattttttacatttttagtagagacagggtttcaccatgttggccaggctggtcttgaacgcctgacacatgtgttcctcctgcctcggcctcccaaagtgctgggattacaggtgtcagccaccatgcccagccaacacttgaaattacttatacccttcacggtttataaactctaatttgctttaagtcaacttaactacaaacccagaaacacataagtagacacatgtttgtacacgtgcttgtataaatgcacaaccacaatttcattgtagtttgtaaatggctgaacatttaaaagcataaagggtaaagtagctaaatattcgatgcaaaaagaatggcaggcagaggtaattttacctctaatttatcctctaccaccattgaggagtctttataaacaataagttaaaactctgattttaatttgtcaagtgcgattgaaaccacaaaattagtcacacacaaaccagaacaaactaagtactgcagatgctgcagatgtttcatttttcagttttaaaattcaaccatatttttcttattataagcaaatatataagatgactttttaaaatctttttcttttttgtttttgtttgttgtttgtttgagagacagtctcgctttatcacccaggctggagtgcggttgcacgatcttggcgcgctgcaacctctgcctcctgggttcaagtgattctcctgcctcagtctctggaatagctgggactacaggtgcgagccaccatacccggctaatttttaaaatatttttagtagagacggggtttcactgtgttggccaggatggtctcgatctcctgaccttgtaatccagctgccttggactcccaaagtgctgggattacaggcatgaaacgaatgcatgcatactcatgctaataaatgcttgggtatgcttataccacactaaaatcacataaataactctggcataatacagtgatttatatatattatatatttatataaaagctatatataatatgctatgttattatatattatacatataatctgtttacagatatatagcaaacacttactatatgttagtctgttagacactgttctcatctcttgaaatatatgagcacacaagacaaagatctctgttctccaagtgtttacattccagaaaggagaggtggaagtaaataataaatgtaatataagaaaataaaaacgtagaccaggataaggaaattgtattatacagttttatacaatttgcatattaaatagagaggatagccttcatagagaagggggattcaaacagaggcttgaaggtaactagccaagtaggtggctggtaatcagtatcccagtcagagggaacagctagcaaaggtgggagtaaacctcctaagttccaggaaaagcaagaagagttggacagagctgcagaagaacaaggggaaggatgcagggaaaacggatcagaaataaaatgaggcggcacagactacacagacacttggtacttcctctaaggtaagttgggaactaccagttgatttttaccagacaggtgacatgatctgccatattctaaaagaatagcattttctcttgaggctaatctttggagaactagaagcagtaatttggataagcaattactactacgggagtcatggtgacaagagagcaacagatgaaaattggtaggatcctacacatactgtggatgtagagacaacaggatctgctggcaaattagatatgcaatgtgagtgaaatagaggacataaaagggcttgattgagagacttcaccttgagtaattggaaggatggagttgatgttgaccgacatcgtgaaatctgagcatagaatatgtttgtgagtgaagacctataattcattttggacgtgtgaatttggaatgtctattagatatccaagtagatatgccaaaaaaaagttgagtataggagattagattttgggagagctgagctgggaaatatatatttgggagttttcagcatatggtgtttaaaactatgaagttggatgagatctctaagggcgtgggtgtagatagacaggagaaaactaatgctgctccaacactgaggggagaacagaagaaactagcaactggaactgagaaggaatagctagtgaggcaaaaggtaaaaccagtcatgtgggcatctgaaaatccaactttaagaactgtgttgaggaggagggaagaattaactgagtcaaataaacattatgtaaattgtatacaaagagtagtctacacttatgcatttttgagttggcaggaaatttttggaagaatacttaggaagctgctggtttgagcaactgtctcttggaagtgagatggcaggtgaaaagaaagggagatgaagtgttcaacacattcagctataaccacatggttccgcatgcatcccatgcataataaaatatgaaaatatacttaaaataacaataatcatgtaggtggcaaaaaatacttgagatgacaacagaacaggtgaaaaacctcaaacaggttatatttgaaaacttttttaaaatgaaaaccaatcctcataatagcatccatggaactagtactgccacggaaccccaaatcaaattctgttagtcatgactgggactaaactttacttctacatgacttcttttaaaatgcaaacacgttacctgaaatgtataatgttaaatatgcaatctaaaaagtattttaaatggaagatggctaaaattatatatgcatagacagctaaaaaaaaactgtatgcaacataaggaaaaaatcaaagtttttagaccctgtaaacatgaatgacagtaggttgtagtgtctgagaggagggatttacgatccaatacatggctgcccatgaaagacatggcccattagagtgtatgcaagagagttttttgcaagagagttacagagacaaaaaaatagtcaaggaccagagcttaatagagtaaataatgtggaatggggtaataaccaaagatttattggtgttgtaggccaagagtacatggttagtcaggataaagacaaggtatcattaatgtggcaagttacaagttatgtgttcactctagaacgaaagatgaaatcccatagtaaaatttaaaatgttaaactacttggatttttcaatatgagatcagttaataatgaaagtatttccagaaacaaagaaaggttgggaaatacagactatgagaggttttaatatttttgcgattagtcatcaaaaaacaatcaaacttaattctatcatggtaatactccctaatgcagttttctaaatctattttaaacaacaagcaataagccaaaggaaaagtgagataatgcctttatacatattgtaactgtgtttacttttctcagtttctaccagagaaaaggcaggtgcatttttttggtatgtttgtgtaaagtgaatttggctttactttttcaaattgaaattatcttattttcatagagtttgaaacttttcttggcattaaagaatagaagagtaaatgcatttacaaaaatttgttaaataaccattaatgaatatatcttggtgctgcgttaaagttattaatcatagctttgtgactgggaaggaaaatatagtaatttttcagggtagctctctgtgaatccacaatactggggaagtcttccccaattctatctgtgaaaacactcataacttaccagttatccatggtgacatgaactaatggaccatctttaaataaattcactaagagttccagaatatggcacaatgttctttttctctgtagtactgtgaaattagcatcaaacacagaagaattcactattctttacctcccccatggttgtcatctctacactgtaaatcatagagccagaaaaaatgaagttgttttcctcctgtcattcatatttcatagcttcctctattgtgtgaaagtatttcatttttaggaaggatcaatgccaaaagagtttattaccttctatcagaagcatttagctagctttagagatctcactgaagaagttgttcttaacatttgtggtgtgtgtgtgtgtgtgtgtgtgtgtgtgtgtgtatgcatacacatgggtaataaacatgaaatgtgaaggcactgcaaaaatgttttgaaagatatttaaaatatatttccagtgcattttctttattttcttgactgcttaccacagacacatgcttctagagagactacagaattaaaaagaaaacagacatctaaagaaagcaattatcatgttggcactgtaaagcaggattttggctgtttgataagacatttataagaaatatgactttttaaaaagttaatgagtacattcaatgtccaccagccttgtctcactgtgtagggctgtgtctttttgcatgtttttgtattaatgcatgaggaaacaggggcaactgagaaatgggagtataattataaggatgcttatttgtatacaacctgcccatggtttttccatccttcatcaagataaaaaagagaaaatgcctgtcattctgttccggaagacatccagatgaactgtgaataagcagctgttattctcacaagaaaattgactgaaatttcatactcggtaaaaaataatttatctgcagtcatcatacacaaagcttcatggagttacacattaaggtttcctataataacttggaaatctacaggaacaagggcagggctttgactcattatttggatgtgaatacatgacccacattaatgttagagataatgggcaacttagcacactccaaatcaaacagcttcatgatccatcattaacctaagtgagctttcactttactgaagcagccctctaaatgaataggtcattgcctgcttaaaaactcaaagatctgttaatattccaaggacttagagtctattagatcagacaatctgagcttgtacaaaattgtaggcacactggatagctaacatcctttggtgtatatataaatattttaaagaacattctttgatacttgatttaaacagggaacactgcatttgtgacattattctgcataaatgtgcatatgtgtcaagttcaaagaaaaagaaaagactctgtagagagatactccacaagaggaaataagtttccactctaagctgactttcataatgcaattaaatccattagagagaatggaatttcaaatactgttcaaattaaggcagtgcagttagaagcagcagcaattcaggaagaattagcaatgcccttctgaagagagctactgaattaaatctcggagggctttaagattaagtcatttaattgctactttaggagctccagacagtgcatagagttgagtccaggtgttaatactgattcttctctgttctcttcatataacaaaactgaatcttagagccaattaaggcaaacttgaaaggccttcttcccccttttcagtatgctccgggtgttttattttaattgtagacaacacgggaaattgagcacattatacatagtgagatattattaaatcttgagttgaaaagataaccaatattcatccatattattttgccttaagttgcaaaaacttgttttttgtagaaggacactcacattgtgtttattttattcccctaatcattttaacaggagaacacagtttctgtaccaaatcctaacactaataacatcaccagctaatgattagtacatttataggccaaggtaaatgcatgaataaattacaatagaaagtactataattcacgagtatgtctcacacccctccctcaagatatccacttttaacatattatgatgtaaattgctcaaactcctttaataggcatacttttgggtgaatttatgcactcttatccattccttcatttattcgttcaccaaacaaaatggattgagggctgctatgtgccctctatgtgcgactattatagggctttcctcatggggcttgcatcatcatatgatatgaagtaggtcctattttataaaatgaagttggataagggtagagatgattcttctgcagaagaaagtgctactttcagacaattgttagagaacatcactctgatgtaatgacaataaaaccaagatttacatgaaacaaagggggatgctgggtgagcgccaaggccttgtggcagtgttgaacttgacgtaatgagaaaggaaatggaggggcttgacaagatattggttttaagccatgggaagtactttgatactatatcggagagtgtacatctgctactgtgtaatgagttggggtcggggagaagggagagtataaaagtagaaacagaaatatctgtttagagactagtgtacagtctagatgtgagacaatagtgtctggagcgaaggtgactgtggtataggaagtgaggttactggattgaagttactgggtttttgaagttactgggttgaagacatatttagagaaggaagtcaggaagcagtagaattgatattgtaccacatgtgggtggaatggagaggagcaaagtctcagaagtgacccttaggtcttaagaaattggatggataattatgttatttactgagataaagaagattaggaaaatgggtatatttagggtgcggtaaagaggggcagaaatgaaaagtctggttttgaacaagttgggtttcaagtgactgttagattcctagatagaaatattgagcaggcattctgaattgaagtcagcagagggattagaagtaaaggcatagatttggaaaaagcatccagatggcatttaaacccatgctactggatgcaattaccccttcagtgattctctagatagagagatgagtgggcctatgatggtatcctgggatgctctgatagatgtatttacaggtcaaaagacacagagaactcagaaaaagagaataagaagaagcactcagtgatgaaagaataaaaccagaaactaataaagaaaaagcagatgaaagatttaatgtgaaaaaaatcatctaaacattagaattgctggattttgaattttgatggatactgtcaaatttacttcccaaagattccacattttacaatccagccaaaactctatgagacaggtctgtgcttttgtgatgttttgtgtgttttaaataagcatgaccttcacttttgtttttaaaaagtaacacctgcttgacaatatccctatctggaggtgtgtgtaaacctctgggccagggcagatcacatgccatatattttcatttatacctctttccctcatcactggtgttatataattgtggcatataaaaattaattgtcagcaaaatgtaaaatgttgagatttgagtatatgaaagaatttttttaataccgttgttaaaatttttattgttaatgtttaatataaataggaatttgccctatgtgttaggttattgacacgactacaattcattccaattccattctcaacaacagttgttatactgggcttccttcttgtaggatcttatattggtgatcttcttctagtaggtgttaaagcacaaatcctggatagttattaatataactagatttctcactataagacactcttttacttgagaaatttatttgaggttttctattcttacctaagtaaacatataacttaaagccttgccaagagcttgttttgcacttttcagtcactatcatttcctagtaattaggaaagtgtagagtttcagtaaaatcttgctttaaaacctgcctgcaatcacatcccttaaaataatggcaacccctcatggaaatattgactcagaaagttgcaggaagacacttcatttgggtatattgttatctgctgttacttcaatcattcctacattctttactcagaaatcgtcttaaatacatcatttcatttagtgctgatgatagcaccccaaaatatattttcactgtagaatggaaactattaatgttaatttcctctggttttcaacatttactgagcatttgaagctctttccattacatttaaaagtattatttttgatcgtttaattagcatcacgttttggttatttcctaataatccttttttgaataaacattgaagtgccagataaaattatatgatttttaaaaaaatagtatatcactggcattattaaaattaatgacattttctaattgtatccctcatctatcctccagatattataaactttcatgttcactaaaactttaatccatcatttaattcccttttactgtatgatcagcctctttcttttattctttttttttctttctttcttttttttcttgtgagaccgagtctcactctgtcgcccaggctggagagcaatggtgcgatctcggctcactgcaacctccgcctcctgggttcaagtgattctcctgcctcagcctcctgagtagctgggatgaaaggtgtgcaccaccatgcctggtgatcagtctctttttaatgttttctattttatctattcatgtgttcaagtctctataaaacaaaatactacaaatttcccttcattatgtactaactctctggttacctcctgttgtctctttatttgacatgttaaccttttgaaatatgatggcaaaactttcatcacaatgtaaacttactaatttttcaaattccaggaatatccatgtctgtccattgaaagcattctttttttaaccttcaagtgattgttttatctacttaatcaatcaattactgatactattgctgctttttagtgattacattttaacttacctaatgtggtgccagattaatagcctattctttccttcaaacagtgtaaccatcttgcaagactttatcccccaattttgttattcttgtccagtattttagttcaattatgtaacaccataaatttgtaatattattgttcatacacgatcaaagtttgttacccacacccccatggtctccattttctttgcttcccagtccttcttggatctcagatcttctgtctgggatcattttccttcttgaagcacattggttagttagtttatcagggagggatgctggtgattttgtttgtttgaaaatgtctctacttttcaaagagaatttcttcagtgtgtaactctagcttggcaattattttatttgagttataatggaattatgggtacacatttcttggctctccttgctgtcactgagaatactgattcagtctaattgttatattttgtagataatctgtctttcttccccattttggaaatctttattttctgtattgtactttttttatgctgtacgtaagtgtggatttttttttctcatcatatcatataaagtttaggatatattgtgcttcttcagagtgaggactcacatttcatcaaaaaatgttttttttttagacaagtcacttgggaaccccttttaccccaacgtgacaaaattcaacacataacaaaccctggacattacatattttcttccaaccccatgttccagctgtggctgtagttatcctctacaaatctagcttagagatgaggaaggttaaaaggagaaagacctgaccatgataagtgttatctgtggggtaattcaaattaaattaacagaataactcaaagttcaaaaagttaaataacttttcccaaattgctcatgtaataatccttaaactatggtttcaaacaattgtctgactcaagttttgaactttccacatcatcatgtagacggtgcatcaggactctcatctttgtacatgggggattttttttgtatgttataataattttccaggaaattggaattatagaacctattgattttatggtgtactaaaggtatattcaaccttacttgtatttagcatcgtgctttgccggtaagtctaaatacactacctgtgtcctaatgtttgactatgtatttggacttggaaccaagcatgcatcattcagccatttgaacacatagtaaaaacttaatacatttgaagaggcaagagtaacatatatccatttgaacacatagatttaaggaataatacgtaagtcctgtatttccctaatgggtatcggtgtacagattggagtctcattgtttctcactagaaccttcacagatatatgcatgagatgtatatattttaagaagaattttacattgttcaagaaacacatatcttacattcaaggtaatataaatccatctgtagagcaatggattaaatattcatggagcaagggttatgaaagaaaaccactgtaaaaaaatacctgaagcataatgaagatttaatttatcccttaataccatcagctataacatgatagacacaaatctgaatacagctaaatttataagactggtaaacatatgccttgttttcaataatttaacaggtgcttactaaatgaagtgataattaataattgagtaattgaataattgaattcaaagcatttatctataatctcacaaaacgtagaataacattatgtagagttcatctgtaattttagaacagtcataactctcacttaatatgttgtaaaaaagttatttactccattttattaatcatcttatgatgagatgcttaaaaacaactttgagtaactactattgatattcaatacaggcagcatagtacacattcacacacacacattttccttttaaagtttggttatgatatattaccctcctagcatagtaagtcaggaaaaagctgcaactgtcttaaagctgaaagttaaaaggcttttaaaagctctgagtttaaattgttcagttattcagtattagcaaaataaaaagctcccagtaaaaataatacattttcatttatttaacaattaaatgtatttttgggtactatttaagcctattcataaaaataaaatgcaatatttgttaaacaggaaggataaatattttccacctataatttaacacaaataggaatatcaattggtactagattataagcaaaatgttctctattgatgtaatgatcacatgataatttctgacataattacttttaaaacagcaataatttgctagaagatgaacaggataatatcttactttaaatgagacatctgtaatcactctttccctttggaagtaggaagaaatttacaacagagtctgctagtaggtcattttattacccaagcccttagattttatatttttacatgaaaacatggctcacttttaaagacagccatcactctatgaatcctcctatcatggcaagactgatttgatgttcatcacaatgcattttaagaggcaagagtgacatatatccttattaatctcataatgataaaggattgatttcaacctatatcccagactgttacatgaaataggctctgccaaaatatcaggttcaaaagatgctcaatttaaggagatcagttttatgctccatcctcaaaggacagagttatatgaggtgtaagtacgtcacatgaggcattaagagaaattttcttccccataaactaaacactgtttgtactgtagtaagaacttaatacatatcattccgtgtgtggaagaaatgactcacactccctccccctccccccaacaataatgcagctttctcttttttgtaggaattatctaaaatgatcacatcactaagcagatcagtgagaggagtgagtttgagtagaaaataaaaaagcattcgtggcttaaaaacttccccctactgcttggaaatggcacaccacagtagaagttaagaacacagcaagcagagattaactgaacaacacagaaaatcaaaaacatttttttaatggggaaggggattaacaatgccagggctaatcttggaaactggtctctgaagtaagagttattaagagaaaaatatgttatgttctagaattcgattttcaacttaattgaaaacctctttttacttcagtagttttcatagaaggtggagagacagtttctaaatattgttgctgaataactcgatgtatcagttaaattagttaaagggaagcccctgttttgcatgtggctatccactcaaccactccaaaacaattcgtcaatcacctgttcatggtttgggcaaagtaaccatctgcctttcaattctgaagagacattctgctagaatcatggaattatttataataaaaacttactcggttgaattctcctgttgacataataataaaaatatataagatgatattttaaattgtctaggataatttaatgatgaggcgctgccactgaatgatgaggttcagtatttcttgacagctgtgtgtctggatattattttataaccttacaactgctcaggtatacagtgaagatcaagcaaactaatacctgcttggcatggttgcatttttcctgttttggtcatgtatagtgtaatttaaaactgtaaacacattttcagaatctactctatttgaatttttccccctcagtatgtaaggtaattttctagctgagcagtttgtgaatgagcttcaaaatactcgatgagaaattgagaatcatgaaatggtcgcagaatcagccagaagtatgtcagttccctctccagagagtacagagaaatgtgtataagagatatcaggtactctgaagtacagaggttctaaatacactgtggtcccgatgtagcaaaaaacaaataatgatgttaaaaacataagaaaatacttataaaatgctgaaggtcttttttgaaaaatgatttgccattatgtcctatatcacacatatttcctccttgttaaatgtatcaccaaatgatcaataaccttaaaataatttggaaatgcatattatataacccacagcagatctggtaatctatctctttcatttgtcccagattagttttgtggtaggaaactcaaatggctgtaccatgagaggcaggccattaaaacatttaaatggttttacagtggtatttttcaaatgaagaatgaagttcataaatttcagcgtcagtggagaaatgagtgaggggggtcggcatctctggaagctctttgaaaataaagcattcattattttgttgtaaaaatcagatatctataaagccatttataaaataactagttggacatctagcacacctacttattttcatttgaaaatttagccatgctaagatgcatttgaggttaaaacatttctttccttcctcttttcacgtaacctctcacggtctgaggaccagagacttgtttagaacttaccgaagtttcccaaagcaaaaccacgcacaagctcctaattcagctgccagatctgtgtgcagcttcgttcagcttctcactacgctaggcatcactttattaatcatgtatgaatttctgtgcatgcaccctgaagcgatcacacacacgcggtgcaatcccaatcaaaaacggaagccttacctgatggcagaaaaggcagctgcaggagcagcagcaccgacggccgcagcagggtgccaacagctcagccttgcgcggaaggtgagacccttctcttctgtttcccctttccaaatcactgtgccaacacactgctttgcattttgtccgttttcattcaaagaaggttctccaggccgggcagccagtagacaccactttcttcctggaagaggctgcctctcttctcagaaaagcctggacccctctctgtggctccctccacatttacccttcagatcaataatgctctcggagcggctggagctcaactgcagcggcgagcggcgagccaatgggggcccaggattccctcctgtcatctccccgccctcaaaacaaaacacagcgtgcctttgacacatcattgagtagtgaaaagtaattgaatcctatatttgaaatgtattttgtttgttctttttcccccctagcgttcattgtagaatgctttgaatgaatccgaggactccttagctctcagaagactcattaaacgagcctagcagcgggtgaagattaggcg

SEQ ID NO: 978 - DNA, 13477 bp, Homo sapiens
ttgttttgcaaatgcattagaaagaatgcttttatcagaaataaaatgactgttcaggaaaagaagaaaatgtctttatgccattatccaggatggtaactcttctcctgtgcatacctgaaaatgtcagaggtgcatttttacattggcattttaatagattgtatgacaaattgtatgttacagggcaattcttggaaaagtcaaacaaaccacataatttatagtttccatttttactgaatttgtaattccaagaaaattgttggctaggaggagattggaaaactgaattcacatcagatcctaatgagaagaaatcaattttaactaagtgggtgaataggagttgtattatttaattagcatataatttgaaagagttcattagcttcacaacaggcacaatcaacacttaggtaaagcacttaattgttgcaaaactttagaatactggtcttgcatgttcttgacctctatggctggtttattaaaacctgaaaatcttccttgattcttctaaagatttctcatccatgggaggcttccttgggctgccaggctgtagaaacttcttcactgtgggcaggttactgattctggttttcagggcctgtaatccacaaagcacagcctcactaaaacaacaagtcaagggctgacacccccattaacatgacccagggaatctgagtccctcctgccaaagaccaagtgagtcgcttccacttgggtgaaggcagaaacagacacccagtgagaaaggaagataagaggaagaacatgtagctcactttattttccccaaagatgtcttgaaattttaatcagttcagtcatccctatctttcttcttacatattaatcctatagattagtgactcttgtataagacaagaaaaactaatgtgcttgtttgatatcagcacagatcagtctctaagcagaagtgaaaatatgggaaaatgagttggaaaggaaaatgttatagaaaatagtaaagacaaaccatgggaccaccttttctcagtgagagatacattgtcgggggcagagtgctggagagctgggcagagaggaacaaaatgtctgacagcaggagccggagcccagggaggaaaccagatggaaagggctctgctcagactgactcaatgtgggcacatatgggataaaggacatcacagagaactcaggaacagaaaccacactgaaatagagggatggggagacatgctgggccctgggtcctttccataataaaaggcaaaatactctttgcggggtagcatgcactacaaatttcctttccataacaaaagtgttttcattcctcaaaattggagcctggaagctcattttggagaccttggggcaccaaaggcctggagaaggctggggtcaaaacatgctcagtcccagggcccagatacaagatcccaagatgggagatgtgggtctgcctctctgaagactgtgaaatgggtcaccttcagcagagggaagctggaaataaggctagagtcaagctcttccacgtagtagagaagttccaccaggtgaatgtcagcccggctcagcttgttgccaacaaggtagtcttgtccgtggctctttaagacctggagaatgggaggaatcagatcaggaacacatgcccacccaggctgggacccctgcttctttcagagcctctccaccctgactttccccacctctgttgccttactgcatggatgcagaaatcccgagctttctccacattatctgaatgaatgagatagtaagaagtgtaactgtactcactcctcagttggagctcagcctcccattttctcttctcatccacatcactgtggcgtctacactacccacccagcttgcttcttccacatgggccaagggcttagcacctgccgccgcatgttctgtctgccccaggccctgcagtgtggagccctcacattcaggatgtggctctacattctgctgtctcccgctccaatctcccttgggcagtgactccaccatcgtgacaacactcttcccccagaaggagactatttcagagtcctcatttctccttgtctgttctcctcattccctgctctatctccctgagatctgtaggaaacctgggtgaacctgaattcatcatcttttttacagcatcgactctggttcctaaatggcactatgttataatctgcaagctgaagcgtttaggagtgaactgctctgatgtctgcaacttactataaaatgcattttacagaatcttcctctgcatcccacagtcactctccttttaaaaaatactgatccctgaaacactgcaatattctctggttgggcaattggtctcctgtcttcctgcatatggtgccagaatgttttctgatggatcactttcatcatgcccctgttcaaagtccatggggttccatagactgaacagcaactctagtgtggtccagagccttccacagcccacattctacttatgaacacaaaattctgttgaacagataattccatattggggttcagtaaattaaaattttactggaagattatagcttgggtataagtgatacaattgtttctccaagtctattttcataaaatgccttgagagtcagagtgctgcattggtgtccaggaagtatcactgaaagtgaagatcagtgccccaggaatgcccagccactatttttctactggcttctaaactcagttccccaaaacactgaacagcttcacttactttttcaaaggcagggaagtagcgattttttgttttctcttggatcaaggcaagcttggcatcttgttcctcaggttgactaaagggcagaagaaggatcatttcacccaaatctgctataccttctatatacatatcaatcctgaaagacaaaaacaaccaaatggtcaaatatcttttgccttagattttataggtttataaaaacctaagagagtagagtatcaggtgatggcaaaataattcacctccaatgagtgccttttatagtctagtcattatgctctgagttttacaggtatatagtcattatgctctgagttttacaggtatattaacatttatttcttaaaacagcctatcaaggtagatagctctctaaattttgttacacgcatgacctaatacaggaagaagatcatcggtggtcacagtcatgagagaaattggtggaatcactgccagtacccactgatgctgtgccaggatttatcatctccattgtggtttgttctgtgcatgaacttagtgtgagtcaaatggccaaagacctgcttcctaagtaatcctaagagagtccctggcacagccatctcagccatattccttgtcctctctcatcattttacagctcccagggctgcttctatgccccatatttgcagttcttccaattacacccatgaaaaacgtttccacagccctctccatgtgctgttgcccaactctagccatgtgtgcctttcttaagagccaaccccttccctggtgaaattctctgtacagttacaaccgtgcaaacttttcttcttttgtgtcaaactggagtttcacaatactttttaaaacaagagctttactgatgcatattcacatactataattgccacctcttatgttatactattgagtggttttcagtgcattcacagaattctgtaaaaataatcacagtctaattgcagaattatttttgtcaccttgataaggacatctgtaccattagcggtattcttcatttttctccaagccccactcctttagccccaggcaatcactaatctactttctacctctatggatttgaatatctggacatttcatattaaaataatcctataatatgtggccttctgtgtctcgtgtattttatgtaacatgtctttatggtttaaccatcttgtagcatgcattcgtacttcattccttttcatgaccaaatatctttccattgcatggctaaggcgcatttttctcctccatttattgattgatggatatttgggttgtttccactttttgaattctatgaatattgttatttgcattattcacttatgtaaaatatatagtgtggatgtattttcgattgtttggggatatacttgttagaggaactgctgggtcatcggtaataccatattaaagtttttgaggagctgccagcagtttcattcaggatttatttggaatcatgcagtctcatcacaacaacaaggagaccccttggctttgctggtattgaatcaatctggctgtttcggccttctatccatgtgtcaaggtaactccagtatccttggtgccagcctctactagccctgctcaagtattccagttgatataattggttggtaatttaggttcctgttcatcatacttggaattactgggaccttagacttggtttctttgcagctttccctccccagtccttcatctacagactctcacatattctatgcctgtcctaagccattggccggggtccagcctctgaagtcctgagcacctggaaacatgattccccatcctcctcagttcattgggtttatgagagtttggaaacctttgtcagggtgctgtgtccatggactgcatcctcttctagaatcaccctcgcctgaaccctccccatgttcactgttccctcatctccatgggactctgcaatactggacctcagcgtgcatgcccaaggcccagcctgctgctggtcttgataccctgccatggtcccacccactcaaggaaggacctaaatcactctatgttctctgtggatggaagaacagaaaatataccgtacagggctttctcctttatgtctttcccatagaggttgtatttgctggcaatgtagttgagaatggctctggtctgcaccagcttcatcccatcaatctcaaccattggcacttgctggaacatcaaatatccatctttaagaggaagaaaaaaaaggagagtgaagtgtctatgaaacccaccatttcaggatgaaaaaaaatggttgttgaaatgactaaatttgtaaaacgaaaaagaaattactgcctggtaagagttcacttgaaacaactttttttttttttttttgaggcagagtatcattctgttgtccaggctggagtggagtggtgtgatcttggctcactgtaacctctgcctcccaggttcaagcgattctactatctcagcctctctatagctgagattacaggcatgcaccactgcacatggctaatttttgtatttttagaagagatggtgtctcaccatgttggccaaactggtctcaaattcctgaactgaagtcatccacctgcctcagcctcccaaattgggattacaggtgtaagccactgcacccagtccaaacaatatgtttataaagcttcctgtagttcttctttttcttaagaagtttccttttagtttttatccatttatttcatatatgtttttgttgcccctccagatacatagtgggactcttgaattttttgtgttgatttatcttcatggatattttaggaagaggttgggacaagttacaatagtactggcaacaagatgtcatttaaaacaggatgttcccagagtaagtctcatggtgtttatgatatttaaggcaggttctgagaggtttttatataagggtccctttctgtgctcttcaaagtctgcgatattgctacagtgttacccagtcccactccccccatgaaagaaaaaactcaagacagtggccacatctattcctcctccttttgtctaatgcatgttcttgcatgtgcttggatggagagggctgtatgggatcctgtgctgatgaccactgctcactcacagtaccccaagcatgaaaacaaagaaagggctttctcaggggtgggagattgttcctctagcaaatactctgagaggtctggtcctttaagcctggagagagttgccagacttgctcaaggagccacatcccttccattttaaccactttctccctctgcaccatgtacaaataccatgccccacacccatagacattgccggctgcgcaaacctccccgtgtaccttctactagataccctcattagagaaacttagaggttgatcttaccatttcttaacttgtccaaatcttctgcagattttataaatttctcttcaaactggaagcagaaacagtaaatatgttcttgttagttcattctattatagacctgtgaaattgaatggcctctatctggtgcatcatttggagaatataagatttctgagtttggcagggtacacagagggggctagtcatggccatttggaaatttagacctaattcattgagaaaagtgcatgggtcacagcacatagctgctcaatcttctagttcacttcacctccaccttgatatgaatgtctatgattaggtcatgttttgagagggacatcactggagaaaaggcactgagcagttcttctagttatggtgttgtcatatcttaggaaagcctgtgtctccaagtgagatcagaccacaaccttgtgtgtccccagcatgaggcatgacatgggctaatggccatcaaatattctgccaccaaggagcctctgctgtaatttgtatcgccccacttctcaggaaccctgctaagggtgacataggtcgccactgttgcacagctttcacacttgcaactgtaattttctcttctgaagtacgtgagacacaatagggtaaaattctcaatttaataaaggaattagggtcccacactagcattatttttaaggaaaacctctggtttctgatgtggttttgtggcattggggaatgcttgtgtgttctagaagcctcctcccctcattttaaccacgtgtttatttctctgcatcctcatagacacgtaggctgccccagggcagggactgtgtctgtcttgttcactatctccatgaccgagtacagaacctggaattaataagtgctcaagtaaataattgctgtgaatgtagtcaatctttaataggtagtttgttacaatccactcccttccatctctcatttgtagtttgcattttacctctaattacaatcattttttaatattatgcatttttatttttttattgtggaaattatgaacatgaataaatataaacagaaaagcataatgattctccttatacttctcacctagaatcaataattatcaatcaaaaccaatatggtttcatctatatgcccacctacttctcctcttgtaataattccaaggaaatcccagatccatatgattaatccttaaatacttcaatgtgttttcctaaaacacattaactattctaaagacagccatagtacattatcacacatgaaatattaacaataattatttcatgtcctcaaatattcaatcgatatttgtgtttctaattgttgtataaatgccataaattattttttacagtttgtttaaattctaatccacttaagttctgcactttgtgattagtgtcttaaatgtattttaatatgtatgcttttagaggagaagaaattttaagaattaataggtcaaatctgttcatctttttcttaattacagtccctttttatttaaggcacaatgcttcagttagtaatcatctcatagtttctgtgggaaaagtatgtgataacgcaatcgtaaatctgacttaagatgacctaactcagaacctacctctactccagctgcagccaggagccaccggatggactccattctgccccgtatattggagtagtggagcttgggcttctctgccatggtagcagtctcctggaggtttctctaagcctgagtgaatgaatgaatgaatgaatgaataattgaaacgatagaatcaaaaatgtactttaggatgtatggttgaaaaccacaaacaatgctgaagaagaacctgccttcttcatgacggtgttggaggagttcccggaatgttttcttggctcaaattattacccagcagtggccaccctcagattccagcaaaccagtctcaagttttcactgtttaactctgaattttcttggcagcctaagaggtgagagtatgtggtaataatacatgtataggagttaatgggaagaggaagaattcaagaactaatatttactgaaaacttcctagtgatccttcctcaatgctagtccctttcaatattttatatctttaaccctccttatagtcccatgaaatgattatctccattttttcgttaatgaaatggaacatcagagaaatacaatgttcacagtcacactccggttggtgatggacatgaatatctacaccaaggactaaaatgaaatcatgcctggaagccagctgggtgaaggccctgggaacccatgaactggccatgaaaccagaggatgtcactgacagggaggaccggctgggagctaaatcactcttcagctctttggctgtgagactgcatttgatcaaaaccagaaattaggcctcagacttgtttaactgtagctagaagatccaaattctttcaagagacagagattgtttatcccttgcttcttttggaattctgtattctaactctatggggtgcattttgttttataagctggaagaagagatgttgctgcattaattttgcaatatggaaggagctagcatttgttcaacatcagtcacacactgatcattcttctaaacttctctttgttttatcctacaaaaattacctaaggttaatgtggttgttattctcattttacatttgaggatactgaggtttttaaagtaacttgctcagagtaaatgatagatctgggatccagggtcactgctattaaaaaccaaatactgagtcttattttctatgttagtgtttctcaaatatgcatggtaatctctcagcagattgtgaaatcccattactttaaaaaataaatagaaaagaaaagaatagaaaatatcagtgagcatgacatgttgaaaggtaagtaatgtttcatgagttgttagtttcagttatttgtatactgtgtgtatggatctttgcatgtgtgcatgctcacttggtcattgtaaatggttagagactgggcttatcagtgaaatttgatagcccttgctctatgccaggctgtttgggtggtggaatgtagcagagtatcagagaatgaaaaccagtggctgcagagacagatgcaactaattgtatcatgaatgtgaatggaaagacacaggactcattgaaagaaggagttccagtgccaggacttaggaatagttgcgttttatcaccaaacccccagctctgttattaaacattaagattcttcttgcaaagttttgtggttgttgagtgtggaacaaaaatatacttgcctttaacaactaatgtatttatttgttttttttttttttttttttttttttttttttttttttgagacagagttttgctgtttttgcccaggctgcagtgcaatggcgcgatcttggctcactacaacctcagcttcccaggttcaagtgattctcctgcctcagcatcctgagtagctgggattacaggcacatgccagcacacctggataattttgcatttttagtgaagacagggtttcagcatgttggacagtctggtctcgaaagtctgaccccaggtgatccactcacttcagcctcccaaagtgctgggattacaggcatgagccactgcacccaacctcaactaatgtatttctaaaaaagtatgcatgattaaaattaggcatcaaaatcttttaaatgtctacattttaaaatatgggagtcaatagtttaacctttggaaagtaaagaattctttgaaatcatactgaatcaactcacctgttttgtaattagatattttgacattgtactttctatgataactccaggagtaaattaaagtaacttgggaaatggaaatagcataattcgacagaatgaaagggagagtgaagttcacatgaaagcgtagggtgtgcttgtttaattgttatgtactagagttcacagtgtcataattccaatccccaaaataaactctcttagccattgatcgaggatcatgtttcaaaaggaagtgaaattttatcttacataatattttatcacaacactccagctgataattaacatatcacttcctcaatgtgaggtttccaagggtcaggctaagactgagacataagttaccattgagctttgttgggtcaacagaaaatgagaaccagagagctcaaggatttgccatgggtcatacacacatgctcctcattcatagtcaatatctagggagtgtgtttaccttctgcaacaaccctgggaaatggctcctattatcctaattaaagatgggtacactgaatttcagagagctaaagcacctgtctcatgctgcacacgtggtgagtgttgggtcagcctgaacttctgattgcaggtccggagcttttccactccacctcataacctggctctcagctcctgtctgagaagttgttttgtattttcctattcaatgtatattagccaaataaatgttggaaggagagggcgagaggggaacatctaattcctgagttcctcctgttagcaacttttcaggggcttgcttggaagaaaaaactaataaaagtgtgcctttctctactttgacaacctaaaaaccagagtgagttgaggactagtgtaattactttacatcaataattaatttacatcaattaaaaaatgggcttgttttgaaaggactataaggtctcatatttccaggagtaaattaaaggagttacgtctctgaggttgtcccagtgacactgtttcttatcagagagaagggagaatgagataaaccatgactccttccattatgagattcataaatgcagtaggttgtttaatctctgagcctcaattttctcttcttagattagagatagttatttctacttttgagggttgttgagaaagttaaatgagataatgtagaaaaaaatcatagtaggaacacagggtgtttgctcttgtcccagtgcttggaagatgggtgaggctctggacacattgagtagcccatggatcttctttctttgatctatctatccaccaattattttaccaaccaacaatctatgtacatgtatctgtttataatctctgtctacccatccatgtatgtattattttatctatcaatcgttctatgtatctatctctctgtaatctgtctcttcatcatctattatctatcttgtatccatttctctggttctctatattttgtccgtagaactctagtaggaataagattttatatgaatccagacttatatcaaatctgtcatatgatggctctctgtttctctctctctttgctttttagctcctgtacagaggtcaatgatattcactaatcagcccacctggattaacaggaagttttcagtgaatgtccaagcagtggggcacatcggtaacacagccttgcttagccccatgaggtcatgtagtcccatggttctcaaccagggggattttgttcctctgctccagaggacattgagcaaggtctagagacattttgggttgctatatctgcagagagggaggggggctacaaatcagataggtagagggcagggatgtgtggggaaaagaaagagagatcagactgttactatgtctatgtagaaagaagtagacataagagactccattttgttctgtactaagagaaattcttctgccttgagatgctgttaatctgtaaccctacccccagccctgtgctcacagaaacatgtactgtgtggactcaaggtttaatggatttagggctatggaggatgtgctttgtaaacaaatgcctgaaggcagtatgcttgttaaaagtcatcactattcagtaatgtcaagtacccagggacacaaaacactgcggaaggccgcagggacctctgcctaggaaagccaggtattgtccaaggtttctccccatgtgatagtctgaaatatggcctcgtgggaagggaaagacctgatagtcccccagcccgacacccataaacggtctgtgctgaggaggattagtaaaagaggaaggcctctttgcagttgagataagaggaaggcatctgtctcccgcttatccctgggcaatggaatgtcttggtgtaaaacccaattgtatgttccatctactgacataggagaaaactgccttaaggctggaggtgagacatgctggcggcaatactgctctttaatgcaccagatatgtttatgtatgtgcacatcaaaacacagcacattttctaaccttgtttatgacacagagacgtgagtttgttcacgttttcctgctgaccctctccccactattatcctattgtcctgccacatccccctctctgagatggtagagataatgatcaataaatactgagggaactcagagactggcgccagcgcaggtcctccatatgctgagccccggtcccctggacccacttttctttctctatactttgtctctgtgtctctttcttttctcagtctctcatcccacccaacaagaaacacccacaggtgtggaggggcaggccaccccttcagggatgcttagaaatatcctagagtgggcaggacagatctccgttcaaagaattacacagttcgcagcaacagtcagagcctctttcttagctattctctatattggccatgagttggtagtactccagagacagaatatgacttgtcgtcgagctaattagtggcagaggctcaactagaatctagtcctcctaacattcaaactaattttttctaattataataaaccttagttttgaattttcacagccaatatagaattacagtgtcacaatttacaattgtgtgttgactatatatataaagaaatttttgcatacattgccacttcttccagcactgattattctcagattgtttaaaatgctaccatttcttttttctcctcatgtcattgtttcccatacctttaaatgctgaggccctggttttctaaactcttcatttttacatttctgtaaagatgtatccaacagaaaagaaataaacagttcttgaactgtcacccaaacacaccaagatggcatgatatgagtaaaaacaaactttttcttgtgctaaggacacatattagtgtatttttctaggaggctagagaggagggtgtgaggcaatgtagagagatttataagatcagtacttactttgttaaatgctgtcacctttgtggctggacaaccgaattccaggtcctaatgtatttataagctctttgttcctctcaatagttccctcccactgaaagaagggtcaagttagggaaa
